United States Patent 10,975,383 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 2

SEQ ID NO: 937 - DNA, 2078 bp, Olea europaea
cacaacctcaccccactctccatcggcaccagtactgacctatttctacctcatttctcgacattagtgattcttcagtttcattatctttccgcaaatttgtttctagtttccggtttcatcattagatcgaaacatgtatcgttttgcggcaaatcttgcctctaaagccagggttgcaagaaatagcagtcagcagattggtagtcggttgggttggagcagaaactatgcagcaaaagacattagatttggagtggaggccagagccttgatgctcaaaggtgttgaagagcttgctgaggcagttaaagttaccatgggcccaaaggggcgtcatgtagtgattgagcaaagttggggtgcccctaaagtgacaaaggatggtgtcacggtggcaaagagcattgagttcaaggacaaagtgaagaacattggtgcgagccttgtaaagcaggttgcgaatgccaccaatgacgttgctggcgatggtactacttgtgctactgtccttacccgtgcaatttttactgagggctgcaagtcggttgcagctggcatgaattcaatggatcttagacgaggtatttccatggctgttgatgctgtggttacaaacttaaagagcagagcacggatgataagtacatcagaggaaattgctcaggtcgggacaatctcggcaaatggagaaagagaaattggagagctgattgcgaaggccatggaaagagttggcaaagagggtgtcatcaccattcaagatggaaagacactgttcaatgaattggaagtagtcgagggaatgaagttggacagaggctatatctccccgtacttcatcacgaatcagaagaaccagaaatgtgagttggatgaccctctcattcttatacacgagaagaagatttcaaacttaaatgctgttgttaaagtactggagttagctttgaagaggcaaagacctctagttatagttgctgaagatgtggaaagcgaagcacttgcaactcttatccttaacaagctccgtgctggaataaaggtttgtgctataaaagctcctgggtttggtgaaaataggaaggctaatttgcaggatcttgctgctttaacaggaggccaggtcataacagaagagctaggattgaatctggaaaatgtagagttagatatgctcggctcttgtaaaaaggtcacaatatctaaggacgacactgttattcttgatggagctggtgagaagagagccatagaggaaagatgcgaacagattaggtcagcaattgaattgagtacttccgactacgacaaggagaagttgcaagaacgactcgctaagctatctggtggtgtagctgtattaaagattggaggagctagtgaagcagaagtcagtgagaagaaagacagagttacagatgcactaaatgccacaaaggcagccgttgaagagggaattgtaccaggtggtggcgttgctcttttgtatgcgtcaaaagaactcgataaattgccaacagccaactttgaccagaagattggtgtacaaattatccaaaatgcattgaagacgccagtacatacaattgccgcaaatgcaggagtggagggtgctgtcattgttggcaagttgttggaacaggataacccagatcttggctatgatgctgctaaaggcgaatatgttgacatggtcaaggcaggaattattgatccattgaaagtcatcagaactgcactgactgatgctgccagcgtgtcttctttaatgacgacaacagaagcgattgtggttgaacaacctaaggacgagaaggccgctcctgaaatgggcggtggcatgggtggaatggactactaaaacgtttagaaaaccaaataaaaaatcaagttattacgattttttgattagtccgtagtttgtaaacataataaggaaccaacaagaagcatcggattaggattcttgatttggaattgtttgtggtggaattcaataggactcgattttcttgtttttgatgtcgcacattgatgtctttttatgtgggaaaatccttttgtgttgctattca

SEQ ID NO: 938 - DNA, 2068 bp, Chrysanthemum coronarium
acacacacacttaaaaaacaaacacactaaatcaccatttttattaatcaatcatgtatcgctttgcagcaaatcttgcctctaaatcaagaattgcaacaaagaccacccgacagattggaagcaggttgaatttaagcagaaactatgctgcaaaagatatcagatttggagttgatgcaagggcgttaatgcttagaggcgttgaagagcttgctgatgctgttaaagttactatgggtccaaaggggcgtaatgtggtgattgaacaaagttacggagcgccaaaagtaactaaagacggtgtaactgttgcaaaagccatcgagtttaatgataaggtgaagaatgttggcgctagtcttgtgaaacaggttgctaatgctacaaatgacgtggctggtgacggtacaacttgtgcaacagtccttacacgagcgatattttcagagggttgcaagtcggttgcagctggtatgaatgcaatggacctcaggcgtggtattacgatggccgttgattcggttgtaaccaacttgaaaagcagagctcgtatgataagcacatctgaggaaatcacacaggtgggtacaatttccgcaaatggagaacgtgaaatcggtgaactaatagccaaggctatggaaagagttggaaaagatggtgtcattactattcaagacggaaagacgttatataatgaactagaagttgtcgagggaatgaagttggacaggggatatatatctccacattttatcacgaacaccaagaaccagaaatgtgaactagatgaccctcttgttctaatctacgagaagaagatttcaaacattacttctgtgatcaaagtgttagagctggcactgaagaaacaaaggcctctcttaatcattgccgaagatgtggaaagtgaagctttggctaccttaattcttaacaagctccgtgccggtgttaaggtatgtgcgataaaagctcccggttttggtgagaacaggaaggctaacctgcaagatcttgccactcttactggaggccaggttataacagaagaacttggtatgaaccttgacaacgtggagttggatatgctgggttcgtgtaaaaaggttactgtatcgaaagatgacacagttgtgcttgatggagctggtgataagaagtcgatagaagaacggtgtgaacagattaggtcaggaatcgattccagcacatctgattatgatagagagaagttccaagagaggttagctaagctctcgggtggcgttgctgtacttaagattggaggagccagtgacactgaagtaggtgaaaagaaagacagagttaccgatgctctaaatgccacaaaggctgctgttgaggaaggaattgtaccaggtggcggtgttgctcttctgtatgcatctaaagagttggacaaattgcaaacagccaacttcgatcagaaaatcggggttcagattattcagaatgcactaaagatgccagttcatacaatagcgtctaacgctggagtggaaggttcagttgtggttggtaagctattagagcaagatgacccagatcttggatatgatgcagccaaaggtgaatatgtgaacatggtgaaaaacggtatcattgacccggtgaaagtgataaggacagccttggtcgatgcagcaagtgtgtcttctttgatgacaactactgaagcaatcgtgacggaacttccaaaaccagctagtgaagcagctccaggaatgggcggcatgggaggaatgggtggaatgggcggaatgggtggcatggacttctgatcagccccgtgatacatacattttactgacagaataaacacatagagcgtggctcagtatgtgcgacgcttggtagtaaaacaaaggcctaagtgtgtttacattttgagaactagtacattattaggatccggaactttatttaagcgcaagtttttgaacagtcttgatcattattttgataccatttgaatatcatctgatttacgctatgttcgagtaagaaaggtgaaatattatcgctcgatttgagatcctgt

SEQ ID NO: 939 - DNA, 2100 bp, Gossypium hirsutum
tttgctgtcaacattttactcaagattttcctctttttctttcctcccaaactaactatgtatcgttttgcttcaagccttgcttctaaagctagggctgctaggaacactacatatcagattggtagtaggctgagttggaataggaactatgctgcaaaagatattaaatttggggtggaagctcgagcattgatgcttaaaggtgttgaagagctcgctgatgctgttagagtaaccatgggtcctaaggggcggaatgtggttattgaacaaagctacggtgctccaaaagtgactaaagatggtgtaactgttgcaaagagtattgaattcaaagacaaagtgaagaacgttggtgcgagtcttgtgaaacaagttgcaaatgccaccaatgatgtagctggtgatggaactacctgtgcaacggtgctgacacgagcaatttttaccgaaggatgcaagtctgttgctgcaggaatgaatgcaatggacctaaggcgtggcataacaatggcagttgatgctgttgtaacaaacttgaaaagccgggcaaggatgattagcacatctgaagagattgctcaggttggaacaatatcagctaatggagagagggaaattggtgagttgattgcaaaggccatggagaaggttggcaaagaaggggtgataacaattcaggatggtaaaacattatataatgagttggaagttgtcgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagcccccggttttggagaaaacaggaagtctagtctgcatgatcttgctgtcctcacaggaggagaggttataacagaagagcttggcatgaaccttgaaaaggtggatctggacatgcttggcacttgcaaaaaggttactgtctcaaaggatgatactgttattcttgatgggaatggtgacaagaaagccattgaagaaagatgcgaacagattaggtcagcaattgaattgagcacctctgattacgataaagagaagttgcaagagagattggcaaaactttctggtggtgtggctgttttgaagatcggaggagctagtgaagctgaagttggtgagaagaaggatagagttacagatgcactgaatgcaacaaaagcagctgtagaagagggtattgtgccaggtggtggtgtcgctctgttgtatgcattgaaagagttggacaagctacctacagctaactttgaccagaagattggtgttcaaataatccagaatgctctaaagacacctgtgcacacaattgcttcaaatgctggagtcgagggagctgttattgttggtaagctgttggagcaggataaccctgatcttggctatgatgcagccaaaggtgaatatgtcgatatggtaaaggctggtattattgatccattgaaagtaattagaaccgctttggtcgatgctgcaagcgtgtcgtcgttgatgacaactaccgaagctgttgtaatcgaacttccaaaggatgagaaggatgttccggcaatgcctggcggtatgggtggcatggattattaaggttattccccctaacaatacactgattttaagtgctttcatataatctatttccatttcctcaacatctgtgagaaaaaagaatatccgagtctcgatgtctaagttggaaggcttccatgtaatcataaattgagagctacttggtgatggttttggtgataaagggtcaacaggactctcttattgttgttgctagaaagaacgaagtagtttgtattagaccattttatcttgaaataaatgaaaaaatgaaaagaaaaaaaaattctttcactttcgactgtgattgatatgagtttttgcgaaaaaaaa

SEQ ID NO: 940 - DNA, 2234 bp, Cajanus cajan
gaattcgaaaaggaagaataactcaattgcaaatttcgtgggcaaaacgataagttaaagtagtttgttgggtttaacttgaaactctaaaaccctagtagccgcttcttctagacccttctcttttcatttcataaaccccacgcacactctcctttgcatttgcatttgcatttgcatttctttactgcattttcccaatcttctctgtctttcatatttacatcatgtatcgctttgcttctagtctcgcctccaaagcaaggatcgctaggagtagccgccaacaggttggaagtaggttgagttggagcaggaactatgcggctaaagacattaaatttggtgtggaggctcgggctctgatgcttaagggtgtcgaagatcttgctgatgctgtcaaagtaaccatgggtcccaagggtcgtaatgtggtgattgagcaaagctttggtgctcctaaagtaaccaaagatggtgtaactgttgcaaagagcattgaattcaaggataaagttaagaatgttggtgccagtcttgtgaagcaggttgctaatgctactaatgatgtggctggtgatggaaccacatgtgctacagtccttacacgtgcaatatttgctgaaggctgcaaatcagttgcggctggaatgaatgcaatggacctgaggcgtggtataagtatggctgttgatgctgtagtgacaaacttgaaaagcagagcaaggatgattagcacatctgaagaaatcgcacaggttgggacaatatctgctaatggagaaagggaaattggtgagttgattgcaaaagccatggagaaagttggcaaagagggagtaatcacaatttcagacggcaaaactttatataatgagttagaagttgttgaaggaatgaagcttgacaggggctacatatctccttatttcataacaaatgataagaaccagaaatgtgaacttgaggatcccctcattctaatacatgagaagaaaatctcaagtataaatgctgtagttaaagtcttagagttggctttgaagagacaaagaccattattgattgtagccgaggatgttgaaagtgatgcacttgcaactcttattctaaataagcttcgtgctggcattaaggtatgtgctatcaaagcccctggttttggtgaaaacaggaaagccggtcttcaagatcttgcagtactaacaggaggagctcttatcactgaagagcttggcttgaagcttgaaaaagtagatctggatatgctcggctcttgcaaaaaaataacaatttctaaggatgacactgtcattcttgacggagcaggtgacaagaaatcaattgaggaaagatgtgagcagattaggtcagcaattgaaaatagcacttcggattatgacaaggaaaagttacaggaaagattagccaagctttctggtggtgttgcagtgcttaagattggtggagccagtgaggctgaagttggtgagaagaaggatagagtgacagatgccttaaatgcaactaaggctgccgtggaggagggcatagtgccaggtggtggtgttgctcttctatatgcgtcaaaagagttggataaacttcaaactgctaactttgatcagaagattggtgtccagattatccaaaacgctttaaagacacctgtgctcacaattgcctcaaatgcgggagttgagggcgcagtagttgtcggaaaactattggaacaggataatcctgatctaggatatgatgctgccaaaggtgaatatgttgatatggttaaatctggaataatagaccccttaaaggtgattaggacagccttggttgatgcagccagtgtatcatctttgatgacaactactgaagctattgtgtctgaacttccaaaggatgataaagatactccagctatgggtggtggaatgggtggaatgggtggcatggattattaaccagcttctattgatttgattgcacctgaaaacaatgggataggtgctgaaccaacacttacagccttttttttttttttttttgttaaattagttgttgtgtgaaggcatcattgtaatcataatgagagatcaagatgtaggtaacaaaatgtgactgcaataattccaattataagatatttcgaaccatttttacttctcaaatcaaggcattgttctcgataagttgttggttgaatgatttccgacattaacccattgttttag

SEQ ID NO: 941 - DNA, 2298 bp, Sesamum indicum
cccgttcaataagccaaatcaaataccacttctgctccattttcctctgcaaagtatttctcgtgcacttattctccctgcagtccgtgcagcttcttcttcaattttgaagtatgtatcggtttgcaacaaatcttgccggaaaagccaggcttgcaagaaacagcagccaacaggttggtagtagatggggttggagcagaaactatgctgcaaaagacattagatttggagtggaggcaagggcattgatgcttaagggtgttgaagagcttgctgatgcagttaaagttactatgggtcctaaggggcgtaatgtagtgattgaacaaagttggggtgcccctaaagttacaaaggatggcgtgacagttgcaaagagcattgaatttaaggacaaagttaagaacattggtgcaagccttgtaaaacaggttgcaaatgctacaaatgatgttgctggtgatggtactacctgcgccactgtcctcactcgcgcgatatttatggaaggctgcaagtcagtggcggctggcatgaatgctatggatctcaggcgtggtattactatggctgttgatgctgtggtcacaaacttgaaaagcagagcgagaatgattagcacctcagaggagattgctcaggttggaactatttctgccaatggagagagagaaattggtgagctgattgcaaaggccatggaaaaagttgggaaggagggtgtgatcacaattcaagatggaaagacattgttcaatgaattggaagtagttgaggggatgaaacttgacagaggttacatttccccatacttcattacaaaccagaagaaccagaaatgtgaattggacgatcctctaattctaattcacgagaagaaaatctcaagcataaatgccgttgtcaaagttctggaactggctttgaagaggcaaagacctcttctgatagttgctgaagatgtggagagtgatgcacttgcaactcttatccttaacaagcttcgagctggaataaaggtctgtgctgtaaaagctcctggatttggtgaaaacaggaaatctagcttgcaggatcttgctgttttaacaggaggccaggtcataactgaggaacttggaatgaaccttgatgatgtggagttggatatgctgggatcatgcaagaaggtcaccatatctaaggatgactctgttatacttgatggagctggtgaaaagaaatccatagaagaaagatgtgagcagatcaggtcagcaattgaattgagcacttctgattatgataaggagaagttgcaagaaagacttgccaaactttctggtggtgtagctgtgcttaagattggaggagctagtgaagcggaagttggtgagaagaaggatagggtcacagatgctttaaatgccacgaaagcggcagttgaggaaggaatcgttcctggtggtggcgttgccctactctatgcatcaaaggaattggaaaagttgccaactgcaaactttgaccagaagattggtgttcaaattattcagaatgcattgaagacaccagtttatacaattgcatcgaatgctggagtagaaggtgccgttgttgttggcaagttgctggaatcagataatcctgatctcggatatgatgccgctaaaggtgaatacgttgatatggtcaaagctggaattattgatccgttgaaggttatcagaactgctcttgtagatgctgctagtgtttcgtcattgatgacaacaacagaagccattgtggttgaacagcctaaagacgagaagcctgcccctccaatgggtggcggcatgggtgaaatggattactgaccagtctcaagacattgaaccaatctagcacgcatgtcaaacattgtttaaacaacaaataagcttaggattgtcaccattttgacgagttcagttgcgggacgttgaggcatccattgtaatcataacaagagttgaaagaaaacatgttgatcatgtaggtttacactctgtaattggttgaaagacgggattggcattttggttaattaatgattgtctttccaggacggttcaagtccatttgattcagctgcaacttcaccttttcttgattgtactgatttgcaaatgctgaaaatcccactgctcctggaattgcatgttttaaacttccgctgcagtgcgtctatcagttactctttgcaactctctattaagagtacgtgaagtttccttatgcgggctggtggcactaagtctgcgttgagtgctagcttttgttcttatcttttgg

SEQ ID NO: 942 - DNA, 2164 bp, Glycine max
taacagtaaaccctaaaaccctagaagccgcttaaatttttctagaccctcctctttcttttcataaacccccaccccacgcacactatcttacttctctctcttttgcgtttgcattgcttcctgcattttctttaccttccatactcacatcatgtatcgctttgcttctaacctcgcttccaaagcaaggattgctaggagtagcagccaccagattggaagtaggctgagttcgagcagaaactatgcggctaaagacattagatttggtgtggaggctcgggcactgatgcttaagggtgttgaagagctagctgatgctgtcaaagtaaccatgggtcccaaggggcgtaatgttgtgattgagcaaagttttggtgcccctaaagtaaccaaagatggagtaactgttgcaaagagcattgaattcaaggataaagttaagaatgttggtgccagtcttgtaaagcaggttgcaaatgctactaatgatgtggctggtgatggaaccacgtgcgctacagtccttacacgagcaatatttactgaaggctgcaaatcagttgcggctggaatgaatgcaatggacctgaggcgtggtataagtatggctgtcgatgctgtggtgacaaacttgaaaagcagagcaaggatgattagcacatctgaagaaatagcacaggtagggacaatatctgctaacggagagagagaaattggtgagttgattgcaaaagctatggagaaagttggcaaagagggagtaatcacaatttcagatggcaaaaccttatataatgagttggaagttgttgaaggaatgaagctcgacaggggctacatatctccttatttcattacaaatgataagaaccagaaatgtgaacttgaagatcccctcattctaattcatgagaagaaaatctcgagtataaatgctatagttaaagtcttagagttggctttgaagagacaaagatctttattgattattgccgaggatgtggaaagtgatgcacttgcaactcttattctaaataagcttcgggctggaattaaggtatgtgctattaaagcccctggttttggcgaaaataggaaagccaatcttcaagatcttgcagttctcacaggaggagcacttattactgaagagcttggcttgaagcttgaaaaagtggatttggatatgcttggcacctgtaaaaaaataacagtttctaaggatgacactgtcattcttgacggagcaggtgacaagaaagcacttgaggaaagatgcgagcagattaggtctgcaattgaaaacagcacctcagattatgacaaggaaaagttacaggaaagattagccaagctttctggtggtgttgccgtgcttaagattggaggagccagtgaagctgaagttggtgagaagaaggatagagtgacagatgccttaaatgcaactaaggctgctgtagaggaaggcattgtatcaggtggtggtgttgctcttctatatgcgtcaaaagagttggataaacttcaaactgctaactttgatcagaagattggtgtccagattatccaaaatgctttaaagacacctgtgctcacaattgcatcaaatgcgggtgttgagggtgcagttgttgttggcaaactattggaacaggagaatcatgatctaggatatgatgcagccaaaggtgaatatgttgatatggttaaagctggaatcatagaccctttgaaggtgattaggacagccttggttgatgcagccagtgtatcatctttgatgacaacaactgaagctgttgtgtctgaacttccaaacgatgataaagatactccagctatggctggtggcatgggtggcatgggttattaaccagcttctattgatttggttgcacctgaaaacaaggattagtgctgaatccacacttactgtctttttttttttggggttaaattatttgttgtgtgaggcatcactgtaatcatagtgagagatcaagatgtaggtaaggaaatgtaactgcaataaataagatatttggagcaattttcacctcccaaatcaaggccattgttgttccctgaaaagttgtcagtttgaaggatattcttgatatatttctaacatagtatggtccgttcacatttagta

SEQ ID NO: 943 - DNA, 1979 bp, Vinca minor
ctagacccttctcttctcttctttaataacaacaaatcccatttctcatctcaccttctcaccccaagaaaattatctctccaatccagaatcttcaaaacccttctcactctccacaattaaactagatcatgtatcgttttgctgcaaatcttgctactaaggccagggttgctaagagcagcagccaacaggttggtagtagattgggatggaataggaattatgcggcgaaagacattaaatttggagtggaagctcgggctttgatgttgaagggtgtggaggatcttgctgaggctgttaaagtcaccatgggtccaaagggccgaaatgtggtgatcgaacaaagttggggtgctcctaaagtgacaaaagatggcgtgactgttgcaaaaagtattgaattcaaagacaaggttaagaatgtaggtgcaagcctagtaaaacaggtggctaatgcaactaatgacactgctggtgatggtactacttgcgcgacaatccttacacgagctatattcacagaaggttgcaagtcagttgctgctggtgtgaatgctatggacctaagacgtggaatcaacagtgctgtggattctgtagtaacacacttgaaaagcagagcacaaatgataagcacgtcagaagaaattgctcaggtcgggacaatttctgctaatggcgaaagagaaattggagagctgattgcgaaggccatggagaaagtaggaaaagagggagtcatcacaattcaagatgggaaaacattgtttaatgagctggaagttgtggagggaatgaagctggacaggggctacatatcgccgtatttcattacgaatcagaaaacacagaaatgtgagttggaaaatcccctcattgtaatccatgagaagaagatttcaagcattaatgcggtggtgaaggtgttagagttggctttaaagagacaaaggccccttctaattatttctgaagatgtagacagtgaagccctggctactctaattctcaacaagcttcgagcgggaatcaaggtttgtgccgttaaagctccgggatttggtgaaagcaggaaggctggtctgcatgatcttgccgctttgactggagcccaggtcataactgaagagcttgggctgaatctcgacaacttggagttggagatgttaggctcatgcaaaaaggtaacaatatccaaggatgacacagttcttcttgatggtgctggggagaagaaggccattgaggaaagatgtgaacagatccgatcttcgattgaattaagcacgtctgactatgacaaagagaagctgcaagaacgactagctaagctttctggtggtgtcgctgttttgaagattggaggggctagtgaagccgaagttggcgagaagaaagacagggtcactgacgctctgaatgcaacaaaggctgctgtagaagaaggaattgtcccaggtggtggcgttgctcttctgtatgcatcaaaagaattggaaaagctgtcaacagccaactttgatcaaaagattggcgtgcagattattcagaacgccctcaagatgccagtacataccattgccgccaatgctggtgtagagggtgctgttgttgttggcaaactgttggagcaggacaatcccgaacttggatatgacgctgcaaaaggtgaatatgttgatatggttaaagcaggaattatcgatccattgaaagttataagaacggctttggttgatgccgcaagtgtatcttccttgttgacgacaacagaagccgtcgtggttgaacttccaaaggaggagaaggcagatccagccatgggtggcggcggcatgggtgatatgggctattgatcatcatcctactactaaaaatgcttgacagagactactaatcttgtcattttattcataaaaaaggcacatcttttgtaatcatagtgagggtaattgtgtcatgatggttaggaa

SEQ ID NO: 944 - DNA, 2259 bp, Eucalyptus grandis
aaaatggacatcccaaaaaccctaaaccctagaagctcctcctccttctagagccttccgctctcttcaagtgccatagccccctcctgcgatccccgagtcgttcgccagctctgcctccctctctctctctctctctctgctctgcgactccatcactcctcccattttcctctcgtcttgcctcgtcccccttcttcttctgctaccatgtatcgcttcgcttcgagccttgcttccaaagccaggattgcgaggaacagtgctcaccagattggaagcagagcaagctgggctaggaattatgctgccaaagacatcaaatttggggtcgaggcgcgtgccttgatgcttaagggtgtggaagaccttgcagatgctgtgaaggtcactatgggcccgaagggtcgtaatgtggtgattgagcaaagctttggtgctcccaaggtgacaaaggatggtgttactgtggcaaagagcgttgagttcaaggacagaattaaaaacgttggtgctagtctcgtgaagcaggttgcaaatgcaaccaatgatgtcgctggagatggcaccacatgcgctacagtcctcacacgagcaatattcaccgagggatgcaagtcagttgcagctgggatgaatgcaatggacttgagacgtgggatcaccctggcagttgatgcagttgtaacaaatttaaaaagcagggcacggatgatcagcacatcagaggagattgcacaggttggaacaatatcatctaatggtgagcgggaaattggtgaattgatcgcaaaggccatggaaaaagttggcaaagagggtgttatcacaatctctgatggaaagacattatacaatgaactagaggttgttgagggcatgaagctggatagaggttacatttccccttatttcattaccaatcagaagaatcagaaatgtgagttagaagatcccctcatactcatccatgagaagaaaatttctagtataaatgcggttgtaaaagttttagagttggcactaaagagacaaagacccttactaattgttgctgaggatgttgaaagtgatgccttggcaactcttatcctaaataagcttcgcgctggtatcaaggtttgtgctattaaggcccctggttttggagagaacaggaaagctggtctacaggatctcgccagtcttactggtggtgaattaataactgaagagctggggatgaacctagagaaggtggatcttgagatgcttggatcttgcaagaaggtcacggtgtctaaagatgacacaattatccttgatggtgctggtgacaagaagtccatagaggagagatgtgaacagattaggtccgcaattgagttgagcacttcagactatgataaagagaaattgcaggagagattggctaaactatccggtggtgtggctgtcttgaagattgggggagctagtgaagcagaagtaggtgagaagaaggatagggttacagatgccttgaatgccactaaggcagctgtagaagagggtatagtaccaggtgggggtgttgctcttctttatgcatcgaaagagttggacaaattgcagactgccaactttgatcagaagattggtgtccagattattcagaatgcattgaagacacctgtgcataccattgcttccaatgccggcgttgagggagctgttgttgtagggaagctcttggagcaggataaccctgacctaggatatgatgcagcaaaaggtgactatgttgatatggtgaaatctggaattatcgatccactgaaagttatcaggactgctttggttgatgctgccagtgtatcgtccttgttgacgacgactgaagcagttgtggttgaactccctaaggacgataaggagggtgcatcaatgcctcctggcatgggcggcatggactattagacttcatagacttccgattgatggtgcatgcgaattgaactcaccaatctttataaggaaagggggaaagggttttggttgggaagatgggtttatgcccatcttgtatgagttgatttttttacgataaatgcgaatcctggtctgagagatcgaaatgtaggtaggaagagatcgattgtttcttgtgaggaagaaaattgtaattggatcttttacccccaaggattttcatcttctctgcctaattttggtttttacgtcttgagccatctatcgtttgtcgaagttttgcatcataatgttataaagttgaattgg

SEQ ID NO: 945 - DNA, 1918 bp, Ricinus communis
aaaatctctgcaatttaatacgcataaatcatgtatcgtttcgcctctagccttgcttctaaagctcggatcgctaggaatagcacccatcagattggaagtagactgagctggagcagaaactatgctgccaaagatatcaaatttggggtggaagctagggctttaatgcttaagggtgttgaagagcttgcagaagctgtgaaagtcacaatgggtcctaaggggcgcaatgtggttattgaacaaagctttggtgcccccaaagtgacaaaggatggtgtgactgttgcgaagagcattgaattcaaagataaaatcaagaatattggtgctagccttgtgaagcaggttgctaatgcaactaatgatgttgcaggcgatgggaccacttgtgctacagttcttactcgagctatattcacagaaggatgcaagtcagttgcagcaggaatgaatgcaatggacctaagacgtggtataagcatggctgttgatgctgttgttactaacttgaagagcagggcgcgaatgatcagcacatctgaagaaattgcacaagttggtacaatatctgcaaatggggagagagaaattggtgagttaattgcgaaggccatggagaaggttggcaaagagggagttatcacaatccaagatgggaagacattatataatgagttggaagttgttgagggaatgaagttggacaggggttacatatccccttatttcatcacgaatcagaaaaaccaaaaatgtgaattggacgatcctctcattttgatccatgagaaaaagatctcaagcataaatgctgtggtgaaagtattggagttggctttgaagagacaaaggcccttgttgataattgccgaagatgtggaaagtgaagcgctggcaacccttattctaaacaagcttcgtgctggaattaaggtatgtgccataaaagctcctggatttggagagaaccgaaaggctggactccaggatcttgctgtcctcacagggggtcaggtcataactgaagaacttggcctcaatcttgagaaggttgatttggatatgcttggcagttgcaaaaaggttacagtgtcaaaagatgataccgttgttcttgatggtgctggagagaagaaggacattgaggaaagatgcgaacagataagatctacaatagaattaagcacttctgactatgacaaagagaagttgcaagaaagattggcaaagctttctggtggtgttgctgtacttaagattggtggagctagtgaagctgaagttggtgaaaagaaagatagggtcacagatgctctaaatgcaacaaaggcagctgtagaagagggtatcgtaccaggtggtggtgttgctcttctttatgccacaaaagagttggaaaagttgcagactgccaactttgaccaaaagattggtgtccaaatcattcaaaatgctctgaagactccagtacatacaattgcaagtaatgcaggagttgagggagctgtcgttgttggcaagttattggagcaggacaattacgatcttggctatgatgctgctaaaggtgaatatgtggatatggtgaaagcagggatcattgacccactgaaagtgattagaactgctttggttgatgccgcaagtgtatcatcattgatgacaacaactgaagctgttgtatctgaacttccaaaggatgagagtgctgctccagcaatgcctcctggcatgggcatggattactgatcatgagattcgtgaagttcaccaaaatccacacaaacagagaactgagtttttcctttttcttttatcttaggcgagtcattgatgtgaaggtccaaaggcatccatccatgtaatcatagtgagatctgcaaattgtagggtgtagtttcggggattggat

SEQ ID NO: 946 - DNA, 2219 bp, Petroselinum crispum
cggctaaacccttaaaccctgcttcttctagacccttcccttcctccacacttatagtatatagtctgtgtgtctatttgttctttattgcatcttcaaataagtctcacttttgaagcagacaaacatttgattattctgcaacaatcccagaaatatcatgtacagatttgcagcaaatcttgcctccaaagcacggattgcttcaaacagcagcaaacagattggtagtaggttaaatttgagcagaaactatgctgccaaggatattagatttggggttgaagcccgagctttaatgctaaaaggtgttgaagagcttgctgatgcagttagagtaactatggggcctaaggggcgtacggtggtcattgagcaaccttatggggcgccaaaagttactaaagatggggtaacggtcgctaagagcattgagttcaaggacaaagtgaagaacatcggagcaagtcttgtcaaacaggttgcaaatgccaccaatgatgttgcgggggacggtaccacttgtgcaacagtcctcacccgtgcaatattcactgaaggttgcaaatcagttgcagctggtatgaatgcaatggaccttagacgtggaattaccatggctgtagatgctgtggtaacaagcttaaagagtcgagcacggatgataagcacatctgaagaaattgcacaggttggaactatatctgcaaatggtgagagggaaatcggtgagttaattgcgaaggcaatggaaagggttggcaaggagggagtaataacaatccaagatggaaagacactgtacaatgagctggaagttgttgaaggtatgaagctcgataggggttacatatcaccatatttcatcacaaatcagaagaaccagaaatgtgagttagatgatccactcatattaattcatgagaagaaaatctctagcataaatgcagtggtaaaagtattagagttggcattaaagagacaaaggcctctgttaatagttgctgaagatgttgatagtgaagcattagctacattaattctaaataagctgcgtgctggaataaaggtttgtgcaatcaaagctcctgggtttggagaaaacagaaagtctaatctccaggatcttgctgtccttactggtggccaggttataactgaagagcttggtatgaaccttgacaatgtggagttggatatgtttgggtcatgcaaaaagataacaatatccaaggatgatactgtggttcttgatggtgctggtgagaaaaaggctatagaagagaggtgtgaacagataaggtcatcaatcgaattgagtacttctgattatgacaaagagaagtatcaagaaagattagctaagctttctggtggtgttgctgtattgaagattggaggagctagtgaaactgaagtaggtgagaagaaggatagagttacagatgcactgaatgccacaaaggctgctgtagaggaaggaatcgtgccaggtggtggagttgctctcttatacgcgactaaggagttagaaaagcttccaacagccaactttgaccaaaaaattggcgtgcagatcattcaggatgcccttaagacaccggtgcacactatcgcatctaatgctggagtggagggggctgttgttgttggcaagctgttggagcaggacgaccctgaccttggatatgatgcggcaaaaggtgcttatgttgatatggtcaaagctggaattattgacccagtgaaagtaattagaacagcactggttgatgccgcaagtgtatcttccttgatgacaactacggaagccattgttgtcgaactccccaaggacgataaagacgtgccaatgggcggcggcatgggtggtatgggaggcatggattattgataggcatattgattaacaagtcctgacatatattacaatcaatataagggtttttgtccattaagttaggagttgtgtgacaaaagcacccaacgtgtaataatcacgctaaaggagaatgctctataagaagttttggtcttgtaggattcttatttatgtgtcttttttcgagtactaaatggctcttcatgtgttcatttttgtataatcgcaatttcaaggcatttcttctagctaggttgtatccgtcttcaatataccagttttttgatattagacaagctagtgattatgtgatggcaagggaatgcatattccaaat

SEQ ID NO: 947 - DNA, 2256 bp, Ricinus communis
gtcttctgtttataattacaaaagcaccttgctctctttcattttcagccctcctgtgaatacgcgcacacactttctctgtcgttagttcattcattttccttctcttttctaactccaaaaatctctgcaatttaatacgcataaatcatgtatcgtttcgcctctagccttgcttctaaagctcggatcgctaggaatagcacccatcagattggaagtagactgagctggagcagaaactatgctgccaaagatatcaaatttggggtggaagctagggctttaatgcttaagggtgttgaagagcttgcagaagctgtgaaagtcacaatgggtcctaaggggcgcaatgtggttattgaacaaagctttggtgcccccaaagtgacaaaggatggtgtgactgttgcgaagagcattgaattcaaagataaaatcaagaatattggtgctagccttgtgaagcaggttgctaatgcaactaatgatgttgcaggcgatgggaccacttgtgctacagttcttactcgagctatattcacagaaggatgcaagtcagttgcagcaggaatgaatgcaatggacctaagacgtggtataagcatggctgttgatgctgttgttactaacttgaagagcagggcgcgaatgatcagcacatctgaagaaattgcacaagttggtacaatatctgcaaatggggagagagaaattggtgagttaattgcgaaggccatggagaaggttggcaaagagggagttatcacaatccaagatgggaagacattatataatgagttggaagttgttgagggaatgaagttggacaggggttacatatccccttatttcatcacgaatcagaaaaaccaaaaatgtgaattggacgatcctctcattttgatccatgagaaaaagatctcaagcataaatgctgtggtgaaagtattggagttggctttgaagagacaaaggcccttgttgataattgccgaagatgtggaaagtgaagcgctggcaacccttattctaaacaagcttcgtgctggaattaaggtatgtgccataaaagctcctggatttggagagaaccgaaaggctggactccaggatcttgctgtcctcacagggggtcaggtcataactgaagaacttggcctcaatcttgagaaggttgatttggatatgcttggcagttgcaaaaaggttacagtgtcaaaagatgataccgttgttcttgatggtgctggagagaagaaggacattgaggaaagatgcgaacagataagatctacaatagaattaagcacttctgactatgacaaagagaagttgcaagaaagattggcaaagctttctggtggtgttgctgtacttaagattggtggagctagtgaagctgaagttggtgaaaagaaagatagggtcacagatgctctaaatgcaacaaaggcagctgtagaagagggtatcgtaccaggtggtggtgttgctcttctttatgccacaaaagagttggaaaagttgcagactgccaactttgaccaaaagattggtgtccaaatcattcaaaatgctctgaagactccagtacatacaattgcaagtaatgcaggagttgagggagctgtcgttgttggcaagttattggagcaggacaattacgatcttggctatgatgctgctaaaggtgaatatgtggatatggtgaaagcagggatcattgacccactgaaagtgattagaactgctttggttgatgccgcaagtgtatcatcattgatgacaacaactgaagctgttgtatctgaacttccaaaggatgagagtgctgctccagcaatgcctcctggcatgggcatggattactgatcatgagattcgtgaagttcaccaaaatccacacaaacagagaactgagtttttcctttttcttttatcttaggcgagtcattgatgtgaaggtccaaaggcatccatccatgtaatcatagtgagatctgcaaattgtagggtgtagtttcggggattggataattcaagatcttgaatttttgtttgatagggaatgtaatgccgcctttaaatcctcccctaataaaaaccaattttatcctttgttaactgctgtgatggcacaaacattttatacctctggtgtttcttatccactatttttcagcctatagaaagatggttgcaaataatttatccttcttgaattgaaagaaaagcaaagtatttagaggggta

SEQ ID NO: 948 - DNA, 2050 bp, Gossypium hirsutum
gccacccctgaaacacacccagtgtcttttgtcaccccacaaatagctttgctgtcaacattttactcaagattttcctctttttctttcctcccaaactaactatgtatcgttttgcttcaagccttgcttctaaagctagggctgctaggaacactacatatcagattggtagtaggctgagttggaataggaactatgctgcaaaagatattaaatttggggtggaagctcgagcattgatgcttaaaggtgttgaagagctcgctgatgctgttagagtaaccatgggtcctaaggggcggaatgtggttattgaacaaagctacggtgctccaaaagtgactaaagatggtgtaactgttgcaaagagtattgaattcaaagacaaagtgaagaacgttggtgcgagtcttgtgaaacaagttgcaaatgccaccaatgatgtagctggtgatggaactacctgtgcaacggtgctgacacgagcaatttttaccgaaggatgcaagtctgttgctgcaggaatgaatgcaatggacctaaggcgtggcataacaatggcagttgatgctgttgtaacaaacttgaaaagccgggcaaggatgattagcacatctgaagagattgctcaggttggaacaatatcagctaatggagagagggaaattggtgagttgattgcaaaggccatggagaaggttggcaaagaaggggtgataacaattcaggatggtaaaacattatataatgagttggaagttgtcgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaaaaaagccattgaggaaagatgtgaacagattagatcagcaattgaattgagcacctctgattatgataaggagaagttgcaagagagattggcaaaactttctggtggtattgctgtcttgaagattggtggagctagtgaagctgaagttggagagaagaaggatagagttacagatgcattaaatgctacaaaggcagctgtagaggaaggcatcgtgccaggaggtggtgttgctcttttatatgcatcgaaagagttggacaagctacctacggccaactttgaccagaagattggtgttcaaatcatccagaatgctctaaaggcacctgtacacacaattgcttcaaatgctggagttgagggagctgtcattgttggtaagctgttggagcaggataaccctgatcttggctatgatgcagccaaaggtgaatatgttgatatggtaaaggctggtattattgatccattgaaagtaattagaactgctttggtggatgctgcaagcgtgtcgtcattgatgacaactactgaagctgttgtagtcgaacttccaaaggatgagaaggatgttccggcaatgcctggcggtatgggtggcatggattattaaggttattccacctaacagtacaccgattgtaagtgttttcatctaatctattttcatttcctcgacatctgtgagaaaaaagattatccgagtcttgatgtttaagttggaaggcttccatgtaatcataaattgagagctatgtggtggttttggtgataaagggtcaacaaaactgtctcattgtttttgctagaaagaaaggactacattgtatt

SEQ ID NO: 949 - DNA, 2043 bp, Gossypium hirsutum
tctttgtcaacccacaaacagctttactgttaacattttactcaagtattttcctcctatttcttcctcccaaaataaccatgtatcgttttgcttcaagccttgcttctaaagctagggctgctaggaacactacatatcagattggtagtaggttgagttggaataggaactatgctgcaaaagatattaaatttggggttgaagctcgcgctttgatgcttaaaggtgttgaagagctttctgatgctgttagagtaaccatgggtcctaagggtcggaatgtggttattgaacaaagctacggtgctcctaaagtgactaaagatggtgtaactgttgcaaagagtattgaattcaaagacaaagtgaagaacattggtgcgagtcttgtgaaacaagttgcaaatgccaccaatgatgtagctggtgacggaactacctgtgcaacggtgcttacacgagcaatttttaccgaaggatgcaagtctgttgctgcaggaatgaatgcaatggaccttaggcgtggcataacaatggcagttgatgccgttgttacaaacttgaaaagccgggcaaggatgattagcacatctgaagagattgctcaggttggaacaatatcggctaatggagagagggaaattggtgagttgattgcaaaggccatggagaaggttggcaaagaaggggtgataacaattcaggatggtaaaacattatataatgagttggaagttgtcgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaagaaagccattgaggaaagatgcgaacagattagatcagcaattgaattgagcacctctgattatgataaggagaagttgcaagagagattggcaaaactttctggcggtgtggctgttttgaagatcggaggagctagtgaagctgaagttggcgagaagaaggatagagttacagatgcactgaatgcaacaaaagcagctgtagaagagggtattgtgccaggtggtggtgtcgctctgttgtatgcatcgaaagagttggacaagctacctacagctaactttgaccagaagattggcgttcaaattatccagaatgctctaaagacacctgtacacacaattgcttcaaatgctggagtcgagggagctgtcattgttggtaagctgttggagcaggataaccctgatcttggctatgatgcagccaaaggtgaatatgttgatatggtaaaggctggtatcattgatccattgaaagtaattagaactgctttggtcgatgctgcaagcgtgtcatcattgatgacaactaccgaagctgttgtagtcgaacttccaaaggatgagaaggatgttccggcaatgcctggcggtatgggtggcatggattattaaggttattccccctaacagtgcaccgattgtaagtgttttcatctaatctatttccatttcctcaacatctgtgagaaaaagaatatccgagtctcgatgtctaagttggaaggcttccatgaaatcataaattgagagctacttggtggtggttttggtgataaagggtcaacaggactctcttattgttgttgctagaaagaacgaactagtttgtattgggccattttatctt

SEQ ID NO: 950 - DNA, 2084 bp, Gossypium hirsutum
cccattgtcttttgtcaccccacaaacagctttgctgtcaacattttactcaagattttcctctttttctttcctcccaaactaaccatgtatcgttttgcttcaagccttgcttctaaagctagggctgctaggaacactacatatcagattggtagcagattgagttggaataggaactatgctgcaaaagatattaaatttggtgttgaagctcgagcattgatgcttaaaggtgttgaagagctcgctgatgctgttagagtaaccatgggtcctaaggggcggaatgtggttattgaacaaagctacggtgctccaaaagtgactaaagatggtgtcacggttgcaaagagtattgaattcaaagacaaagtgaagaacgttggtgcgagtcttgtgaaacaagttgcaaatgccaccaatgatgtagctggtgatggaactacctgtgcaacggtgcttacacgagcaatttttaccgaaggatgcaagtctgttgctgcaggaatgaatgcaatggacctaaggcgtggcataacaatggcagttgatgccattgtaacaaacttgaaaagccgggcaaggatgattagcacatccgaagagattgctcaggttggaacaatatcggctaatggagagagggaaattggtgagttgattgcaaaggccatggagaaggttggcaaagaaggggtgataacaattcaggatggtaaaacattatataatgagttggaagttgttgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctaattctgaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaagaaagccattgaggaaagatgcgaacagattagatcagcaattgaattgagcacctctgattatgataaggagaagttgcaagagagattggcaaaactttctggcggtgtggctgttttgaagatcggaggagctagtgaagctgaagttggcgagaagaaggatagagttacagatgcactgaatgcaacaaaagcagctgtagaagagggtattgtgccaggtggtggtgtcgctctgttgtatgcatcgaaagagttggacaagctacctacagctaactttgaccagaagattggtgttcaaatcatccagaatgctctaaagacacctgtgcacacaattgcttcaaatgctggagtcgagggagctgttattgttggtaagctgttggagcaggataaccctgatcttggctatgatgcagccaaaggtgaatatgtcgatatggtaaaggctggtattattgatccattgaaagtaattagaactgctttggtcgatgctgcaagcgtgtcatcattgatgacaactaccgaagctgttgtagtcgaacttccaaaggatgagaaggatgttccggcaatgcctggcagtatgggtggcatggattattaaggttattccccctaacaatacactgattttaagtgctttcctctaatctatttccatttcctcaacatctgtgagaaaaagaatatccgagtctcgatgtctaagttggaaggtggttttggtgataaagggtcaacaggactctcttattgttgttgctagaaagaacgaactagtttgtattgggccattttatcttgaaataaatggaaaaaatgaacagaaaaaaaaactttacactttcgactgtgatcgatatgagtttctgc

SEQ ID NO: 951 - DNA, 2252 bp, Olea europaea
actcgtaattcttgagtctcattatctttcttcaattttttctgtttccaaattcttctttttattgaaacatgtatcgttttgctgcaaatcttgcttccaaagccaggattgcaagaaatagcagccaacagattggtagtagattgggttggagcagaaactatgctgcgaaagatattagatttggagtggaggccagggctctgatgcttaagggtgttgaggagctctctgaggcagttaaagtcaccatgggcccgaaggggcgtaatgtagtgattgagcaaagttggggtgcccccaaagtgacaaaggatggtgttactgtggcaaagagcattgagttcaaggacaaagtcaaaaacattggtgcgagccttgtaaagcaggttgcaaatgccaccaatgatgttgctggtgacggtactacatgtgctactgtcctaacccgtgcaatatttgctgagggctgcaagtcagttgcagctggcatgaactcaatggatcttagacgaggtatttccatggctgttgattctgtggttacaaacttaaagagcagagcacgaatgataagtacatcagaagaaatttctcaggttgggacaatctctgcaaatggagaaagagaaattggagagctgattgcaaaggctatggaaagggttggcaaagagggtgtcatcaccattcaagatggaaagactctgttcaatgaattggaagtagttgagggaatgaagttggacagaggctatatttccccgtacttcatcacaaatcagaagaaccagaaatgtgagttggatgaccctctcattcttatacacgagaagaaaatttcaaacttaaatgctattgtcaaagtattagagttggctttgaagaggcaaagacctctagtaatagttgccgaagatgtggaaagcgatgcacttgcaactcttatcctcaacaagcttcgtgctgggattaaggtttgtgctataaaagcacctggatttggtgaaaataggaaggctagtttgcaggatcttgctgctttaacaggaggccaggtcataacagaagaacttggattgaatctggaaaatgtggagttggatatgctcggctcatgtaaaaaggtcacaatatctaaggatgacactgttattcttgatggcgctggtgagaagaaagccatagaggaaagatgtgaacagataaggtcagcaattgaattgagcacttctgattatgacaaggagaagttgcaagaaagacttgctaagctatctggtggtgtagctgtattaaagattggaggagctagtgaagcagaagttagtgagaagaaagacagagttacagatgctctaaatgccacaaaggcagctgttgaagaaggaattgtacctggtggtggtgttgctcttttgtatgcatcgaaagaactcgataaattgccaacagccaactttgaccagaagattggtgtacaaattatccaaaatgcattaaggacaccagtacatacaattgctgcaaatgcaggagtggagggtgctgttgttgtcggcaagttgttagaacaggataacccggatcttggttatgatgcagctaaaggtgaatatgttgatatggtcaaggctggaattatcgatccattgaaagtcattagaaccgcgctaactgatgctgccagcgtgtcatctttgatgaccacaacggaagctattgtggttgaactaccaaaggacgagaagcctgcccctgaaatgggaggcggcatgggcggaatggactactaaaacgcttagaaaacatcaataaaaagaattaaatttttgatgatttttcaacgagtcacttgcgggagaacatggcatcatttgtaatcataatgagaaaacaagagcatcattggattagggattgctttgggaattcatcgcatgccatgtgcaacttgtactttcaagacttgtttttcttgtcgatgattgatgtcatgtcaattaatgattaaattttattttcctaatggctttgaccatcgaattacttattttggtagaagtttaataaaaattggtaaaagttgtgggttttatataaatgtgtgggttaaattgtaatatttgggctcagtgattcctattacctgtttgtcactaaatacatatggactattagatactccttttctatgtttgctttctttttcgtctattttaaattataggctagtttttaattaaaag

SEQ ID NO: 952 - DNA, 2105 bp, Prunus persica
acgcttaataacccctctctcccaaccatctctctcagttcgtgcactttctcgctctgtctatcactctctctgtctctgtcactctgcgatctcagtatgtatcgttttgcttcaagcctcgcatccaaagctcgagttgctaggaactgctccaagcagattggtggtacgttgagttggagtagaaattatgcagccaaagacataaaatttggggtggaggcccgagccctcatgctcaatggtgtcgaagatcttgccgatgctgtcaaagtcaccatgggccctaaggggcgtaatgtggttattgaacaaagctttggtgcacccaaagtaacaaaagatggtgtaactgttgcaaaaagtatagagttcaaggataaaatcaagaatgttggtgctagcctggtgaaacaggttgctaatgccaccaatgatgtagcgggtgacggcactacttgtgctacaatcctgaccagagccatttacaccgaaggatgcaagtcagttgctgccgggatgaatgcaatggatttgcgacgcggtattactatggcagttgattctgtggtaacaaacttgaagagcagagcaagaatgatcagcacttctgaagagatagcacaggttggaacaatatctgcaaatggagagagagaaattggtgagttgattgcaaaggccatggagaaggttggcaaagagggtgtaatcactatctcggatgggaaaacattggacaatgagttggaggttgttgagggaatgaagctagacaggggctacatatccccttatttcatcaccaaccagaaaaatcagaaatgtgaattggaaaatcctctaatcgtaatccatgagaagaaaatctcaagtattaatgcagtggtgaaaatattggagttggctttgcagaagcaaaggcctttgctgattgtcgccgaagatgtggagagcgaagcactggcaacccttattctaaataagcttcgtgctggaatcaaggtctgtgcaatcaaagcccctggttttggtgaaaataggaaatccagtctccaggatcttgccgttctcactgggggttctcttattactgaggagcttggtctgaatcttgacaaagtggaattggatatgctcggcacttgcaaaaaggtcacaatttcaaaagatgacactgtaattcttgatggtgctggtgacaagaaggctattgatgaaagatctgaacagattagatcggccattgaattaagtacttccgattatgacaaggaaaagttacaggagagactggcaaagctttctggtggtgttgctgttttgaagattggaggagctagcgaaactgaagttggtgagaagaaggatagggttactgatgccttgaatgccaccaaggcagccgttgaagagggtatagtaccaggtggtggcgttgctcttctttatgcatcgaaagagttggaaaagctcccgactgctaactttgaccagaagattggagttcagattattcagaatgctctgaaggcacctgtccatacaattgcttctaatgctggagtggagggagctgttgttgtcggtaagctattggagcaagataaccctgatcttggctatgatgccgctaaaggtgaatatgttgatatggtcaagtccggaataatagatccattgaaagtaattagaactgctttagttgatgctgcaagcgtgtcgtctttgctgacaactactgaagctgttgtagttgaacttcccagtgataaggagactccagcaatgggtggtggcatgggtggcggcatgggtggaatggactattgaggctcctcccaattttacactcatttgacaacccacccctgattgagtccgcaaaatccgcatgtaaaataaaaaaaacagggtgtaattttatcttgggttagttttggttgcaaggcatcgtgtagtcatagcgctagagagagagagagagagagagagagagagatcgatgagcgtgtaggtagctcctctaattcaggataaaacttgttattgcaggggagaattcgaatgtaccaattattcttttcaaataaaaactattt

SEQ ID NO: 953 - DNA, 2637 bp, Fragaria vesca
tctttctcactctctgtttctctcttgctctgctctctgctctgtcgctatgtatcgcctcgcttcaagcctcgcttccaaagctcggggtattaggaacaatgcccagcagattggtggtaggttgaattggagcagaaactatgcagcgaaagatattagatttggcgtggacgcccgagccctcatgctcagtggcattgaagatcttgccgatgctgttaaagttacaatgggtcctaaggggcgtaatgtggttattgagcaaagctttggcgcacccaaagtgacaaaagatggtgtaacagttgcaaaaagcattgagtttaaggataaagttaagaacgtcggagctagcctcgtaaaacaggttgctaatgccacaaatgatgtagctggtgatggtaccacttgtgccacgatcctgaccagagctatctacactgaaggatgcaagtcagttgctgctggtatgaatgccatggacctaagacgtggtattaccatggcagttgattctgttgtaactaacttgaagagcagagccagaatgatcagcacttctgaagagatagcacaggttggaacaatatcggcaaatggcgagagagaaatcggtgaattgattgcaaaggccatggagaaggttggcaaggagggagtaatcacgattgctgatggcaaaacattgtataatgagttggaggttgttgagggcatgaagctagacagaggctatatatctcctcatttcatcaccaacccaaaaaatcaaaaatgtgaactggaagatcctctagttctaatccatgagaagaaaatctcaaatattaatgctgtcattaaagtattggagctggctttgaagaagcaaaagcctttgctgattgtcgcagaagatgtggaaagtgatgcacttgcaacacttatattaaataagcttcgtgctggaatcaaggtctgtgcaatcaaagcccctggtttcggtgaaaataggaaatccaatatgcaggatcttgcagttctcactggtggcactgttattactgaagagctgggtttgaaccttgaaaaagtggatatggatatgcttggaacttgcaaaaaggtcaccatttcaaaagatgacactgtaattcttgacggtgctggtgacaagaaggcacttgaggaaagatgtgaacagattcggtctgcaattgaagcaagcacttccgattatgacaaagagaaattacaagagagactggcaaaactttctggtggtgttgctgtgttgaagattggaggagccagtgaagctgaagttggtgagaagaaggatagggttactgatgccctaaatgccaccaaagcagctgttgaagagggtattgtaccaggtggcggtgttgcactcctctatgcagctaaagagttggacaaactttcaactgctaacttcgatcagaagattggagttcagattattcagaatgctctaaaggcacctgtccacacaattgcttctaatgcgggagttgaaggagctgttattgtcggtaagctcttggagcaagatgaccctgatctgggatatgatgcagctaaaggtgaatatgttgatatggtcaaagctggaataatagacccattgaaagtaattaggactgctttagtggatgctgcaagtatttcatctttgctgacaactactgaagctgtcgtagttgaacttcctagtgacaaggagaccccggcaatgggcggtggtatgggtggcatgggtggtatggattattgagaactgccccattccaaactcattttagagtaactggagtgtaaaactagcatcagagtgtttactacattgcttagagttgtttgggtcgcaagtcattgagttttttgggtctgaaggtgtagtcatagtgaggatcagtgtgtaggtagatcctgtaatacaggacagagaagttgtttctgggaagaatctcaaactaaatgtacgcatctaattcttttcaaataaaaacttttcttccttgatttctttcgtatcttaggttggtaggggtgatctttcttcttcggcatcttgtttctgcatttaggcattataaggggcatatccatgtgttggatgagtttcttttttggtctgaattttctgttttcatcaaagagcaactgcagttctggtcagttcctctgaggtcagagatatgtttctgcctcgtaaacctgaaatgattcttagcatgcctttgggcctttggtctgcggctctacgccggaaaagcttgtgtggcatcataccaagaacggagtgttcagcgtcaaatctggttgttgggtagcaagtactactgtggcctgttctagtactggagcaaatatggaggcttcgtataaggtctggaggtcgattgtgccacacaaattgaaggtattcttatggagagctatcaacagtttcctcccctgtacgcaaaacctggtaagaagaaaaatcatggccgagtcttgttggcaatgtggcaatttaatagaatcagttagttattcatatattatgggatggaaaattctagtgtgcagcactgcatactatgcagatcctactagaagacaggatagctgaggttacctaga

SEQ ID NO: 954 - DNA, 2181 bp, Prunus mume
acgcttaataagcgctctctcccaaccatctctctcatttcgtgcactttgtcgctctttctatcactctctctgtctctgtcactctgcaatctcagtatgtatcgttttgcttcaagcctcgcatccaaagctcgagttgctaggaactgctccaagcagattggtggtacgttgagttggagtagaaactatgcagccaaagacataaaatttggagtggaggcccgagccctcatgctcaatggtgtcgaagatcttgccgatgctgtcaaagtcaccatgggccctaaggggcgtaatgtggttattgaacaaagctttggtgcacccaaagtaacaaaagatggtgtaactgttgcaaaaagtatagagttcaaggataaaatcaagaatgttggtgctagcctggtgaaacaggttgctaatgccaccaatgatgcagcgggtgacggcactacttgtgctacaatcctgaccagagctatttacaccgaaggatgcaagtcagttgctgctgggatgaatgcgatggacttgcgacgcggtattactatggcagttgattttgtggtaacaaacttgaagagcagagcaagaatgatcagcacttctgaagagatagcacaggttggaacaatatctgcaaatggagagagagaaattggtgagttgattgcaaaggccatggagaaggttggcaaagagggtgtaatcacaatctcggatgggaaaacattggacaatgagttggaggttgttgagggaatgaagctagacaggggctacatatccccttatttcatcaccaaccagaaaaatcagaaatgtgaattggaaaatcccctaatcgtaatccatgagaagaaaatctcaagtattaatgctgtggtgaaaattttggagttggctttgcagaagcaaaggcctttgctgattgtcgccgaagatgtggagagcgaagcactggcaacccttattctaaataagcttcgtgctggaatcaaggtctgtgcaatcaaagcccctggttttggtgaaaataggaaatccagtctccaggatcttgccgttctcactgggggttctcttattaccgaggagcttggtctgaatcttgacaaagtggaattggatatgctcggcacttgcaaaaaggtcacaatttcaaaagatgacactgtaattcttgatggtgctggtgacaagaaggctattgatgaaagatctgaacagattagatcggccattgaattaagtacttccgattatgacaaggaaaagttacaggagagactggcaaagctttctggtggtgttgctgttttgaagattggaggagctagcgaaactgaagttggtgagaagaaggatagagttactgatgccttaaatgccaccaaggcagctgttgaagagggtatagtaccaggtggtggcgttgctcttctttatgcatcgaaagagttggaaaagctcccgactgctaactttgaccagaagattggagttcagattattcagaatgctctgaaggcacctgtccatacaattgcttctaatgctggagtggagggagctgttgttgtcggtaagctattggagcaagataaccctgatcttggctacgatgcagctaaaggtgaatatgttgatatggtaaagtctggaataatagatccattgaaagtaattagaactgctttagtcgatgctgcaagcgtgtcgtctttgctgacaactactgaagctgttgtagttgaacttcccagtgataaggagactccagcaatgggtggtggcatgggtggtggcatgggtggaatggattattgaggctcctcccaattttacactcatttgacgacccacccctgattgagtccacaaaatccgcatgtaaaataaaaaaacggggtgtaattttatcttgggttagttttggttgcaaggcatcgtgtagtcatagtgctagagagagagagagagatcagcgtgtaggtagctactgtaattcaggataaaacctgttattgcattggagaatttgaattcgaatgtaccaattattcttttcaaataaaaactattttcttgccgtagtagtttggtcattttgagttgtatttttcctcctttttttctcgcagcgaaggtatagagggtttgataaggttaatc

SEQ ID NO: 955 - DNA, 2166 bp, Amborella trichopoda
gagagagaggtttctagacaccgtatccgccttaaaccctaataaagggtttaagcctttctctctctctttctcactctctctttcagttggttttctgcttcacaaaagcggcagcttccttttgtttaacaagccacagtctagtgtttctcctacaaaatgtacagactcgcatctggtttactcgcaaaatccagaatcagaaacaccagtagccagattggaagtagagtcaattggaatcggaattatgctgcaaaggatatcaggtttggcattgatgctcgagctttaatgctcaagggtgttgaagacttagctgatgctgtaagaataaccatgggcccaaagggtcgcaatgttgttattgagcaaagttttggggcaccaaaagtaacaaaggatggagtcactgtcgccaaaagtattgagtttaaggatagagttaagaacatgggtgcaagccttgtcaagcaagttgccaatgcaacaaatgatgtagctggcgatggtaccacttgtgcaacaattcttacccgagcaatattctcagaaggttgtaaatcagttgcagctggcatgaatgctatggacttaagacgtgggatttctatggcagtagatgctgttgtaaccaacttaaagagtagggctagaatgatcagcacatctgaggaaattgcacaggtaggtaccatatcggcaaatggtgaaagggaaattggggagttgattgcaaaggcaatggaaaaggttggcaaagaaggagtcattactattgaggatgggaagacactgtttaacgaattggaggttgttgaaggaatgaagctcgacaggggctatatttcaccatattttataaccaatcaaaagactcaaaaatgtgaacttgaggatcccctcattttgatacatgagaagaagatatcgagcattaatgcagttgtcaaagtattggagctggctttgaagaagcaaagacctttactgattgttgcagaagatgtagaaagtgatgcattagccacccttattctgaataagcttcgtgcaggtgtgaaggtgtgtgccattaaagcaccaggttttggagagaacagaaaagcttatctgcaggatctggctacacttactgggggggaggtcatcactgaagagcttggcttgaaccttgagaaggtggacttgaagatgcttggcagcgctaaaaaggtaactgtatcaaaggatgatactgttgttcttgatggagctggggacaaaaaagcgattgaagaaagatgtgagcagctgcgttctgctattgaagtgagcacttcggattatgatagggagaagctccaagaacgattggcaaagctttcaggaggagttgctgttctcaagattggtggagcaagtgaagtagaagtcggagagaagaaggatagagttacagatgctcttaatgctaccaaagcggcagtagaggaaggcattgtaccaggtggtggcgttgcacttctttatgctacaaaggagcttgaaaagcttcaaactgctaattttgaccagaagattggagttcagatcatccagaatgccctcaagacacctgcactgactattgcagcgaatgctggtgtggaaggtgctgtggttgtgggcaaattacttgagcaggataaccccgacctcggctatgatgcagccaaaggggaatatgtggacatggtgaaggctggaataattgatccattgaaggtcatcagaactgccttggtggatgcggcaagtgtctcatcattgatgacaatgactgaggcagttgttgctgaatttccaaagaatgagagtgcgagcccagccatgggcgccagcggcatgggtggaatgcatttctaaggtgtatatttacaatgataattttttggctgagagagagagagagagatgttttgcattctagagttgttaaacaagtgactgccccggcataccaaacatttatgtacaatttaaaatgccaattgttgaggctgtattctaagacgtgaggcgaattttgtattcacattatgtgaattatttgcaataaaaacaccattttgatggtggtttgaagttccagtttatattttgattcgagtctctctcgacagagtggaggggggagagtat

SEQ ID NO: 956 - DNA, 2093 bp, Brassica rapa
taaaaccctaaaagggagggcattaaacaagtagcagctgcagcttctagagtcttctccttcgtttattaaaagtccgacgcttctctccatcgacctcgcttgctcatcccatttatctcttccttagcttctccatcgttcatcttcttccttctcagccaccatgtttcgtttcgtgtccagtctcgcctccaaggctaggattgcaagtaacacaagacaggtttccagcagaatgagctggagcaggaactatgcagcgaaagagattaaatttggggttgaagctcgtgccttgatgcttagaggtgttgaagagcttgctgatgctgttagagtcactatgggtcccaagggacgtactgttgtgattgagcaaagttggggtgctcctaaagtgactaaagatggtgtcactgttgccaagagcattgagtttaaggataaagtgaagaacgttggtgctagtcttgtcaagcaggttgctaatgctactaatgatgttgctggtgatggtactacgtgtgctactgtgctcaccagggcgatattcaccgaaggctgcaaatcagttgcagcaggaatgaacgctatggacctgaggagaggtatctccatggcggttgatgccgtggtgacaaaccttaaaagcagggcgaggatgatcagcacgtctgaggagattgctcaggttgggaccatttctgcgaatggagagagggagattggtgaactgatcgcaaaggctatggagaaggttggcaaagaaggtgtgatcacaatccaagatggaaagacgttgattaatgagttggaagttgtagaagggatgaagttggacagaggttatacttccccttactttatcaccaatcagaaaactcaaaaatgtgaactggaagagcctctcattcttatccatgagaagaagatctcctccatcaattctatagtgaaagtgttggagttggctatgaagaaacaaagaccgctgttgattgtctctgaagatgtggaaagtgaagctcttgcaactcttatccttaacaagctacgtgctggaatcaaggtttgtgccatcaaggccccagggtttggagagaacaggaaggccaacttgcaagaccttgctgcccttactggtggagaggttatcacggatgagcttggcatgaacctagagaaggtggatttgggcatgctagggacctgcaaaagggttactgtttccaaggatgacactgttattcttgatggggctggcgacaagacggccattgaggaaagatgcgagcagattagatcagcaattgaactgagcacctcggattatgacaaggagaaactgcaagaaagattagctaagctttctggaggagttgctgttttgaagattggaggagcaagtgaagctgaggttggtgagaagaaagacagagtgacagacgctttgaatgccactaaagcagctgttgaagagggtattttgccaggaggaggtgtggctcttctgtacgcagcgagagagttagagaaacttccaacagccaactttgaccagaagattggtgtgcagatcattcagaacgctttgaagactcctgttcacacaatagcttcaaacgctggagttgaaggtgctgttatagttggcaagctcttggagcaagataacacagaccttggttatgatgctgctaaaggtgaatatgtggatatggtgaaagctggtatcattgatcctctgaaagtgatcaggaccgctttggttgatgctgccagtgtgtcatctctgttgacgacaactgaagctgtagtcgtggatcttcctaaagatgaaagcgagtccgcaggagctggagcaggcatgggtggaatgggaggcatggattattaattacatcactaaaactctcgtcttttcttttcaccaatcatcaccttaacttgagagagaggagggacacaattcttgtaggagtctgtttttgcctgtgtttgcccaataaaaacaattaaacaggtcatttgcctgttttgctatatggatctgtttattacttttgcctaatttaaattatacaaataga

SEQ ID NO: 957 - DNA, 2018 bp, Vaccinium corymbosum
ttcaacccctctccccttcttctagacccttctctctctctagttcactctgttttccaacttcagcaatatgtatcgcttcgccgctaatctcgcttccaaagcccggatcgctaggaatggtactcaacagattggtactagattgacttggagcagaaactatgcagcgaaagacattaaatttggagtcgaagcacgggctttgatgctccggggtgttgaagagcttgctgatgctgtcaaagtaacaatggggccgaaaggccggaatgttgttttggagcaaagctatggtgccccaaaagttacgaaagacggtgttactgtggcaaagagcattgagttcaaagacagagtcaagaatattggtgcaagccttgtaaagcaggttgcaaatgctacaaatgatgttgctggtgatggtaccacctgtgctacggtccttacccgtgccatatatgctgagggatgcaagtcagtggcagctggaatgaatgccatggaccttagacgtgggatcacaatggcagttgatgcggtggtgacaaacttgaagagcagagcacggatgatcagcacatctgaagaaatagcccaggttggcacaatatcagcaaatggagagagagagattggcgagcttatagccaaggctatggagaaggttggcaaagagggagttatcaccattgccgatgggaaaacattgtacaatgaattggaagtggttgaaggaatgaagctggataggggctatatatctccgtatttcattaccaatacgaagaaccaaaaatgtgaattggaagatccactgatattgattcatgagaaaaagatctcaagcttgaatgctgtggtgaaagtattggagatggccctgaaggagcgaaggcctttgctgatcgttgcagaagatgtggaaagtgaagcattggcaactctcattctaaacaagcttcgtgcaggaattaaggtctgcgccattaaagctcctggatttggagaaaacaggaaggccaatctgcaggatcttgccactcttacaggaggagaggtcatcactgaggagctaggtatgaaccttgagaatgtgggaccaggaaccttcggtacatgcaaaaaggtcaccatttcgaaagatgatactgttattcttgatgggaatggtgataagaaagctattgaggaaagatgtgaacagctccgaacttcaattgaattaagtacctctgattatgacaaggagaagctacaagagagacttgcaaagctttctggtggcgttgcggtgttgaagattggaggggcgagtgaagctgaggttggtgagaagaaggatagagttacggatgctttgaatgcaacaaaggcagctgtggaggaggggatagtacctggcggtggtgttgctcttctttatgcctcaaaagagctggaaaagctgcatactgcaaattttgatcaaaagattggtgttcagattatccagaatgctctaaaggcaccagtgcacacgatcgcatcaaatgctggagttgagggggcagtagttgttggtaagctattggaacaggacaatcctgaccttggatatgatgctgctaaaggtgaatatgtagacatggtcaaggcaggaattattgatccattgaaggtcattcgaacggctttggtggatgctgctagtgtctcttctttgttgactacaacggaggctgttgttgtcgagcttccaaaggatgagaaggaagctccagcgatgggcggaggaatgggtggcatggattattgagaggggtaagcggcggttgtgcatcagaaacagtcttgtttttgggaatccatttttctttccagaataattataacttctactatttagttaggataagtggatattcaggaggtatttctcctcgaggagcaccaccgtataccaataaagacattgttgagcggtagggtaattttcttagtaaatttaggtgtactttttggtttttggtttacct

SEQ ID NO: 958 - DNA, 1965 bp, Brassica napus
ttagcttctccatcgttcatcttcttccttctcagccgccatgtttcgtttcgtgtccagtctcgcctccaaggctaggattgcaagtaacacaagacaggtttccagcagaatgagctggagcaggaactatgcagcgaaagagattaaatttggggttgaagctcgtgccttgatgcttagaggtgttgaagagcttgctgatgctgttagagtcactatgggtcccaagggacgtactgttgtgattgagcaaagttggggtgctcctaaagtgactaaagatggtgtcaccgttgccaagagcattgagtttaaggataaagtgaagaacgttggtgctagtcttgtgaagcaggttgctaatgctactaatgatgttgctggtgatggtactacgtgtgctactgtgctcaccagggcgatattcacggaaggctgcaaatcagttgcagcaggaatgaacgctatggacctgaggagaggtatctccatggcggttgatgctgtggtgacaaaccttaaaagcagggcgaggatgatcagcacgtctgaggagattgctcaggttgggaccatttctgcgaatggagagagggagattggtgaacttatcgcaaaggctatggagaaggttggcaaagaaggtgtgatcacaatccaagatggaaagacgttgattaatgagttggaagttgtagaagggatgaagttggacagaggttatacttccccttactttatcaccaatcagaaaactcaaaaatgtgaactggaagagcctctcattcttatccatgagaagaagatctcctccatcaactctatagtgaaagtgttggagttggccatgaagaaacaaagaccgctgttgattgtttctgaagatgtggaaagtgaagctcttgcaactcttatccttaacaagctacgtgctggaatcaaggtttgtgccatcaaggccccagggtttggagagaacaggaaggccaatttgcaagaccttgctgcccttactggtggagaggttatcacggatgagcttggcatgaatctagagaaggtggacttgggcatgctagggacctgcaaaagggttactgtctcaaaggacgacactgttattcttgatggggccggtgacaagacagccattgaagagagatgcgagcagattaggtcagcaattgaactgagcacctcggattatgacaaggagaaactgcaagaaaggttggctaagctctctggaggagttgctgttttgaagattggaggagcaagtgaagctgaagttggtgagaagaaagacagagtgacagacgctttgaatgccactaaagcagctgttgaagagggtattttgccaggaggaggtgtggctcttctatacgcagcgagagagttagagaaacttccaacagccaactttgaccagaagattggtgtgcagatcattcagaacgctttgaagactcctgttcacacaattgcttcaaacgctggagttgaaggtgctgttatagttggcaagctcttggagcaagataacacagaccttggttatgatgctgctaaaggtgaatatgtggatatggtgaaagctggtatcattgatcctctgaaagtgatcaggacggctctggttgacgctgccagtgtgtcatctctgttgacgacaactgaagctgtagtggtggatcttcccaaagatgaaagcgagtccgcaggagctggagcaggcatgggtggaatgggaggcatggattattaattacatcactaaaactcttttgtctttcttttcaccaatcatcaccttaacttgagagagaggagggacacaattcttgtaggagtctgtttttgcctgtgtttgcccaataaaaacaattatacaggtcatttgcctgttttgctatatggatctgtttagtacttttgcctaatttaaaattatacaaa

SEQ ID NO: 959 - DNA, 2117 bp, Gossypium hirsutum
cacaaacagctttactgttaacatttttactcaagatttttcctccatttctttcctcccaaataaccatgtatcgttttgcttcaagccttgcttctaaagctagggctgctaggaacactacatatcagattggtagtaggttgagttggaataggaactatgctgcaaaagatattaaatttggggttgaagctcgcgctttgatgcttaaaggtgttgaagagctttctgatgctgttagagtaaccatgggtcctaagggtcggaatgtggttattgaacaaagctacggtgctcctaaagtgactaaagatggtgtaactgttgcaaagagtattgaattcaaagacaaagtgaagaacattggtgcgagtcttgtgaaacaagttgcaaatgccaccaatgatgtagctggtgacggaactacctgtgcaacggtgcttacacgagcaatttttaccgaaggatgcaagtctgttgctgcaggaatgaatgcaatggaccttaggcgtggcataacaatggcagttgatgccgttgttacaaacttgaaaagccgggcaaggatgattagcacatctgaagagattgctcaggttggaacaatatcggctaatggagagagggaaattggtgagttgattgcaaaggccatggagaaggttggcaaagaaggggtgataacaattcaggatggtaaaacattatataatgagttggaagttgtcgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagcccccggttttggagaaaacaggaagtctagtctgcatgatcttgctgtcctcacaggaggagaggttataacagaagagcttggcatgaaccttgaaaaggtggatctggacatgcttggcacttgcaaaaaggttactgtctcaaaggatgatactgttattcttgatgggaatggtgacaagaaagccattgaagaaagatgcgaacagattaggtcagcaattgaattgagcacctctgattacgataaagagaagttgcaagagagattggcaaaactttctggtggtgtggctgttttgaagatcggaggagctagtgaagctgaagttggtgagaagaaggatagagttacagatgcactgaatgcaacaaaagcagctgtagaagagggtattgtgccaggtggtggtgtcgctctgttgtatgcattgaaagagttggacaagctacctacagctaactttgaccagaagattggtgttcaaataatccagaatgctctaaagacacctgtgcacacaattgcttcaaatgcaggagttgagggagctgttattgttggtaagctgttggagcaggataaccctgatcttggctatgatgcagccaaaggtgaatatgtcgatatggtaaaggctggtattattgatccattgaaagtaattagaaccgctttggtcgatgctgcaagcgtgtcgtcgttgatgacaactaccgaagctgttgtaatcgaacttccaaaggatgagaaggatgttccggcaatgcctggcggtatgggtggcatggattattaaggttattccccctaacaatacactgattttaagtgctttcatataatctatttccatttcctcaacatctgtgagaaaaaagaatatccgagtctcgatgtctaagttggaaggcttccatgtaatcataaattgagagctacttggtgatggttttggtgataaagggtcaacaggactctcttattgttgttgctagaaagaacgaagtagtttgtattagaccattttatcttgaaaataaatagaaaaaaatagaaaaagaaaaaaaattctttcactttcgactgtgattgatatgtagttttggacaaaaaaaaa

SEQ ID NO: 960 - DNA, 2185 bp, Vigna unguiculata
aaactgcttcttctagagccttccctccatccattgaaaaagagcgtgaagcatttccattctgcattagtctctgcaacttcttgtgtgctttctcagtcggtgacatcatgtaccgctttgcaacctcccttgcttccaaagctagaattgctaggagcagcactcaacaaattggaagtagagtgaattggagcaggaattatgctgccaaagacattaagtttggcgtggaggcccgggctttgatgcttaagggggttgaagagctcgctgatgctgtcaaagtaaccatgggccctaaggggcgtaatgtggtgattgagcagagctttggtgcacccaaagtgacaaaggatggagtaactgttgctaagagcattgaattcaaggacaaagtcaagaatatcggtgccagtcttgtaaagcaggttgcaaacgctaccaatgatgtggctggcgatggaaccacatgtgctacaattcttactcgagctatatttacggaagggtgtaagtcagtcgcagctggaatgaatgctatggatctgagacgaggtataaatatggctgttgatgctgtggtgacaaatctgaaaagcagagcacggatgattagcacttctgaagaaattgcacaggttgggacaatatctgccaatggggagagggaaattggtgaattaattgcaaaagctatggagaaagttggcaaagagggtgtgatcactatctcagatggcaagacattatataacgaattggaagtcgttgaaggaatgaagcttgacaggggatacatttctccgtatttcataacaaaccagaagaatcagaaatgtgaactagaggaccctctcattataatccatgaaaagaaaatctcgagcataaatgccattgttaaagtattagagttagctttgaagagacaaagacctttgttgattgttgccgaggatgtagaaagtgatgcccttgcaactcttattctaaataaacttcgtgctggaatcaaggtatgtgcaatcaaagctcctggttttggtgaaaatcggaaatctggtctccaggatcttgctgtccttacgggaggtcaacttatcactgaagagcttggcttgaatcttgaaaaagtggatttggaaatgtttggctcttgcaaaaagataacaatttctaaagatgatactgttattcttgatggagctggtgataagaaagcaattgaagaaagatgcgagcagattagatcagcaattgaaaacagcacttcagactatgacaaggaaaagttacaagaaagattagccaaactttctgggggtgttgcagtgcttaagattggaggagctagtgaggccgaagttggagagaagaaagatagggtgacagatgccttaaatgcaaccaaggctgctgtagaggagggaatagtaccaggtggtggtgtcgctcttctttatgcatcaaaggagttggataagcttcaaactgccaattttgatcagaagataggtgtccagatcatccaaaatgctttgaagacttctgtgcacacaattgcttcaaatgcaggagttgaaggtgctgttgttgttggcaagttgttggaacaggataatcctgatcttgggtatgatgcagctaaaggtgaatatgttgatatggttaaatctggaatcattgatccattgaaggtgattaggaccgccttggttgatgcagccagtgtgtcatctttgatgacgacaactgaagctgttgtatctgaacttccaaaggatgataaagatgttcctgccatgggtggcggcatgggtggcatggattattaaggaactatttttggtagtttttttactggacttggagtgaagtggtgtgtcaccattattttgccttttttttcgcttatttgttgacaaaaggcatcatgtatccatgtaaccataggtagagataaaaaaaaatgtagggagaggttgtggttacaatggaattaaagaacatctgaaacatttttcagattccaaattatgattgaacattgttccactctgaaattgtcaattgaaagattgccctgaaataatttcagtagattgaactcgttctttttctatcatttctcaaacgagacaactttctaactttcaattgaaattatcagttgaaagatggc

SEQ ID NO: 961 - DNA, 2962 bp, Panax ginseng
ttaggaacactgctccaacaattaggaagaagcgcaaaagtggctttcaatttcttgttgatcaacacaaatttcaattacaaaaccattgaaaaaccataaccactaagaaaacaagttattgtccactaaactaaagacgaacagggagagcttgtggcagggcttcatgagcaattgtctgaaacttgcaatccgccgaaaacaactgggccgatatagtattgtcgctctcttccgcagcaataagttgaatcaggacgccctccagttcctctccatcactccattcatgaatttccgcctttaccagaccacggttttcccttatcaaatcccaaaccgggaaattcttccttggcattgcatagtctctgtcttttagcttcaagattgggcaaaaatcacccacgccatctccaacatagattatctttttaatattgccctcctctgcaagggaagcttgtatcctttcaattattagacccttgcacatatttggaggacagaggttggtgcaggcatgtggggaagtatgaaaatcgacgtaagggaagattcttaacttcccttcctcatccacaaaacccgggttggtgttgatttcagagaaatattccctcaatccaagatgattcagaattgtctctatataaaacagatttgcatcgcttactattctcaaatcacaccctagagcatgagctgctttgatggctggaataatcctgggatggattggaacccgtttcagtacatccgcaatgtcttcaattttttttccctgcgagtgaagctgcttcatcatttgatccatgacagaattccaaggcatggtggggaggagctgattgaataaatcggtagcacccaattcgtcgatgacccagttatcgctatccagatcgataatagtcttgtcgaagtcgaaaaccaccacgattccgccacccattttcggcgacccaaataaaaccaaaggacttgataattgttgtaggtatccccatgtactctgcgttgataccactgcttccttataatacgctcactgcactcctcccccaagtttctggccgtaaacataccctttcatcgacatcttctgtattgcaaaatctcaactttctgtatcagtctccgaaaaaaaagcatgtatagatttgcagcaaatcttgcctccaaagctaggattgctacaaacagcacccaacagattggcagtaggctgagttggagcagaaactatgcggccaaggatattagatttggagttgaagcccgggctttgatgcttaagggcgttgaagagcttgctgatgcagttagagtaactatgggccctaaggggcgtactgtggtgattgaacagtcttatgggccacctaaggttacaaaagatggtgttactgtagccaagagtattgaattcaaggacaaagtgaagaacattggggcaagccttgtcaaacaggttgcaaatgccaccaatgatgttgctggtgatggtactacatgtgccaccatcctcacccgcgcgatctttacggaagggtgcaagtcggttgcagctggtatgaatgcaatggaccttagacgtggtattaccatggctgttgatgctgtggtaacaaatttgaagagcagggcacggatgataagcacatctgaagaaatagcacaggtcggcacaatatctgcaaatggtgagagagagattggtgagctaatcgcgaaagcaatggagaaagttggcaaggagggagtaattactattcaagatgggaagacattgtataatgaattggaagttgttgaaggaatgaagctcgacaggggctacatttccccatattttatcacaaaccagaagacccagaaatgtgaattagatgaccctctcattttaatccacgagaagaaaatctcaagtataaatgctgtggtgaaagtactagaattagcattgaagaaacaaaggccccttctgattgttgctgaagatgtggaaggtgaagcacttgcaacactcatcctcaataagcttcgtgcaggagtcaaggtctgtgcaatcaaagctcctgggtttggagagaacagaaaggctaatcttcaggatcttgctgttcttactggaggccaggttataactgaagaacttggtatgaaccttgataatgtagagttagatatgtttggttcgtgcaaagaggttacaatatccaaagatgacacagttgttcttgatggcgctggtgacaaaaaggctatagaagaaaggtgtgaacagataaggtcagcaatcgagtcgagcacttctgattatgacaaggagaagtttcaagaaagattagcaaagctttctggcggtgttgctgtattgaagattggaggagctagtgaaactgaagtaggtgagaagaaagatagagtaacagatgctctgaatgccactaaggcagctgtagaagaaggaattgtgccaggtggtggtgttgctcttctctatgcaaccaaagagttagacaaactgccaacagccaactttgatcagaagatcggcgtacaaattattcgggatgccttgaagacaccagtgcatacgattgcctctaatgccggagtagagggtgctgttgttgttggcaagctgttggaacaggacgaccctgatcttggttttgatgcagccaaaggtgcatatgttgacatggttaaggctggaattattgatccattgaaagtaataagaacagcattggttgatgcagcaagtgtatcttccttgatgacaactacagaagctatcgttgttgaacttcctaaggaagagaaggaagtcccaatgggcggcggcatgggcggcatggatttttgatagtcttcctaaaatgaaactgattcaacctacgcatacattagtttggatgcatggatttttcccagtaggagaggttta

SEQ ID NO: 962 - DNA, 2398 bp, Gossypium raimondii
aaaaaactgaagagttttttattttaatatttctttaaaaaagaaaaagaaacgttaaaaaaatgaagttggaatgataaaaccctaaaccctaaagaagggttaagaaactgctgctcctgcttctagacccttcttctctcccatctctttctgggtttccttttccctcttttaaaacccacccctgaaacccacccattgtcttttgtcaacccacaaacagctttactgttaacattttactcaagattttcctccatttctttcctcccaaaataaccatgtatcgttttgcttcaagccttgcttctaaagctagggctgctaggaacactacatatcagattggtagtaggttgagttggaataggaactatgctgcaaaagatattaaatttggggttgaagctcgagctttgatgcttaaaggtgttgaagagctttctgatgctgttagagtaaccatgggtcctaagggtcggaatgtggttattgaacaaagctacggtgctccaaaagtgactaaagatggtgtaactgttgcaaagagtattgaattcaaagacaaagtgaagaacgttggtgcgagtcttgtgaaacaagttgcaaatgccaccaatgatgtagctggtgatggaactacctgtgcaacggtgcttacacgagcaatttttaccgaaggatgcaagtctgttgctgcaggaatgaatgcaatggaccttaggcgtggcataacaatggcagttgatgccgttgtaacaaacttgaaaagccgggcaaggatgattagcacatctgaagagattgctcaggttggaacaatatcggctaatggagagagggaaattggtgagttgattgcaaaggccatggagaaagttggcaaagaaggggtgataacaattgaggatggtaaaacattatataatgagttggaagttgttgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctgcgctcattcttaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaaaaaagccattgaggaaagatgtgaacagattagatcagcaattgaattgagcacctctgattatgataaggagaagttgcaagagagattggcaaaactttctggtggtgttgctgtcttgaagattggtggagctagtgaagctgaagttggagagaagaaggatagagttacagatgcattaaatgctacaaaggcagctgtagaggaaggcatcgtgccaggaggtggtgttgctcttttatatgcatcgaaagagttggacaagctacctacggccaactttgaccagaagattggtgttcaaatcatccagaatgctctaaagacacctgtgcacacaattgcttcaaatgctggagtcgagggagctgttattgttggtaagctgttggagcaggataaccctgatcttggctatgatgcagccaaaggtgaatatgtcgatatggtaaaggctggtattattgatccattgaaagtaattagaactgctttggtcgatgctgcaagcgtgtcgtcattgatgacaactaccgaagctgttgtagtcgaacttccaaaggatgagaaggatgttccggcaatgcctggcggtatgggtggcatggattattaaggtgaaggaactaattgtctacttcaagctctcttagctacagcttgaattaccatctctcccttgtccttgaaggttaaaggtctgagagttggcattcccaaagaaaaacaacctacagcttgaagtgatatgttgagtggaaatgtggacaagtatttgcattactttcattaacgaaattagaatcaagtaatctatttgaatttattagtaatcaaaatttggttctatcatcttcaaatccaacttaagtagtttgaatccatgtgcatttttaaaaaaaattgtgggcaacaatcttggaagagtttacgggtcttaagatttaagtttcattcattcatcaagtttgtaatcttaatcctatattctcgttaagatca

SEQ ID NO: 963 - DNA, 2681 bp, Mimulus guttatus
aaaccctaaaaccctaatctccttctagactcttctcttctcttctctctctttttatatacacacacactccatttcatctctgccaaacaatctctctctctcacacaagtttctctctctaaaagactgaagcatgtaccgttttgcagcaaatcttgcctccaaagccagggttgcaagaaacagcagccagcagattggtggtagattaggtgggttgagaaattatgcagctaaagatattagatttggagttgaggctagagctttgatgcttaagggtgttgaagaacttgctgatgctgttaaagttactatgggccctaaggggcggaatgtagtgattgaacaaagttggggcgccccgaaagtgacaaaggacggcgtgacggttgcaaaaagcatcgaatttaaggacaaagtcaagaacatcggtgcaagcctcgtaaagcaggtggcgaatgctacaaacgatgctgccggtgacggtacaacatgtgctactgtcctcactcgtgcaatattcgccgagggctgcaaatcagtggcagctggcatgaacgccatggatctaagacgtggtattacaatggctgtcgatgctgtggttacaaacttgaaaagcagagcaagaatgataagcacgtccgaggagattgctcaggttggaacaatttctgcaaacggagatagagaaatcggcgagctgattgcgaaggctatggaaaaagtcggcaaagagggtgtcatcacaattcaagatgggaagactttgttcaatgaattggaagtcgtcgaagggatgaagctagacagaggttatatctccccgtacttcatcacaaaccaaaagaaccaaaaatgcgaattggacgaccctctaattctgatttacgagaagaaaatttccagcattgcttcaattgtgaaagttcttgaactggctttgaagagacaaaggcctcttctgataattgctgaagacgttgagagcgatgcacttgcaactcttattctgaacaagcttagagctggcattaaggtttgtgctgtaaaagctccaggatttggtgaaaacaggaaatcgaacatgcaggatcttgctgttttaactggaggccaggtcataactgaggagctgggaatgaacctagatgacgtggagcttgatatgctcggctcgtgcaagaaggtcactatatcgaaggatgataccgttgtacttgatggagctggtgagaagaaatcgattgaagaaagatgtgaacagattaggtcaacaattgagttgagcacttcggattacgacaaggagaagttgcaagaaaggcttgctaaactttctggtggtgtcgctgtgctaaagattggaggagctagtgaagcagaagttggtgagaagaaagacagagtaacagatgctttaaatgcaacgaaagctgcagtcgaagaaggaattgtacccggtggaggtgttgctctactctatgctgcaaaagaattagataaattggcgaccgcaaacttcgatcagaagatcggtgttcaaattattcaaaacgcacttaagatgcccgtttatacgatagcagcaaatgctggagtagaaggtgctgttgtcgtcgggaaattgttggaatcggtagatcccgatcttggttatgatgcagctaaaggtgaatacgttgatatggtgaaagctggaattatcgacccgttgaaagttatcagaacagcccttgtagatgctgctagcgtgtcttctttgatgacgactaccgaggcgattgtggtggagcagccaagtagcgataaggcgggaccaccaatgggtggcggcggcatgggcggcatgggtgacatggattattaagaagctgtgaaagatgatttaactatgccctgactatatatttgtttaaaacaaaaaaaaaaacaaataaatctaggtttttcctttttgtgccgttttgacgagggttttttagttgcgggacctaatttatcgtattaaatacgaaggattgatgagaaaattcgggcaaaaacaatgattcgtgtagagggttattagactctgtaattgtttcgaacaattgccgttgttttgggtaattattgtctatctatggttatctaacaacttgcttttggttgaaccaaatacgtgcacgtgtttgattaataaaattcgtttttcttaccgatcgacgaatggattatctcgtgtcgtaatttccaaatttgttgctagaacataacctctctgaataaaatgtggtaagaactggaaaatcaatcttaaagacaattttacacactaactagtggcgacttttgattgcgaaaattcgggaaaatcgggatgacaaaagagttgtgaacacttattgaaataataaagacattcaaatacaattgcttctagtacatctagttttctaggtcagagaagtgatcttctccatattacttacatagggcagccccgattctcgatgaaaatcccgaacgaaaaaaaaaaaaacggaatgaaaaaagtcaaaaatattagcaacctataaaataaagttggaaattcgttatctcgtttttctacgcctttgagttccaacacaatccgagcagtaccattttcctttcggctgttcttttagtccaacgcagccatagtggaa

SEQ ID NO: 964 - DNA, 2024 bp, Raphanus sativus
ttccatcgatctccctttctcgtcctcccactcatctcctcccagttatctcttcgttcatcttcttcttccttctcagccaccatgtttcgtttcgtttccagtctcgcctccaaggccaggattgcaagtaacacaagacaggtttccagcaggatgagctggagcaggaactatgcagcgaaagagattaagtttggggtcgaagctcgtgctttgatgcttagaggtgttgaagagcttgccgatgctgttagggtcactatgggtcccaagggacgaactgtcgtgattgagcaaagctggggagctcctaaagtgactaaagatggtgtcaccgttgccaagagcattgagtttaaggataaagtgaagaacgttggtgccagtcttgtcaagcaggttgctaatgctactaatgatgtcgctggtgatggtactacatgtgctactgtgctcaccagggcgatattcacggaaggttgcaaatcagttgcagctggaatgaacgccatggacctgaggcgaggtatttccatggcggttgatgctgtggtgacaaaccttaaaagcagagctaggatgatcagcacatccgaggagattgctcaggttgggaccatttctgcaaatggagagagggagattggtgaattgattgcaaaagctatggagaaggttgggaaagaaggtgtaatcacaatccaagatggaaagacattgattaacgagttggaagttgtagaagggatgaagctggacagaggttacacatccccttactttatcaccaatcagaaaacccaaaaatgtgaactggaagagcctctcattcttatccatgagaagaagatctcctccatcaactctattgtgaaagtgttggagttggctatgaagagacaaagaccactcttgattgtttctgaagatgtggagagtgaagctcttgcaacccttatccttaacaagttgcgtgccggaatcaaggtttgtgccatcaaggccccagggtttggagagaacaggaaggccaatttgcaagaccttgctgcccttactggtggagaggttatcacggatgagcttggcatgaacctagagaaggtggatttaagcatgctagggacctgcaaaagggttactgtctccacggacgacactgttattctcgacggggctggcgacaagacagccattgaggaaagatgcgagcagattaggtcagcagtcgaactgagcacctcagattacgacaaggagaaactgcaagaaaggttggctaagctctctggaggagttgctgttttgaagattgggggagcaagtgaagctgaggttggtgaaaagaaagacagagttacagatgctttgaatgccactaaagcagctgttgaagagggtattttaccaggaggaggtgtggctcttctatacgcagcgagagagttggagaaacttccaacagccaacttcgaccagaagattggtgtgcagatcattcagaacgctttgaagacacctgttcacacaattgcttcaaacgctggcgtcgaaggtgctgttatcgttggaaagctcttggagcaagataacacagacctcggttatgatgctgctaaaggtgaatatgtggatatggtgaaagctggtatcatagatcctctgaaagtgatcaggacggctctggttgatgctgctagtgtgtcatctctgttgacgacaactgaagctgtagttgtggatcttcccaaagatgaaagcgagtcagcaggagctggagcaggcatgggtggaatgggaggcatggattattagttacatttactaaaactcttttgttttttattcaccaatcatcaccttaacttgagaaaagagagactattcgtttaggagtcttttgtcctttgcctgtgttttacgaaataataacaattaaacaggacatcattgcctgtttaactatgtggactgtttattagttttgtcgcctaattttaaagtcacacatagagcagaca

SEQ ID NO: 965 - DNA, 2833 bp, Brassica oleracea
ctcgcttgctcgttctcctatttgtctcttttctttagcttcttcatcgtgcatcttcttccttctcagcgaccatgtttcgtttcgtttccagtctcgcctccaaggctaggattgcaagtaacacaagacaggtttccagcagaatgagctggagcaggaactatgcagcgaaagagattaagtttggggttgaagctcgtgctttgatgcttagaggtgttgaagagcttgccgatgctgttagagtcactatgggtcccaagggacgtactgttgtgattgaacaaagttggggtgctcctaaagtgactaaagatggggtcaccgttgccaaaagcattgagttcaaagataaagtgaagaacgttggtgccagtcttgtgaagcaggttgctaatgctactaatgatgttgctggtgatggtactacatgtgctactgtgctcaccagggcgatattcacggaaggctgcaaatcagttgcggcaggaatgaacgctatggacctgaggagaggtatctccatggcggttgatgctgtggtgacaaaccttaaaagcagggcgaggatgatcagcacatctgaggagattgctcaggttgggaccatttctgcaaatggagagagggagattggtgaactgatcgcaaaggctatggagaaggttggcaaagaaggtgtgatcacaatccaagatggaaagacgttgattaacgagttggaagttgtagaagggatgaagttggacagaggttatacttccccttactttatcaccaatcagaaaactcaaaaatgtgaactggaagagcctctcattcttatccatgagaagaagatctcctccatcaactctatagtgaaagtgttggagttggctatgaagagacaaagaccactgttgattgtttctgaagatgtggagagtgaagctcttgcgacacttatcctaaacaagctacgtgccggaatcaaggtttgtgccatcaaggccccagggtttggagagaacaggaaggccaacttgcaagaccttgctgcccttactggtggagaggttatcacggatgagcttggcatgaatctagagaaggtggacttgggcatgctagggacctgcaaaagggttactgtctcaaaggacgacactgttattcttgatggggccggtgacaagacagcaattgaagagagatgcgagcagattaggtcagcaattgaactgagcacctcggattatgacaaggagaaactgcaagaaaggttggctaagctctctggaggagttgctgttttgaagattggaggagcaagtgaagctgaagttggtgagaagaaagacagagtgacagacgctttgaatgccactaaagcagctgttgaagagggtattttgccaggaggaggtgtggctcttctatacgcagcgagagagttggagaaacttccaacagccaactttgaccagaagattggtgtgcagatcattcagaacgctttgaagactcctgttcacacaattgcttcaaacgctggagttgaaggtgctgttatagttggcaagctcttggagcaagataacacagacctcggttatgatgctgctaaaggtgaatatgtggatatggtgaaagctggtatcatagatcctctgaaagtgatcaggacagctctggttgacgctgccagtgtgtcttctctgttgacgacaactgaagctgtagtggtggatcttcccaaagatgaaagcgagtcagcaggggctggagcaggcatgggtggaatgggaggcatggattattaattacatcactaaaactcttgtcctttttttcaccaatcatcacaccttaacttgagagagaggagggacacgattcttgtaggagtctgtttttgcccgtgtttgcccaataaaaacaattaaacaggacattgcctgtttttgctatatggatctgtttattagttttgcctaatttaaagtctacaaataatgcgcacagccactttcttctcgttgatggtatcaagccacaacatcaatagaccaccatgaaccagagctagattcatacctttcaatcctaccaaatttgtcttttcgccggtttagtgaccaagtgatacggtatatagttttacacttttacttgtacataaacatttgcggttaatgattttgaataataaggaaacatttttcattaaggaaaggaaacaacacgcaagcacaacacaacattaaacaggtgatgataaaatgcagcaacagacaagaaaacacagaaacaacaagaacaatgatccaaactagaacgcaaaagaaaccaaacacatcttaaagctagagacaatggatcttaatctctctcagacactctctcatggagacaccaaaccacctcctgagctgggaacagaaccgccaccattacctccaataccaggaaaccccattgcaccacccaaaccaccaaacgcaccagacccaccaagaagcggtgtcccggatgggagaggcaacgtcataccggtcccaccacctggcatccccatgaatccgcctattccagcagcaccaccgacaatgaagttcttttggtcgtcgagaggggcattgacggtaggagcctcagctttggtaggagaagcagctccttgaagaggcagtgtctgagtctgctgcaagttgcgagcacttgagtgggacacaagcaacgcagctgcagagaccagaaggactaggttggtgagtgatgagaaactcatagccattttgtatttttaccacgaacaaatgtgatgttttgtgtttgatttgatagc

SEQ ID NO: 966 - DNA, 2146 bp, Trifolium pratense
agagacttctcttttcccttcaaaaataaactctgcagcattcttcattcaacaaaaacacacactttctgcaatttcttcactcttcaattcaattttctcacttccatcaacaccatgtaccgatttgcttcttcccttgcctccaaagctcgaattgctaggaatagcactcatcagattggaagtagagtggcatggagtagaaattatgcggcaaaagagatcaaatttggtgtggaggctcgggctttgatgcttaagggtgttgaagagcttgctgaggcagttaaagtaaccatgggtcctaagggccgtaatgtggttatcgagcaaagttttggtgcccctaaagtgacaaaagatggagtaacggttgctaagagcattgaattcaaggataaagtcaagaatattggtgccagtcttgtaaagcaggttgcaaatgctaccaatgatgtggctggtgatggaactacatgtgctacaattcttactcgagcaatatttgcggaaggttgcaaatcagttgcagctggaatgaatgcaatggacctgaggcgaggtataaacatggctgttgatgctgtcgtgacaaacttgaaaagccgagcacggatgattagcacttctgaagaaatagctcaggttgggacgatatctgctaatggtgacagagaaattggtgagttgattgcaaaagctatggagaaagttggcaaagaaggtgtaatcacaatcgccgatggcaagacattggacaacgagttggaagttgttgaaggaatgaagcttgaccgaggctacatttctccatatttcataacaaaccagaagaatcagaaatgtgaacttgaggatcccctcattataatccacgagaagaaaatctcaagtattaattccatagttaaagtattagagttagctttgaagaaacaaagacctttattgattgttgccgaggatgtggaaagtgatgcacttgcaactcttattctaaataagcttcgtgctggaatcaaggtatgtgcgatcaaagcccctggttttggtgaaaaccggaaatctggtctccaagatcttgctgttcttaccggaggtcaacttatcaccgaagagcttggcttgaatcttgaaaaagttgatcttgacgtgtttggctcttgcaaaaagattacaatttccaaagatgacactgtcattcttgacggtgccggtgataagaaagctatcgaggaaagatgtgagcagattaggtcggcagttgaaaacagtacttcagattatgacaaggagaaattacaggaaagattggccaagctttctggtggtgttgctgtgcttaagattggaggagccagtgaggctgaagttggtgagagaaaggatagagtgacagatgccttaaatgcaaccaaggcagctgtagaagagggcatagttcctggtggtggtgttgctcttctttatgcgtcaaatgagttaagtaagcttccaactgccaattttgaccagaagataggtgtccagattattcaaaatgctttgaagacacctgttcacacaattgcatcaaatgctggagttgagggggctgttgttgttggtaaactattggaacaggataatcctgatcttgggtacgatgccgccaaaggtgaatatgttgatatggttaaagctggaataattgatccattgaaggtgattaggaccgccttggttgacgcagccagtgtgtcatctttaatgacaacaactgaagctattgtgtctgatctcccaagtgacgataaagatggttctgctatgcctggtggcatgggcggcatgggtggcatgggtggttattagtgtggatgaatctagctttctttcactgaaccttgattagagagtggggcttcaccactgttatttttgcttattatttcttgacagaaggcatcaatatgtaaccatagcagagagattaaatctgtaggtagtagagaggaaagatttgtgattgtcatttattgcaataacaatgataatttagacatttggaacaatttttaccctccaaattagtgagaaattgttgacacataaagtttgtctggtcctttcaagggaatgtggttttaattatgctattgtt

SEQ ID NO: 967 - DNA, 1953 bp, Brassica juncea
atcgaagcaagaaaattaaattggaaaatgaagttaaatcccaaagccctaaaaccctaaaaggggacgcattaaacaagtagcagctgctgtttctagagtcttctccttcgttttattaagagtcctccacgcttctttctctccatcgatctcccagttatctcttccttagcttcgtcatcgttcatcctcatccttctcagccaccatgtttcgtttcgtttccagtctcgcctccaaggctaggattgcaagtaacacaagacaggtttccagcagaatgagctggagcaggaactatgcagcgaaagagattaaatttggggttgaagctcgtgccttgatgcttagaggtgttgaagagcttgctgatgctgttagagtcactatgggtcccaagggacgtactgttgtgattgagcaaagttggggtgctcctaaagtgactaaagatggtgtcacagttgccaaaagcattgagttcaaggataaagtgaagaacgttggtgccagtcttgtgaagcaggttgctaatgctactaatgatgttgctggtgatggtactacatgtgctactgtgctcaccagggcgatattcaccgaaggttgcaaatcagttgcagcaggaatgaacgctatggacctgaggcgaggtatttccatggcggttgatgcagtggtgacaaaccttaaaagcagagctaggatgatcagcacatccgaggagattgctcaggttgggaccatttctgcgaatggagagagggagattggtgaactgattgcaaaagctatggagaaggttggcaaagaaggtgtaatcacaatccaagatgggaagacattgattaacgagttggaagtcgttgaagggatgaagttggacagaggttatacttccccttactttatcaccaatcagaaaacccaaaaatgtgaactggaagagcctctcattcttatccatgagaagaagatctcctccatcaactctatagtgaaagtgttggagttggctatgaagaaacaaagaccgctgttgattgtttctgaagatgtggaaagtgaagcacttgcaactcttatcctcaacaagctacgtgctggaatcaaggtttgtgccatcaaggccccagggtttggagagaacaggaaggccaatttgcaagaccttgctgcccttactggtggagaggttatcacggatgagcttggcatgaatctagagaaggtggacatgggcatgctagggacctgcaaaagggttactgtctcaaaggacgacactgttattcttgatggggccggtgacaagacagccattgaagagagatgcgagcagattaggtcagcaattgaactgagcacctcggattatgacaaggagaaactgcaagaaaggttggctaagctctctggaggagttgctgttttgaagattggaggagcaagtgaagctgaggttggtgagaagaaagacagagtaacagatgccttgaatgccactaaagcagctgtcgaagagggtattttgccaggaggaggtgtggctcttctatacgcagcgagagagttagagaaacttccaacagctaactttgaccagaagattggtgtgcagatcattcagaacgctttgaagactcctgttcacacaattgcttcaaacgctggagttgaaggtgctgttatagttggcaagctcttggagcaagataacacagaccttggttatgatgctgctaaaggtgaatatgtggatatggtgaaagctggtatcattgatcctctgaaagtgataaggacggctttggttgatgctgccagtgtgtcatctctgttgacgacaactgaagctgtagtggtggatcttcccaaagatgaaagcgagtccgctggagcaggaggcatgggtggaatgggaggcatggattattaattacatcacta

SEQ ID NO: 968 - DNA, 1961 bp, Gossypium hirsutum
accatgtatcgttttgcttcaagccttgcttctaaagctagggctgctaggaacactacatatcagattggtagtaggttgagttggaataggaactatgctgcaaaagatattaaatttggggttgaagctcgagctttgatgcttaaaggtgttgaagagctttctgatgctgttagagtaaccatgggtcctaagggtcggaatgtggttattgaacaaagctacggtgctccaaaagtgactaaagatggtgtcactgttgcaaagagtattgaattcaaagacaaagtgaagaacgttggtgcgagtcttgtgaaacaagttgcaaatgccaccaatgatgtagctggtgatggaactacctgtgcaacggtgcttacacgagcaatttttaccgaaggatgcaagtctgttgctgcaggaatgaatgcaatggaccttaggcgtggcataacaatggcagttgatgccgttgtaacaaacttgaaaagccgggcaaggatgattagcacatctgaagagattgctcaggttggaacaatatcggctaatggagagagggaaattggtgagttgattgcaaaggccattgagaaagttggcaaagaaggggtgataacaattgaggatggtaaaacattatataatgagttggaagttgttgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctgcgctcattcttaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaagaaagccattgaggaaagatgcgaacagattagatcagcaattgaattgagcacctctgattatgataaggagaagttgcaagagagattggcaaaactttctggtggcgtggctgtcttgaagattggtggagctagtgaagctgaagttggagagaagaaggatagagttacagatgcattaaatgctacaaaggcagctgtagaggagggcatcgtgccaggtggtggtgttgctcttttatatgcatcgaaagagttggacaagctacctacggccaactttgaccagaagattggtgttcaaatcatccagaatgctctaaagacacctgtgcacacaattgcttcaaatgctggagtcgagggagctgttattgttggtaagctgttggagcaggataaccctgatcttggctatgatgcagccaaaggtgaatatgtcgatatggtaaaggctggtattattgatccattgaaagtaattagaactgctttggtcgatgctgcaagcgtgtcatcattgatgacaactaccgaagctgttgtagtcgaacttccaaaggatgagaaggatgttccggcaatgcctggcggtatgggtggcatggattattaaggttattccccctaacagtgcaccgattgtaagtgttttcatctaatctatttccatttcctcaacatctgtgagaaaaaagattatccgagttttgatgtttaagttggaaggcttccatgtaatcataaattgagagctatttggtggttttggtgataaagggtcaacaaaactctcattgtttttgctagaaagaaaggactacattgtattggaccatttttctt

SEQ ID NO: 969 - DNA, 2011 bp, Medicago truncatula
caactctgcagcgtttcttccttcaattcaacaacactctctgcaatttcttcaattcaattttctcagttccaattccaatcacactatgtaccgatttgcttcatcacttgcctccaaagctcgaattgctaggagcaacgctaatcagattggaagtagggtggcatggagcagaaattatgctgccaaagagatcaaatttggcgtggaggctcgtgctttgatgcttaagggtgttgaagaacttgctgaggcagttaaagtaaccatgggtcctaagggccgtaatgtggtgattgagcaaagctttggtgcccctaaagtgacaaaagatggagtcactgtggctaagagcattgaattcaaggataaagtcaagaatattggtgccagtcttgtaaagcaggttgcaaatgctaccaatgatgtcgctggtgatggaaccacttgtgctactgttcttacccgagcaatatttacggaaggatgcaaatcagtagcagctggaatgaatgcaatggacctgaggcgaggtataaatatggctgttgatgctgttgtgacaaacttgaaaagcagagcacgaatgatcagcacttctgaagaaatagctcaggttggcacaatatctgctaatggggatagagaaattggtgagttaattgcaaaagccatggagaaagttggcaaagaaggtgtaatcacaattgctgatggcaagacattgcaaaatgagttggaagttgttgaaggaatgaagcttgaccgaggctacatttctccgtatttcataacaaaccagaagaaccagaaatgtgaactcgaggatcccctcattataatccatgagaagaagatctcaaatataaattctatagttaaagtattagagttagctttgaagaaacaaagacctttattgattgttgctgaggatgtggaaagtgatgcccttgcaactcttattctaaataagcttcgtgctggaattaaggtatgcgcgatcaaagcccctggttttggggaaaacaggaaatctggtctccaggatctcgctgttcttacaggaggtcaacttatcactgaagagctcggcatgaatcttgaaaaagttgatcttgaaatgtttggctcttgcaaaaagattacaatttctaaagatgacactgtcattcttgatggagccggtgataagaaatcaattgaggaaagatgtgagcagattaggtcggcagtcgaaaatagcacttcagattatgacaaggaaaaattacaggaaagattggccaagctttctggaggagttgcggtgcttaagattggaggagccagtgaggctgaagttggtgagaaaaaagacagagtaacagatgccttaaatgcaaccaaggcagctgtagaggagggcatagtacctggtggtggtgttgcacttctttatgcatcaaatgagttaagtaagcttccaaccgccaattttgatcagaagataggtgtccaaattatccaaaatgctttaaagacacctgtgcatacaattgcatcaaatgctggagtcgagggtgctgttgttgttggtaaacttttggaacaggataatcctgatcttggttacgatgccgccaaaggtgaatatgttgatatggttaaatctggaataattgatccattgaaggtgattaggaccgccttggttgacgcagccagtgtgtcgtctttgatgacaacaactgaagctgtcgtttctgaactcccaaaagaagataaagatactcctgccatgcctggtatgggtggtatggactattagctgctatgaagacttggattggagtggtgcttcaacactgttatagcctctctttttcttatttatttgacataaggcatccatgtaatcatagtgagagattaaagctgtaggtaggtagatttgtgattgttattgctatgatgtagttgaaacatttggaacaattttcaatccaattcattccaaaatattgag

SEQ ID NO: 970 - DNA, 1910 bp, Elaeis guineensis
gacttctagaggctcgtcctctcttctctaaacccccctgcaccccgtccttcctttcctccgctccattcccatctgagttccgctcgtcgccaacgctaaccctgagcttactcttcttcttccgtcatcgccaacgcttcaatccacttgtctccaccatgtaccgtgctgcggccagcctcgcctccaaagctcggattgccgggagcagcagccgacagattggaagtaggcttggttggagcagaaactatgcagccaaggacatcagatttggagttgaagctcgtgctttgatgcttaagggcgtggaagagcttgctgatgccgtgaaggtgactatgggacccaagggccgcaatgttgttttggagcaaagctttggcgcaccaaaagttacaaaggatggggtgactgttgcaaagagcattgagtttaaggacaaagtgaagaatgtaggtgcaagccttgtgaagcaggttgctaatgcaactaatgatgttgctggtgatggtacaacgtgtgctactgtccttacgagagcaatattcactgaagggtgcaagtcagtggcagctggcatgaatgcaatggatctaaggcgtggcatcacaatggctgttgatgctgtggtgaccaacttaaagagcagggctagaatgattagcacttcagaagagatagcacaggttggtaccatatcagcgaatggagaaagagagattggtgagctaattgccaaggctatggagaaagttggcaaagagggtgtaatcaccattgcagatggaaacactctgtacaatgaattggaagttgtagaaggaatgaaacttgacaggggctacatatctccctatttcattactaaccaaaagaaccaaaaatgtgaattggaggatcctctcattctgatacatgagaagaaaatttcaagcattaatgcggtggtgaaagtgttagagttggccttgaaaaaacaaaggcctctactaattgttgctgaggatgtggaaagtgatgccttggctactctcatccttaataagcttcgcgcaggcatcaaggtctgtgccattaaggctcctggttttggggagaacaggaaatccagcttgcatgaccttgctatcctcactgggggtgatgttattaccgaagaacttggtatgaaccttgagaaagtagaatttgacatgcttggtacatgcaagaaggtgacaatatcaaaagatgacactgtcattcttcatggggctggagacaagaaggccattgaagagagatgcgagcagctgagatctgcaattgaagcatccacttctgactatgataaagagaaactacaggaacggttggcgaagctttctggaggtgttgctgtcctgaagattggaggggccagtgaagctgaagttggtgagaggaaggatagagtaactgatgctttgaatgcaaccaaggctgcagttgaagagggtattgtgacaggtggtggtgttgctcttctctatgcatcaaaggagttggagaagttgcagacagctaactttgatcagaaaattggagttcaaataatccagaatgctttgaagaccccagtgcacaccattgccacaaatgcaggagttgagggcgctgtggtaattggcaagcttttggagcaggataatcctgaccttggttatgatgcagccaaaggtgaatatgtggacatggttaaagcaggtatcattgaccctctgaaagtgattagaactgcattggtggatgctgcaagtgtttcctcattgatgactacaactgaagctgttgttgtagaactcccaaaagaagagaaggatgtcccagccatgagtggaggcatgggaggaatggattaactaaaaaaaaaaaaaatagaaaag

SEQ ID NO: 971 - DNA, 2232 bp, Arachis hypogaea
aaggaagtgtgctccattgttcatctcaaccattaagcccttcaatttctcggtgcatttctcagttttactttgctaaattcaatccaccaccatgtaccgctttgccgcttctcttgcctcaaaagctaagattgctaggagcagcagtcaacagattggaagtaggtggaactggaacaggaactatgcggcaaaggacattagattcggtgtggaagctcgcgctgtgatgcttaagggtgttgaagagcttgccgacgctgtcaaagttacaatgggtcctaaggggcgtaatgtggtgattgagcaaagttttggtgccccaaaagtaacaaaagacggagtaaccgttgcaaagagcattgaattcaaggataaggtcaagaatattggtgctagtcttgtgaaacaggttgcaaatgcaactaatgatgttgctggtgatggaaccacatgtgctactgttcttactcgagccatttttatggaagggtgcaagtcagttgcagctggaatgaatgcaatggacctgaggcgaggtataaatatggctgttgatgctgtggtgacaaacctgaaaagcagagcaaggatgattagtacttctgaagaaatagcccaggttgggacaatatcagcaaatggggagagagaaattggtgagctaattgcaaaagctatggagaaagttggcaaagagggtgtaatcacaatctcagatggcaagactttgtacaatgagttagaagttgttgaaggaatgaagcttgacaggggatacatatctccatatttcataactaaccagaagaaccagaaatgtgaacttgaggatccactgattctaatccatgagaagaaaatctcgagtattaatgctatagtcaaagtattagagttggctttaaagaaacaaagacctctgttgattgttgcggaggatgtggaaagtgatgcccttgcaactctcattctaaacaagcttcgtgctggaataaaggtatgtgccatcaaagcacctggttttggtgaaaataggaagtcaggcctccatgatcttgctgttcttacaggaggtgaacttatcactgaagagcttggcatgaatcttgaaaaagtgcattcggaaatgcttggcacttgcaaaaaggtgacaatttctaaagatgatactgtcattcttgatggagctggtgacaagaaagcaattgaggaaagatgtgatcagattaggtcagcaattgaaaatagcacttcagattatgacaaggaaaagttgcaggaaagactggccaagctttctgggggtgttgcagttcttaagattggaggagctagtgaggctgaagttggtgagaagaaggatagagtgacagatgccttgaatgcaaccaaggccgccgtagaggagggcatagtacctggtggtggtgttgctcttctttatgcatcaagtgagttagataagcttccaactgccaactttgatcaaaagataggtgtacaaattatccaaaatgctttaaagactcctgtgcacacaattgcgaccaatgcgggagttgagggtgctgttgttgttggcaaacttttggaacagaacaaccctgatcttgggtatgatgcagcaaaaggtgaatacgttgatatggttaaagctggaattattgatccactgaaggttattagaaccgccttggttgacgcagccagtgtatcatctttgatgacaacaactgaggctgttgtttctgaactctcaaaggatgacgaggctccttcaatggctggtggcatgggtggtatgggtggcatggattattagtttggcttccttttgattattaatacttgaaaaagaatggtgcttcactaatttatagcctgtgtcttatttgttatcacaaagcatccgtgtgtattcatagtgagagatcaaatagatagttaggaagggtttttttttgttgttgttgcaatgataacaaataagatagttgggacatttttacagtgtgatctacagaacgttgtttccctgtgaaattgtcaattgaaagaggtctctactaatttgacggttaaagttaacccctttagctttacatgtactaaataattgtttttaccatgaatttaaataatttgagatgtccaaaagtgacaaattttgtaaaaaaaagaaaaaaaaacaaaagtactctgcgttgataccactgctctctatca

SEQ ID NO: 972 - DNA, 2195 bp, Citrullus lanatus
ggggtgtaatgtttccatttccgactaaaccctaaaccctagaaggtgctgtggtttgagtttgtttctagagccttcttctccacactattaaacccattcactctccgcatttcgtcgcctttcccttctcttctcactgctcttcttcttcctctcgctgctcccatctcctacctttttgggtttcagcggacgtctacaatgcaccggttcgccacaggcctcgcttccaaagcccgccttgctaggaacagtaccaatcagattgctagtaggtctagctggagcagaaactatgccgccaaagatgttaaatttggggtggaggctcgaggtcttatgctcaagggtgttgaagatcttgctgatgctgttaaagtcacaatgggtccgaaggggcgcaatgtagtgattgaacaaagttatggggctcccaaagttacaaaagatggtgtaactgttgcaaagagtatcgagtttaaagataaagttaaaaatgttggtgccagtcttgtgaagcaggttgctaatgcgaccaatgatgtggcaggcgatgggaccacttgtgctactattcttacaagagcaatatttacggagggttgcaagtccgttgctgctggaatgaatgccatggatttaagacgtggcatctccatggcagtcgattctgtagtaacaaacttgaagagtagagcacgaatgataagcacatctgaagagatagctcaggtcgggacaatatctgcaaatggagaaagggagattggtgagttaattgccaaggccatggagaaagttggcaaagagggcgtgatcaccatcgcggatgggaaaacattgtataatgagttggaagttgttgaagggatgaagttagacaggggatatatttccccttacttcattacaaaccaaaagaatcagaaatgtgaattggaggatcctcttattctaatccatgaaaagaaaatctcaagcataaatgctgtggtgaaagttctagagttggctctgaagaggcaaaggccccttcttattatttccgaagatgttgaaagtgatgcactagccactcttatcctgaataagctccgcgctggaatcaaggtctgtgccattaaagcaccaggttttggggaaaataggaaggctggactgcaggaccttgcagttctcacgggtggtgaagtcattactgaagagcttggaatgaatcttgagaaagttgatctggatatgcttggctcttgcaagaagatcacaatttcaaaggatgatacagttattcttgatggtgccggtgacaagaaagctattgaggaaaggtgtgaacagataagggctggtattgaagcaagcacttcagattatgacaaggagaagttacaggagagattagcgaaactctctgggggtgttgctgttttaaagattggaggagcaagtgaggcagaagtgggcgagaagaaggatagagtcaccgatgccttgaatgccacaaaagcagctgttgaagaaggaatagtaccaggtggtggtgttgctcttttgtatgcatccaaagaactagaaaaacttccaacggccaacttcgatcagaagattggtgtccagattattcagaatgctctaaagacacccgtacacacaattgcatcgaatgctggagttgagggagccgttgtggttgggaagctcttggagcaggacaatcctgatcttggttatgatgctgcaaaaggtgaatatgtagacatggtcaaagctggcatcatcgatcctctgaaagtaattagaactgcactcgtggacgccgccagtgtttcctctttgatgacgacaacagaagccatcgttgtcgaactccccaaggacgaaaaggaagttccagcaatgggtggtggcatgggcggaatggattactaaacaaagcagccatcaataatttgatgaaatcaaaacaattttagctctgcttgcttccgagaccctgacgttttccggaccttaaagatgtcttcttatttgtttcataatagtcttgatttattttagtcaaggaaagctttccattcatgtggaatgagggtagcatagagtcagagactagggagagtaatcatttcatgttgcggaaagactgcagtctttttctttttaatcataaaatatataacctttttcttcat

SEQ ID NO: 973 - DNA, 2022 bp, Brassica napus
aagtagcagctgctgcttctaaagtcttctcctttcgtctattaagtgtgtcctcccctccatcgatctcgcttgctcgttctcctatttgtctctttttctttagcttcttcatcgtgcatcttcttccttctcagcgaccatgtttcgtttcgtttccagtctcgcctccaaggccaggattgcaagtaacacaagacaggtttccagcagaatgagctggagcaggaactatgcagcgaaagagattaagtttggggttgaagctcgtgccttgatgcttaaaggtgttgaagagcttgccgatgctgttagagtcactatgggtcccaagggacgtactgttgtgattgaacaaagttggggtgctcctaaagtgactaaagatggggtcaccgttgccaaaagcattgagttcaaagataaagtgaagaacgttggtgccagtcttgtgaagcaggttgctaatgctactaatgatgttgctggtgatggtactacatgtgctactgtgctcaccagggcgatattcacggaaggctgcaaatcagttgcggcaggaatgaacgctatggacctgaggagaggtatctccatggcggttgatgctgtggtgacaaaccttaaaagcagggcgaggatgatcagcacatctgaggagattgctcaggttgggaccatttctgcaaatggagagagggagattggtgaactgatcgcaaaggctatggagaaggttggcaaagaaggtgtgatcacaatccaagatgggaagacgttgattaacgagttggaagttgtagaagggatgaagttggacagaggttatacttccccttactttatcaccaatcagaaaacgcaaaaatgtgaactggaagagcctctcattcttatccatgagaagaagatctcctccatcaactctatagtgaaagtgttggagttggctatgaagagacaaagaccactgttgattgtttctgaagatgtggagagtgaagctcttgcgacacttatcctaaacaagctacgtgccggaatcaaggtttgtgccatcaaggccccagggtttggagagaacagaaaggccaacttgcaagaccttgctgcccttactggtggagaggttatcacggatgagcttggcatgaatctagagaaggtggacttgggcatgctagggacctgcaaaagggttactgtctcaaaggacgacactgttattcttgatggggccggtgacaagacagcaattgaagagagatgcgagcagattaggtcagcaattgaactgagcacctcggattatgacaaggagaaactgcaagaaaggttggctaagctctctggaggagttgctgttttgaagattggaggagcaagtgaagctgaagttggtgagaagaaagacagagtgacagacgctttgaatgccactaaagcagctgttgaagagggtattttgccaggaggaggtgtggctcttctatacgcagcgagagagttggagaaacttccaacagccaactttgaccagaagattggtgtgcagatcattcagaacgctttgaagactcctgttcacacaattgcttcaaacgctggagtcgaaggtgctgttatagttggcaagctcttggagcaagataacacagacctcggttatgatgctgctaaaggtgaatatgtggatatggtgaaagctggtatcatagatcctctgaaagtgatcaggacagctctggttgacgctgccagtgtgtcttctctgttgacgacaactgaagctgtagtggtggatcttcccaaagatgaaagcgagtcagcaggggctggagcaggcatgggtggaatgggaggcatggattattaattacatcactaaaactcttgtcctttttttcaccaatcatcacaccttaacttgagagagaggagggacacgattcttgtaggagtctgtttttgcccgtgtttgcccaataaaaacaattaaacaggacattgcctgtttttgct

SEQ ID NO: 974 - DNA, 1795 bp, Centaurea maculosa
atcatgtatcgtttcgccgtaaatcttgcttctaaagctagggttgcaaacaatggcaaccaactgattggaagtaggttgagttggagaagaaactatgcagctaaagacatcagatttggagtagatgctagggctttaatgcttagaggtgttgaagagcttgctgatgctgttagagttaccatgggcccaaaggggcgtaacgtggtgatcgaacaaagctatggagcaccaaaagtaacgaaagacggtgtaacagtggcaaaaagcatcgaatttaaagataaagtcaagaatgttggtgcaagccttgtgaaacaggttgccaatgctacaaatgatgtggctggtgatggtaccacttgtgcaacagtcctcacaggggcaatattttcagaggggtgcaaatcagttgcagctggtatgaatgcaatggacctccgccgtggtatttccatggccgttgattcagtggtagcaaacttgaagagcagggcccgtatgataagcacatctgaggaaatcacacaggtgggtacgatttctgcaaacggagaacgtgagataggcgagctaatagccaaggctatggagaaagtggggaaagagggtgtcatcacaattcaagatggaaagacattgtataatgaactagaagttgttgagggaatgaagctggacaggggctacatatctccacatttcattacaaatcaaaagaatcagaagtgtgaactagaggaccctcttgttctaatccatgagaagaagatatcaaacattaattctgtgattaaagtgttagagttggcattgaagagacaaaggccgctgctaattgttgctgaagacgtggaaagcgatgcattggctaccttaattcttaataagcttcgagctggcataaaggtttgcgccataaaagctcctggttttggtgagaacagaaaggcaaatctggaagatctcgccactctcaccggcggccagcttataaccgaagaacttggtatgaaccttgacaatgtggagctggaaatgcttggatcttgtaaaaaggtcaccgtatctaaagatgacacggttgtgcttgacggtgctggcgataagaagtctatagaagagcggtgcgaacagattaggtcagcaatcgagtccagtacatctgattatgataaagagaaattccaagagagattggcgaaactttctggtggtgttgctgtactgaagattggaggagccagtgacagtgaagtaggtgaaaagaaagatagagttacagatgctctaaatgccacaaaggcagccgttgaggaaggcatcgtaccaggtggtggtgttgctcttctttatgcatctaaagagttggataagttgccaacagccaactttgatcaaaaaataggcgttcaaattatccagaatgcactaaagatgcccgtttatacgattgcttctaacgctggagtggagggttcagttgtcgttggtaagcttttagagcaggatgacccggatcttggatatgatgccgcaaaaggtgaatatgtggatatggtgaaaaatggaatcattgacccattgaaagtgataagaactgccttggttgatgcagcaagtgtgtcgtctttgatgacaacaactgaagctatcattgttgaactcccaaagcctgctagtgaagccgctccgggaatgggtggtggtatgggtggaatgggcggcatggactattgaccacccgtgtcatactgcaaatgatcaacacatattttactaacgaaataaa

SEQ ID NO: 975 - DNA, 2466 bp, Cicer arietinum
gataagaataacacaaacatcaacgttagaaacgcaaaaccctaaaccctctagaagcagaagaaacgtgcattttctagagacttctctcggtgtttagttttttcactataaacgcaaaaccctaaaaagaacattgcagtgcgtgctttcatcaacaacactttctgcaattgtttcagcgtttagttttctcagttcaaactactcacaatgtaccgttttgcttcctcccttgcctccaaagctcggattgctaggaacaacactcatcagattggaagtagggttggatggaacagaaattatgcggcaaaagagattaaatttggcgtggaggctcgagctttgatgcttaagggtgttgaagagcttgctgaggcagttaaagtaaccatgggtcctaagggtcgtaatgtggttattgagcaaagttttggtgcccctaaagtgacaaaagatggagtaacagttgctaagagtattgaattcaaggataaagtcaagaatattggcgccagtcttgtaaagcaggttgcaaatgctaccaatgatgtggctggtgatggaaccacatgtgctacgattcttacccgagcaatatttactgaagggtgcaaatccgttgcagctggaatgaatgcaatggaccttaggcgaggtataaatatggctgttgatgctgttgtgacaaacttgaaaagcagagcacggatgattagcacttctgaagaaatagcccaggttggtacaatatctgctaatggggagagagaaattggcgagttaattgcaaaagctatggagaaagttggcaaagaaggtgtaatcacaattgcagatggcaagacattgaacaatgagttggaagttgttgaaggaatgaagcttgaccgaggctacatttctccatatttcataactaaccagaagaaccagaaatgcgaacttgaggatcccctcattataatccatgagaagaaaatctcaagtataaatgctattgtgaaagttctagagttagctttgaagagacaaagacctttattgattgttgctgaggatgtagaaagtgatgcccttgcaactcttattctaaacaagcttcgtgctggaatcaaggtatgtgcgatcaaggcccctggtttcggtgaaaaccggaaatctggtctccaggatcttgctgttctcacaggaggtcaacttatcactgaagagctcggaatgaatcttgaaaaagttgatcttgatatgtttggctcttgcaaaaagattacaatttccaaagacgatactgtcattcttgatggagctggtgataagaagtcaattgaggaaagatgcgagcagatcaggtcagcaatcgaaaatagcacttcagattatgacaaggaaaaattacaggaaagattggccaagctttccgggggagttgcggtgcttaagattggaggagccagtgaagctgaagttggtgagaaaaaggatagagtgaccgatgccttaaatgcaaccaaggcagctgtggaagagggcatagtacctggtggtggtgttgctcttctttatgcatcaaatgagttaagtaaacttcaaactgccaacttcgatcaaaaaataggcgtccaaattatccaaaatgctttgaagacacctgtgcaaacaattgcatcaaatgctggagttgagggggctgttgttgttggtaaactattagaacaggataatcccgatcttgggtatgatgccgccaaaggcgaatatgttgatatggttaaagctggaataattgatccattgaaggtgattagaaccgccttagttgacgcagccagcgtgtcatctttgatgacaacaactgaagctattgtgtatgaactcccaaaagaagataatagtagtcctgctatgcctggtggaatgggtggcatggattattagccgctatttttgccgatgaagacctggattggggtggttcttcaccactattgtagcttttttgttatttatggacataaggcatccatgtaaccatagtgagagatcaaagttgtaggtaggaagatttgtgattgttattgcaatgatgataggatcgagacatttggaacaattttcattccaaaattgtaaggaattgttcccttcataagttgccaattgaaagacagcctatggtaatttccacatatatcgaagctagtccttttacaaggaggttgttttaattatatgcttaaatttttacaaggaggttgttttaattatatgcttaaattgttaacgttttcttccgacttaaaatcttcatttaaagtttttcaacctgaatactaatggttaacgaaagtttgagattatttgcaagagtaattatgtacattgtatacaggttggtaaactttcacattcacaattttttatggcagtttattttggatattctcaaatacatgtttgatt

SEQ ID NO: 976 - DNA, 2138 bp, Gossypium hirsutum
cccacaaacagctttactgttaacatttactcaagatttcctcctttcttcctcccaaaataaccatgtatcgttttgcttcaagccttgcttctaaagctagggctgctaggaacactacatatcagactggtagtaggttgagttggaataggaactatgctgcaaaagatattaaatttggggttgaagctcgagctttgatgcttaaaggtgttgaagagctttctgatgctgttagagtaaccatgggtcctaagggtcggaatgtggttattgaacaaagctacggtgctccaaaagtgactaaagatggtgtcactgttgcaaagagtattgaattcaaagacaaagtgaagaacgttggtgcgagtcttgtgaaacaagttgcaaatgccaccaatgatgtagctggtgatggaactacctgtgcaacggtgcttacacgagcaatttttaccgaaggatgcaagtctgttgctgcaggaatgaatgcaatggaccttaggcgtggcataacaatggcagttgatgccgttgtaacaaacttgaaaagccgggcaaggatgattagcacatctgaagagattgctcaggttggaacaatatcggctaatggagagagggaaattggtgagttggttgcaaaggccatggagaaagttggcaaagaaggggtgataacaattgaggatggtaaaacattatataatgagttggaagttgttgagggcatgaagctagacaggggctacatatccccatatttcatcaccaacactaaaacccaaaaatgtgaattagatgatcctcttatcctaattcatgagaagaaggtatcaagcttgaatgctgttgtaaaagtattagagttagctttgaagagacaaaggcccttgctgattgtagctgaagatgtagagagcgaagcacttgctacgctcattctgaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaagaaagccattgaggaaagatgcgaacagattagatcagcaattgaattgagcacctctgattatgataaggagaagttgcaagagagattggcaaaactttctggcggtgtggctgttttgaagatcggaggagctagtgaagctgaagttggcgagaagaaggatagagttacagatgcactgaatgcaacaaaagcagctgtagaagagggtattgtgccaggtggtggtgtcgctctgttgtatgcatcgaaagagttggacaagctacctacagctaactttgaccagaagattggtgttcaaataatccagaatgctctaaagacacctgtgcacacaattgcttcaaatgctggagtcgagggagctgttattgttggtaagctgttggagcaggataaccctgatcttggctatgatgcagccaaaggtgaatatgtcgatatggtaaaggctggtattattgatccattgaaagtaattagaactgctttggtcgatgctgcaagcgtgtcatcattgatgacaactaccgaagctgttgtagtcgaacttccaaaggatgagaaggatgttccggcgatgcctggcagtatgggtggcatggattattaaggttattccccctaacagtgcaccgattgtgaaggaactaattgtctacttcaagctctcttagctacagcttgaattaccatctctcccttgtccttgaaggttaaaggtctgagagttggcattccaaagaaaaacaagctacagcttgaagtgatatgttgagcggaaatgtggacaagtatttgcataactttcattaaccaaattagaatcaagtaatctatttgaatttattagaagtactcaaaatttggttctatcatcttcaaatccaacttaagtagtctgcatccatgtgcatttttaaaaaaaattgtgggcaacaatcttggaagagtttac

SEQ ID NO: 977 - DNA, 1769 bp, Cucumis sativus
tttttgggtttcagctaacgtctacaatgcaccgtttcgcctcaggccttgcttccaaagcccgccttgctaggaacagtactaatcagattgctagtcggtctaactggagcagaaactatgctgcgaaagatgttaaatttggggtggaggctcgaggtcttatgctcaaaggtgtcgaagatcttgccgaagcggttaaagtcacaatgggtccgaaggggcgcaatgtagtgattgaacaaagttacggggctcccaaagttacaaaagatggtgtgactgttgctaagagcatcgagtttaaagataaaatcaagaatgttggtgccagtcttgtgaagcaggttgctaatgcaacaaatgatgtggcaggcgatgggaccacttgtgctactattcttacaagagcaatatttatggagggctgcaagtctgttgctgctggaatgaatgccatggatttaagacgtggtatctccatggcagttgattctgtagtaacaaacttgaagagtagagcacgaatgataagcacatctgaagagatagctcaggtcgggacaatatctgcaaatggagaaagggaaattggtgagttaattgccaaggccatggagaaagttggcaaggagggtgtgatcaccatttcggatgggaagacattatataatgagttggaagtcgttgaaggaatgaagttagacaggggatatatttccccttatttcattacaaaccaaaagaaccagaaatgtgaattggaggatcctcttattctaatccatgaaaagaaaatctcaagcataaatgctgtagtcaaagttttggagctggctctgaagaggcaaagaccccttcttattatttccgaagatgttgaaagtgatgcactagccactcttatcctgaataagctccgtgctggaattaaggtctgtgccattaaagcaccaggttttggggaaaataggaaggctggactgcaggaccttgcagttctcactggtggtgaagtgattactgaagagcttggaatgaatcttgagaaagttgatctggaaatgcttggctcttgcaagaagatcacaatttcaaaggatgatacagttattcttgatggttcgggtgacaagaaagctattgaggaaagatgtgaacagataagggctggtatcgaagcaagcacttcggactatgacaaggagaagttacaggagagattggcgaaactctctggcggcgttgctgtattgaagattggaggagcaagtgaagcagaagtgggtgaaaagaaggatagagtcacagacgccttgaatgccacaaaagcagctgttgaagaaggaatagtaccagggggtggtgttgcacttttgtacgcatccaaagaactggacaaacttccaaccgccaactttgatcagaagattggagtccagattattcagaatgctctgaagacacccgtacacacaattgcatcaaacgctggagttgagggagccgttgtggttggaaagctcttggagcaggacaaccctgatcttggttatgatgctgcaaaaggtgaatatgtagacatggtcaaagctggcatcattgatcctctgaaagtaattagaactgcacttgttgacgctgctagtgtttcctctttgatgacaacaacggaagccattgtagtcgaactgcccaaggacgaaaaggaagttccagcaatgggtggcggcatgggtggaatggactactaaacaaagcagccttca

SEQ ID NO: 978 - DNA, 1837 bp, Nicotiana benthamiana
agattcttcttttcttctctaaataagccccttcaacacgtttctgctctcttctgtcttgtttctcgttctcagtctgcaaattttcatagttcccactatgtatcgttttgcagcaaaacttgcttctaaagccagtgtttccagaaacagcactcaacaggtgggtagtaggctgaattggagcagaaattatgcagcaaaggacgttaaatttggagttgaagctcggggcttgatgcttcagggcgttgagcagctcgctgatgcagttaaagtcaccatgggtccaaagggtcgtaatgtggtgattgaacaaagttggggcgcacccaaggtaacaaaagatggtgtgactgttgcaaaaagcatcgaattcaaggacaaaataaaaaatgttggtgccagccttgtaaaacaggttgccaatgccactaatgatgctgctggtgatggcaccacttgcgcaacagtcctcacccgagcaatatttgctgaagggtgcaagtctgttgcagctggtatgaatgcaatggaccttagacggggtatcacaatggctgtggatgctgttgtaacaaacctgaaaagcagagcacggatgataagcacatccgaggagattgctcaggttgggacaatctctgcaaatggagagagagaaattggtgagctaattgcaaaggctatggagaaagtaggcaaggaaggtgtcatcactattcaagacggtaagacattatttaatgaattggaagttgttgagggcatgaagctggacaggggctacatatctccatactttatcactaatgagaagaatcagaaatgtgagctggatgacccacttattcttattcacgagaaaaaaatctcaagcataaatgctgttgtgaaagtgttagagttggcattgaagagacaaaggcccctcttaattgtgtccgaagatgtagagagtgaaatacttgctacacttattctgaacaagcttcgtgctggaatcaaggtttgtgccatcaaagctccaggatttggtgaaaacaggaaggctaatttgcaggatcttgctactttaactggaggccaggtcataactgaagaacttggattgaatcttgagaatgtggagttggacatgctgggaaaatgtaaaaaggtgactatttccaaggatgacaccgtcgttcttgatggtgctggtgagaagaaggccattgaggagagatgtgaacagatcagatcagcaattgaagtgagcacatctgattatgacaaggagaaattgcaggaaagactagctaagctttcaggtggtgttgcagtattgaaggtcggaggagctagtgaacttgaggttggtgagaagaaagacagagttacagatgctttgaatgccacaaaggctgctgtagaggaaggaattgttccaggtggcggtgttgcacttctgtatgcatccaaagaattggataacttgccaacagccaactttgaccagaagattggtgtccaaattattcagaatgctctgaagacaccagtacatacaattgcctctaatgctggggtggagggtgctgtagtggttggtaaactgttggagcaggatgaccctgatcttggatatgatgcggcaaaaggtgaatatgttgatatggtaaaatcagggatcattgaccctttgaaagtaattaggactgccctagttgatgctgctagtgtatcatctctattgactacaactgaagctgttgttgttgagcttcccaaggacgagacgccatctccacctatgcctggtggtggtatgggctactaatgcgctagcaaaaaa

SEQ ID NO: 979 - DNA, 2070 bp, Solanum phureja
gttgtttcttgtagagccttctttgtttctttctctaaataagcccaacttcttcatatctcctctcttcagtttttctctctttttctcagctgcaaaaaatttcttctacaattatgtatcgttttgcagcaaaacttgcttctaaatccagggttgcaaggagaagcacccaacaggttggtagtaggttgaattggagcaggaactatgctgctaaggatattaaatttggagttgaagctaggggactgatgcttcaaggagttgagcaacttgctgatgcagttaaagtcactatgggtccaaagggtcgtaatgtggtgattgaacaaagttggggtgcacccaaggtgacaaaagatggtgtcactgttgcaaaaagcatcgaattcaaggacaaaataaaaaatgttggtgccagccttgtaaagcaagttgccaatgccactaatgatgctgctggtgatggtaccacttgtgcaacagtcctcacccgagcaatatttgctgaagggtgcaagtctgtagctgctggtatgaatgcaatggatcttagacgaggtatcacaatggctgtcgatgctgttgtaacaaacctgaaaagcagagcacgcatgataagcacatccgaggagattgcccaggttggtacaatctctgcaaatggagaaagggaaataggtgagataattgcaagggctatggagcaagtaggaaaggaaggtgtcatcactattcaagatggaaagacactgcttaatgatttgcaagttgttgaggggatgaagttggacaggggctacatatccccatacttcattacaaatgagaagaatcagaaatgtgagctggatgacccacttattcttattcacgagaaaaaaatctcaagcataaatgctattgtgaaagtgttagaattggctttgaagagacaaaggcccctcctaattgtgtccgaggatgtggagagtgaagcactcgctacacttattctgaacaagcttcgtgctggaatcaaggtttgcgccataaaagctccaggatttggtgaaaacaggaaggctaatttgcaagatcttgctgctttaactggaggccaggtcataacggaagaacttggaatgaacattgaaaatgtggagttggacatgctgggaaaatgcaaaaaggtgactgtctccaaggatgacactgttgttcttgatggtgcgggtgagaagaaggccatagaggagagatgtgaacagattagatcagcaattgaactgagcacgtctgattatgacaaggagaaattgcaagaaagactagctaggctttcagggggtgttgcagtgttgaaggtaggaggagctagtgaaattgaggttggtgagaagaaagacagagttacagatgctttgaatgccacaaaagctgctgtcgaggaaggaattcttccaggtggtggggttgcacttctttatgcatcaaaagaattggactcattgccaacagccaattttgatcagaagattggtgttcaaattattcagaacgctctgaagacaccagtatatacaattgcctctaatgctggggtggaaggatcagtagtggttggcaaattgttggagcaggataacccggatcttggatatgatgctgcaaaaggtgaatatgttgatatgataaaagcaggaatcattgatccattgaaagtaattaggacggccctggttgatgctgctagtgtgtcgtctttattgactacaactgaagctgttatcgttgagcttcccaaggatgagaaggcatctccagctatgcctggtggtggtatggactactaatgcactagaaaagaacagtgattcaagctacctgacatacaatttagcacacacagaataagaaacttaaggttgttgctcatggtacctcaattgtaacaatagcaagagatgtttttgtaggttgagaacttgtaatatttgcaagacaatgcggcatcctcatttttaatccactttcttgttctcagtgacattctgaattccaagaattttcgtagtataaatgaat

SEQ ID NO: 980 - DNA, 2190 bp, Glycine max
tcgtaaggtgttgttggttgggtttaacttcaaaccctaaaaccctagaagccgcttaattttttctagacttttctttttcttttcataaacccccaaccccacgcacactctcttagttctctctcgtttgcatttgcattgcttcctacattttctttaccttctctctgtctcttccatactcacatcatgtatcgcttggcttctaacctcgcttccaaagcaaggattgctaggagtagcagccaacagattggaagtaggctgagtttgagcagaaactatgcggctaaagacattaaatttggtgtggaggctcgggctctgatgcttaagggtgttgaagagcttgctgatgctgtcaaagtaaccatgggtcccaagggccgtaatgttgtgattgagcaaagttttggtgcccctaaagtaaccaaagatggagtaactgttgcaaagagcattgaattcaaggataaagttaagaatgttggtgccagtcttgtaaagcaggttgctaatgctactaatgatgtggctggtgatggaaccacatgtgctacagtccttacacgagcaatatttactgaaggctgcaaatcaatcgcggctggaatgaatgcaatggacctgaggcggggtataagtatggctgtcgatgctgtggtcacaaatttgaaaagcagagctaggatgattagcacatctgaagaaatagcgcaggttgggatgatatctgctaatggagagagagaaattggtgagttgattgcaaaagctatggagaaagttggcaaagagggagtaatcacaatttcagatggcaaaacattatataatgagttggaagttgttgaaggaatgaagctcgacaggggctacatatctccttatttcattacaaacgataagaaccagaaatgtgaacttgaagatccccttattctaattcatgagaagaaaatctctagtataaatgctatagttaaagtcttagagttggctttgaagagacaaagacctttattgattattgccgaggatgtggaaagtgatgcacttgcaactcttattctaaataagcttcgggccggaattaaggtgtgtgctattaaagcccctggttttggtgaaaataggaaggctggtcttcaagatcttgcagttctcacaggaggagcacttattactgaagagcttggcttgaagcttgaaaaagtggatttggatatgcttggtacctgtaaaaaaataacagtttctaaggatgacactgtcattcttgatggagcgggtgacaagaaagcacttgaggaaagatgcgagcagattaggtcagcaattgaaaacagtacctcagattatgacaaggaaaagttacaggaaagattagccaagctttctggtggtgttgcagtgcttaagattggaggagccagtgaagctgaagttggtgagaagaaggatagagtgactgatgcattaaatgcaactaaggctgctgtagaggagggcatagtgcctggtggtggtgttgctcttctatatgcatcgagagagttggataaacttcaaactgctaacttcggtcaaaagattggtgtccagattatccaaaatgctttaaagacacctgtgctcactattgcatcaaatgcgggagttgagggtgcagttgttgttggcaaactattggagcaggagaatcatgatctaggatatgatgcagccaaaggtgaatatgttgatatggttaaagctggaatcatagaccccttgaaggtgattaggacagccttggttgatgcagccagtgtatcgtctttgatgacaacaactgaagctgttgtgtctgaacttccaaacgataataaagatactccagctatggctggtggcatgggtggcatgggttattgaccagcttctattgatttggttgcacttgaaaacaaggattggtgctgaaccctcacagcccccccttttttgttaaattatttggtttgtgaaggcatctttgtaaccatagtgagagatcgagatgtaggtatatggaaatgtgactgctataattccaattataagatatttggaacaatttttacatcctaactcaaggcattgtttcccgaaaatgtcagttgaagtatatttttgagacatttataacgtagtatgatccgttca

SEQ ID NO: 981 - DNA, 2022 bp, Valeriana officinalis
ttcttctccacgatttctccaaactataattatcttctcaatccttcaattctctcccaaatcctcaaaccatgtatcgttacgccgcaaatcttgcttccaaagcacggatcgctagactaaacgggcagcaggttggaagtagattggcttggagcagaaactatgcagctaaggagattaaatttggtgttgaagctcgtgctttgatgcttagaggtgttgaagagcttgctgatgctgttaaagtcaccatgggacctaaagggcgaaatgtatgcatagatcaaagctacggacctcctaaagtgacaaaagatggtgtcacagtagcaaagagcatcgagttcaaagatagagttaagaatgtcggtgccagccttgtaaaacaggttgctaatgccacaaatgatatcgccggagatggtactacttgtgctacggtcctcacacgcgcgatatatactgagggatgcaagtcggttgcagctggaatgaatgcaatggatctgcgacgtggcatcaccatggccgttgatgctgttgtcactaatttgaagagtagagcacgtatgatcagtacatccgaagaaattgctcaggttggcacaatatcggcaaatggagaaagagagatcggtgagcttattgctaaggctatggagagagttggcaaagagggtgtcattaccatctctgatgggaaaacactacataacgagctcgaggtagttgaggggatgaagcttgatagaggctatatatcaccttatttcattaccaaccagaaaaaccaaaaatgtgaattagatgacccacttattttaatccatgagaagaaaatctcaagtctaaatgctattgtgaaagtccttgagttagccttgaagaagcaaagaccattacttatcgtctcagaagatgttgagagcgaggcacttgcaactctcattctaaacaaattgcgagcaggaatcaaggtttgtgccattaaagcccctggatttggggagaacaggaaggctaatttgcaagatcttgctaccctcactggaggagaggttgtaaccgaagagcttggtcataaccttgagaaggtgggaatagaaatgctcggtacttgcaaaaaggttacaatttcgaaagacgatacagtgattcttgatggagctggtgataaaaaggccatcgaagaaagatgcgagcagctgagatcttcagttgaattgagcacctctgattacgacaaggagaagcttcaagagagacttgcgaagctttctggtggtgtagctgtcttgaaaattggaggagcaagtgaagcagaggtcagtgagaaaaaagatagagttacagacgctttgaatgctaccaaggcagctgttgaagaaggaatcgtaccaggtggtggtgtggcacttctttatgcatcaaaggaactcgacaaactaagcactgccaattttgatcaaaagattggtgttcaaattatccagaatgccctcaaggcaccggttttcacaattgcgtcaaatgccggagtagagggagctgtagttgttggcaagctcttagaacaggataactctgatttcggatatgatgccgcaaaaggagagtatgtggatatggttaaggctggaataattgacccactaaaagttatcaggacagctttgattgatgctgctagtgtatcgtcacttctgacgacgacagaggcggttgtggttgatctgccgaaggacgacaaggaagttccgatgggcggtggcggtggaatgggcggaatgggtggaatggattattagttgtagaatcgacgggttttctaatttctagtagtgttttgttaaacgtgtcggtcggtgtattcatattcatagtgagtttttagaatgccgagtttgtagcgtcggtaaacgtctgtgtgagccaggcttatttgttactttcacaaggatttgaatttttctccaaaactctgattgtgctataaaatgattcaataaatgagtttgg

SEQ ID NO: 982 - DNA, 2210 bp, Gossypium hirsutum
taaccatgtatcgttttgcttcaagccttgcttctaaagctagggctgctaggaacactacatatcagattggtagtaggttgagttggaataggaactatgctgcaaaagatattaaatttggggttgaagctcgagctttgatgcttaaaggtgttgaagagctttctgatgctgttagagtaaccatgggtcctaagggtcggaatgtggttattgaacaaagctacggtgctcctaaagtgactaaagatggtgtaactgttgcaaagagtattgaattcaaagacaaagtgaagaacattggtgcgagtcttgtgaaacaagttgcaaatgccaccaatgatgtagctggtgacggaactacctgtgcaacggtgcttacacgagcaatttttaccgaaggatgcaagtctgttgctgcaggaatgaatgcaatggaccttaggcgtggcataacaatggcagttgatgccgttgttacaaacttgaaaagccgggcaaggatgattagcacatctgaagagattgctcaggttggaacaatatcggctaatggagagagggaaattggtgagttgattgcaaaggccatggaaaaagttggcaaagaaggggtgataacaattgaggatggtaaaacattatataatgagttggaagttgttgaaggcatgaagctagacaggggctacatatccccttatttcatcaccaacactaaaaccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagccccaggttttggtgaaaataggaagtctagtctgcatgatcttgctgtcctcactggaggagaggttataacagaagaacttggcatgaaccttgaaaaggtggatctggacatgctcggcacttgcaaaaaggttactgtctcgaaggatgacactgttattcttgatgggaatggtgacaaaaaagccattgaggaaagatgtgaacagattagatcagcaattgaattgagcacctctgattatgataaggagaagttgcaagagagattggcaaaactttctggtggtattgctgtcttgaagattggtggagctagtgaagctgaagttggagagaagaaggatagagttacagatgcattaaatgctacaaaggcagctgtagaggaaggcatcgtgccaggaggtggtgttgctcttttatatgcatcgaaagagttggacaagctacctacggccaactttgaccagaagattggtgttcaaatcatccagaatgctctaaaggcacctgtacacacaattgcttcaaatgctggagttgagggagctgtcattgttggtaagctgttggagcaggataaccctgatcttggctatgatgcagccaaaggtgaatatgttgatatggtaaaggctggtattattgatccattgaaagtaattagaactgctttggtggatgctgcaagcgtgtcgtcattgatgacaactactgaagctgttgtagtcgaacttccaaaggatgagaaggatgttccggcaatgcctggcggtatgggtggcatggattattaaggttattccacctaacagtacaccgattgtaagtgttttcatctaatctattttcatttcctcgacatctgtgagaaaaaagattatccgagtcttgatgtttaagttggaaggcttccatgtaatcataaattgagagctatttggtggttttggtgataaagggtcaacaaaactgtctcattgtttttgctagaaagaaaggactacattgtattggaccattttctggaaattaatggcaaaatgaaaaaagaattgtctcactttccacctgtgattgacatgaattcttgcttcaaaaaaaagaataataatcctctaagagtacatttaaaagcgggccaaggtcccaatacgatttttccacccggagtggcgtacccaagtaagttgaacccctattccccccttttagtggaagtcctatatccacataaatatggccccgaaagtttcacaactgagcatgacctgg

SEQ ID NO: 983 - DNA, 2135 bp, Phalaenopsis aphrodite
tttatatgcggtcttctctttctcttggatgtggaaaccctaatttgatcactcgccgcctttgctttctcgtctcttctctccactcttatctccgtctcggtgagaaacgacagttcggactttagtcatgcatcgattcgcaactagcctcgctgcgaaatcccgggttgccagcggcggcggctgcagcagccgacagattggaagcaggcttgcctggagcagaaactatgccgccaaggacattaggtttggagtggaagcccgtgctttgatgctcaagggcgtggaggagctcgctgatgcggttaaagtgaccatgggccctaagggacgtaatgtagttcttgagcaaagctttggtgcaccgaaggtcacgaaggatggtgtaactgttgccaagagcattgagttcaaggacagagttaaaaacatgggtgctagccttgtgaaacaggtggctaatgcaactaatgatgttgctggagatggtaccacatgtgcgaccatccttaccagagcaatttttgctgaaggatgcaagtcggttgcagctgggatgaatgcaatggacctaagacgaggcatctctttggctgttgatactgtggtcaccaatcttaaaagtaggacaagaatgatcagcacttcagaagagattgcacaggttggtactatttctgcaaatggagagcgagagattggtgaattaattgccaaggcaatggagaaagttgggaaagaaggtgtcatcacaatttctgatggcaaaactctttacaatgaactggaggttgttgaaggaatgaaactcgacaggggctacatatcaccttatttcatcactaaccagaaaaaccaaaaatgtgaactggaagatccactcattttaattcatgagaagaaaatttcaagcatcaactctgtagtgaaagttttggagttagcattaaagaggcagaggcctttgctcattgttgctgaagatatagaaagtgatgctttggcaacattgatccttaacaagctgcgagctggaatcaaagtttgtgccatcaaagctcctggatttggggaaaacaggaaagctggtttgcaagatcttgctgttctcactggcggtgagttgatcaccgaggaacttggcttgaaccttgagaaagttgaacttgaaatgcttggggcatgcaaaaaggtgactgtttcaaaagatgatactgttattcttgatggttctggcgacaaaaaggctattgaagagagatgcgaacagataaggtctgctgttgagtctagtacatctgactatgataaggaaaagttacaagaaaggttggccaagctctctggtggtgttgctgttttaaagataggaggggccagtgaagctgaagttagtgagaaaaaagatagagtaacggatgctctgaatgccactaaagctgctgttgaagaaggaatcgttccaggtggaggtgttgctctcctctatgcgtctaaggagctggagaaattgcatactgctaacttcgatcagaagattggagtgcaaatcattcaaaatgctttgaggaccccagtgcacactattgcatcaaatgcgggtgtagagggagccgtggttgtgggaaagctcttggagcaggataatcctgacctaggatatgatgcagccaaaggtgaatatgttgacttggtgaaggctggtattattgaccccctgaaagtaattagaactgcattagtggatgctgcgagcgtttcatctctgatgaccacaacagaggctgtggttgtggagcagccaaaggatgagaaagaagtttctccttcaatgggtggcggcggcatgggtggacttgattactaatttttcactcaaagccatgcagcagtttcgctctgaattttattactcttttatgtatttttgatgagaaagagctttcatttcttattatgcagtttgccctaatttagttgttcagccaaatgagtcatcaattttgttttgaggcgaactatttcattgatgtggatggattattcctgttgtggtgactgtatgtgctaatatttatttcatcacgcaaacatggaataagagatttcgtggtttcttttacatgata

SEQ ID NO: 984 - DNA, 2083 bp, Musa acuminata
gcttgtttcgcttccccggcccgccaccctgcctcgtctcccttttatctaacccaggggctcattttttcgtctgaatccccaagcgcccacccaaaacgctagtccgttctctcctcgattctaccatgtatcgggccatttcctccctcgcctccaaagcccgggtcgccagaggcagcggcggacagatcggaagtagacttggctggagtagaaactatgctgcaaaggacatcagatttggagtggaggctcgtgctttgatgcttaagggtgtggaagatctcgctgatgcggtgaaagtgaccatgggcccgaaggggcgcaatgttgttattgaacaaagctttggtgcccccaaagttacaaaagatggtgtcactgttgcaaagagcatcgagttcaaggacagaataaagaatatgggggccagccttgtgaagcaggtcgccaatgcaaccaatgatgttgctggtgatgggacaacttgtgctaccatccttacaagagcaatattttctgaagggtgtaagtcggtggcagctggaatgaatgcaatggatttgagacgtggcattacaatggctgttgatgctgtggtgactaacttgaagagcagagcaagaatgattagtacctcagaggagatagcccaggttggtacaatatcagctaatggagaaagagaaattggtgaactaattgcaaaagcaatggagaaagttggcaaagagggagtcataacagttgctgatgggaaaaccctatacaatgaactcgaagtcgttgaaggaatgaaactcgacagaggctacatatcaccctattttattactgatcaaaagaatcaaagatgtgaacttgaagatcctcttattttaatacacgagaagaaaatttcaagcatcaatgcagttgtcaaggtgttagaattggctttgaagagacagaggcctttgctaattgtggcagaagacgtagaaagtgatgcactggcgaccctaattcttaataagcttcgtgccgggattaaggtttgtgctgtgaaggcccctggttttggggagaacaggaaggctagtttgcaagatcttgctactctcactggtggatctgttataacagaagaacttggtatgaaccttgagaaagttgagtttgacatgcttggcacgtgcaaaaaggtgtcaatctcaaaagatgacactgtagttcttgatggagccggtgacaaaaaggctctcgaagagagatgtgagcagatacgatctgcaattgaagtaagcacgtcagactatgacaaagagaagctgcaagagaggttggcgaaactttctggtggagttgctgtgctcaagattggaggagcaagtgaaatagaagttggtgagaagaaagacagagtcacagatgcgttaaatgcaactaaggctgcggttgaagagggaattgtaccaggtggtggtgttgcacttctttatgcatctagagagctggataagttgcagactgccaactttgaccaaaagattggtgtccaaataattcagaatgctttgaagtctccagcgcatacaattgcttccaatgctggagtagagggggctgtggttgttggcaagctgttggaacaagagaatccagaccttggttatgatgcagccaaaggggagtatgtagacctggtgaaagcaggtataattgacccattgaaggtcattaggactgcattggtggatgctgcgagcgtttcttctttgatgaccaccactgaagctgttgtggttgaacttccaaaggatgagaaggagacccctccgatgggacctggcatgggaggaatggactactaatatctgatgtataaacttcagtttcttgaggctggtaatgatgtggtgataaaccacagagttaagttttgcttctgctggcagtaatttattatgatcgatagatacccccatttacaatgaagactgccattggagagatgaattatagaataattgcttagttgattaaggcacactttctttccaggtaattggttagctttctgatttgaaagctgtggctg

SEQ ID NO: 985 - DNA, 2051 bp, Nicotiana benthamiana
atcccccacttctctctgtctctctcaccaccattttctcagttgcaaaaaaatgtatcgttttgcagcaaatcttgcttccaaagccagagttgcaagaaccagcacccaacagattggtggaaggttaaattggagtagaaattatgctgcaaaggacattagatttggagttgaagctcgggctatgatgcttcaaggtgttgaggaactcgctgatgctgttaaagtcactatgggtccaaagggacgtattgtggtgattgaacaaagttggggtgcacccaaagtaacaaaagatggtgtcactgtcgcaaaaagtgttgagttcaaggacagtataaaaaatgttggtgcaagcctcgtaaaacaagttgccaatgccacaaatgatgttgctggtgatggtaccacgtgtgctacagtcctcacccgagcaatatttgctgaaggatgcaagtcagtggcagctggtatgaatgcaatggaccttagacggggtatcaccatggccgtagattccgttgtaacaaacctgaaaagcagagcacggatgatcagcacatcagaggaaattgcacaggttgggactatctctgcaaatggagaaagagaaattggtgagctaattgcaaaggctatggagagagtaggcaaggagggagtcatcactattcaagatggaaagacactgttcaatgagttggaagttgttgaagggatgaagctggacagaggttacatctcaccatacttcattacaaatcagaagaatcagaaatgtgaactcgatgacccactaattcttattcatgagaaaaagatctcaagcgttaatgctgtcgtgaaagcattagagttggctctgaagagacaaaggcccctcttaattgtggctgaagatgtggacagtgaagcacttgccactcttattttgaacaagcttcgtgctggaatcaaggtttgtgccattaaagccccaggctttggtgaaaacaggaaagctaatttgcaagatcttgctattttaactggaggccaagttgtaacagaagagcttggattgaacattgaaaatgtggagttggagatgctgggatcatgtaaaaaggtggctatttccaaggatgatactgtcattcttgatggcgctggtgagaagaagtccatagaggaacgatgtgaacagattagatcaaccattgaactcagcacatctgattatgacaaggagaagttgcaggaaagactagctaagatttcaggaggtgttgctgtgttaaagatcggaggagctagtgaagctgaagttggcgaaaagaaagatagagtcactgacgctttgaatgccacaaaggctgctgtggaggaaggaattgttccaggtggcggtgttgctcttctttatgcagcaaaggaattggataaattagaaactgccaactttgaccagaaaattggtgtacagattattcagaatgctcttaagacacctgtgcatacaatagcttcaaatgcaggagtagagggggcagtcgtggttggtaaactgttggagcaggacgacactgatcttggatatgacgctgccaaaggtgaatatgtggatatggtcaaggcaggaatcattgacccgttgaaagtgatcaggacagccttggtcgatgctgccagcgtgtcatctcttttgaccacaaccgaagcagttgttgttgagcttcctaaggatgagaaagaaactccagcaatgggtggcggcatgggtggcatggactactaatggccaagaatagtaattgaagctgcttgacttacaattggttagaacaaatgaaaataaatttagggttgttgcccattttgatgaatctttatgagaggataggcacccattgtacccatagtaggaaaggctattgtgaattcatctatatgtaggttgagaatttgttagtcttttttttttccctttctggaaacacagtttttttccccttatttatttctacaattttacatgcagcaaaatcttgctgtcacctcatagtcaa

SEQ ID NO: 986 - DNA, 2058 bp, Nicotiana benthamiana
ttcatcacgtttcagctctcttctgtcttttttctcgttctttctctttcacactctgcaaattctcatagttcccactatgtatcgttttgcagctaaacttgcttctaaagccagtgttgccagaaacagcagccaccaggtgggtagtaggttgaattggagcagaaattatgcagccaaggacgttaaatttggagttgaagctcggggcttgatgcttcagggcgttgagcagcttgctgatgcagttaaagtcaccatgggtccaaagggtcgtaatgtggtgattgaacaaagttggggcgctcccaaggtaacaaaagatggtgtgactgttgcaaaaagcatcgaattcatggacaaaataaaaaatgttggtgccagccttgtaaaacaggttgccaatgctactaatgatgttgctggtgatggcaccacttgcgcaacagtcctcacccgagcaatatttgctgaagggtgcaagtctgttgcagctggtatgaatgcaatggaccttagacggggtatcacaatggctgtggatgctgttgtaacaaacctgaaaagcagagcacggatgataagcacatccgaggagattgcccaggttgggacaatctctgcaaatggagaaagagaaattggtgagctaattgcaaaggctatggagaaagtaggcaaggaaggtgtcatcactattcaagacggaaagacattatttaatgagttggaagttgttgaggggatgaagctggacaggggctacatatctccatactttatcacgaatgagaagaatcagaaatgtgagctggatgacccacttattcttattcacgagaaaaaaatctcaagcataaatgctattgtgaaagtgttagaattggctttgaagagacaaaggcccctcttaattgtgtccgaagatgtggagggtgaaatacttgctacacttattctgaacaagcttcgtgctggaatcaaggtttgcgccatcaaagctccaggatttggtgaaaacaggaaggctaatttgcaagatcttgctgctttaactggaggccaggtcataactgaagaacttggattgaatcttgagaatgtggagttggacatgctgggaaaatgtaaaaaggtgactatttccaaggatgacaccgtcgttcttgatggtgctggtgagaagaaggccattgaggagagatgtgaacagatcagatcagcaattgaactgagcacatctgattatgacaaggagaaattgcaggaaagactagctaagctttcaggtggtgttgcagtattgaaggtcggaggagctagtgaacttgaggttggtgagaagaaagacagatttacagatgctttgaatgccacaaaggctgctgtagaggaaggaattgttccaggtggtggtgttgcacttctttatgcatcaaaagaattggataacttgccaacagccaactttgaccagaagattggtgttcaaattattcagaatgctctgaagacaccagtacatacaattgcctctaatgccggggtggagggtgctgtagtggttggtaaactgttggagcaggatgaccctgatcttggatatgatgcggcaaaaggtgaatatgttgatatggtaaaatcagggatcattgaccctttgaaagtaattaggactgccctagttgatgccgctagtgtatcatctctattgactacaactgaagctgttgttgttgagcttcccaaggaggagacgccatctccacctatgcctggtggtggtatgggctactaatgcactagcaaagaacagtgattcaagtgcctgacatacaatttagcacacagaataagaaacttaaaggttgtctgatgaattcttacagtagcgatggtacctcaattgtaacaatagcaagagatgactgtgaattcatgttttgtaggttgataatttgtaatattcgtaagacagttcggcatcctcatcttttttgtctacgaaaattgttatactcagtgacagttgaattctatgaatttttgaaggag

SEQ ID NO: 987 - DNA, 2235 bp, Cajanus cajan
acaattactaatactatgtaaggaaaatataaaaaataaatttgcacaacaaaatcaaaaccttggaacataaaaccctaaaccctagaagctgcttcttctagagtcttcccttcatttcccttgaaaaggaagcgtggagcggtacccctctgcattagtttctgcaaattggcgagtgattctcagttacttacatcatcatgtatcgctttgcaacttcccttgcctccaaagctcgaattgccaggagcagcactcaacagattggaagtagggtgagttggagcaggaattatgcggccaaagacattaggtttggcgtggaggcccgggctttgatgcttaagggtgttgaagagcttgctgatgctgttaaagtaaccatgggcccaaaggggcgtaatgtggtgattgagcaaagttttggtgcacctaaagtgacgaaagatggagtgactgttgctaagagcattgaattcaaggataaagtcaagaatattggtgccagtcttgtaaaacaggttgcaaatgctaccaatgacgtggctggtgatggaaccacatgtgctacaattcttactcgagcaatatttacggaaggctgcaaatcagttgcagctggaatgaatgcaatggacctgagaaggggtataaatatggctgttgatgctgtggtgacaaacctgaaaagcagagcacggatgattagcacttctgaagaaattgcccaggttgggacaatatctgctaatggggaaagggaaattggtgagttaattgcgaaagctatggagaaagttgggaaagagggtgtaatcactatctcagatggcaagacattgtataatgagttggaagtcgttgaaggaatgaaactcgacaggggatacatttctccatatttcataacaaaccagaagaaccagaaatgtgaacttgaggatcctctaattataatccatgaaaagaaaatctcaagcataaatgctattgttaaagtattagagttagctttgaagagacaaagacctttattgattgttgctgaggatgttgaaagtgatgcccttgcaactctaattctaaataaacttcgtgctggaatcaaggtatgtgccatcaaagctcccggttttggtgaaaaccgtaaatctggtctccaggatcttgctgttctcaccggaggtcaacttattactgaagaacttggtttgaatcttgaaaaagtggatctggacatgcttggctcttgcaaaaaggtaacaatttctaaagatgacactgtcatccttgatggagctggtgataagaaatcaattgaggaaagatgcgagcagattagatcagcaattgagaatagcacttcagattatgacaaggaaaagttacaggaaagactagccaagctttctggaggtgttgcagtacttaagattggaggtgctagtgaggctgaagttggtgagaagaaggatagagtgacagatgccttaaatgcaaccaaggcagctgtagaggagggcatagtaccaggtggtggtgttgctcttctgtatgcgtcaagtgaattggataagcttcaaactgctaactttgatcaaaagataggtgtccagattatccaaaacgctttaaagactcctgtgcacacaattgcttcaaatgctggagttgagggtgctgttgttgttggcaaactattggaacagaataatactgatcttgggtatgatgcagccaaaggtgaatatgttgacatggtaaaatctggaatcattgatccattgaaggtgattaggaccgccttggttgatgctgccagtgtgtcgtctttgatgacaacaaccgaagctgttgtgtctgaactcccaaaggacgataaggatgttcctgccatgggtggcggcatgggtggcatggattattaagtggctattttcactgatcagcctagctccctttcgttggacttagttcggagtggtgtttcaccactattttgcctttttttactcatttgttggcagaaggcatccatgtaatcatagtgagagataaaagatgtagggagggaaatttgtgattgttgttgcaatgaaattaagaaacatctgaaacaattttcacattccaaattattagcttttttccactctgacattgtcaattgaaaggccccttaatttcaacaaaattgaagatattccttttctgattacctatacaaacaag

SEQ ID NO: 988 - DNA, 2145 bp, Glycine max
tgcttcttctagagccttcctttcatttcccttgaaaaggaagcgtgaagcgttttccctctgcattaatttgtatctgcagtctgcaacaacttcttcttcagttcttcacaccaatcatgtaccgctttgcaacctccctcgcctccaaagctagaattgctaggagcagcactcaacagattggaagtagggtcagttggaacaggaattatgctgccaaagacattaagtttggtgtggaggcccgggctttgatgcttaagggtgttgaagagctcgccgatgccgtcaaagtaaccatgggccctaaggggcgtaatgtggttattgagcaaagttttggagcacccaaagtgacaaaagatggagtaaccgttgctaagagcattgaattcaaggataaagtcaagaacatcggtgccagtctcgtaaagcaggttgccaatgctaccaatgatgtggctggtgacggaaccacttgtgctacaattctcactaaagcaatatttacggaagggtgtaaatcagttgcagctggaatgaatgcgatggacctgagacgaggtataaatatggctgttgatactgtggtgacaaatctgaaaagcagagcacggatgattagcacttctgaagaaattgcccaggttggaacaatatctgccaatggggagagggaaattggtgagttaattgcaaaagctatggagaaagttggcaaagagggtgtcatcacgatctcagatggtaagacattgtacaatgagttggaagttgtggaaggaatgaagctcgacaggggatacatttctccatatttcataacaaaccagaagaaccagaaatgtgaacttgaggatcctctcattataatccatgaaaagaaaatctcaagcataaatgctattgttaaagtattagagttggctttgaagagacaaaggcctttactgattgtcgctgaggatgtggaaagtgatgcccttgcaactcttattctaaataaacttcgtgctggaatcaaggtatgtgccatcaaagctcctggttttggtgaaaaccgtaaatctggtctccaggatcttgctgttcttacaggaggtcaacttatcactgaagagcttggcttgaatcttgaaaaagtagatctggaggtgtttggctcttgcaagaagataacaatttctaaggatgacactgtcatccttgatggagctggtgataagaaagcaattgaagaaagaagtgagcagattagatcagcaattgaaaatagcacttcagattatgacaaggaaaagttacaggaaagattagccaagctttctgggggtgttgcagtactgaagattggaggagccagtgaggctgaagttggtgagaagaaggatagagtgacagatgccttaaatgcaaccaaggcagctgtagaggagggcatagtaccaggtggtggtgttgctcttctctatgcatcaagtgagttggataagcttcaaactgctaactttgatcaaaagataggggtccagatcatccaaaatgctttgaagactcctgtgcacacaattgcttcaaatgccggagttgagggtgctgttgttgttggtaaactattggaacagaatgatcctgatcttggatatgatgcagccaaaggtgaatatgttgatatggttaaagctggaatcattgatccattgaaggttattaggaccgccttggttgatgcagccagtgtgtcatctttgatgacaacaactgaagctattgtgtctgaactcccaaaggacgataaagatgttcctgccatgggtggcatgggtggtatgggtggcatggattattaaggggctatttcccctgatgaatcttgctccctttaaatggacgtagattggggtggtgtttcaccactattttgccttttttttcttcttatttattgacagaaggcatcaatgtaatcatagtgagagataagagatcttgggaggaaaatttgctattgttgttgcaatgacattaaggaacgtctgaaacaattttcagattccaaattattaacactgttccattctaaagttgtcaattgaaagacggctccttaataatttcaacagattgaagtccttttctaac

SEQ ID NO: 989 - DNA, 1983 bp, Nicotiana tabacum
tagttccaactatgtatcgttttgcagctaaacttgcttctaaagccagtgttgccagaaacagcagccaccaggtgggtagtaggttgaattggagcagaaattatgcagccaaggatgttaaatttggagttgaagctcggggcttgatgcttcagggcgttgagcagcttgctgatgcagttaaagtcaccatgggtccaaagggtcgtaatgtggtgattgaacaaagttggggtgcacccaaggtaacaaaagatggtgtgactgttgcaaaaagcatcgaattcaaggacaaaattaaaaatgttggtgccagccttgtaaaacaggttgccaatgccactaatgatgttgctggtgatggtaccacttgtgcaacagtcctcacccgagcaatatttgctgaagggtgcaagtctgtcgcagctggcatgaatgcaatggaccttagacggggtatcacaatggctgtggatgctgttgtaacaaacctgaaaagcagagcacggatgataagcacatccgaggagattgcccaggttgggacaatctctgcaaatggagaaagagaaattggtgagctaattgcaaaggctatggagaaagtaggcaaggaaggtgtcatcactattcaagacggaaagacattctttaatgagttggacgttgtcgaggggatgaagctggacaggggctacatatctccatactttatcacgaatgagaagaatcagaaatgtgagttggatgacccgcttattcttattcacgagaaaaaaatctcaagcataaatgctgtggtgaaagtgttagagttggctttgaagagacaaaggcccctcttaattgtgtctgaagatgtggagagtgaaatacttgctacacttattctgaacaagcttcgtgctggaatcaaggtttgtgccatcaaagctccaggatttggtgaaaacaggaaggctaatttgcaagatcttgctactttaactggaggccaggtcataactgaagaacttggattgaatcttgagaatgtggagttggacatgctgggaaaatgtaaaaaggtgaccatctccaaggatgacaccgttgttcttgatggtgctggtgagaagaaggccattgaggagagatgtgaacagatcagatcagcaattgaactgagcacatctgattatgacaaggagaaattgcaggaaagactagctaagctttcaggtggtgttgcagtattgaaggtcggaggagctagtgaacttgaggttggtgagaagaaagacagagttacagatgctttgaatgccacaaaggctgctgtagaggaaggaattgttccaggtggcggtgttgcacttctttatgcatcaaaagaattggataacttgccaacagccaactttgaccagaagattggtgtccaaattattcagaatgctttgaagacaccagtacatacaattgcctctaatgctggggtcgagggtgctgtagtggttggtaaactgttggagcaggatgaccctgatcttggatatgatgcggcaaaaggtgaatatgttgatatggtaaaatcagggatcattgaccctttgaaagtaattaggaccgccctagttgatgctgctagtgtgtcatctctattgactacaactgaagctgttgttgttgagcttcccaaggatgagacgccatctccacctatgcctggtggtggtatgggctactaatgcactagcaaagaacagtgattcaagtgcctgacatacaatttagcacacagaataagaaacttaaggttgtctgatgaattcttacggtagcgatggtacctcaattgtaacaatagcaagagatgaatgtgaattcgtgtttttgtaggttgagaatttgtaatatttgtaagacagttcggcatcctcatttttttgtctacaaaaattgttatcctcagtgacagttgaattctaagaatttttg

SEQ ID NO: 990 - DNA, 2098 bp, Trigonella foenum-graecum
gctgcttgttctagagacttccctttcccttcaaaaactaactctgcagcgtttcttccttcaattcaacaacactactttctgcaatttcttcattgttcaattttctcagttccaattccaatcacaccatgtaccgatttgtttcatcccttgcctctaaagctcgaattgctaggagtagcactcatcagattggaagtagggtggcatggaacagaaattatgcggcaaaagagatcaaattcggtgtggaggctcgtgctttgatgcttaagggtgttgaagagcttgctgaggcagttaaagtaaccatgggtcctaagggtcgtaatgtggtgattgagcaaagttttggtgcccctaaagtgacgaaagatggagtcactgttgctaagagcattgagtttaaggataaagtcaagaatattggtgccagtcttgttaagcaggttgcaaatgctaccaatgatgtggctggtgatggaaccacttgtgccacaattcttacccgagcaatatttacggaagggtgcaaatcagttgcagctggaatgaatgcaatggacttgaggcgaggcataaatatggctgttgatgctgtcgtgacaaacttgaaaagcagggcacgaatgatcagcacatctgaagaaatagctcaggttgggacaatatctgctaatggggatagagaaattggtgagttaattgcaaaagccatggagaaggttggcaaagaaggtgtaatcacaatcgctgatggcaagacattgcaaaatgagttagaagttgttgaaggaatgaagctggaccgaggctatatttctccgtatttcataacaaatcagaagaaccagaaatgtgaactcgaggatcccctcattataatccatgagaagaaaatctcaaatataaattctatagttaaagtgttagagttagctttgaagaaacaaaggcctttattgattgttgctgaggatgtggaaagtgatgcccttgcaactcttattctaaataagcttcgtgctggaatcaaggtatgtgcaatcaaagcccctggttttggggaaaacaggaaatctggtctccaggatcttgctgttcttacaggaggtcaacttatcactgaagagctcggcatgaatcttgaaaaagttgatcttgaaatgtttggctcttgcaaaaagattactatttccaaagatgacaccgtcattcttgatggagctggtgataagaaatcaattgaggaaagatgtgagcagattaggtcggcaatcgaaaatagcacttcagattatgacaaggacaaattacaggaaagattggccaagctttccggaggagttgcagtgcttaagattggaggagccagtgaggctgaagttggtgagaaaaaggatagagtaacagatgccttaaatgcaaccaaggcagctgtagaggagggcatagtacctggtggtggtgttgctcttctttatgcatcaaatgagttaagtaagcttccaaccgccaattttgatcagaagataggcgtccaaattattcaaaatgctttaaagacacctgtgcatacaattgcatcaaatgctggagttgagggtgctgttgttgttggtaaacttttggaacaggataatcctgatcttggttacgatgccgccaaaggtgaatatgttgatatggttaaatctggaataattgatccattgaaggtgattaggaccgccttggttgacgcagccagtgtgtcctctttgatgacaacaactgaagctattgtttctgaactcccaaaagaagataaagatgctcctgctatgcctggtatgggcggtatggattattagatgctatgaagacctggattagagtggtgcttcaccactattatagcctccttttttcttatttatttgacataaggcatccatgtaatcatagtgagagatttaagctgtaggtaggaagatttgtgattgttactgctatgatgtagttgagacatttggaacaattttcattccaaaatagaaaggaattgtccccttcatgagttgtcaattgaaagacggcctctgttaatttccaa

SEQ ID NO: 991 - DNA, 1870 bp, Tripterygium wilfordii
cgttgataggagcagtgttgagcaggttggaagcaggttgaactggagcaggaactatgctgccaaggacattagatttggggtaggggctcgtgccttgatgctaagaggggttgaagagctcgctgatgctgtcaaagtcacaatgggtcccaaggggcgtaatgtggttattgaacaaagctatggtgccccaaaagtgaccaaggatggtgtaactgttgcaaagagtattgagttcaaagataaggttaagaacattggtgctagcctagtgaaacaagtggcgaatgcaaccaatgatgttgctggcgatgggactacatgtgctacgatcctcacaaaagcaatatttgctgaagggtgcaaatcagttgctgctgggatgaacgcaatggaccttagacgtggtatcactatggcagtcgattctgttgtcacaaacttgaagagcagggcgaggatgatcagcacttcagaagaaatagctcaggttggtactatatcggcaaatggagaaagggaaattggtgagttgattgcaaaggccatggagaaagttggcaaagagggagttattacaattcaagatgggaagacattatttaacgagttagaagttgttgaggggatgaagttggacaggggctacatttctccttatttcattaccaaccaaaagaatcaaaaatgtgaattagaagatcctctagttctgatccatgagaagaaaatctcaagcataaatgccgtggtgaaagtactagagttggcattgaagaaacaaaggcccttgttgattgttgctgaagatgttgaaagtgatgccctagcaactctaattctcaacaaactgcgtgctggaatcaaggtctgtgcaatcaaagcccctgggtttggagagaacaggaaggccaatctgcaagatcttgcagttctcactggaggagagcttataactgaggagctcggtatgaatcttgaaaaggtggatctggatatgcttgggtcttgcaaaaaggttacagtttcaaaagatgatactgttgttcttgatggcgccggtgacaagaaggtcattgaggaaagatgcgagcagatcagggctgcaattgaattgagcacatccgactatgacaaggagaaattgcaagatagattggcaaaactctcaggaggtgttgcagtattgaagattggaggagctagtgaaactgaagttggtgagaagaaagacagagttacagatgccttaaatgccacaaaggcagcagtcgaagagggtatagtaccaggtggaggtgttgctcttctttatgcatcaaaagagttggataagctgccaactgccaacttcgatcagaagattggtgttcaaattattcagaatgcactcaagacacctgtatacacaattgctgcaaatgctggagtagagggagctgttgttgttggtaagttactggagcaggataaccctgatcttggatatgatgctgccaaaggtgaatatgtcgatatggttaaatcgggcatcatcgatccattgaaagttattaggacagctttggtcgacgcagctagtgtgtcctctttgatgacaacaactgaagctgtcatatctgaacttccaaaagatgagaaggaagttccagcaatgggtggcggtatgggtggtatgggcggaatggattattgagttcctgaatttatttttgatcttcaggcaggccatacattattcataaatgagttattattcaaatgtgggaaatttaggatcaaaccatctcgataagggttgggtgaggaaaattggcatgtgtacggtaatgaaaactgtttatcaggactttttgcccctgcaatt

SEQ ID NO: 992 - DNA, 1907 bp, Chrysanthemum coronarium
ccgccactacagccgccgtcatcatgtatcgtctagccgccagtctcgcatccaagtcaaggattgctagaaataatgctcaacagttgagatattatgctgcgaaagatatacatttcggtgtcggtgcgagagcgttgatgctaaaaggagtcgaagagcttgctgatgctgttaaagttaccatgggcccgaaggggcgtaatgtggttattgaacaaagttatggagcgccaaaagtaacgaaagacggtgtaacggttgcaaaagccattgaatttaatgataaggtgaagaatgttggcgcgagtcttgtgaaacaggttgctaacgccacaaatgacgtggctggtgatggtacaacttgcgcaacagttcttacacgcgctatattttcagagggttgcaagtcggttgcagctggtatgaatgcaatggacctcaggcgtggtattaccatggctgttgattcggttgtaacaaacttgaaaagtagagctcgtatgataagcacatctgaggaaatcacacaggtgggtacaatttccgcaaacggagaacgtgaaatcggtgaactaatagctaaggctatggaaagagttgggaaagagggtgtcatcactattcaagacggaaagacgttgtataacgaactagaagttgttgagggaatgaagttggacaggggatatatatctccgcattttatcacgaacaccaagaatcagaaatgcgaactggatgaccctattgttctaatctacgagaagaagatttcaaacattaattccgtgatcaaagtgttagagttggcactgaagaaacaaaggccactattaatcgttgctgaagatgtggaaagtgaagcgttggctaccttaattcttaacaagctccgtgccggcatcaaggtctgtgccataaaagctcctggttttggcgagaacagaaaggccaacttgcaagatcttgccactctcaccggaggccaggttataacagaagaacttggtatgaacatcgacaacgtggagttggaaatgcttggctcgtgtaaaaaggttactgtctcgaaagatgacacagttgtgcttgatggtgctggtgataagaagtcgatagaagaacggtgtgaacagattaggtcagcaattgagtcgagcacatctgattatgatagagagaagttccaagagaggttggctaagctttctggtggcgtcgctgtactaaagattggaggagccagtgacactgaagtaagtgaaaagaaagacagagttaccgatgctctaaatgccacaaaggctgctgttgaggaaggaattgtaccaggtggtggtgttgctcttctgtatgcatctaaagaattggacaaattgcaaacagccaacttcgatcagaaaatcggggttcagattattcagaatgcactaaagatgccagttcatacaatagcatctaacgctggagtggaaggttcggttgtggttggtaagcttttagagcaagatgacccagatcttggatatgatgccgctaaaggtgaatatgtggacatggtgaaaaatggtatcattgacccgttgaaagtgataaggacagccttggtcgatgcagcaagtgtgtcttctttaatgacgactactgaagcaattgtgacggaactcccaaaaccggctagtgaagcagctccaggaatgggcggcggcatgggtggaatgggcggaatgggtggcatggacttttgatcagccctgtgatagcaaaaaagattgacatacattttactgacagaataaacacagagcgtggctcagtatgtgcgacactaggtagttgaacaaaggcctaagtgtgtttacagtgtgagaactagtacattattagcatgcggaattttgttt

SEQ ID NO: 993 - DNA, 1977 bp, Manihot esculenta
catgtatcgtttcgcttctagcctcgcttctaaagctcggatcgctaggaacagcactcatcagattggaagtagaataagttggagcaggaactatgcggccaaagacattaaatttggtgtggaagcccgggctttaatgctcaagggcgtcgaagagcttgctgacgctgtgaaagtcaccatgggccccaaggggcgcaatgtggtgattgaacaaagttttggtgcccccaaagtgacaaaggatggagtgactgttgcaaagagtattgaattcaaggacaaagtcaagaatgtcggtgccagccttgtgaagcaggttgcaaatgctaccaatgatgtagcaggagatgggaccacatgtgccactgttcttactcgagcaatatttatggaaggctgcaagtcagttgcagcagggatgaatgcaatggacctaagacggggcatcagcatggctgttgatgctgttgttaccaacttgaagagcagaacacgaatgatcagcacatctgaagaaatagcacaagttggtacaatatctgcaaatggggagagagaaattggtgagttgattgcaaaggccatggagaaggttggaaaagagggggttattacaatccaagatgggaagaccttatataatgagttggaagttgttgagggaatgaagctggacaggggttacatatccccttatttcatcaccaaccagaaaaaccaaaaatgcgaattagatgatcccctcattctgattcatgaaaagaaaatctcaagcataaatgctgtggtgaaagtgttggagttggctttgaagagacaaaggcctttgttgatagtttctgaagatgtggaaagtgaagcattagcaacccttattctaaacaagcttcgcgctggaattaaggtgtgtgccataaaagctcctggttttggagagaacaggaaggcagggctgcaggatcttgctgttctcacagggggtgaggtgataactgaagaacttggcctaaatcttgaaaaggttgatatagatatgcttggcagttgcaaaaagattacggtgtccaaagatgatactgttattcttgatggtgctggtgacaagaaggccattgaggaaagatgtgaacagataaggtctgcaatagagttaagcacttctgactacgacaaagagaaattgcaagaaagactggcaaagctttctggaggtgttgctgtgctcaagattggaggagctagtgaagctgaagttggtgagaagaaagatagggttacagatgctttaaatgctacaaaggcagctgtagaagagggtattgtgccaggtggtggtgttgctcttctttatgcctcaaaagagttggataatttgcagactgccaactttgaccagaagattggtgtccaaatcattcagaatgctctgaagactccagtacatacaattgcaagtaatgcaggagttgagggagctgttgttgttggtaagctgttggagcaggataacccggatcttggttatgatgctgccaaaggtgaatatgttgatatggtgaaagcagggattattgacccgctgaaagtaattagaactgccttggttgatgcagcaagtgtgtcatcattgatgacaacaactgaagctgtcgtatctgaacttccaaaggacgagaaggatgttccagcaatggcgcctggcatgggcatggattactaattttcctcgtaaaacactcatccaaattaggaattaacagtcatcaattcacatggaccattgggtttttatcctttcttttatttttaacgagtcattattgtgaaggtctaaaggcatccgtgtattcatagtgagatgtgtaggtattagttccggggcctggattattcaagataaaaccatcttgaattcctgtttgctagtgcacttttttatccccttggaataagacaatgtttacctttttt

SEQ ID NO: 994 - DNA, 2240 bp, Amorphophallus konjac
tctctctctctctcccaacgccaacaacattctaacgagagcgctcaaaccctactgctccctgcgccgccccagcgctcctcgagccgccattccttcttcgtccttccgccatgtatcgagccgcagcgagcctcgcctccaaggcccgggtcgctgggagccgcagccagcagattgggagcaggctgggttggagcaggaactatgccgcgaaggacatcagatttggggtggaggcccgtgcattgatgctcaagggagtcgaggacctcgcagatgctgtgaaagtgacaatggggccgaagggtcgcaatgtagtattagaacaaagctttggtgcacctaaagtaacaaaggatggtgtgacagtggcaaagagcattgagttcaaagataggattaagaacatgggtgcaagccttgtgaagcaggttgccagtgcgacaaacgatgttgctggtgatggtaccacctgtgccaccatccttacacgagcaatatttgctgaggggtgcaaatcagtggctgctgggatgaatgcaatggatctaagacgtggaatcacaatggcagttgacgcggttattaccaacttgaagagtagggctcgaatgattagcacgcctgaggaaattgcacaggttggtacaatatcagcaaatggagaaagagagatcggtgaactcattgccaaggcaatggaaaaggtcggcaaggaaggagttatcactgttgctgatgggaaaactcttgacaatgaattggaagttgttgagggaatgaaactggacagaggttacatatctccatacttcattactgaccaaaagaatcagaaatgtgaacttgaggatccactcatcttgatacatgagaagaaaatatcaagcattaatgctgttgttaaagttctggagctggccttaaagagacaaagacctctccttattgttgctgaagatgttgaaagcgatgcactggcaactcttatacttaacaagcttcgtgctggaatcaaggtttgtgcaatcaaagctcctggttttggagagaaccggaaagccagtcttcatgatcttgctgttcttactgggggtgatgttataactgaagatcttggtatgaatcttgatagggttgaattgagcatgcttggcacatgcaaaaaggtgaccatttctaaagatgatactgtcattcttgatggagctggtgacaagaaagctatcgaggagaggtgtgaacagctgaggtcttcaattgagctcagtacatcagattatgataaagagaagttgcaaggaagactggcaaaactttctggtggtgttgcagttctgaagattggaggtgccagtgaagcagaagttggcgagaaaaagacagggtgactgacgctttaaatgcaaccaaggcagctgtcgaagaaggaattgtgcctggtgggggcgttgcactcctctatgcatcaagggagcttgacaagttaagcactgctaactttgaccagaaaattggagttcagatcatccaaaatgctttgaagacacctgtacacacaatagcctccaatgctggagttgaaggtgctgtagttgttggcaagcttttggagcaggataacaccgatcttgggtatgatgcagctaaaggtgaatatgtagatatggttaaggctggcattattgatccattgaaagtgatcagaactgcgctgttggatgccgcaagtgtgtcgtctttgatgacaacgaccgaggctgttgttgtggagctacccaaggaagaaaagggtactccagcaatgggaggcggcatgggtggaatggattattgaagggatacctcagagacgtaattacatggatactgaaattttatttgtttctctttgccctattcaaaaatctcaattgcctatgaaataaattttgttagactttagggtccggcccttatacatccatgagagtagccattagaggactcttatgctggtttaacgttgattgtagacgcttaagagctacgataagagggcctttcatggttctctacccccttttggggaaaacgcgaagtagatgaaattgtatcatttttttgaaaggaaaagtcactttggcccctctgctttcccacgctgtttctctggcagctagaaaaaaaattcatttgtttttgtcacttagcaattcttttccgggatgtgtattgtcatcagagttttgagtggg

SEQ ID NO: 995 - DNA, 1980 bp, Castanea mollissima
tctctttcttttgtttttcttgtttcagccatgtaccgctttgcctcaagtctcgcctctaaagctcggcttgctaggaacacaacccagcagattggtagtagattgaattctagtagaaactatgctgccaaagatataagatttggggtggaggcccgggctctgatgctaaagggtgtggaggagcttgctgatgctgttaaggtcaccatgggtcctaagggacgcaatgtggtaatcgaacagagttggggtgcccccaaagtgacaaaagatggtgtcactgtagcaaagagcattgaattcaaggacaaagtcaagaatattggtgctagccttgtgaagcaggttgcaagtgccaccaatgatgcagcaggggatgggaccacatgtgccacagtacttacgcgggcaatatttaccgaagggtgcaaatcagttgccgcagggatgaatgcaatggacctaagacgtggcattagcatggcggttgattgtgttgttaatcatttgaagagtagtgcacgaaagatcagcaaaagtgacgaaatagcacaggttgggacaatatctgcaaatggagagagagaaattggtgagttgattgcaagggcaatggagagagttggcaaagagggagtaatcacaattcaagatggaaaaacattgtacaatgagttggaagttgttgagggcatgaagctcgaccgtggttacatatccccttacttcattactaaccagaaaaaccagaaatgtgaactggaagatcctctcattctaatccatgagaagaaaatctcaagtttaaatgccatcattaaagtattagaactggctttgaagagacaaaggccgttactaattgtttcagaagacgtggaaagtgaggctttggcaactctcattctcaataagcttcgtgctggaatcaaggtttgtgctatcaaagcccctggttttggtgaaaacaggaagtccaatctgcaggatcttgccattcttacaggaggcgaacttattactgaagagcttggcatgaatcttgaaaaagtggatctggatatgcttggctcatgcaaaaaggttacaatatcaaaggatgacactgttattcttgatggtgctggggacaagaaggctcttgaggaaagatgtgaacagatccggtccgcaattgaaaatagcacctctgattatgacaaagaaaaattacaagagagattgggaaagctttctggtggtgtagcagttttgaagattggaggagctagtgaagctgaagttagtgagaagaaggatagagtgaccgatgccttgaatgccacaaaggcagctgtcgaagagggtatagtgccaggtggtggcgttgctcttctttatgcatcaaaagagttggaaaagctggaaactgccaactttgatcagaagattggtgttcagattattcaaaatgctttgaagacacctgtgtacacaattgcttgtaatgctggagttgagggggctgttgttgttggtaagctgttggaagaaaatgaccctgacaaaggatatgatgcggccaaaggtgaatatgttgatatggtcaaagccggaataattgatccagtgaaagtgattagaactgctttggttgatgctgcaagtgtatcatctttgatgacgacaaccgaagctattgtgactgaaatacccaaggatgataaagaagctccggcaatgggaggtggcatgggtggcatgggtggcatggattattgaggctcttttgctggttgaacaatcatccaacggccctatttttcactccaagatccataactaatgcaaacatcatgaatatttcttgcatctcttaattggtttggtcacaaggcatccatgtaatcatagagaacaaagtaggtagctttggtaacttaggatgaaacctgtgattgttgcttcaatgaggaatcatcatgtatcggaact

SEQ ID NO: 996 - DNA, 1801 bp, Musa acuminata
atgtatcgggccatttcctccctcgcctccaaagcccgggtcgccagaggcagcggcggacagatcggaagtagacttggctggagtcgaaactatgctgcaaaggacatcagatttggagtggaggctcgtgctttgatgcttaagggtgtggaagatctcgctgatgcggtgaaagtgaccatgggcccgaaggggcgcaatgttgttattgaacaaagctttggtgcccccaaagttacaaaagatggtgtcactgttgcaaagagcatcgagttcaaggacagaataaagaatatgggggccagccttgtgaagcaggtcgccaatgcaaccaatgatgttgctggtgatgggacaacttgtgctaccatccttacaagagcaatattttctgaagggtgtaagtcggtggcagctggaatgaatgcaatggatttgagacgtggcattacaatggctgttgatgctgtggtgactaacttgaagagcagagcaagaatgattagtacctcagaggagatagcccaggttggtacaatatcagctaatggagaaagagaaattggtgaactaattgcaaaagcaatggagaaagttggcaaagagggagtcataacagttgctgatgggaaaaccctatacaatgaactcgaagtcgttgaaggaatgaaactcgacagaggctacatatcaccctattttattactgatcaaaagaatcaaagatgtgaacttgaagatcctcttattttaatacacgagaagaaaatttcaagcatcaatgcagttgtcaaggtgttagaattggctttgaagagacagaggcctttgctaattgtggcagaagacgtagaaagtgatgcactggcgaccctaattcttaataagcttcgtgccgggattaaggtttgtgctgtgaaggcccctggttttggggagaacaggaaggctagtttgcaagatcttgctactctcactggcggatctgttataacagaagaacttggtatgaaccttgagaaagttgagtttgacatgcttggcacgtgcaaaaaggtgtcaatctcaaaagatgacactgtagttcttgatggagccggtgacaaaaaggctctcgaagagagatgtgagcagatacgatctgcaattgaagtaagcacgtcagactatgacaaagagaagctgcaagagaggttggcgaaactttctggtggagttgctgtgctcaagattggaggagcaagtgaaatagaagttggtgagaagaaagacagagtcacagatgcgttaaatgcaactaaggctgcggttgaagagggaattgtaccaggtggtggtgttgcacttctttatgcatctagagagctggataagttgcagactgccaactttgaccaaaagattggtgtccaaataattcagaatgctttgaagtctccagcgcatacaattgcttccaatgctggagtagagggggctgtggttgttgggaagctgttggaacaagagaatccagaccttggttatgatgcagccaaaggggagtatgtagacctggtgaaatccggtataattgacccattgaaggtcattaggactgcattggtggatgctgcgagcgtttcttctttgatgaccaccactgaagctgttgtggttgaacttccaaaggatgagaaggagaccccaccgatgggacctggcatgggaggaatggactactaatatctgatgtataaacttcagtttcttgaggctggtaatgatgtggtgataaaccacagagttaagttttgct

SEQ ID NO: 997 - DNA, 2047 bp, Castanea mollissima
ctctcggtttcagactctctctctttctttgttttctgtttcagccatgtaccgctttgcctcaagtctcgcctctaaagctcggcttgctaggaacacaacccagcagattggtagtagattgaattctagtagaaactatgctgccaaagatataagatttggggtggaggcccgggctctgatgctaaagggtgtggaggagcttgctgatgctgttaaggtcaccatgggtcctaagggacgcaatgtggtaatcgaacagagttggggtgcccccaaagtgacaaaagatggtgtcactgtagcaaagagcattgaattcaaggacaaagtcaagaatattggtgctagccttgtgaagcaggttgcaagtgccaccaatgatgcagcaggggatgggaccacatgtgccacagtacttacgcgggcaatatttaccgaagggtgcaaatcagttgccgcagggatgaatgcaatggacctaagacgtggcattagcatggcggttgattgtgttgttaatcatttgaagagtagtgcacgaaagatcagcaaaagtgacgaaatagcacaggttgggacaatatctgcaaatggagagagagaaattggtgagttgattgcaagggcaatggagagagttggcaaagagggagtaatcacaattcaagatggaaaaacattgtacaatgagttggaagttgttgagggcatgaagctcgaccgtggttacatatccccttacttcattactaaccagaaaaaccagaaatgtgaactggaagatcctctcattctaatccatgagaagaaaatctcaagtttaaatgccatcattaaagtattagaactggctttgaagagacaaaggccgttactaattgtttcagaagacgtggaaagtgaggctttggcaactctcattctcaataagcttcgtgctggaatcaaggtttgtgctatcaaagcccctggttttggtgaaaacaggaagtccaatctgcaggatcttgccattcttacaggaggcgaacttattactgaagagcttggcatgaatcttgaaaaagtggatctggatatgcttggctcatgcaaaaaggttacaatatcaaaggatgacactgttattcttgatggtgctggggacaagaaggctcttgaggaaagatgtgaacagatccggtccgcaattgaaaatagcacctctgattatgacaaagaaaaattacaagagagattgggaaagctttctggtggtgtagcagttttgaagattggaggagctagtgaagctgaagttagtgagaagaaggatagagtgaccgatgccttgaatgccacaaaggcagctgtcgaagagggtatagtgccaggtggtggcgttgctcttctttatgcatcaaaagagttggaaaagctggaaactgccaactttgatcagaagattggtgttcagattattcaaaatgctttgaagacacctgtgtacacaattgcttgtaatgctggagttgagggggctgttgttgttggtaagctgttggaagaaaatgaccctgacaaagggtatgatgcggccaaaggtgaatatgttgatatggtcaaagccggaataattgatccagtgaaagtgattagaactgctttggttgatgctgcaagtgtatcatctttgatgacgacaaccgaagctattgtgactgaaatacccaaggatgataaagaagctccggcaatgggaggtggcatgggtggcatgggtggcatggattattgaggctcttttgctggttgaacaatcatccaacggccctatttttcactccaagatccataactaatgcaaacatcatgaatatttcttgcatctcttaattggtttggtcacaaggcatccatgtaatcatagagaacaaagtaggtagctttggtaacttaggatgaaacctgtgattgttgcttcaatgaggaggactcatcatgtatcggaactatgtttattttttttccaaataaacaatcggtttccttacaaaaaaaa

SEQ ID NO: 998 - DNA, 2408 bp, Panax ginseng
gtacatgggggaagagagttctcgagtcctgaccgaagttgtatcatcaggtccaacaatccaaaactgtgtccgactaattcgccttttgtttgtgcgtactgcgtcccaagtcccaaccactaaaaccctaaccctaaaaaccccattctcagtttcccgtctgaacccttctcttattattgtttactttctgtcatcttgctaagcactcttcaagtagaagttcgaaccctaactttctctctcctgcctctaatttcactgatcaacaaggatgtatcgttttgccaccaaacttgcgttcaaaactcagatcgttaggaagagtaatcagcagattggtagtagattggcttggagccgaaattatgcagctaaagatattagatttggagttgaagcccgagctttgatgcttcgaggtgtcgaagagcttgctgatgcagttaaagtcacaatggggcctaaagggcgtaatgttgtcttggaacaaagttttggggcccctaaagtgaccaaggatggtgtcaccgttgcaaagagcattgagtttaaagacagagtcaagaacgtcggagccagcctcgtaaagcaggttgcaaatgctacaaacgatgttgctggtgacggtaccacctgtgcaacaatcctcacacgtgcaatattttcagaagggtgcaaatctgtggcagctggaatgaatgccatggatctcagacgtggaatcaccatggcagttgatgctgtggtagcaaacttgaagagcagagcacggatgattagtacatctgaggaaatagcgcaggttggcacaatatcggcaaatggcgaaagagagattggagagcttatagccaaggctatggagaaggttggcaaagagggagttattacaattactgatgggaaaacactgcacaatgaactagaagtggttgagggaatgaagctggacaggggttacatatccccttacttcatcaccaatcccaagaaccaaaaatgtgaattggaagatccattgattttgatccatgagaaaaagatatctagcttaacagctgtggttaaagtgctggagttggccttgaagaagcaaagacctttattgatagtttctgaagatgtggaaagtgaagcattagcaactctcattctgaataagcttcgtgctggaatcaaggtttgtgccattaaagctcctggatttggagagaacaggaaggccaatttgcaagaccttgcaaccctcactggaggcacggttataaccgatgagcttggaatgaaccttgaaaaggtgggacttgaagtgtttggctcatgcaaaaaggttacaatatcaaaggatgatacagttatccttgacggagcaggtgacaagaaagctattgaagaaagatgtgagcagctaagatcaacaattgagttaagcacttcagattatgacaaggagaagcatcaggagaggttagcaaaactttctggaggtgttgctgttttgaagattggaggagccagcgaagctgaggttagtgagaagaaggatagagtaactgacgctttaaatgctacaaaggcagctgttgaagaaggaattgtcccaggtggtggtgtagctcttctttatgccttgaaggaacttgaaaaactgcagactgccaattttgatcagaagattggtgttcagattatccagaatgctctcaaggcacctgtgcaaacaattgcttctaacgctggagtcgagggagctgttgtggtaggcaagctgttggagcaggacgatcctgatcttggatatgatgcagctaaaggtgcatatgtagacatggtcaaggcaggaattattgacccgttgaaggtcattaggacagctctggtagatgctgctagtgtctcgtctttgttgacaactacggaggctgttgtggtagaacttcccgaggatgaaaaggaagtaccagcaacaggtggaggtatgggtggcatggattactaaccccgctgaccgctggtctcagtaaaacaacttgatttggataccagaaattctacataaaaattgaaactgtattaggtaaatctgtagtttagctgattttactgtccacccttttcatacttagattttcagttatccctctggaagtctgaaaccagcgtccaaccaatggtttggagttgtagttattcaccaagtaaaaacattcaaagggggagtcttaataattgggaattgtgagaggtgagcctgtagaaggaatgttttgacattagcgttttgttaaaggggtttttctcttgttatttaaatttttaagtcaaatcccaaatggacacgcacaaaacagagcatttgcactatctaatttgttgtcacatataataataatgttggtgca

SEQ ID NO: 999 - DNA, 2006 bp, Solanum tuberosum
ggtttctttctctaaataagcccaacttcttcatatctcctctcttcagtttttctctctttttctcagctgcaaaaaatttcttgtacaattatgtatcgttttgcagcaaaacttgcttctaaatccagggttgcaagaagcagcacccaacagattggtagtaggttgaattggagcagaaactatgctgctaaggatattaaatttggagttgaagctaggggactgatgcttcaaggagttgagcaacttgctgatgcagttaaagtcactatgggtccaaagggtcgtaatgtggtgattgaacaaagttggggtgcacccaaggtgacaaaagatggtgtcactgttgcaaaaagcatcgaattcaaggacaaaataaaaaatgttggtgccagccttgtaaagcaagttgccaatgccactaatgatgctgctggtgatggtaccacttgtgcaacagtcctcacccgagcaatatttgctgaagggtgcaagtctgtagctgctggtatgaatgcaatggatcttagacgaggtatcacaatggctgtcgatgctgttgtaacaaacctgaaaagcagagcacgcatgataagcacatccgaggagattgcccaggttggtacaatctctgcaaatggagaaagggaaataggtgagataattgcaagggctatggagcaagtaggaaaggaaggtgtcatcactattcaagatggaaagacactgcttaatgatttgcaagttgttgaggggatgaagttggacaggggctacatatccccatacttcatcacaaatgagaagaatcagaaatgtgagctggatgacccacttattcttattcacgagaaaaaaatctcaagcataaatgctattgtgaaagtgttagaattggctttgaagagacaaaggcccctcctaattgtgtccgaggatgtggagagtgaagcactcgctacacttattctgaacaagcttcgtgctggaatcaaggtttgcgccataaaagctccaggatttggtgaaaacaggaaggctaatttgcaagatcttgctgctttaactggaggccaggtcataacggaagaacttggaatgaacattgaaaatgtagagttggacatgctgggaaaatgcaaaaaggtgactatctccaaggatgacaccgttgttcttgatggtgcgggtgagaagaaggccatagaggagagatgtgaacagattagatcagcaattgaactgagcacgtctgattatgacaaggagaaattgcaagaaagactagctaggctttcagggggtgttgcagtgttgaaggtaggaggagctagtgaaattgaggttggtgagaagaaagacagagttacagatgctttgaatgccacaaaagctgctgtcgaggaaggaattcttccaggtggtggggttgcacttctttatgcatcaaaagaattggactcattgccaacagccaactttgatcagaagattggtgttcaaattattcagaacgctctgaagacaccagtatatacaattgcctctaatgctggggtggaaggatcagtagtggttggcaaattgttggagcaggataacccggatcttggatatgatgctgcaaaaggtgaatatgttgatatggttaaagcaggaatcattgatccattgaaagtaattaggacggccctggttgatgctgctagtgtgtcatctttattaactacaactgaagctgttatcgttgagcttcccaaggatgagaaggcagctccagctatgcctggtggtggtatggactactaatgcactagcaaagaacagtgattcaagctgcctgacatacaatttagcacacagaataagaaacttaaggttgttgctcatggtacctcaattgtaacactagcaagagatgaatgtgaattcatgtttttgtaggttgagaacttgtaatatttgcaagacaatgcggcatcctcatttttaatccactt

SEQ ID NO: 1000 - DNA, 2061 bp, Trifolium pratense
cagtactgcagtgttgttcttcttcttccctcaacgtcagtctctgcaatttcatctgtactttgttttctcagttaccctttactcaattcaatcacatcatgtatcgttttgctacttcaattgcctctaaagctcggattgctaggagcaatgttaatcagattggaagtagggtggcatggagtagaaattatgcggcaaaagagatcaaatttggtgtggaggctcgagctttgatgcttaagggtgttgaagagcttgctgaggcagttaaagtaaccatgggtcctaagggccgtaatgtggtgattgagcaaagttatggtgctcctaaagtgacaaaagacggagtaactgttgctaagagcattgagttcaaggataaagttaagaatattggtgccagtcttgtaaagcaggttgcaaatgctaccaatgatgtggctggtgatggaactacatgtgctacaattcttactcgagcaatatttacggaagggtgcaaatcagttgcagctggaatgaatgcaatggacttgaggcgaggtataaacatggctgttgatgctgttgtgacaaacttgaaaagccgagcaaggatgattagcacttccgaagaaatagcccaggttgggacaatatctgctaatggtgacagagaaattggtgagttgattgcaaaagctatggagaaagttggcaaagaaggtgtaatcaccatcgcagatggcaagacattggacaacgagttggaagttgttgaaggaatgaagcttgaccgaggctacatttctccatatttcataacaaaccagaagaatcagaaatgtgaacttgaggatcccctcattataatccacgagaagaaaatctcaagtattaattccatagttaaagtattagagttagctttgaagaaacaaagacctttgttgattgtcgctgaggatgtggaaagtgatgcacttgcaactcttattctaaataagcttcgtgctggaatcaaggtatgtgcgatcaaagcccctggttttggtgaaaaccggaaatctggtctccaagatcttgctgttcttaccggaggtcaacttatcaccgaagagcttggcttgaatcttgaaaaagttgatcttgatgtgtttggctcttgcaaaaagattacaatttccaaagatgacactgtcattcttgatggagctggtgataagaaatcaattgaggaaagatgtgagcagattaggtcagcaatcgaaaatagcacttcagattatgacaaggaaaagttacaggaaagattagccaagctttctgggggtgttgcagtgcttaagattggaggagccagtgaggctgaagttggtgagaagaaggatagagtgacagatgccttaaatgcaaccaaggcagctgtagaagagggcatagtacctggcggtggtgttgctcttctttatgcgtcaaatgagttaagtaagcttccaactgccaattttgatcagaagataggtgtccagattattcaaaatgctttgaagacacctgtgcacacaattgcatcaaatgctggagttgagggtgctgttgttgttggtaaactattggaacaggataatcccgaccttggctacgatgccgccaaaggtgaatatgttgatatgattaaatccggaataattgatccgttgaaggttattagaaccgccttggttgatgcagccagtgtgtcatctttgatgacaacaactgaagctgttgtgtctgaactcccaaaggacgataaagacggtcctgccatgcctggcggcatgggcggcatggattattaggctgctatgaagacctggattggagtggtgcttcaccactattatagcctctcttttttcttatttatttgacataaggcatccatgtaatcatagtgagagatcaaagctgtaggtaggaggatttgtgattgttattgctatgatagaattgagacatttggaacatttttcattccaaaacactaaggaattgttcccttcataagttgtcaattgaaacaagacttct

SEQ ID NO: 1001 - DNA, 1944 bp, Flaveria ramosissima
ccgtaaacatgtatcgttttgcagcaaatcttgcttctaaatctaggattgtaaacaccagaactcaacagattggaactaggttgaattggagtagaaactacgcggctaaagacatcagatttggagttgatgccagggctttaatgcttaaaggtgttgaagagcttgctgatgctgttagagtaactatgggtccaaaggggcgtaatgtggtgattgaacaaagttatggagccccaaaagtaacaaaagacggtgtaactgttgcgaaaagcattgaatttagtgataaagtcaagaatgttggtgcgagtcttgtgaaacaagttgctaatgctacaaacgatgttgctggtgatggtactacttgtgcaacagttcttacacgtgcaatattttcagaagggtgcaaatcagttgcagctggtatgaatgcaatggacctacggcgaggtatttccatggcggttgatgcggttgttacaaacttgaagagtagggctcgcatgataagcacatctgaggaaatcacacaggtgggtacgatttctgcaaatggagaacgtgaaataggtgaattgatagccaaagctatggaaaaagttgggaaagagggtgtcatcaccattcaagatgggaagacactgtataatgagctagaagttgttgagggaatgaagttggacaggggatacatatctccacatttcattacaaaccaaaaaaatcaaaaatgtgaactagatgatcctattgttctaatacacgagaagaagatttcgaacattaattcggttatcaaagtgttagagttggcactgaagaaacaaaggcccctgttaattgttgctgaagatgtggaaagtgacgcgttggctaccttaattcttaacaagcttcgtgctggaattaaggtttgtgctattaaagcacctggttttggtgagaacagaaaggcaagcttgcaagatcttgccactcttaccggtggtcagcttataaccgaagaactgggtatgaatcttgacaatgtggagcccgaaatgcttggctcttgtaaaaaggttaccgtatctaaagatgacacagttgtgcttgatggtgctggtgataagaagtctatagaagaacggtgtgaacagataagatcagcaattgaggctagcacgtctgattacgataaagagaaattgcaagacaggttagctaagctttctggtggtgttgctgtacttaagattggaggagctagtgacagtgaagtaggtgaaaagaaagatagagttacagatgctttaaatgccacaaaggcagctgttgaggagggaattgtgccaggtggtggcgttgctcttctgtatgcatctaaagaattggataagttgcaaacagccaattttgatcagaaaataggcgttcaaattattcaaaatgcactaaagatgccagttcataccattgcttctaatgctggagtggagggttcggttgtggttggtaagcttttagagcaggatgatccggaccttggttatgatgcagctagaggtgaatatgtggatatggtgaaaaacggaatcattgacccgctgaaagtgattagaacagccttagttgatgcagcaagcgtgtcttctttgatgaccaccactgaagctattgtggttgaactccccaagccggctagtgaaccggctccaggaatgggtggcatgggcggaatgggtggcatggactactgacccatgacgtgattctgcaacctattgacttacattttactgacaaaataaacacacaaaaggttggcttttaatgtgagagttagagtttcccttttttctatggcatttggcttgtgagcaaacttgatcagcctgcggatatttattaagcgcaagttttgtgaacaaattttgatcaataattcatattctgata

SEQ ID NO: 1002 - DNA, 2039 bp, Panax ginseng
cctcttcaactcattgaagtacttcaatttgaaacctaaatttctctctcctctttctcagtctcagcagggatgtatcgtttcgccaccaaacttgcctccaaagctcagatcgctaggaacagtacacatctgattggaagtagattggcttggagccgaaattatgcagccaaagatattagatttggtgttgaagcccgagctttgatgcttcggggtgtggaagagcttgctgatgctgttaaagttacaatggggcctaaagggcgtaatgtcatcttggaacaaagctttggggctcctaaagtgaccaaggatggagtcaccgttgcgaaaagcatcgagttcaaagacagagttaagaatgtaggtgccagccttgtaaagcaggtcgcaaatgctacgaatgatgttgctggtgacggtaccacctgtgcaacagtcctaacgcgtgccatatattcagaagggtgcaaatctgtggcagctggaatgaatgccatggatctcagacgtggaattactttggcggttgatgctgtggtggcaaacttgaaaagcagagcaaggatgattagtacatcagaggaaatagcgcaggttggtacaatatcagctaatggagaaagagagattggagagcttatagccaaggctatggagaaggttggcaaagagggagttattaccatagctgatgggaaaacactagacaatgaactggaagttgttgagggaatgaagcttgacaggggctacatatccccttacttcatcaccaatcccaagaatcaaaaatgtgaattggaagatcctttgattttgatccatgagaaaaaaatatccggcttaacttccgtggtgaaagtgctggagttggccttgcagaagcaaagacctttattgatagtttctgaagatgtggaaagtgatgcattagcaactctcattctgaataaacttcgagctggagtcaaggtttgtgccattaaagctcctgggtttggagagaacaggaaggccaatttgcaagaccttgcgatcctcactggaggcgaggttattaccgaagagcttggaatgaaaattgaaaaagtgggacttgaaatgcttggctcttgcaaaaaggttacaatttcaaaggatgataccgtaatccttgatggggcaggtgacaagaaagctattgaagaaagatgtgagcagctaagatcgacaattgagttaatcacttctgattatgacaaggagaagcatcaggagaggctagcaaagctttccggtggtgttgctgttttgaagattggaggagcaagcgaagctgaggttagcgagaagaaggatagagtaactgatgctttaaatgctacaaaggcagctgttgaagaaggcattgtcccaggtggtggtgtagctcttctttatgcctcaaaggaacttgaaaagctgcagactgcaaattttgatcagaagattggtgttcagattatccagaatgctctaaaggcacctgtgcatacaattgcttccaatgctggagttgagggagctgtagtggttggcaaattgttggagcaggacgatcctgatcttggttatgacgcagctaaaggtgcgtatgtggacatgatcaagtcgggaatcattgacccattgaaggttattaggacagctctggtagatgctgcaagtatatcgtctttgttgactacaacggaggctgttgtggtagaacttcccaaggatgataaggaagtagcggcaatgggtggtggcatgggttattgaatgaataaatacacactgtaatccctctgggaccagaagcaacctgattttcaataccacaaacttgttaaattgaaactgtgtattaggtaaaaattgttagtttagctgatttttacagtctgccccattccgtaattgagattttaagtttctgttctctttctatattcttcctctggaagtctgaaaccggtgtaatcatagtaagagggggaggctgtacgaatgatatgaaattaatgttt

SEQ ID NO: 1003 - DNA, 2016 bp, Nicotiana benthamiana
cttctagacccttctctttcctctctaaataaaagacctaaaaactcgatattcaccccccacttctctctgtctctctcaccaccattttctcagttgcaaaaaaatgtatcgttttgcagcaaatcttgcctccaaagccagagttgcaagaaccagcactcaacatattggtggaaggttaaattggagtagaaattatgctgcaaaggacattagatttggagttgaagctcgggctatgatgcttcaaggtgttgaggaactcgctgatgctgttaaagtcactatgggtccaaagggacgtaatgtagtgattgaacaaagttggggtgcacccaaagtaacaaaagatggtgtcactgtcgcaaaaaatgttgagttcaaggacaaaataaaaaatgttggtgcaagccttgtaaaacaagttgccaatgctacaaatgatgttgctggtgatggtaccacgtgtgctacagtcctcacccgagcaatatttgctgaaggatgcaagtcagtggcagctggtatgaatgcaatggaccttagacggggtatcaccatggccgtagattccgttgtaacaaacctgaaaagcagagcacggatgatcagcacatctgaggaaatagcacaggttgggactatctctgcaaatggagaaagagaaattggtgagctaattgcaaaggctatggagagagtaggcaaggaaggagtcatcactattcaagatggaaagacactgttcaatgagttggaagttgttgaagggatgaagctggacagaggttacatctcaccatacttcattacaaatcaaaagaatcagaaatgtgaactcgatgacccactaattcttattcatgagaaaaagatctcaagcgttaatgcggtcgtgaaagcattagagttggctctgaagagacaaaggcccctcttaattgtggctgaagatgtggacagtgaagcacttgccactcttattttgaacaagcttcgtgctggaatcaaggtttgtgctattaaagcaccaggctttggtgaaaacaggaaagcgaatttgcaagatcttgctattttaactggaggccaagttgtaacagaagagcttggattgaacattgaaaatgtggagctggagatgctgggatcatgtaaaaaggtggctatttccaaggatgatactgtcattcttgatggcgctggtgagaagaagtccatagaggagcgttgtgaacagattagatcaaccattgaactcagcacatctgattatgacaaggagaagttgcaggaaagactagctaagatttcaggaggtgttgctgtgttaaagatcggaggagctagtgaagctgaggttggcgaaaagaaagatagagtcactgatgctttgaatgccacaaaggctgccgtggaggaaggaattgttccaggtggtggtgttgctcttctttatgcagcaaaggaattggataaattagaaactgccaactttgaccagaaaattggtgtacagattattcagaacgctcttaagacacctgtacatataatagcttcaaatgcaggagtagagggtgcggttgtggttggtaaactgttggagcaggacgatactgatcttggatatgatgctgccaaaggtgaatatgtggatatggtcaaggcaggaatcattgacccgttgaaagtgatcaggacagccttggtcgatgctgccagcgtatcgtctcttttgacaacgaccgaagcagttgtcgtcgagcttcctaaggatgagaaggaaactccagcaatgggtggtggcatgggtggtatggactactaatggagaagccaagaatagtaattgaagctgctcgacttacaattggttagaacaaatgaaataaatttagggttgttgcccattttgatgaatcttgaggataggcacccattgtacccatagtaagagagacttgtgtgaattcatctatatgtcggttgagaatttgttagtcttttttt

SEQ ID NO: 1004 - DNA, 2099 bp, Quercus alba
attctagaccttctcctccctttaaaagactcgtactcttttccccactttctctcaaaaccccatcgttttttctcttcttcttctctctttctcacagtctcagactctctctctttgttttctgtttcagccatgtaccgctttgcctcaagtctcgcctctaaagctcggcttgctaggaacacaacccagcagattggtagtagattgagttctagtagaaactatgccgccaaagatataagatttggggtggaggcccgggctctgatgctaaagggtgtggaggagcttgctgatgctgttaaggtcaccatgggtcccaagggacgtaatgtggtaatcgaacaaagttggggtgccccaaaagtgacaaaagatggtgtcactgtagcaaagagcattgaattcaaggacaaagtcaagaatattggtgctagccttgtgaagcaggttgcaagtgccaccaatgatgcagcaggggatgggaccacatgtgccacagtacttacacgggcaatatttaccgaagggtgcaaatccgttgccgcagggatgaatgcaatggacctaagacgtggtattagcatggcggttgattctgttgttaatcatttgaagagtagtgcacgaaagatcagcaaaagtgacgaaatagcacaggttgggacaatatctgcaaatggagagagagaaattggtgagttgattgcaagggcaatggagagagttggcaaagagggagtaatcacaattcaagatggaaaaacattgtacaatgagttggaagttgttgagggcatgaagcttgaacggggttacatatccccttacttcattactaaccagaaaaaccagaaatgtgaactggaagaccctctcattctaatccatgagaagaaaatctcaagtttaaatgccatcattaaagtattagaactggctttgaagagacaaaggccgttactaattgtttcagaagacgtggaaagtgaggctttggcaactctcattctcaataagcttcgtgctggaatcaaggtttgtgctatcaaagcccctggttttggtgaaaacaggaagtccaatctgcaggatcttgccattcttacaggaggcgaacttattactgaagagcttggcatgaatcttgaaaaagtggatctggatatgcttggctcatgcaaaaaggttacaatatcaaaggatgacactgttattcttgatggtgctggggacaagaaggctcttgaggaaagatgtgaacagatccggtccgcaattgaaaatagcacctctgattatgacaaagaaaagttacaagagagattgggaaagctttctggtggtgtagcagttttgaagattggaggagctagtgaaactgaagttagtgagaagaaggatagagtgaccgatgccttaaatgccacaaaggcagctgttgaagagggtatagtgccaggtggtggcgttgctcttctttatgcatcaaaagagttggaaaagctggaaactgccaactttgatcagaagattggtgttcagattattcagaatgctttgaagacacctgtgtacacaattgcttgtaatgctggagttgagggggctgttgttgttggtaagctgttggaagaaaatgaccctgacaaaggatatgatgcagccaaaggtgaatatgttgatatggtcaaagccggaataattgatccagtgaaagtgattagaactgctttggttgatgctgcaagtgtatcatctttgatgacgaccactgaagctattgtgactgaaatacccaaggatgataaagaagctccggcaatgggaggtggcatgggtggcatgggtggcatggattattgaggctcttttgctggttgaacaatcatccctattttcactccaagatccataactgatgcaatcatcaggaatttttcttgtatgtcttaattggtttggtcacaaggcatccatgtaatcatagagaacaaagtaggtagctttggtaacttaggatgaaacctgtgattgttgcttcaatgaggaatcatcatgtatcggaactttatttattttttccaaataaa

SEQ ID NO: 1005 - DNA, 2233 bp, Populus trichocarpa
aagagcacaaaaccctaaaccctaccaataactagaagctgccgcgctgcttctagagccttctctccctctacaaaaagcacaagctctcccctcgcccagcctcctgcttgtgctctctctgtctatatcatttcgacaatacttccccaataatcccacaaaagtttctctctgtttcttctctcttgtaagttttattaacactactatgcaccgcttcacctcgagcctcgcttctaaagctcggattgctaggagcagcaccaatcagattggaagtaggttgagttggagcagaaactatgctgccaaagacataagattcggtgtggaggctcgtgctgggatgctcaagggtgttgaagagctagctgatgctgtcaaagtcaccatgggccctaagggtcgcaatgtggttattgaacaaagctatggtgcccctaaagtgacaaaagatggtgtgactgttgctaaaagcattgaattcaaggataaagtcaagaatgttggtgctagcctggtgaagcaggttgcaaatgccaccaacgacactgcaggcgatgggaccacttgtgctacagttctcactcaagcaatatttactgaaggatgcaaatcagttgcagctggaatgaatgcaatggacctaagacgtggtatcagcatggcagttgaatcagttgttaccaatttgaagagcagagcaagaatgatcagcacatctgaagaaattgcacaagttggtacaatatcagcaaacggggagagggaaattggtgaattgatagcaaaggccatggagaaggttggcaaagagggagttataacaattcaagatgggaaaacattatctaatgagttggaagttgttgaggggatgaagcttgacaggggctatatatccccttatttcatcacagaccagaaaacccaaaaatgtgaattagatgaccctctcattctgatccatgacaagaaagtctcaagtttgcatgctgtggtgaaagtcctagagttggctttaaagagacaaaggcccttgctgattgttgctgaagatgtggaaagcgaggccttggcaactcttattttaaataagcttcgtgctggaatcaaggtctgttccattaaggcccctggtttcggagagaacaggaaggccatattgcaggatctggctgcactcacaggaggcgaagttataactgaagagcttggcctcaatcttgaaaatgtggatttggatatgcttggcagttgcaaaaaggttacagtatcaaaggatgacacagttattcttgatggtgctggcgataagaagtccattgaagaaagatgtgaacagatccgatctgcaatagattcaagcacttctgactatgacaaagagaagttgcaagaaagattggcaaagctttctggtggtgttgctgtgctgaagattggaggagccagtgaagctgaagtcagtgagaagaaagatagagttacagatgccctaaatgccacaaaggctgctgtagaagagggtattgtgccaggtggtggtgctgctcttctttatgcatcaaaagagttggataagcttcaaactgcaaactttgaccagaagattggtgttcaaattatacagaatgccctgaagactcctgtgcatacaattgctagtaatgcgggagttgagggagctgttgttgttggtaagctattggagcaggacaaccctgatctagggtatgatgctgccaaaggtgaatatgttgatatggtgaaagctggaattattgacccactgaaagtaattagaactgctttggtcgatgctgccagtgtctcgtcgttgatgacaacaactgaggctgttgtaactgatcttccaaaggatgtaaaggatgctccagcaatgggtccaggcatgggcatggattattgaggttgttttttagacattgatccgaactgcctgacataaatatttcaccctttgtacccaaatcagtgagcattgttcttctgatcgaaagacatgtaatcatagtgagcaagttgcggcatgtaggtagtgttcgatgattggataatggatttttgttagggaaaacttgcatgtaaggcgcctttttcctcaaaataaaacatcctcatctttgtaaaccaagagctcggtctggtagttcccttccttatgttctcctgcaagaaacaccatccccacgaaccatttctactt

SEQ ID NO: 1006 - DNA, 2117 bp, Fragaria vesca
gtatccaattcattcatacccagaagcctcttacttcctctctctgcaacttggatcaccatgtaccgcttcgcctctaacctcgcctccaaagccaggttggctaagaccagtggccagcagattggtagcagaataagttggagaaggaactatgctgccaaggatattaaattcggtgtcgaagcccgatcattgatgctcaggggtgtggaagagcttgccgatgccgttaaagtcacaatggggccaaaaggacgcaatgttgttctggagcaaagctatggagcccctaaggtgacaaaggatggtgtcaccgtagcaaagagcatcgagttcaaagacaaagtcaagaacattggtgctagtcttgtaaaacaggtggcaaatgctacaaatgatgctgcaggcgatggtaccacttgtgcaacagttctcacccgtgccatatttactgaaggatgcaagtcagttgcagctggaatgaatgccatggacctaagacggggcatcacaatggcagttgattgtgttgtgacaaacttgaagagtagggctcggatgatcagcacatctgaggaaatagcacaggttggcacaatatcagctaatggtgaccgagaaattggtgagctaatagctaaggctatggagaaagtcggcaaagaaggtgttatcaccatatctgatggaaaaacactcgataatgaattggaggttgttgaaggaatgaagctggacaggggttatatatccccttacttcatcaccaatcagaagaaccaaaaatgtgaattagaagatgcacttgtcttaatctacgaaaagaaaatctcaaatctaaatgctgtagtgaaaatattggagctggcattgaagaaacaaaggcctctgctgattgttgctgaagattttgaaagtgaagcgcttgctacactcattttaaacaagcttcgtgctggaattaaggtctgtgcaattaaagctcccggatttggagagaacaggaaggcaaatttgcaggacataagcgttcttactggaggcgaggtgataactgaagagcttggtctaaacctcgaaaaagtaacaccagagatgcttggaacatgcaaaaggattacagtatccaaggatgacaccgttattcttgatggggctggtgacaagaaagctattgaagaaagatgtgaacagttaagatcatcaattgaattaagtacttcggactacgacaaggagaagctacaagagcgtctggcgaagctttctggtggagttgctgttttaaagattggtggtgccagtgaaacagaagttggtgaaaagaaggacagagttactgatgctctgaatgccaccaaggctgccgtagaggaaggaattgtacccggtggtggtgcagcacttctgtatgcctctaaagaactggacaagttacaaactgcaaactttgatcaaaagattggtgtgcagatcattcagaatgctcttaagatgcctgtatacacaattgcttctaatgctggagtggagggggcagttgttgttggcaagctattggagcaggacaatcctgaccttggatatgatgcagcaaagggtgaatatgtagatatgataaaggccgggatcattgatcccctaaaagtcatcagaactgccttggtagatgctgcaagtgtctcctccttaatgactactactgaggccgttgttgtctcgctcccagagaaggaagcccctgcagtgggagctggcatgggaggaatgggaggaatggattactagaagttcagtagttggatctgctagagcctctgctgctaatagtctatcctctttatactgactcctcgaattcctttttttctttttcccgatggtattgttggaggccaaacatgaatgtaatcatagtgagatgaggttttaatctgtaggaggaatgtagtgctattaattagtcaggcaagagattttgttctcctcacattagacttgagaaaattcatatttccagaaaaccttggtgtgattggtgaacaatgatagtacaaaaactgaaataatctgtgggacaatgaacatggaaattcctcaatttcttctgtatt

SEQ ID NO: 1007 - DNA, 2054 bp, Panax ginseng
aagcagtggtatcaacgcagagtacgcgggggaagtacttcaatttgaaacgtaactttctctctcctctttctcagtctcagcggggtgtatcgtttcgccaccaaacttgcctccaaagctcagatcgctaggaacagtacacatcagattggaagtagattggcttggagccgaaattatgcagccaaagatattagatttggtgttgaagcccgagctttgatgcttcgtggtgtggaagagcttgctgatgctgttaaagttacaatggggcctaaagggcgtaatgtcatcttggaacaaagctttggggctcctaaagtgaccaaggatggagtcaccgttgcgaaaagcatcgagttcaaagacagagttaagaatgtaggtgccagccttgtaaagcaggttgcaaatgctacgaatgatgttgctggtgacggtaccacctgtgcaacagtcctaacgcgtgccatatattcagaagggtgcaaatctgtggcagctggaatgaatgccatggatctcagacgtggaattactttggcggttgatgctgtggtggcaaacttgaaaagcagagcaaggatgattagtacatcagaggaaatagcgcaggttggtacaatatcagctaatggagaaagagagattggagagcttatagccaaggccatggagaaggttggcaaagagggagttattaccatagctgatgggaaaacactagacaatgaactggaagttgttgagggaatgaagcttgacaggggctacatatccccttacttcatcaccaatcccaagaatcaaaaatgtgaattggaagatccattgattttgattcatgagaaaaaaatatccggcataacttccgtggtgaaagtgctggagttggccttgcagaagcaaagacctttattgatagtttctgaagatgtggaaagtgatgcattagcaactctcattctgaataagcttcgagctggagtcaaggtttgtgccattaaagctcctgggtttggagagaacaggaaggccaatttgcaagaccttgcgatcctcactggaggcgaggttattaccgacgagcttggaatgaaaattgaaaaagtgggacttgaaatgcttggctcgtgcaaaaaggttacaatttcaaaggatgatacagtaatccttgatggggcaggtgacaagaaagctattgaagaaagatgtgagcagctaagatcgacaattgagttgatcacttctgattatgacaaggagaagcatcaggagaggctagcaaagctttccggtggtgtagctgttttgaagattggaggagcaagcgaagctgaggttagcgagaagaaggatagagtaactgatgctttaaatgctacaaaggcagctgttgaagaaggaattgtcccaggtggtggtgtagctcttctttatgcctcaaaggaacttgaaaagctgcagactgccaattttgatcagaagattggtgttcagattatccagaatgctctaaaggcacctgtgcatacaattgcttccaatgctggagttgagggagctgtagtggttggcaaattgttggagcaggacgatcctgatcttggttatgacgcagctaaaggtgcgtatgtggacatgatcaagtcgggaatcattgacccattgaaggtcattaggacagctctggtagatgctgcaagtatatcgtctttgttgactacaacggaggctgttgtggtagaacttcccaaggatgagaaggacgtaccggcaatgggtggtggcatgggttattgaatgaataaataaacactgtaatccctctgggactagcgaagcaacctgattttcaataccacaaacttgttaaattgaaactgtgtattaggtaaaaattgttagtttagctgatttttacagtctgccccattccgtaattgagattttaagtttctgttctctttctatattcttcctctggaagtctgaaaccggtgtaatcatagtaagagggggaggctgtacgaatgatatgaaattaatgt

SEQ ID NO: 1008 - DNA, 1808 bp, Capsicum annuum
tttcttgtaattatattttaatttataattatgtatcgttttgcagcaaaacttgcttctaaatccagggttgccagaagcaccacccaacaggttggtagtaggttgaattggagcagaaactatgcagctaaggatattaaatttggagttgaagctcggggattgatgcttcaaggtgttgaacagcttgccgatgctgttaaagtcaccatgggtccaaagggtcgtaatgtggtgattgaacaaagttggggtgcacccaaggtgacaaaagatggtgtcactgttgcaaaagccgtcgaattcaaggacaaaataaaaaatgttggtgccagccttgtaaaacaggttgccaatgccactaatgatgctgctggtgatggtaccacttgtgcaacagtcctcacccgagcaatatttactgaagggtgcaagtctgtagctgctggtatgaatgcaatggatcttagacgaggtatcacaatggctgttgatgctgttgtaacaaacctgaaaagcagagcacggatgataagcacatccgaggagattgcccaggttggtactatctctgcaaatggagaaagggaaattggtgagctaattgctagggctatggagaaagtaggcaaggaaggtgtcatcactattcaagatggaaggacactggaaaatgatttggaagttgttgaggggatgaagctggacagaggctacatatccccgtacttcatcacaaatgagaagaaccagaaatgtgagctggaggacccacttattcttattcacgaaaaaaaaatctcaagcataaatgcgattgtgaaagtgttagagttggctttgaagagacaaaagcccctcttaattgtgtccgaagatgtggagagtgaagcacttgctacacttattctgaacaagcttcgcgctggaatcaaggtttgcgccatcaaagctccaggatttggtgaaaacaggaagtctaatttgcaagatcttgcagctttaactggaggccaggtcattacagaagaacttggtttgaacattgaaaatgtggagttggacatgctgggaaaatgtaaaaaggtgactatctccaaggatgacactgttattcttgatggtgcgggtgagaagaaggccatagaggacagatgtgaacagattagatcagcaattgaactgagcacatctgattatgacaaggagaaattacaggaaagactagctaagctttcagggggtgttgcagttttgaagataggaggagctagtgaagttgaggttggtgagaagaaagacagagttaccgatgctctgaatgccacaaaagctgccgtagaggaaggaattgttccaggtggtggagttgcacttctgtatgcatcaaaagaattggagacattgccaacagccaactttgaccagaagattggtgtgcaaattattcagaatgctctgaagatgccagtacataccattgcctctaatgctggggtggagggatcagtagtggttggcaaactgttggagcaggataaccctgatcttggatatgatgcggcaaaaggtgaatatgttgatatggtaaaagcaggaatcattgacccattgaaagtaattaggacagccctggttgatgctgctagtgtgtcatctctattgactacaactgaagctgttattgttgagcttcccaaggatgagaaggcatctccacctatgcctggtggtggtatggactactaatgcactatcaaaaagcagtgattcaagatgacctgacgtacaatttagctcacaga

SEQ ID NO: 1009 - DNA, 2089 bp, Aquilegia formosa
actcgcccaacttctcgactataatttctttgcttcaatctctttctgatcaaaatcctctttgcttttaccatttgaaacaacaaaaaccctaataaactcttttgcttctctaatctttaattaaatatgtttagagctgttgcaaaccttgccactaaagctaggatcgcgaggaacagtagtcatcagatcggaagtaggattggttggaacagaaattatgcagcaaaagacattagatttggtgttgaagctcgtgctttgatgcttaggggtgttgaagagcttgctgatgcagttaaagtgactatgggaccaaaggggcgtaatgttgtattagaacaaagttatggtgcccccaaggtgacaaaagatggtgttactgttgccaagagtattgaatttaaggaccgaattaagaatgttggtgctagccttgttaagcaagttgcaaatgcaaccaatgatgccgctggtgatggtacaacttgtgctactgtgctcacccgagcaatattttctgaaggatgcaagtcagtagcagctggaatgaatgcaatggaccttagacgtgggatcacaatggctattgattcagtagtgacaaccttgaaaagcagaacgcgaatgattagcacatccgaagaaatagctcaggttggtacaatatcagcaaatggagaaagagaaattggtgagctgttagccaaggctatggagaaagttggcaaggagggtgttatcactatagttgatggaaagacgctgtataatgaattggaagttgtggaaggcatgaagcttgacagggggtatatatctccctacttcgtcacaaaccagaagaaccagaaatgtgaattagatgatcctctcattttaattcatgagaagaagatttcaagcataaatgctgtcgttaaagttctagagttggccctaaagcatcaaagatccttgttgataattgctgaagatgtggaaagtgatgcactggcgactctccttataaataagatccgagctggaatcaagctttgtgctattaaggctcctggatttggagagaacaggaaggccagcatgcaagatcttgctgttctcacagggggtcaactcataactgaagaacttggaatgaacctagagaaggtagacctgggtatgctgggcacatgtaaaaaggtgacagtatctaaagatgacacagttgtacttaatggggctggtgagaagacagccattgaggaaagatgcgagcagctgaggtccacaatggagttgagcacttctgactatgataaagagaagctacaagaaaggcttgcaaagctttctggtggtgttgcaattttgaagattggtggagctagtgaagccgaagttggtgaaaggaaggatagagttactgatgctctaaatgctactaaagcagctgttgaagagggtattgtcccaggtggtggtgttgctcttctttatgcatcaagggatctggacaagttgcagacagccaattttgaccaaaaaattggagtccaaattattcagaatgctctcaagatgcctgtgcacactattgcttccaatgctggagtggagggggctgttgttgttggcaagctcttggagcaggacaataccgaccttggatacgatgcagccaaaggtgaatatgtggacatgatcaaggctggaattatagacccattgaaagtaatcagaactgctttggtcgatgctgctagtgtgtcttcgttgatgaccacaactgaggctgtcatcgttgagcttccaaaagatgagaccagtgctccatcaatgggtggaggtatgggaggtatgggtggcatgggcggcatggatttttgaaggaacttatggtgataggcaagccattgaaatggacatgactgaagttgtgtcgtagactttgttcagtgatatgccttgtcagtgctgagttcaaatatttcttcccctatttgtgtaagggaggatatagtcatagtttgaggattagctttcgtgaaattttgttctccataacatagtggttgtaccatagtaacttgagtaaatttta

SEQ ID NO: 1010 - DNA, 2143 bp, Phaseolus vulgaris
caaaagcaaaacacaagaacttctggaacataaaaccctaaaccctagaaactgcttcttctagagccttccctccttcccttgaaaagaagcgtgaagcatttcccttctgcattagtctctgcaacttcttcagtgctttctcagttgctcgcatcatgtaccgctttgcaacctcccttgcttccaaagctagaatttctaggagcggcacccaacaaattggaagtagggtgagttggagcaggaattatgctgccaaagacattaagtttggcgtggaggcccgggctttgatgcttaagggtgttgaagagcttgctgatgctgtcaaagtaaccatgggccctaaggggcgtaatgtggtgattgagcagagttttggtgcacccaaagtgacgaaagatggagtaactgttgctaagagtattgaattcaaggacaaggttaagaatattggtgctagtcttgtaaagcaggttgcaaatgctaccaatgatgtggctggtgatggaaccacatgtgctacaattcttactcgggctatatttacggaagggtgtaaatcagttgcagctggaatgaatactatggacctgagacgaggtataaatatggctgttgattctgtggtgacaaatctgaaaagcagagcacgaatgattaacacttctgaagaaattgcacaggttgggacaatatctgccaatggggagagggaaattggcgagttaattgcaaaagctatggagaaggttggcaaagagggtgtaatcactatctcagatggaaaaacattatataacgaattggaagttgttgaaggaatgaagctcgacaggggatacatttctccatatttcataacaaaccagaagaatcagaaatgtgaactagaggatcctctcattataatccatgaaaaaaaaatctcaagcataaatgccattgttaaagtattagagttagctttgaagagacaaagacctttgttgattgttgctgaggatgtggaaagtgatgcccttgcaactcttattctaaataaacttcgtgctggaatcaaggtatgtgcaatcaaagctcctggttttggtgaaaatcggaagtctggtctccaggatcttgctgttcttacaggaggtcaacttatcactgaagagcttggcctgaaccttgaaaaagtggatctggaaatgtttggctcttgcaaaaagttaacaatttctaaagacgacactgttatccttgatggagctggtgataagaaagcaattgaagaaagatgtgagcagattagatcagcaattgaaaatagcacttcagattatgacaaggaaaagttacaagaaagattagccaagctttctgggggcgttgcagtgcttaagattggaggagccagtgaggctgaagttggagagaagaaggatagagtgacagacgccttaaatgcaaccaaggcagctgtagaggaaggaatagtaccaggtggtggtgtcgctcttctttatgcatcgaaagagttggataagcttcacactgccaactttggtcaaaagataggtgtccagattatccaaaatgctttgaaggcttctgtgcacaccattgcttcaaatgcaggagtggaaggtgctgttgttgttggcaagctattggaacagaataatcctgatcttgggtatgatgcagctaaaggtgaatatgttgatatggttaaagctggaatcattgatccattgaaggtgattaggaccgccttggttgatgcagccagtgtgtcatctttgatgacgacaactgaagctgttgtgtctgaactcccaaaggacgataaagatgttcctgccatgggtggtggcatgggtggcatggattattaaggggcctattttcaccagctctttttcgttggatttggagtggaggggtgtataactatttttgcttttttattgacacagaaggcatccatgtaatcataggtagagataaaaaatgtagggagagaaatttatgattattgttgcagtgaaattgaggaacatctgaaacatttttcagattccgaattatgattgaacatttttccactctgaaattttcaattgaaaggtgacccgtaataattgcagtagtt

SEQ ID NO: 1011 - DNA, 2235 bp, Ricinus communis
attgttgatcagtttgagcccaatattttcacagaccaaacaaagataccgaaacacaaattttgtgtgcttctctttgatacctcagtcccgtaccttacccccaccaaaaccctaaaccctacctacctctcttcttcttcttcttcttcttcttcaactagaggcctataatctcatttaattttcacttttttagcaatgtatcgttttgtctctggactcgcatctaaagccagattggctaagaacagtacccagcaggtgggtagtagattggcttggagcagaagttatgcagctaaagatataaaatttggcgttgaagctcgcgccttgatgcttaaaggtgttgaggatcttgctgatgctgttaaagtgacaatgggccctaaagggcggaatgtagttttggagcaaagttggggagcccctaaagtgacaaaagatggtgttacagtagccaagagcattgaattccaagacagagtgaagaatgttggtgctagcctcgtgaagcaggtcgcaaatgctacaaatgatgtggcaggcgatggaacaacgtgtgcaacagtcctcactcgtgcaattttagttgaaggatgcaagtctgtggcagctggaatgaatgccatggatctaagacgtgggatttcaatggcagttgatactgttatcactaacttgaagagcagaacaaggatgataagcacatctgaagaaatagcacaggttggaacaatatcagcaaatggagaaagagagattggtgagctcatagccaaggcaatggagaaagttggaaaagagggtgtcattactatttctgatggaaaaacattgtacaatgagctagaggttgtcgagggaatgaagctggacagaggctacatatccccttattttgtcaccaatacaaaaaaccaaaaatgtgaactagaagatcccctaattttaattcatgagaagaagatctcaaatctaaatgctgtagtcaaggttttagaattagctttgaagaagcaaagacctttgctgattgttgctgaagatgttgaaagtgaagcactagcaactctcattctaaacaagcttcgtgctggaatcaaggtctgtgccataaaagcaccagggtttggagaaaataggaaggccagtatgcaagaccttgccgttctcactggtggtcaggttataactgaggagcttggtatgaaccttgaaaaggtgggagcagaggcatttggctcatgcaaaaaggttacagtatccaaggatgacacaattattcttgatggatttggtgataagaaagccttggaagaaagatgtgagcagttgaggtcttcaatcgaattgagcacttctgattatgacaaggaaaaattgcaagagcggcttgcgaagctttctggtggtgttgcagttctgaagattggtggggctagtgaagcagaagttagtgaaaagaaagacagagttactgatgctctgaatgccaccaaggcggctgtggaggaaggaattgtacctggtggtggggttgcacttctttatgcatctaaagatttggacaagttgcatactgcaaactttgaccagaagattggtgtccagattatccagaatgctcttaagatgccggtacacactattgctgcaaatgcaggagtagagggggcagttgttgttggcaagctattagagcaggataatcctgatcttggatacgatgcagctaaaggggaatacgtggatatggtaaagtcaggaattattgatccactgaaagtcattagaacagccttggtagatgccgcaagtgtctcttcattgatgactacaactgaggccattgtgacggaactacccaaggacgagaaggaacccaccgccatggccggtggtggtggtggcatgggctattaaagtcgttccaccgtgacagcaccaataccctgatgattttaaactgacattaacctttcccttttattttttatttctctttcagcgaaccgcggagtttagttcaatcctcgttcatataaagtgtaatttttgactatacatatatatattttttggaccaatatgtatttttatccccacttatgggatctacaggggacgtaaaatgttttgaatctgaacccatttataacaataataaaaatgaaaatctttttgctggaataatacagatgggaaaaaagataaataccataaaagtgt

SEQ ID NO: 1012 - DNA, 2022 bp, Ricinus communis
tttgtgtgcttctctttgatacctcagtcccgtaccttacccccaccaaaaccctaaaccctacctacctctcttcttcttcttcttcttcttcttcaactagaggcctataatctcatttaattttcacttttttagcaatgtatcgttttgtctctggactcgcatctaaagccagattggctaagaacagtacccagcaggtgggtagtagattggcttggagcagaagttatgcagctaaagatataaaatttggcgttgaagctcgcgccttgatgcttaaaggtgttgaggatcttgctgatgctgttaaagtgacaatgggccctaaagggcggaatgtagttttggagcaaagttggggagcccctaaagtgacaaaagatggtgttacagtagccaagagcattgaattccaagacagagtgaagaatgttggtgctagcctcgtgaagcaggtcgcaaatgctacaaatgatgtggcaggcgatggaacaacgtgtgcaacagtcctcactcgtgcaattttagttgaaggatgcaagtctgtggcagctggaatgaatgccatggatctaagacgtgggatttcaatggcagttgatactgttatcactaacttgaagagcagaacaaggatgataagcacatctgaagaaatagcacaggttggaacaatatcagcaaatggagaaagagagattggtgagctcatagccaaggcaatggagaaagttggaaaagagggtgtcattactatttctgatggaaaaacattgtacaatgagctagaggttgtcgagggaatgaagctggacagaggctacatatccccttattttgtcaccaatacaaaaaaccaaaaatgtgaactagaagatcccctaattttaattcatgagaagaagatctcaaatctaaatgctgtagtcaaggttttagaattagctttgaagaagcaaagacctttgctgattgttgctgaagatgttgaaagtgaagcactagcaactctcattctaaacaagcttcgtgctggaatcaaggtctgtgccataaaagcaccagggtttggagaaaataggaaggccagtatgcaagaccttgccgttctcactggtggtcaggttataactgaggagcttggtatgaaccttgaaaaggtgggagcagaggcatttggctcatgcaaaaaggttacagtatccaaggatgacacaattattcttgatggatttggtgataagaaagccttggaagaaagatgtgagcagttgaggtcttcaatcgaattgagcacttctgattatgacaaggaaaaattgcaagagcggcttgcgaagctttctggtggtgttgcagttctgaagattggtggggctagtgaagcagaagttagtgaaaagaaagacagagttactgatgctctgaatgccaccaaggcggctgtggaggaaggaattgtacctggtggtggggttgcacttctttatgcatctaaagatttggacaagttgcatactgcaaactttgaccagaagattggtgtccagattatccagaatgctcttaagatgccggtacacactattgctgcaaatgcaggagtagagggggcagttgttgttggcaagctattagagcaggataatcctgatcttggatacgatgcagctaaaggggaatacgtggatatggtaaagtcaggaattattgatccactgaaagtcattagaacagccttggtagatgccgcaagtgtctcttcattgatgactacaactgaggccattgtgacggaactacccaaggacgagaaggaacccaccgccatggccggtggtggtggtggcatgggctattaaagtcgttccaccgtgacagcaccaataccctgatgattttaaactgacattaacctttcccttttattttttatttctctttcagcgaaccgcggagtttagttcaatcctcgttcatataaagtgtaatttttgactatacatatatattttt

SEQ ID NO: 1013 - DNA, 2032 bp, Cucurbita pepo
gtttttgggtttcagtggacgtctacaatgcaccgattcgccacaggcctcgcttccaaagcccgtcttgctaggaacggtgccaatcagattgctagtaggtctaactggagaagaaactatgcggcgaaagacgttaaatttggggtggaggctcgaggtcttatgctcaagggtgttgaggatcttgctgatgccgttaaagttacaatgggtccgaaggggcgcactgtagtgattgaacaaagttttggggctcccaaagttacaaaagatggtgtgaccgtcgccaaaagtatcgagtttaaagataaagttaaaaatgttggtgccagtcttgtgaagcaggttgctaacgcgaccaatgatgtcgcaggcgatgggaccacttgtgctactattctcacaaaagcaatatttacggagggctgcaagtctgttgctgctggaatgaatgccatggatttaagacgtggtatctccatggctgttgattcagttgtgaccaacttgaagagtagagcacgaatgataagcacatcagaagagatagcacaggtcgggacaatatctgcaaatggtgaaagagaaattggtgagttaattgccaaagccatggagaaagttggcaaggagggcgtgatcaccatctctgatgggaagacaatggataacgagttggaagtcgttgaagggatgaagttagataggggatatatttccccttacttcattacaaaccagaagaaccagaaatgtgaattggacgatcctcttattataatctatgaaaagaaaatctcaagcataaatgctgtggtgaaagttttggagttggctctgaagaagcaaaggccccttcttattgtttccgaagatgttgaaagtgaggcactagctactcttatcctgaataagcttcgtgctggaattaaggtctgtgccattaaagcaccaggttttggcgaaaataggaaggccggactgcaggaccttgcagttctcacgggtggtcaagtcattactgaagagcttggaatgaatctcgagaaagtcgatctggacatgcttggctcttgcaagaagatcacaatttcaaaggatgatacagttattcttgatggcgctggtgacaagaaggctattgaggaaagatgtgaacagataaggtcgggtattgaagcgagcacttccgattacgacaaggaaaattacaggagagattagcgaaactctctggcggtgtagctgtattgaagattggaggagcaagtgaagcagaagtgggcgagaagaaggatagagtcaccgatgctttgaatgccacaaaagcagctgttgaagaaggaatagtaccaggaggtggtgttgctcttttgtatgcatccaaagaattagataaacttccaactgccaactttgatcagaagattggtgtccagattattcagaatgctctaaagacacctgtacacacgattgcatcgaatgcgggagtcgagggagccgttgtggttggtaagctcttggagcaggacgaccctgatcttggttatgatgctgcaaagggtgaatatgtagacatggtcaaagctggcatcatcgaccctctgaaagtaatcagaactgcactagttgacgccgcaagtgtttcctctttgatgacaacaaccgaagcggtcgtagtcgaactccctaaggacgaaaaggaagttccagcaatgggtggtggcatgggcggaatggattactaaccaaagcagccatcaatagttataccttccacatatgtctagtagctcgacataccgacatgtcgcgaccgatgttgtttgaaatttccctggttcttcttggtttagctgttggaatgccatttgtttcataattggcagattttaatcccgtgatgatgacattttttttcgatgagttggaaaattattaggcaaaaatgaatgtagctcaagtgttgaataaaaaaatctttactacgaaaaaaaaaaaaataaaatactactgtagttgtact

SEQ ID NO: 1014 - DNA, 2224 bp, Lupinus angustifolius
ccttctcctctgtttcaaaaccccaccacctctctcttacttccccattcacattttttcatttctcactctcttttcttctttacactgttccattcctcatcactcaatcaatcatgcaccgttttgcttcaaatctcgcctctaaagctagggttgctaggaacattagccaacagtttggtggaagtaggttgagttggagcagaaactatgcggccaaagaagttaaattcggtgtcgaggctcgggctttgatgcttaagggtgttgaagatcttgcagatgctgtgaaagtaaccatgggtcctaaggggcgtaatgtggtgattgagcaaagttggggtgccccgaaagtgacaaaagatggagtaactgttgcgaagagcattgaattcaatgataaaattaagaatattggtgccagtcttgtaaagcaggttgcaaatgctaccaatgacgtcgctggggatggaaccacatgtgctactgtacttacccgagcaatatttaccgaaggctgcaagtcagttgcagctggaatgaatgcaatggacttgaggcgtggtataactctggctgttgatgctgtggtgacaaacttgaaaagcagggcacggatgattagcacatccgaggaaatagctcaggtggggacaatatcagctaatggggagagagaaatcggtgagttaattgcaaaagctatggagaaagttggcaaggagggagtaatcactatcgcagatggcaagactttatacaatgagttggaagttgttgaaggaatgaagcttgacaggggatacatatctccttatttcattacaaaccagaagaaccagaaatgtgaacttgaggatcctctcattttgattcatgagaagaaaatctcaagtatacaatctgttgttaaagtattagagttggctttgaagaaacaaaggcctttgttgattgttgccgaggatgttgaaagtgatgcattggcaactcttattttaaataagctccgcgctggaatcaaggtatgtgccatcaaagcccctggattcggtgaaaataggaaatcaggcctccaagatcttgcaattcttacaggaggatctcttatcactgaagagctgggcttgaatcttgagaaagtggatttggatttgcttggtacatgcaaaaaggtaacaatttccaaggatgacactgtcattcttgacggagcagccgacaagaaagcccttgaggaaagatgtgagcagatcaggtcagcaattgataatagcacttcagattatgacaaggaaaaattacaggaaagattagccaagctttctgggggtgttgcagtgcttaagattggaggagcaagtgaggctgaagttggcgagaagaaggatagagtgacagatgccttgaatgctactaaggcagctgtcgaggagggcatagtaccaggtggtggtgttgctcttctctatgcatcgaaagagttggataaacttcaaactgccaactttgatcaaaagattggtgtccagattatccaaaatgctttgaaggcacctgttcacataattgcatcaaatgcgggagttgagggtgctgttgttgttggcaaactatgggaacaggataatcatgatcttgggtatgatgcagcaaaaggtgaatatgttgatatggttaaatctggaatcatagacccagtgaaggttattaggacagccttggttgacgccgccagtgtatcatctttgatgacaacaactgaagctgttgtggttgagcttccaaaggatgaaaaagctgctccggctatgcccggtggcatgggtggtatgggtggcatggattattaaccatcttccttttgtttggaactggaatacagaatggtaaggaaaatgcaacaggcaataattccaatagtgattttggatcattttttaccatcaaatatacgttattgttccaagtgaaattgttaattgaaagattattgttccaagttaaggaaaaatacaggttatacagtttggtttattttcttaaggtatcataattattggaaatcttggttcaaggcttttgatttgatactgggctaaagatgcccctttgtttcacttattaaggttgtttttttatgaatattgtaattggaataatcttattactccaaaaaatcgatttctactttttcaaaaagtaatctaagagttttctt

SEQ ID NO: 1015 - DNA, 2159 bp, Glycine max
cttgttctagagccttcccttcacttcccttgcccttgaaaaggaagcgtgaagcgtttcccctccgcattagcctgtctttgcagtctgcaacaacttcttcttgagtgttttctcagttcctcacatcatgtaccgctttgcaacctccctcgcctccaaagctagaattgccaggagcagcactcaacagattggaagtagggtcacttggaacaggaattatgcggccaaagacattaagtttggtgtggaggctcgggctctgatgcttaagggtgtcgaagagctcgctgatgccgttaaagtaacaatgggccctaaggggcgtaatgtggttattgagcaaagttttggagcacctaaagtgacgaaagatggagtaaccgttgctaagagcattgaattcaaggacaaagtcaagaatatcggtgccagtcttgtaaagcaggttgctaatgctactaatgacgtggctggtgatggaaccacttgtgctacaattcttactaaagcaatatttacggaaggatgtaaatcagttgcagctggaatgaatgcgatggacctgagacgaggtataaatatggctgttgatgctgtggtgacaaatctgaaaagcagagcacgtatgattagcacttctgaagaaattgcccaggttggaacaatatctgccaatggggagagggaaattggtgagttaattgcaaaagctatggagaaagttggcaaagagggtgtcatcacaatctcagatggcaagacattgtacaatgagttggaagtcgttgaaggaatgaagctcgacaggggatacatttctccatatttcataacaaaccagaagaaccagaaatgtgaacttgaggatcctctcattataatccatgaaaagaaaatctcaagcataaatgctatcgttaaagtattagagttagctttgaagagacaaagatctttattgattgtcgccgaggatgtggaaagtgatgcccttgcaactcttattctaaataaacttcgtgctggaatcaaggtatgtgccatcaaagctcctggttttggtgaaaaccgtaaatctggtctccaggatcttgctgttcttacaggaggtcaacttatcaccgaagagcttggtttgaatcttgaaaaagtagacctggacttatttggctcttgcaagaagataacaatttctaaagatgacactgtcatccttgatggagctggtgataagaaagcaattgaggaaagatgtgagcagattagatcagcaattgaaaatagcacttcagattatgacaaggaaaagttacaggaaagattagccaagctttctgggggtgttgcagtactgaagattggaggagccagtgaggctgaagttggtgagaagaaggatagagtgacagatgccttaaatgcaaccaaggcagctgtagaggagggcatagtacctggtggtggtgttgctcttctttatgcatcgagtgagttggataagcttcaaactgccaactttgatcaaaagataggtgtccagatcatccaaaatgctttgaagactcctgtgcacacaattgcttcaaatgcaggagttgagggtgctgttgttgttggcaaactattggaacagaatgatcctgatcttggatatgatgcagccaaaggtgaatatgttgatatggttaaaactggaattattgatccattgaaggttattaggaccgccttggttgatgcagccagtgtgtcatctttgatgacaacaactgaagctgttgtgtctgaactcccgaaggacgataaagatgttcctgccatgggtggtggcatgggtggcatggattattaaggggctattttccctgatcaaccttgcttcctttaattggacgtagattggggtggtgtttcaccactattttgccttttttttctttcttatttattgacagaaggcatcaatgtaatcatagtgagagataagagatctagggagggaaatttgtggttgttgttgcaatgacattaaggaacgtctgaaacaaaaacaattttcagattccaaattattaaacattgttccattctgaagttgtcaattgaaagacggccccttaataatttcaactgattgaacatgttcctttttt

SEQ ID NO: 1016 - DNA, 2078 bp, Solanum lycopersicum
ctagagccttctttgttcttctctaaataagcccaacttgttcatatctcctctcttcagttctctctcttttttctcagctgcaaaaatttttcttgtaaaattatgtatcgttttgcagcaaaacttgcttctaaatccagggttgccagaagcagcacccaacaggttggtagtaggttgaattggagcagaaactatgctgctaaggatattaaatttggagttgaagctaggggaattatgcttcaaggagttgagcagcttgctgatgcagtcaaagtcactatgggtccaaagggtcgtaatgtggtgattgaacaaagttggggtgcacccaaggtgacaaaagatggtgtcactgttgcaaaaagcattgaattcaaggacaaaataaaaaatgttggtgccagccttgtaaagcaagttgccaatgccactaatgatgctgctggcgatggtaccacttgtgcaacagtacttacccgagcaatatttgctgaagggtgcaagtctgtagctgctggtatgaatgcaatggatcttagacgaggtatcacaatggctgtcgatgctgttgtaacaaacctgaaaagcagagcacggatgataagcacatccgaggagattgcccaggttggtacaatctctgcaaatggagaacgtgaaataggtgagataattgcaagggctatggagcaagtaggaaaagaaggtgtcatcactattcaagatggaaagacactgcttaatgatttgcaagttgttgaggggatgaagttggacaggggctacatatccccatacttcatcacaaatgagaagaatcagaaatgtgagctggatgacccacttattcttattcatgagaaaaagatctcaagcataaatgctattgtgaaagtgttagaattggctttgaagagacaaaggcccctcctaattgtgtccgaagatgtggagagtgaagcactcgctacactcattctgaacaagcttcgtgctggaatcaaggtttgcgccataaaagcaccaggatttggtgaaaacaggaaggctaatttgcaagatttggctgctttaactggaggccaggtcattaccgaagaacttggaatgaacattgaaaatgtggagttggagatgctgggtaaatgcaaaaaggtgaccatctccaaggatgacactgttgttcttgatggtgcgggtgagaagaaggccatagaggagagatgtgaacagattagatcagcaattgaactgagcacgtctgattatgacaaggagaaattgcaggaaagactagctaggctttcagggggtgttgcagtgttgaaggtaggaggagctagtgaagtcgaggttggtgagaagaaagacagagttacagatgctttgaatgccacaaaagctgctgtcgaggaaggaattcttccaggtggtggagttgcacttctttacgcatcaaaagaactggactcattgccaacagccaactttgaccagaagattggtgttcaaattattcagaatgctctgaagacaccagtatatacaattgcctctaatgctggggtggaaggatcagtagtggttggcaaactgttggagcaggataacccggatcttggatatgatgctgcaaaaggtgaatatgttgacatggtaaaagcaggaatcattgatccattgaaagtaattaggacggccttggttgatgctgctagtgtgtcgtctttattaactacaactgaagctgttatcgttgagcttcccaaggacgagaaggcagccccagctatgcctggtggtggtatggactactaatgcactagaaaagaacactgattcaaattgcctgacatacaatttagcacacagaataagaaatttaaggttgttgctcatggtacctcaattgtaacactagcaagagatgtttttgtaggttgagaacttgtaatattttcaagacaatgcggctacctcatttttaatctacttccttgttctctgtgattatcactgaaatccaaaaattttcctgagtagtataaatgaattttcttgcagttgtg

SEQ ID NO: 1017 - DNA, 2589 bp, Elaeis guineensis
aaattctccctcgccccctcacgctctccccctcttctccactcaactccattccggtctgacttacgctttctcgaaccttaaccctaatctttctcttctccatcatgtaccgagctgcagccagccttgcctccaaagcacggattgcggggagcagcagccgacagattggaagcaggcttggttggaacagaaactatgcagccaaggatatcagatttggagtggaagcccgttctttgatgcttaagggtgtggaagagcttgctgatgccgtgaaggtgactatgggacccaagggtcgcaatgttgttttggagcaaagctttggcgcaccaaaagttacaaaggatggggtgactgttgcaaaaagcattgagttcaaggacagggtgaagaacatgggcgcaagccttgtgaagcaggttgccaatgcaactaatgatgttgctggtgatggtacaacatgtgccactgtccttacaagagcaatattcgctgaagggtgcaagtcagtggcggctggcatgaatgcaatggatctaaggcgtggcatcacaatggctgttgatgctgtagtgaccaacttaaagagcagggctagaatgatcagcacttcagaagagatagcacaggttggtaccatatcagctaatggagaaagagagattggtgagctaattgcaaaggctatggagaaagttggaaaagagggggtaatcaccatctcggatgggaacactctgtacaatgaattggaagttgtagaaggaatgaaacttgacaggggctacatatctccctacttcattactaaccaaaagaaccaaaaatgtgaattggaagatcctctcattctgatacacgagaagaaaatttcaagcattaatgcggttgtgaaagcgttagagttggccctgaaaagacaaaggcctctactaattgttgctgaggatgtagaaagtgatgcattggctaccctcatccttaataagcttcgtgcaggaattaaggtctgcgccattaaagctcctggttttggggagaacaggaaagccggcttgcatgaccttgctatcctcactgggggtgagctcatcactgaagaactcggtatgaatcttgaaaaagtagaatttgacatgcttggtacatgcaagaaggtgacaatatcaaaagatgacactgttattcttgatggggctggagataagaaagccattgaagagaggtgcgagcagctgagatctgcaattgaagcatgcacttctgactatgataaagaaaagctgcaggaaagattggcaaagctttctggaggcgttgctgtcctaaagattggaggggccagtgaagccgaagttggtgagaaaaaagatagagtaaatgatgctttgaatgcaaccaaggctgctgtggaagagggtatcttgccaggtggcggtgttgctcttctctatgcatcaaaggagttggagaagctgcagactgctaactttgatcagaaaattggagttcaaataatccagaatgccctgaagaccccagtgcacaccattgctgcaaatgcaggagttgaaggggctgttatagttggcaagcttttggagcaggataatcctgaccttggttatgatgcagccaaagatgaatatgtggacatggttaaggcaggtatcattgatccactgaaagtgattagaactgcattggtggatgctgcaagtgtatcatcgttgatgactacgactgaggctgttgttgtggagctcccaaaagacgagaaggatgttcctgccccgggtggaggcatgggaggaatggattactaaaattcttttcaagaagttccaaaatcacagagaatctagattaggattttgaatgtgtaatcctgtgtcataggttttgtgctgaactggcggcatcaattaatctaatcacagaggaaaactgttgtgttattggaaaactagtgtttccgctgccaaaaacttgattgttacaagcactacccctaattttttccttgctgaggaatgaaccagatttttcagttcattccggttcttgcagccttggacactagaactctacaccagttcagtctttggtcataaaaactcccaacaacaataacgatctagaagctattcagatgcctcgtcactgacagtggtggaacggcggtaaggaaagctggagaactgtatccggtcttgtccccactatttgagaagtctaagattccaaatcctggcattcgttgaatgcttgctcgagtgagataaaggcatctaaagtatatctctggcaatttgtatcatttaaatgagtattttgttctgtaatccttgtgttataggcggagtgatgctatcgttcctcattgcattggaacggatgtagaggggagaaactctaatccgcgttcattgtttctgctttctacttgtgtggtcgggaagcagacactgtatctcctatgtgcttgtatttgacattgtaagcagattagtttgatcccaagacaaaaaaaaaaaaacaactagatacccgacgagacacacggaggacagccccccc

SEQ ID NO: 1018 - DNA, 2104 bp, Trifolium pratense
acacacactttctgcaatttcttaactcttcgttcaattttctcacttccatccacaccatgtaccgatttgcttcttcccttgcctccaaagctcgaattgctaggaacagcactaatcagattggaagtagagtggcatggagcagaaattatgcggcaaaagagatcaaatttggtgtggaggctcgggctttgatgcttaagggtgttgaagagcttgctgaggctgttaaagtaaccatgggtcctaagggccgtaatgtggttattgagcaaagttttggtgctcctaaagtgacaaaagatggagtaacggttgctaagagcattgagttcaaggataaagtcaagaatattggtgccagtcttgtaaagcaggttgcaaatgctaccaatgatgtcgctggtgatggaaccacttgtgctactgttcttacccgagcaatatttgcggaagggtgcaaatcagttgcagctggaatgaatgcaatggacttgaggcgaggtattaatatggctgttgattctgtcgtgacaaacttgaaaagcagagcacggatgattagcacttccgaagaaatagcccaggttgggacaatatctgctaatggggacagagaaattggtgagttaattgcaaaagctatggagaaagttggcaaagaaggtgtaatcacaatcgcagatggcaagacattgcacaacgagttggaagttgttgaaggaatgaagcttgaccgaggctatatttctccgtatttcataacaaaccagaagaatcagaaatgtgaacttgaggatcccctcatcataatccacgaaaagaaaatctcaagtataaatgccatagttaaagtattagagttagctttgaaaaaacaaagacctttattgattgttgctgaagatgtggaaagtgatgcccttgcaattcttatcctaaataagcttcgcgctggaatcaaggtatgtgccatcaaagtccatggttttggtgaaaatcggaaatctggtctccaggatcttgttgttctaacacgaggtcaaacctcggccacaatctcaagaaagtggatctcgaaatgtttggctcttgcaaaaagattacaatttccaaagatgacacagtcattcttgacggtgccggtgataagaaatctatcgaggaaagatgtgagcagattaggtcagcagttgaaaacagtacttcagattatgacaaggagaaattacaggaaagattggccaagctttctggtggtgttgctgtgcttaagattggaggagccagcgaggctgaagttggtgagaaaaaggatagagtgacagatgccttgaatgcaacgaaggcagctgtagaggagggcatagtacctggtggcggtgttgctcttctttatgcatcaaatgagttaagtaagcttcaaactgccaacttcgatcagaagataggtgtccaaattatccaaaatgctttgaagacacctgttcacacaattgcatcaaatgctggagttgagggggcagttgttgttggtaaactattggaacaagataatcccgatcttgggtatgatgccgccaaaggtgaatatgttgatatggttaaagctggaataattgatccattgaaggtgattaggaccgccttggttgacgcagccagtgtgtcatctttaatgacaacaactgaagctattgtgtctgatctcccaagtgacgataaagatggttctgctatgcctggtggcatgggcggcatgggtggcatgggtggttattagtggacgaatctagctttctttcactgaacattgagtagagagtggggcttcaccactgttatttttgcttattatttcttgacagaaggcatcaatatgtaaccatagcagagagattaaatctgtaggtagtagagaggaaagatttgtgattgtcatttattgcaataacaatgataattgagacatttggaacaatttttagcctccaaattagtgacaaattgttgacacaaagtttgtctggtcctctcaagggaatgtagttttaattatgctgttgttaaatatttctcttactaatttaaaaaatcatta

SEQ ID NO: 1019 - DNA, 2277 bp, Ananas comosus
ataacagtgcactaaaaccctaaaccctggttccttgaagacgcttctagagtcctctccctccctcttcttcatacaccaaattctcgtttcttcttcaatcccttcgctcggaatcgcgttcgtggagagctccgcttcatgtatcgcgtcgccacaaccctcgcctccaaagcccggatcgccgggagcagcagtcgacagattggaagtaggatagcttggagcagaaactatgcggccaaggacatcaagttcggagtagaggctcgtgcattgatgcttaagggagttgaggagttagctgatgcggtgaaagtgacaatgggacccaagggccgcaatgttgtgctggagcaaagttttggtgcaccaaaagttacaaaggatggggtgactgttgctaagagcattgagttcaaagatagggccaaaaatgttggtgcaagccttgttaagcaggttgctaatgcaacaaatgatgctgctggtgatggtacaacatgtgccactgtccttacacgagcaatatttgctgaaggatgcaagtcagtggccgctggaatgaatgcaatggatctgaggcgtggcatcacaatggctgttgacactgtggtaagcaacttaaaaagcagggcaaggatgataagcacatcggaggagatagcacaggtcggtaccatatcggccaatggagaaagagaaattggtgagctaatagcaaaagctatggaaaaagttggcaaagagggtgttataaccattgcagatggtaatacactgtataatgaattggatgttgtggaaggaatgaagcttgatagaggttatatatcgccttactttgtctctaacgcaaaaactcagaaatgtgaattagaagacccccttattttgatatatgaaaagaaaatatcaagcattaatgcggtggttaaactattggaattagccttaaagagacaaaagccgctgcttattgttgctgaagacgtcgaaagtgatgcactggcgactgtcattcttaataagcttcgtgcaggcattaaggtctgcgccattaaagctcctggttttggggagaataggaaagccattctacaggaccttgctatacttagtgggggtgaactcataacagaagagcttggaatgaatcttgaaaaggttgagcctcacatgtttggtacatgtaaaaaggtgacagtatcgaaagatgacactgttattctggatggggctggtgataagaagactattgaagaaagatgcgagcaactgagagctgctatcgaagcaagcacctctgactacgataaagagaaactccaggaaagattagcgaagctttcgggaggtgttgccgtcctaaagattggaggagcaagtgaagccgaagttagtgagaagaaggatagagtgaatgatgctcttaatgctaccaaagctgcagtagaagagggtatcgtgccaggtggtggtgttgcacttctctatgcttcaaaggagttggagaaattggaaacagctaattttgatcagaagattggggtccaaataattcaaaatgcacttaagaccccagtgcacaccattgcttccaatgcgggagtagaaggcgcagtggttgtgggcaaacttctggagcaggataaccccgatcttggttatgatgcggccaaaggtgaatatgtggacatggtaaaagcgggcatcatcgacccgttgaaagttattagaactgcactggtggatgctgcgagtgtttcatcattgatgacgacgaccgaggcggtggtcgtggaactgccgaaagaagagaaggacgtgcctgcgatgggtggcggcatgggaggaatggattattagaatgcatgccccaacaatgcagatgagggtttccgaggcccagatttagtcggtagcaccggaagagagactagtgttaggaaattcacttctgctgcctggaaggatgattttcactaataactgtataaactagttctctccttgctgaggaactagtcaggtttctgtaagatcggaaggcacacccccccccccccccccccccccccccccccccccccccccccccccccccccccccccccccccccccccccccccccgtttgctttaattaatcttaaactatggactgtgtgtagcagttcctttttcttataatttggagatcgaaatgtctgatagaaaaatgtcttggcttagatgtgagagttggctcttaaaaccagattaaagtgaaggtgt

SEQ ID NO: 1020 - DNA, 2123 bp, Amorphophallus konjac
ctatatttctagaaccacccagcaaaccaaaacccccagcggcttcttcttcccctcccccttccccgttcgggtctccagcagcgaagaaccctagtttctgctccgcggcgcctcccgttgctcccccaccatgtaccgcgcggcggcctgtctcgcctccaaggcccggattgcggggagccggagccagcaggtcgggagcaggctgggttggagtaggaactatgccgccaaggacattaagttcggggttgaagcccgtgctttgatgttacggggagtggaagagctcgctgatgctgtgagagttacaatgggcccgaagggacgaaacgttgttttggaacaaagctttggtgcaccaaaagtaacaaaagatggtgttaccgtggcaaagagcattgaattcaaggatagagtgaagaacatgggtgcgagccttgtaaagcaggttgctaatgcaacaaatgattctgctggcgatggtaccacttgtgccacagtcctcactagggcaatatttgctgaagggtgtaagtcagtggcggcaggaatgaacgccatggatctaagacgtggtatcacaatggcagttgatgcagttgtgactaacttgaagagtagggcacgaatgatcagcacatcagaagagatagcacaggttggcacaatatcatcaaatggagaaagagagattggcgagctcattgcaaaggctatggaaaaagttggcaaggagggagttattacaattgctgatggtaaaactctttacaatgaattggaagtggttgaggggatgaaacttgacaggggctatatatccccctacttcatgacagatcaaaaaacccagaaatgtgaacttgaggatccacttatcttaatacatgagagaaagatttcaagtatcaatgctgtagtaaaagtactggagctagctttaaagagacaaagacctctcctaattgttgctgaagatgtggagagtgatgccctggcaactctcatcctcaacaagcttcgtgctggaattaaggtctgtgccattaaagctcctggctttggagaaaacaggaaagccattatgcaggatcttgctactcttactggtggtgatgttataactgaagaacttggtttgaaccttgaaaaggtggaatttgatatgctcggtacatgcaaaaaggtaacaatctccaaggatgacactgtcattcttgatggggctggtgataagaaagctattgaagaaagatgcgaacagctaaggtctgcaattgagctaagcacttcggactatgataaagagaagttgcaagaaagattggccaaactctctggtggtgttgctgtgctgaagattggaggagccagtgaagcagaggtgggcgagaaaaaagatagagtgactgatgccctgaatgcaaccaaggctgctgtagaggaaggcatagtgccaggtggtggtgttgctctcctctatgcatcaagggagcttgaaaagctgcagactgccaattttgatcagaaaattggtgttcaaattatccagaatgcccttaagacaccagtgcacacaatagcttctaatgctggagttgaaggtgctgtggttgtggggaagttattagaacaggataatcttgatcttggatatgatgcagcaaaaggtgaatatgttgatatggttaagtctggtatcatcgatccattgaaagtaattagaactgcgttggtggatgctgctagtgtttcttcattgttgaccacaactgaggctgttgtcgtggagattcccaaagaagagaaggattccccaccaatgccgggcatgggcggcatggattactgaccacctccctctcagcgccagtgtaactgtaccagacgagcgcaagcgttatcattttactgtgttttaattttatctttcatgttctcacactgaactctagcggccacatgtttagttctatgatgatccggctctaggtttattatttttccttttttggtgcagtctgaaaagggagaggaatagagtgtagggaaataggcattttcctcaccagttgtaagactttgactgtgattaataaacaacgattcttcctaac

SEQ ID NO: 1021 - DNA, 2286 bp, Phaseolus vulgaris
ctatgaacgtggttaaggggttgttggcttaaaccctagagagcagaagaagccgctttttccagacccttctctttcctttcaaaaaccccacacactctctctcccattctctcactttgcctttgcattgggtgctccattgctgcatttctttactttctctcttcatttcttattcgcatcatgtatcgttttgcttctagcctcgcctccaaagcaaggattgctcggagtggcagcaaacaggttggaagtaggttgagctggagccgaaattatgcggctaaagacattagatttggtgtggaggctcgggctctgatgcttaagggtgttgaagagcttgcagaagctgtcaaagtaaccatgggtcccaaggggcgtaatgtggtaattgagcaaagttttggtggccctaaagtaaccaaagatggagtaactgttgcaaagagcattgaattcaaggataaagttaagaatgttggtgccagtctcgtaaagcaggttgctaatgctactaatgatgcggctggtgatggaaccacgtgtgccacggtccttacacgagctatatttgctgaaggctgcaaatcagttgctgctggaatgaatgcaatggacctgaggcgtggtataaatatggctgttgatgctgttgtaacaaacttgaaaagtagagctcggatgattagcacatctgaagaaatagcacaggttgggacaatatctgctaatggagagcgtgaaattggtgagctgattgccaaagctatggagaaagttggcaaagagggagttatcactatttcagatggcaaaactttatataatgagttggaagttgttgaaggaatgaagcttgacaggggctacatatctccttatttcataacaaatgataagaaccagaaatgtgaacttgaggatcccctcattctaatccatgagaagaaaatctcgagtataaatgctgtagttaaagtattagagttagctttgaagagacaaagaccgttattgattattgctgaggatgttgaaagtgatgctcttgcaacacttattctaaataagcttcgggctggaattaaggtatgtgctattaaggcccctggttttggtgaaaataggaagtctggtctccaagatcttgcagttctcacaggaggagcacttatcactgaagaacttggcttgaagcttgaacaagtggatttggatatgcttggcagttgcaaaaaaataactatttctaaggatgacactgtcgttcttgatggagctggtgacaagaaagcaattgaggaaagatgcgaacagattagatcagcaattgaaaacagtacctcggattatgacaaagaaaagttacaggagagattagccaagctttctggtggtgttgcagtgcttaagattggaggagccagtgaagctgaagttggtgagaagaaggatagagtgacagatgccttgaatgcaactaaggctgctgttgaagagggcatagtacccggtggtggtgttgctcttctatatgcatcaaaagagttggataaacttcaaactgctaacttcgatcagaagattggcgtccagattatccaaaatgctttaaagacacccgtgctcacaattgcatcaaatgcgggagttgagggtgcagttgttgttggcaaactattggaacaggacgatcttgatctaggatatgatgctgccaatggtgagtatgtggatatggttaaatctggaatcattgacccattgaaggtgattaggacagccttggttgatgcagcaagtgtatcatctttgatgacaacaactgaagctgtcgtgtctgaacttcctaaggatgataaggatattccagctatggctggaggaatgggtggcatggattattaaccggcttcgattggtttcattgcacctgaagacatagattggtgctgaacccacactcacaacctttttttgttgttaaattatgtgtgaaggcatcactgtaatcatagtgagagaacgagatgtaggtaagaaaatttgactgtaataattccaattacaagacatttggaacaattttttcctcccaaaactgaattgatttaaggaattccgtccatatttagtacaagtacactctccaaaactgaaaacaatcatcataatttatcttttaacctcgatggatcagtataatgtaaacaatactccatggtcatatctgatcgaaaagtatgaagtttgttcccatctggttacgggtttcacttt

SEQ ID NO: 1022 - DNA, 2331 bp, Cicer arietinum
aaagaaataaaaaagcgtcaaaagtgaaaaccagaaacttgttaggggtacaaataaaaagaaacgcaaattttaaaccctaaaccctagcagcttctattccctttttgttccggaacagtttctcgtttcttcatttctcaactttgcaatttgattacttttctcaatcgccccttattcattccaaccacaccatgtatcgttttgctacctcaattgcctccaaaactcggattgctaggaacaatgttcaacgtgttggaagtagggtggggtggaacagaaattatgcggccaaagacattaaatttggtgtggaggctcgggctttgatgcttaagggtgttgaagagcttgctgaggcagttaaagtaactatgggtcctaagggccgtaatgtggtgattgagcaaagttatggtgctcctaaagtaacgaaagatggagtaacggttgccaagagcattgagtttaaggataaagtcaagaatatcggtgccagtcttgtaaagcaggttgctaatgctaccaatgatgtggccggtgatggaactacttgtgcaacaattcttactcgagcaatatttaccgaagggtgcaaatcagttgcagctggaatgaatgcgatggacctgaggcgaggtataaatatggctgttgatgctgtggtgacaagcctgaaaagcagggcacggatgattagcacttctgaagaaatagctcaggttgggaccatatctgctaatggagagagagaaattggggagttaattgcaaaagctatggagaaagttggcaaagaaggtgtaatcacaattgcagatggcaagacattgtacaatgaattggaagtcgttgaaggaatgaagcttgaccgaggctatatttctccatatttcataacaaaccagaagaaccagaaatgtgaacttgaggatccccttatcataatccatgagaagaaaatctcaagtattaattctatagttaaagtgttagagttagctttgaagaaacaaagacctttattgattgttgctgaagatgttgaaagtgatgcacttgcaactcttatcctcaataagcttcgtgctggaatcaaggtatgtgccatcaaagcccctggttttggtgaaaaccggaagtctggtctacaggatcttgctgttcttacaggaggtcaacttgttaccgaagaactcggcatgaatcttgagaaagtggatttggatatgtttggctcttgcaaaaagattacaatttccaaagatgacactgtcattcttgacggagctggtgataagaaagctattgaggagagatgtgagcagattaggtcggcaatcgaaaatagcacttcagattatgacaaggaaaaattacaggaaagattagccaagctttctggaggtgttgccgtgcttaagattggtggagccagtgaggctgaagttggtgagaaaaaggatagagtgacagatgctttaaatgcaaccaaggcagctgtagaagagggcatagtacctggtggtggtgttgctcttctttatgcatcaaatgagttaagtaaacttcaaactgccaactttgatcaaaagataggcgtccagattatccaaaatgctctaaagacacctgtgcacacaattgcatcaaatgctggagttgagggtgctgttgttgttggtaaactattggaacaagataaccctgatcttgggtatgatgccgccaaaggtgaatatgttgatatggttaaagccggaataattgatccattgaaggttattagaaccgccttagttgatgcagccagcgtgtcgtctttgatgacaacaactgaagctattgtgtatgaactcccaaaagaagataatagtagtcctgctatgcctggtggaatgggtggcatggattattagtggatggattaatctagctgtctttcactgaaccttgattagaaattagagagagtggtgtttcaccactattatcatagcttctttttggttatcgtttattgacggaaggcattaatgtaatcatagcagagagatttttgattgttatttattgcaatgataaattgaggcatttggaacaattcttacactccaaattagtcataaattgtctccacattatgattgttatttgttctcaattctctttactataagtttttctaggtgggatccttatggtaagagcttttaagattgtctggaagagtgaatattgatgtagtgtttcttagatgagtggttaagttcggtgattttaactaattgaaatttaagagcggtgaagagtctataattcact

SEQ ID NO: 1023 - DNA, 2027 bp, Actinidia deliciosa
ctttatttactctctctctctctctcctcgcagaacattcgcagcttccgcattcggccacgatcatctctctttctcaacactctctctcttgatcactctgcttcgcaactccagaaccatgtatcgcttcgccgccaatctcgcttccaaagcccggatcgctagcaacggtactcagcagattggtggtaggtttgcttggagaagaaactatgcggcgaaggaaattaaatttggagttgaagcacgggctttgatgctgaggggtgttgaagagcttgccgacgctgtcaaagttacaatggggccaaaaggtcggaatgttgttttggaacaaagctttggtgctcctaaagtgacaaaagacggtgttactgtggcaaagagcattgagttcaaagacagagtcaagaatattggtgcaagccttgtaaagcaggttgcaaatgcgacaaatgatgttgctggtgatggtaccacttgcgcaacagtcctcacccgtgccatatattctgagggatgcaagtctgtggcagctggaatgaatgccatggacctgagacgtgggatcacaatggcagttgatgcagtggtgacaaacttgaagagtagagcacggatgattagcacatctgaagaaattgcccaggttggcactatatcatcaaatggggagagagagattggcgagcttatagccaaggctatggagaaagttggcaaagagggagttattaccattgctgatgggaaaactctgtacaatgaattggaagttgttgaaggaatgaagctggacagaggttacatttccccttatttcattaccaatccaaagaaccaaaaatgtgaattggaagatccactaatattaattcatgagaagaaaatatcaagcttgaatgctgtggtgaaagtgttagagttggccctgaagtcacaacgacctttgctgattgtttctgaagatgtggaaagtgaagcattggcaaccctcattttaaacaaccttcgtgctggaatcaaggtctgtgctattaaagctccgggatttggagaaaacaggaaggccaacctgcaggaccttgccattcttacaggaggcgaggtcataactgatgagctcggtctgaacctggaaaaggttggaccagaaacttttggatcatgcaaaaaggttaccatatcaaaagacgactccgttattcttgatggtgctggtgacaagaaagccatagaagagagatgtgaacagctgcgaacatcaattgaattaagcacctctgactatgacaaggagaagctacaagagagactagcaaagctttctgggggtgttgccgtattgaagattggaggggccagtgaagctgaggttggtgagaagaaagatagagttaatgatgctttgaatgcaacaaaggcagctgtggaggagggcattgtacctggtggtggtgttgctcttctttatgcctcaaaggagctggaaaagctgcataccgcaaattttgatcaaaagattggtgttcagattatccagaatgctctcaaggcaccagtgtacacaattgctgccaatgcaggtgttgagggggccgtagttgttggtaagctgttggaacaggacaatcctgaccttggatatgatgcagctaaaggtgaatacgtagacatggtcaaggcaggaattattgatccattgaaggtcattagaacggccttggtagatgccgcaagtgtgtcgtcattgttgactacgacagaggctgttgtcgttgaactcccaaaggatgagaaggaagccccagcaatgggcggaggaatgggtggcatggattactagagataagcggttgcatcctaattcattcatgtttctctggctacattattcctctggaaattttttttacataattaaagcaacagtaggtggactaattattatgcagttgaagcgagaattttgttcctttcgagatcactgtaaatcaaaatgagacgttgagtgtaggaagttt

SEQ ID NO: 1024 - DNA, 2172 bp, Solanum tuberosum
ctagccccttcctcactaaataaaatacctttgaagcttcttcttcatccccacttctatctttgttcttcaaaaccccttccattttcactttcagcagcatttctcagtttcaaaatgtatcgttttgcagcaaatcttgcttctaaagccagagttgcaagaaccagttcccaacagattggtgggaggttcaattggagtagaaactatgctgcaaaggatatcagatttggagttgaagctagagctttgatgcttcaaggtgttgagcagcttgctgatgctgttaaagtcactatgggtccaaaggggcgtaatgtggtgattgaacaaagttggggtgcacccaaagtaacaaaagatggcgtgactgttgcaaaaagtattgaattcaaggacaagatacaaaatgttggtgctagccttgtaaaacaagtcgccaatgcaacgaatgatgttgctggtgatggtaccacttgtgcaacagtcctcacccgagcaatatttgctgaaggatgcaagtcagtggcagctggtatgaatgcaatggaccttagacggggtattaccatggctgtagattctgttgtgacaaacctgaaaagcagagcacggatgatcagtacatctgaggaaattgcacaggttgggactatctctgcaaacggagaaagagaaattggcgacctaattgcaagggctatggagaaagtaggcaaggagggagtcatcactattcaagacgggaaaacgttgctcaatgagttggatgttgttgaagggatgaagttggatagaggttacatatcaccatacttcatcacaaatcagaagaatcagaaatgtgaactggataacccactaattctgattcatgagaaaaagatctcaagcgttaatgctgttgtgaaagcattggagttagctctgaagagacaaaggcccctcttgattgtggctgaagatgtggacaatgaagcactcgccactcttattttgaacaagctccgtgctggaatcaaggtttgtgccatcaaagcaccaggctttggtgaaaacaggaaagcttatttgcaagatcttgctattctaactggaggccaagtcataacagaagagcttggactgaacattgaaaatttggagttcgagatgctgggaacatgtaaagaggcgactatctctaaggatgatactgtcattcttgatggtgctggtgagaagaagtccatagaggaacgatgtgaactgattagatcaaccattgaacagagcacatctgactatgacaaggagaagttgcaggaaagactagctaagctttcagggggtgttgctgtgttaaagattggaggagccagtgaagctgaggttggtgaaaagaaagatagagtaactgatgctttgaatgccacaaaggctgcagtggaggaaggaattgttccaggtggtggtgttgctcttctttatgcagcaagagaattggataatttgacaacagccaactttgaccagaagattggtgtacaaattattcagaatgctctgaagacaccagtacatacaatagcctctaacgcaggagtagagggtgctgtcgtggttggtaaactgttggatcaggacaaccttgatcttggatatgatgcggccaagggtgaatatgtagatatgataaaggcagggatcatcgatccagtgaaagtgattaggacagctttggttgatgctgccagcgtctcgtctctcttgaccacaactgaagcagttgttgtcgagcttcctaaggatgagaaggaatctcctgcaatgggtggcggtatgggtggcggtatgggtggcatggacttctaattgaaaagccaaaaacagtaattgcagctgcttgacacacatttgtttagaacaaagcaaaaaaataaatttagagttgtttcctattttgatgaatctttacgatagaaaatgcgcctattgtatcaatagcaagagagaccattgtgaattcatgtttttgtaggttcaaaatttgtagtcttcatttgaatacgcagcattttggttaacaaaatataggtccatttcagtgctctcttttgttttggtgtcctttctggtttaactatttttttgaggtgatgaatttatacctgttctacttttcttttt

SEQ ID NO: 1025 - DNA, 1945 bp, Phalaenopsis aphrodite
ccagcggcggcggctgcagcagccgacagattggaagcaggcttgcctggagcagaaactatgccgccaaggacataaggtttggagtggaagcccgtgctttgatgctcaagggcgtggaggagctcgctgatgcggttaaagtgaccatgggccctaagggacgtaatgtagttcttgagcaaagctttggtgcaccgaaggtcacgaaggatggtgtaactgttgccaagagcattgagttcaaggacagagttaaaaacatgggtgctagccttgtgaaacaggtggctaatgcaactaatgatgttgctggagatggtaccacatgtgcgaccatccttaccagagcaatttttgctgaaggatgcaagtcagttgcagctgggatgaatgcaatggacctaaggcgaggcatctctttggctgttgatactgtggtcaccaatcttaaaagtaggacaagaatgatcagcacttcagaagagattgcacaggttggtactatttctgcaaatggagagcgagagattggtgaattaattgccaaggcaatggagaaagttgggaaagaaggtgtcatcacaatttctgatggcaaaactctttacaatgaactggaggttgttgaaggtatgaaactcgacaggggctacatatcaccttatttcatcactaaccagaaaaaccaaaaatgtgaactggaagatccactcattttaattcatgagaagaaaatttcaagcatcaactctgtagtgaaagttttggagttagcattgaagaggcagaggcctttgctcattgttgctgaagatatagaaagtgacgctttggcaacattgatccttaacaagctgcgagctggaatcaaagtttgtgccatcaaagctcctggatttggggaaaacaggaaagctggtttgcaagatcttgctgttctcactggtggtgagttgatcaccgaggaacttggcttgaaccttgagaaagttgaacttgaaatgcttggggcatgcaaaaaggtgactgtttcaaaagatgatactgttattcttgatggttctggcgacaaaaaggctattgaagagagatgcgaacagataaggtctgctgttgagtctagcacatctgactatgataaggaaaagttacaagaaaggttggccaagctctctggtggtgttgctgttttaaagataggaggggccagtgaagctgaagttagtgagaaaaaagatagagtaacggatgctctgaatgccaccaaagctgctgttgaagaaggaatcgttccaggtggaggtgttgctctcctctatgcgtctaaggagctggagaaattgcatactgctaacttcgatcagaagattggagtgcaaatcattcaaaatgctttgaggaccccagtgcacactattgcatcaaatgcgggtgtagagggagccgtggttgtgggaaagctcttggagcaggataatcctgacctaggatatgatgcagccaaaggtgaatatgttgacttggtgaaggctggtattattgacccctgaaagtaattagaactgcattagtggatgctgcaagcgtttcatctctgatgaccacaacagaggctgtggttgtggagcagccaaaggatgagaaagaagtttctccctcaatgggtggcggcggcatgggtggacttgattactaatttttcacccaaagccatgcagtttcgctctgaattttactcttttatgtatttttgatgagaaagagctttcatttcttattatgcagtttgccctaatttagttattcagccaaatgagtcatcaattttgttttgaggcgaactattttattgatgtggatggattattcctcttgtgatgactgtatgtgctaatatttatttcatcacgcaaacatggaataagagatttcgtggtttctt

SEQ ID NO: 1026 - DNA, 2134 bp, Malus domestica
cctgattgcccaccttctttctctctctaaggtgctctgcaacttcatcaatcatgtatcgcttcgccactaaccttgcctccaaagccaggttggctaggaacagttctcaacagattggcagtaaattgatttcgagaaggaactatgcagcgaaagaaatcagattcggtgttgaagcccgggccgggatgcttaggggtgtggaagagctcgctgatgctgtcaaagtcacaatggggccgaaagggcgcaatgttgttctggaacaaagctttggtgcccctaaagtgacaaaggatggtgtcactgtagcaaagagtattgagttcaaagataaagtgaagaacattggtgctagtcttgtaaagcaggtcgccaatgctacaaacgatgcagcaggagatggtaccacttgtgctacagtccttactcgtgctatatttactgaaggatgcaagtcagtggcggctggaatgaatgctatggacctaagacgaggcatttcaatggcagttgattctgttgttgcaaacttgaagagtagagctaggatgatcagcacatctgaagaaatagctcaggttggtacaatatcagcaaacggagagagagaaattggtgagctcatagctaaagctatggagaaagttggcaaagagggtgttattaccatttctgatggaaaaacactgtataatgaattggaggtcgttgaaggaatgaagctggataggggctacatatccccctacttcatcaccaatccaaagaaccaaaaatgtgaattagaagatccactcgtcctaatccatgagaagaaactctcaaatttaaattctatagttaaaatattagagctggccttgcagaaacaaagacctcttgtaattgttgctgaagatgtggaaagtgaagcacttgcaacgctcattataaacaagcttcgtgctggaattaaggtttgtgcaattaaagcccctggatttggagaaaacaggaaggcaaatttgcaggacctagctgttcttacgggagcccaggtaataactgaggagcttggtctgaacatcgaaaaagtgggaatagaaacactgggaacatgcaaaaggattacggtatcaaaagatgacacagtcattcttgatggggctggtgacaagaaagccattgaagaaagatgtgaacagctgagatcatcaattgaattgagcacttctgattatgacaaagagaagttacaagagcgccttgcaaagctttctggtggtgttgccgtcttaaagattggtggagctagcgaagcggaagttagtgaaaagaaggatagagtaactgatgctctaaacgctaccaaggctgctgtagaggaaggaattgtagccggtggtggtgccgcccttctatatgcctcaaaagagctggacaagctggtgactgcgaactttgatcaaaagatcggtgttcaaataattcagaatgctctaaagatgcctgtatccacaatcgcttctaatgctggagtcgagggggctgttgtcgttggcaaactactagagcaggacaatcctgaccttggatacgatgcagctaaaggtgaatatgttgacatgataaaggcagggatcatcgacccattgaaagtcattagaaccgccttggtggatgctgcaagtgtttcctcgttgatgaccactaccgaggcagttgtggtcgagcttccgaaggacgagaaggaaacccctgcaatgggaggaggcatgggaggcatggattactagatgttgtatcggcatgctgaatttactggaggctgtcttcttcggctctaaccttcctcgtgtcgtttatcctaatttgaaactgagttctccaatttcacaattttatagctttttccttttgaatggtattggaggctgaacatgaatgtaatcatagtgagggattgactgtgcagtagcattttacaccgtttgtagtctctggtgggtatttatttctcatttgacaaaggattttattttcatctgcaactttgttagtgttaattgtgagagaaaaaaatttgataataaaagtaagtatgaatgtgtggttagtgtcgtattaagtgtttagcgcttgtgcacta

SEQ ID NO: 1027 - DNA, 2116 bp, Aquilegia formosa
gagaattctcttaaacccaaacctgcctactattaatttgcatttcaactcacatctgaatacctttttagcctgcaacacgacaacccattgcttctaccttcttttccaatcatgtacagagcagttgctaaccttgcttccaaagccaggattgctaggaagcaaagccaacaaattagtagtaggtggagttggagtagaaactatgctgcaaaagatattcaatttggagttgaggctcgtggattgatgcttaggggagttgaagagcttgcagatgctgtgaaagtcactatgggaccaaagggacgtaatgttgtattggaacaaagttttggtgcaccgaaagtgactaaagatggtgtgactgttgctaagagtattgagttcaaggacagagttaaaaacatgggtgctagccttgtaaagcaggttgcaaatgccaccaatgatgtggcaggcgatggtacaacctgtgccactgtccttacacgagcaatattttcagaagggtgcaagtcagtggctgctggaatgaatgcaatggacttaagacgtgggatcaatatggctgttgatgctgtagttaccaacttgaaaagcagggcaagaatgattagcacttctgaagaaatagctcaggttggtactatatcggcaaatggggaaagggagattggtgagctaatagcaaaggctatggaaaaagttggcaaagagggggttataacaattgctgatggtaagacactgtacaacgagctggaagttgtcgagggaatgaagctggaaagaggatatatatccccttattttatcaccaatgagaagaaccagaaatgtgaattagagaatcctctcgtattaatccatgagaagaaaatctcgagcataacttctgtggtaaaggtcttagaactagcaatgaagaggcagaggcctttgttgatagttgcagaagatgttgacagtgaagcacttgcaactcttattataaataagatcagagctggtttgaagctctgtgccatcaaagctcctggttttggagaaaacaggaaggccaacatgcaagatcttgctactctcacgggggctactctgatcactgaagaacttggcatgaaccttgagaaggtggacctagatatgtttggtagctgtaaaaaagtaacaatatccaaggatgacaccgtggttcttgatggggctggtgacaagaaagatcttgaagaaagatgcgaacagatacggtctgctatcgaatcaagcacttctgattatgacaaggaaaagttgcaagagagactcgctaagctttctggaggtgttgccgtgttaaagattggaggtgctagtgaaactgaagtaggggagaaaaaggacagagttactgatgctctgaatgcaaccaaggcagctgttgaggagggaatcgtacctggtggtggtgttgccctactttatgcatcaaaggagctggacaagctacaaactgcaaattttgaccagaaaatcggtgtccagattattcagaatgctctcaagatgccagttcatacaattgctgccaacgctggggttgagggtgctgtggtggtgggcaagctacttgagcaggatgacactgacctaggatatgatgcagccaaaggtgaatatgtgaatatgattaaggctggaatcattgacccactgaaagttattagaactgcgttggttgatgctgcaagtgtatcgtcattgatgaccacaactgaagctgttgtagttgaatcacccaaagatgagaaggaagctccagcaatgggcggtggaatgggtggcatgggttattaagatctttgaacaaggaaaatgctatccatttgtatcaacgactggacaagggatgataacaacgcttcttaaagtaaaagtttgttaatccttctctattgtatcattaaattgatttctgtaggtcttttcttcattgtcagagatctaaacaactgtgtacgttagggagaagtcattttataggaaattttgtttacagtaataattggtgtatgaacttaaatgtttcacaccaaatgctaagataagcgaaataaatcccatttaagct

SEQ ID NO: 1028 - DNA, 2135 bp, Fagus grandifolia
taatataataaaaacacaaaaacccttaaaccctagaaccctagaacctgcgctgcgcttgagactgactgcttctagacccttcccttcactttaaaagacccacttctctctctctttctcaaaacccatcatctttctttctctgtttttggtagtctctgccatttccgccataacatcatgtaccgttttgccacaagtctcgcctctaaagctcggattgctaggaacagcacccagcagattggtagtagattgagttcgacaagaaactatgcggcgaaagatataagatttggggtggaggcccgggctcttatgctaaagggtgtggaggagcttgctgatgctgtcaaggtcactatgggtcctaagggacgtaatgtggtaatcgaacaaagttggggtgccccgaaagtgacaaaagatggtgtaactgtagcgaagagcattgaattcaaggacaaagtcaagaatattggtgctagccttgtgaaacaggttgcaagtgccacgaatgatacagcaggggatggaaccacatgtgccacagtacttacacgggctatattttccgaagggtgcaaatcagttgccgcagggatgaatgcaatggacctaagacgtggtattagcatggccgttgatgctgttgttacacatttgaagagtagtgcacgaaagatcagcaaaagtgacgaaatagcacaggttgggacaatatctgcaaatggagagagagaaattggtgagttgattgcaagggcaatggagagagttggcaaagagggagtaatcacaatccaagatggaaaaacattgtataatgagttggaagttgttgagggcatgaagctagacaggggttacatatccccttacttcattactaaccagaaaaaccagaaatgtgaattggaagatcctctcattctaatccatgagaagaaaatctcaagtttaaatgctgtcattaaagtattagagctggctttgaagagacaaaggcccttactgattgtttcagaagatgtggaaagtgaggctttggcaactcttattctcaataagcttcgtgctggaatcaaggtttgtgccatcaaagcccctggttttggtgaaaacaggaaagccaatctgcaggatcttgccacacttacaggaggtgaacttattactgaagagcttggcatgaatcttgaaaaagtggatctggatatgcttggctcttgcaaaaaggttacaatatcaaaggatgacactgttattcttgatggtgctggggacaaggcggctcttgaggaaagatgtgaacagatccggtcagcaattgaaaatagctcctctgattatgacaaagaaaagttacaggagagattgggaaagctttctggtggtgtagcagtgttgaagattggaggagccagtgaaatcgaagttagtgagaagaaggatagagtgactgatgccttaaatgccacaaaggcagctgtcgaagagggtatagtgccaggtggtggcgttgctcttctttatgcatcaaaagagttggaaaagctggaaactgccaactttgatcagaagattggtgttcagattattcagaatgctctgaagacacctgtgtacacgattgcttctaatgctggagttgagggggctgttgttgttggtaagctgttggaagaaaatgaccctgcccaaggatatgatgcagccaaaggtgaatatgttgatatggtcaaagccggaattattgatccagtgaaagtgattagaactgctttggttgatgctgcaagtgtgtcgtctttgatgacaaccactgaagctattataaccgaaataccctcgaatgataaagaggctccggcaatgggtggtggcatgggtggcatggattattgaggatctttttctggtcgtacaatcatccaatgacccttttgtttcactccaagatccttaaatgatgcaaacatcggattttttcttgcatgtcttaattggtttggtcataaggcatccatgtaatcatagagaacaacgtaggtagctttgataacttaggatggaacctgtgattgttgcttcaatgaggaatcaacttgtattggaacttttttccccct

SEQ ID NO: 1029 - DNA, 2371 bp, Populus trichocarpa
caaacattttgccaaaagcaggccggatccaacccaacggtaaacctcgtttaacagtgaaatgaacacaaaaccctaaaccctgccaataaccagaagctgcttctagagccttctctttctctacaaaaagcactcgctctccacttcctcggcctccattcgtgatctctctgtctctaccacttcgtcaaactttctctacaatcccacaaattatctgtgtttcttctctcgtaattcttcttggcgatactatgcaccgcttcacttctagcctcgcttccaaggctcggattgctaggagcaccaccaaacaaattggaagtaggttgagttggagcagaaactatgctgccaaagacataagattcggtgtggaggctcgtgctgtgatgcttaagggtgttgaagagctagctgatgctgtcaaagtcaccatgggccctaagggtcgcaatgtggttattgaacaaagctttggtgcccccaaagtgactaaggatggtgtgactgttgcaaagagcattgagttcaaggataaagtcaagaatgttggtgctagcctcgtgaagcaggttgcaaatgccacaaatgatgctgcaggcgatgggaccacttgtgctacggtcctcactcgagcaatatttgctgaagggtgcaagtcagttgcagcaggaatgaatgcaatggacctaagacgtggtatcagcatggctgtggaatcagttgttaccaatttgaaaagcagaacaagaatgatcagcacatccgaagaaattgcacaagttggtacaatatcagcaaatggggaaagagaaattggtgagttgattgcgaaggccatggagaaggttgggaaagagggagttataacaattcaagatgggaaaacattatctaatgagttggaagttgttgagggattgaagcttgacaggggctatatatccccttatttcatcacggaccagaaaacccaaaaatgtgaattggatgaccctctcattctgatccatgacaagaaagtctcaaatttgcatgctgtggtgaaagtactagagttggctttaaagagacaaaggcccttgctgattgttgctgaagatgtggagagtgaggcactggcaacacttattttaaataagcttcgtgctggaatcaaggtctgtgccattaaggcccctggttttggagagaacaggaaggctacattgcaggatcttgctgtcctcacaggagccgaagttataaccgaagagcttggcctcaatcttgaaaaggtggatttggatatgcttggcagttgcaaaaaggttacagtatcaaaggatgacactgttattcttgatggtgctggtgacaagaagtccattgaagaaagatgtgaacagatccgatctgcagtagagtcgagtacttctgactatgacaaagagaagttgcatgaaagactggcaaagctttctggtggtgttgctgtgctgaagattggaggagctagtgaagctgaagttggtgagaagaaagatagagttacagatgccctaaatgccacaaaggctgctgtggaagagggtattgtgccaggaggtggtgctgcacttctttatgcatcaaaagagttggataagctgcaaactgccaactttgaccagaagatcggtgttcaaattattcagaacgccctgaagacccctgtgcatacaattgctactaatgcgggagtcgagggagctgttgttgttggtaagctattggagcaggacaaccctgatctagggtatgacgctgccaaagatgaatatgttgatatggtgaaagctggcattattgacccgctgaaagtaattagaactgctttggtcgatgctgccagtgtctcctcgttgatgacaacaactgaggctgttataactgagcttccaaaggatgaaaatgatgctccggcaatgggtccaggcatgggcatggattactgaggttgatttttagagactgatccgacctgcctgacatagatatttgaccctttgtacccaatttatcgattcattgttcctaagatcaaaaggcatcatctaatcatagtgagtgagtctcggcatgtaggtagtttttgataattggataatggattattgtttgggaaaacttgcatgtaaggctctttttcccccctggcacatccttatctttggcaaccaagagcttggtcattatagccctgtttgttccttctcggcatgtaggaagtatttgttctacatgttctaggcatttgttccttctccgtgaacccaagaataatctgcaatttgattagggtttctacttgaatctgatttgtgttaaaatgttctttttccgc

SEQ ID NO: 1030 - DNA, 2390 bp, Cichorium intybus
attccacactctaacattttctcttttaatttctctgttccgtcgtcgccgccgccgccaccatgtatcgtctcgccgccaatcttgcgtctaaatcaaggatcgccagaaacaatgctcagcagattagctcgaatttaagctcgaggcgaaactacgccgccaaagatattagattcggagtagaagcgagagctttaatgcttagaggtgttgaagaacttgcagatgccgtcaaagtcaccatgggtcctaagggacgtaatgttgtcatcgaacaaagctatggagcccccaaggtgacaaaggacggtgtcactgtagcaaagagtatcgagttcaaagacagggtgaagaatgtaggtgctagtcttgttaagcaggttgctaatgccaccaacgatgttgctggtgatggtaccacctgtgcaacagttcttacacgtgcaatctattctgaaggctgcaagtcagttgcagctggaatgaacgccatggatcttagacgtgggatcacaatggctgttgattctgttgtcacaaacttgaagagcagagctaggatgatcagtacatctgaagaaatagcacaggttgggacaatatccgcaaatggggaacgggagatcggtgaacttattgccaaggctatggagaaagttggcaaagaaggtgtcattaccatctctgatggcaaaacactttacaatgaattggaagtggttgagggaatgaagttggatagaggctatatatcaccttacttcatcaccaatacaaagaaccaaaaatgtgaattagatgaccctttgatcttaatacatgagaaaaagatctccagcttaaatgctatagtcaaagttctagagttggctttgaagaatcaaagatctttgctaattgttgctgaagatattgaaagtgaggcattagccactctcattcttaacaaacttcgtgccggtatcaaggtctgtgccattaaagcccctggatttggtgaaaaccgaaagtcaaacttgcaggatcttgcaactttgaccggaggagaggtcataaccgatgagcttggtatgaatcttgataaaatggcaccagaaatgttaggaacttgcaaaagggttactatatcaaaggacgacaccgttatccttgatggggctggtgacaaaaaatccattgaagaaagatgtgaacagttgagatcatcaatcgaattaagcacttcagattatgacaaggagaagcttcaagagagattagcaaaactttctggtggtgttgctgttttgaagattggaggagctagtgaagctgaagttggtgagaaaaaggatagagttactgatgctctaaatgctacaaaggctgcagttgaggaaggaattgtaccaggtgggggtgttgctcttctatatgcttccaaggagcttgacaatcttgttaccgccaatttcgatcagaagattggtgttcaaatcattcaaaatgctctcaaggcaccagtgcacacaattgctgccaatgcgggagttgagggtgctgttatagttgggaaacttctagagcaagataaccccgacctaggatatgacgccgctaaaggtgaatatgtagacatggttaaggcaggaatcattgaccccctaaaagtgatcaggactgctttagtggatgccgcaagtgtgtcatctttattgactacaacagaggctgtgattgttgaacttccaaaggacgagaaggatgcaccagcaatgggcccaggcatgggtgactattgaaggaaacggtaactcattcttttcatatatatgagcattttccaagctgtacaacgaaacgaattagaagctagttggttagatccgattatctccaatccaatgatttgagcaattagagttttcttcctttttgattatacgcttattaccaatgtcagaccattatgtaatcatctagagggccaaaacaaattttcacccgttatcatatgacatcaattttctctaataaacttttggatgtcgtatttctggtaatttggatgtgagtgatttacgaattaaaatcagaagtggatccatctattttctatatgagccacatcttgattgatccatgtagttaagttgcattttcatatcatagtttcttgctacaatctctctacaaacctcatcaacccgcctttcctactgttttctccgtttcttgcttctaatcttcttttaactttactattttaaatcttaatttaaaatgttataatatctttatcttcacaaatataatatgtcaaatattcctcagcccattcctgatatctttatcttctttaaagccatggaattttatagcttatgtccacgactgaaattctatgt

SEQ ID NO: 1031 - DNA, 2036 bp, Panax ginseng
ggacgcactctgtactcctgcccaatttctcaacttcataatttaacttcataatttacatttgcagcctctgtactacaaaatctaaagtttctccaacaattacagaaaaaatatgtatcgttttgcagcaaaccttgcctccaaagctaggattgcaacaaattgcacccaacagattggaagtagattcagtttgagcagaaactatgcggccaaggatattagatttggagttgaagctcgggctttaatgcttaagggtgttgaagagcttgctgatgcagttaaagttactatgggccctaaggggcgtacggtggtgattgaacaaccttttggggcacctaaggtgacgaaagatggtgtgaccgtggccaagagcattgaattcaaggacaaagttaaaaacattggggcaagccttgtcaaacaagtagcaaatgccaccaatgatgttgctggtgatggtactacttgtgccactatcctcacgcgtgcaatctttatggaaggctgcaagtcggttgcagctggtatgaatgccatggatcttagacgtggtattaacatggctgtagatgctgtggtaacaaacttgcaaagcagggcgcggatgataagtacatctgaagaaatagcacaggttggcacaatatctgcaaatggagagagagagattggtgagctaattgcaaaggcaatggagaaagtcggcaaggagggagtaattacaatccaagatgggaagacattgtataatgaattggaagttgttgaaggaatgaagctggatagggggtacatatccccgtatttcatcacaaacgagaagaacttgaaatgtgaactagatgaccctctcattttaatccatgagaagaaaatctcaagtataaatgctgtggtaaaattacttgaattggcattgaagatacaaaggccactattaattgttgctgaagatgtggaaagtgaagctcttgcgacactcattcttaataagcttcgtgccggaatcaaggtctgtgcaatcaaagctcctgggtttggagagaacagaaaggctaatcttcaggatcttgccgtccttgctggaggccaggttataagtgaagaacttggtatgaaccttgacaatgtagagttggatatgcttggttcatgcaaaaaggtcacagtatctaaggatgacacgattgttcttgatggtgctggggagaagaaggctatagaagaaagatgtgaacagataaggtcagcaattgagtcgagcacttctgattatgacaaggagaagcttcaggaaagattggcgaagctttctggtggcattgctgtcttaaagattggaggagctagtgaagctgaagtaagcgaaaagaaagatagagtcacagatgctctaaatgccacgaaggcagctgtagaagaaggaattgtgccaggtggtggtgttgctcttctttatgcaaccaaagagttagaaaagcttccgacagccaactttgatcagaaggtcggcgtacaaattattcaagatgccctgaagacagcagtgcataccattgcctctaacgccggagtagaaggggctgttgttgtcagcaagctgttagagcaggataatcctgatcttggttatgatgcggccaaaggtgcgtatgttgatatggtcaaagctggaattatcgacccattgaaagttataagaacggccttggttgatgcagcaagtgtatctgccttgatgacgactacagaagctatcgttgtagatcttctgaaggacgagaaagaagttccaatgggcggcggcatggattattgatagtttcaactgagttaacctgcctaacatgtactaaaattaacacaagttttttgacatgaagagagttttatgtgggagccaaaacatccatgtaatcatgaataaaacagtagtttgaaagttttgattttgtaggatttaaagaatctaatactgttgtcccaaggactcgttggtacttttcagagagatgccaattcct

SEQ ID NO: 1032 - DNA, 2030 bp, Medicago truncatula
ctaaaccctaaaagctgctgcttcttctagatctttctctttctttcaaaaggaactgtgcagcgttcttccatcaacaccagtctctgcaatttcttccgtactttgctttctcagttaccctatacgcaatcaaactacaccatgtaccgatttgcttcatcacttgcctccaaagctcggattgctaggaacaatgttcaacaggttggaagtagggtggcatggaacagaaattatgctgccaaggagataaaatttggcgtggaggctcgtgctttgatgcttaagggtgttgaagacctcgctgaggctgttaaagtaaccatgggtcctaagggccgcaatgtggttattgagcaaagttttggtgctcctaaagtgaccaaagatggagtaaccgttgctaagagcattgagttcaagtgtaaggtcaagaatattggtgccagtcttgtaaagcaggttgctaatgctaccaatgatgtggctggtgatggaactacatgtgctacaattcttactcgagcaatattttccgaaggctgcaaatcagttgccgctggaatgaatgcgatggacctgaggcgaggtataaatatggctgttgacgctgttgtcacaagccttaaaagcagagcacggatgattagcacttctgaagaaatagcccaggtggggaccatatccgctaatggggacagagaaattggtgagttaattgcaaaagctatggagaaagttggcaaagagggtgtaatcacaattgctgatggcaagacattgcacaacgagttggaagttgttgaaggaatgaagcttgaccgaggctatatttctccgtatttcataacaaaccagaagaaccagaaatgtgaacttgaggatcccctcgtcataatccacgagaagaaaatctcaagtttaaatgctatagttaaagtattagagttagctttgaaaaaacaaagacctttattgattgttgctgaagatatagaaagtgatgcccttgcaactcttatcctaaataagcttcgtgccggaatcaaggtgtgtgccatcaaagcccctggttttggtgaaaatcggaaatctggtctccaggatcttgctgttcttacaggaggtcaacttatcactgaagaccttggccacaatcttgagaaagttgatctggaaatgtttggctcttgcaaaaagattacaatttccaaagatgacactgtcattcttgacggtgctggtgacaagaaagctattgaggaaagatgtgagcagatcaggtctgcagttgaaaatagcacttcagattatgacagggataaattacaggaaagattggccaagctttctggtggtgttgccgtgcttaagattggaggagctagtgaagctgaagttggtgagaaaaaggatagagttacagatgccttaaatgcaacaaaggcagctgtagaggagggcatagtacctggtggtggtgttgctcttctttatgcatcaaatgagttaagtaagctttcaactgccaattttgatcagaagataggtgtccaaattatccaaaatgctttaaagacacctgtgcacacaattgcatcaaatgctggagttgagggtgcggttgttgttggtaaactattggaacaggataatcctgatcttggttacgatgccgccaaaggtgaatatgttgatatggttaaagctggaattattgatccattgaaggtgattaggaccgccttggttgatgcagccagtgtatcatctttgatgacaacgactgaagctattgtgtccgatctcccaagtgaagataaagatggtcctgctatgcctgctggcatgggcggcatgggtggttattagtagatgaatctggctttctttcactaaaccttgattagagagagagtggtgcttcaccactattattatagcatttttctgcttattgtttactgacagaaggcattaatttgtaatcatagcagagggaccaaatctgtaggtagagaggagag

SEQ ID NO: 1033 - DNA, 2099 bp, Orobanche aegyptiaca
tttttcttgctcaacacttcacattcccaatcactattaaaacctttcttcatctcacactcgagcaactaaaaaattcagcccatcgccagcatgtatcgcttcgccacttccctagcttctaaagccaggaatcctaaaaccagccaactggttggtggtaggctgtcgtggagtagaaattatggggcaaagggaattaaatttggagttgaagctagggctgctatgcttagaggcgtcgaagagcttgctgatgctgtcaaagttacaatggggcctaaaggtcgtaatgttgtactagaacaaagttatggcgctccaaaagtgaccaaggatggtgtcactgtcgcaaaaagcattgagtttcaagataaagtgatgaatgttggtgctagccttgtaaaacaggttgcaaatgccaccaatgatgttgctggagatggtaccacttgtgcgaccatactcacgcgtgcaatatatgccgaaggatgcaaatcagttgcagctggaatgaatgccatggacttgagacgtgggattaacatggcagttgatacggttgtgacaaacttgaaaagcagggcacgaatgattagcacatctgaagagatagcacaggttggtacaatatcagctaatggagaaagagagattggtgagcttatagctaaggctatggaaaaagttggcaaagagggagtcattaccattgcagatgggaagacactgaataatgaactggaagtagtcgagggtatgaagcttgatagaggctacatatcccctcacttcatcaccaacaagaagaaccaaaaatgtgaattggaagatgctctaattttaatccacgagaagaaaatcgataacattaatgccatggtgtcagcactggagttagccttgaagaagcaaaaaccattgttgattgttgctgaagatatcgagagtgatgcattggcaactctcattataaacaagcttcgagtgggattaaaggtttgtgccattaaagctcctggatatggagacaacagaaaggcttatttacaggacctggcagtcttaacaggaggcgaggtcatcaccagtgatctaggcatggatcttgagaatttgacagttgacatgcttggctcgtgcaaaaaggttacagtatcaaaggatgacacggtcgttcttgatggggctggtaacaagaagtctattgaagaaagatgtgaacagatacgatcaggaattgagttgagcacttctgattatgacatagagaagctccaggagagactagctaagctttctggtggtgttgctgtgttgaagattggtggtgccagtgaaactgaggttggggagaagaaggatagagttactgatgctctcaatgcaacaaaagctgctgtcgaggagggaatcgtacctggtggtggcgttgctctcctttatgcatccaaggagctggagaagttacaaactgcaaacttcgatcaaaagattggtgttcagataatccagaatgctctcaaggctccagtacacactattgcatctaatgctggagttgagggagctgttgtggtgggcaagctattggagcaggacaatccagaccttggatatgatgccgctaaaggtgattatgtggacatggttaaggctggaataattgatccattgaaggttattagaaccgctttagtagatgctgcgagtgtttcgtcgttgttaaccaccacggaggctgttgtttatgaacttcctagtgaggagaaaccctctccaccaatgggcggtggcggcatgggcggcatgggtggtggcatgggcttctaaggacttaaacgaactgtttaaattcgaagatcattccatttgtcgttctaattttttcgggatctgattccatgtgtcgatgtatttatttagtggtaatgtaacttgtcttgaggtttggccgagttgcatagacgtcccctaatattttaaaagttacttcagtatgggtcgtcgtcaacgcttttgaaccgtttcatttactattactatgatattattggccccataaagtagcactcctttgtttatcattaattggttct

SEQ ID NO: 1034 - DNA, 2166 bp, Solanum lycopersicum
ataaaaccctaaaaccctagaaggtgcttcttgggatcttctaggcccttcttcactaaattaaatacctttgaagcttcttcttcatccccacttctctctttgtacttcaaaatccctttccactttctctttcagcagcatttctcagcttcaaaatgtatcgttttgcagcaaatcttgcttctaaagccagtgttgcaagaaccagttcccaaaagattggtgggaggttgaattggagtagaaactatgctgcaaaggatatcagatttggagttgaagctagagctttgatgcttcaaggtgttgagcagcttgctgatgctgttaaagtcactatgggtccaaaggggcgtaatgtggtgattgaacaaagttggggtgcacccaaagtgacaaaagatggcgtgactgttgcaaaaagtattgaattcaaggacaagatacaaaatgttggtgctagccttgtaaaacaagtcgccaatgcaacaaatgatgttgctggtgatggtaccacttgtgcaacagtcctcacccgagcaatatttgctgaaggatgcaagtcagtggcagctggtatgaatgcaatggaccttagacggggtattaccatggctgtagattctgttgtgacaaacctgaaaagcagagcacggatgatcagtacatctgaggaaattgcacaggttgggactatctctgcaaacggagaaagagtaattggcgacctcattgcaagggcaatggagaaagtaggcaaggagggagtcatcactattcaagacgggaagacattgctcaatgagttggatgttgttgaagggatgaagttggatagaggttacatatcaccatacttcatcacaaatcagaagaatcagaaatgtgaactggataacccactaattctgattcatgagaaaaagatctcaagcattaatgctgttgtgaaagcattggagttagctctgaagagacaaaggcccctcttaattgtggctgaagatgtggacaatgaagcactcgctactcttattttgaacaaactccgtgctggaatcaaggtttgtgccatcaaagcaccaggctttggtgaaaacaggaaagcttatttgcaagatcttgctattttaactggaggccaagtcataacagaagagcttggactgaacattgaaaatttggagttcgagatgctgggaacaagtaaagaggcaactatctctaaggatgatactgtcattcttgatggtgctggtgagaagaagtccatcgaggaacgatgtgaactgattagatcaaccattgaacagagcacatctgactatgacaaggagaagttgcaggaaagactagctaagctttcagggggtgttgctgtgttaaagataggaggagccagtgaagctgaggttggtgaaaagaaagatagagtaactgatgctttgaacgccacaaaggctgcagtggaggaaggaattgttccaggtggtggtgttgctcttctttatgcagcaagagaattggataatttgacaacagccaactttgaccagaagattggtgtacaaattattcagaatgctctgaagacgccagtacatacaatagcctctaacgcaggagtagagggtgctgtcgtggttggtaaactgttggatcaggacaaccttgatcttggatatgatgcggccaagggtgaatatgtagatatgataaaggcaggaatcatcgatccagtgaaagtgatcaggacagctttggtcgatgctgccagtgtctcgtctcttttgaccacaactgaagcagttgttgtcgagcttcctaaggacgagaaggaatctcctgcaatgggtggcggtatgggtggtggtatgggtggcatggacttctgattgaaaagccaaaaacagtaattgcagctgcttgacacatttggtttatagaacaaagcaaaaaaataaatttagatttatttcctattttgatgaatctttttacgatagaaaacgcgcctattgtatcaatagcaagagagacaagaccattgtgaattcatgtttttgtaggttcaaaatttgtagtcttcatttgaatacgcagcttaaatataggtccatttcagtgttcctttctggttttactattatattgaggtgtgat

SEQ ID NO: 1035 - DNA, 2029 bp, Gossypium hirsutum
cacccctgaaacccacccattgtcttttgtcaacccacaaacagctttactgttaacattttactcaagattgttcctgcatttctttcctgccaaaataaccatgtatcgctttgcttcaagccttgcttctaaagctagggctgctaggaacactacatatcacattggtagtaggttgagttggaataggaactatgctgcaaaagatattaaatttggggttgaagctcgagctttgatgcttaaaggtgctgaagagctttctgatgctgttagagtaaccatgggtcctaagggtcggaatgtggttattgaacaaagctacggtgctcctaaagtgactaaagatggtgtaactgttgcaaagagtattgaattcaaagacaaagtgaagaacattggtgcgagtcttgtgaaacaagttgcaaatgccaccaatgatgtagctggtgacggaactacctgtgcaacggtgcttacacgagcaatttttaccgaaggatgcaagtctgttgctgcaggaatgaatgcaatggaccttaggcgtggcataacaatggcagttgatgccgttggtacaaacttgaaaagccgggcaaggatgattagcacatctgaagagattgctcaggttggaacaatatcggctaatggagagagggaaattggtgagttgattgcaaaggccatggaaaaagttggcaaagaaggggtgataacaattgaggatggtaaaacattatataatgagttggaagttgttgaaggcatgaagctagacaggggctacatatccccttatttcatcaccaacactaaaaccaaaaatagtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagccccaggttttggtgaaaataggaagtctagtctgcatgatcttgctgtcctcactggaggagaggttataacagaagaacttggcatgaaccttgaaaaggtggatctggacatgctcggaacttgcaaaaaggttactgtctcgaaggatgacactgttattcttgatgggaatggtgacaaaaagccattgaggaaagatgtgaacagattagatcagcaattgaattgagcacctctgattatgataaggagaagttgcaagagagattggcaaaactttctggtggtattgctgtcttgaagattggtggagctagtgaagctgaagttggagagaagaaggatagagttacagatgcattaaatgctacaaaggcagctgtagaggaaggcatcgtgccaggaggtggtgttgctcttttatatgcatcgaaagagttggacaagctacctatggccaactttgaccagaagattggtgttcaaatcatccagaatgctctaaagacacctgtacacacaattgcttcaaatgctggagtcgagggagctgtcattgttggtaagctgttggagcaggataaccctgatcttggctatgatgcagccaaaggtgaatatgtcgatatggtaaaggctggtattattgatccattgaaagtaattagaactgctttggtcgatgctgcaagcgtgtcatcattgaggacaactaccgaagctgctgtagtcgaacttccaaaggatgagaaggatgttccggcaatgcctggcagtatgggtggcatggattattaaggttattccccctaagagtgcaccgattgtaagtgttttcatctaatctatttccatttcctcaacatctgtgagaaaaagaatatccgagtctcgatgtctaagttggaaggtggttttggtgataaagggtcaacaggactctcttattgttgttgctagaaagaacgaactagtttgtattgggccattttatctt

SEQ ID NO: 1036 - DNA, 2691 bp, Panicum virgatum
gcttcgctgtgagcctgcgacattcaggttggtgggccgtaacacccttcacctgcagcagcccagaaggcgaaagcccactttggacggccgcggcagccgccgcgccgtcgcggatgtgctggctgccgcgccagcccgcaccaccgccgcacgcccaccaacagccacccagtaaaaccctaaaccctagtggatgcttctagagccaccgcgcaccctccgctcgcctcccccgcacccccctctaaaatccgtccaccccggacctcctcggcgcctcgcgtcccctttccccctccgcaagaaagaaagcgaagcagctccgcctccgcctccacccccacccccaccacaaactcaggctcgctcgccgacgaccgcctccgaccccgcgccatgtaccgcgcggcagccagcctcgcctccaaggcgcggcaagccgggagcagcgccgccgcacgccaggttgggagcaggcttggctggagcagaaactatgctgccaaggatatcaggtttggcgttgaggcccgtgctctgatgctgaggggtgttgaagaattggctgatgcagtcaaagtgacgatgggtcctaagggtcgcaatgtggttattgaacaaagctttggtgcacctaaagtcacaaaggatggtgtgaccgttgctaagagcattgaattcaaggatagagtaaagaatgttggtgcgagccttgtgaagcaggttgccaatgcaactaacgacactgctggagatggtaccacatgtgcaactgttttgacaaaagcaatatttactgaggggtgcaagtctgttgcggctggaatgaatgctatggatttaaggcgtggaatctcaatggctgttgatgctgttgtgaccaatctgaagggcatggccagaatgatcagcacttcagaagagattgcacaggtgggtacaatatcagcaaacggggaaagggaaattggtgagcttattgccaaagctatggagaaggttggcaaagagggtgtaatcaccattgcggatggtaacaccctttacaatgagcttgaagttgttgagggcatgaaactcgacagaggttacatctctccgtacttcattaccaactcaaaaacccaaaaatgtgaactggaagacccattgattttgattcatgacaagaaggtttcgaacatgcacgcagtggttaaagttttagagatggcccttaagaagcaaaggcctctactgattgtcgcagaagatgtggaaagtgaagcattgggcactctgattattaacaagcttcgtgctggcatcaaggtctgcgctgtcaaagctcctggttttggtgaaaacaggaaggcgaacttacaagaccttgctatccttaccggaggagaagtcataaccgaagaacttggaatgaaccttgagaattttgagcctcacatgttgggtacatgcaaaaaggtgacggtctctaaggatgacactgttattcttgatggagctggagacaagaagtccattgaggagagggcagagcagattagatctgcaattgagaatagcacttctgattatgacaaggaaaagctacaagagcggttggcaaagctctctggaggtgttgctgttctaaagattggaggagccagcgaagcagaagttggtgagaagaaggatagagtgacagatgccttgaacgctactaaggcagctgtggaagagggcatcgtgccaggtggtggtgttgctcttctctatgcatcaaaggagcttgataaattgcagactgcgaactttgatcagaagattggtgtacagatcattcagaatgctctgaagacacctgtgcacactattgcttccaatgctggtgtggagggagcagttgtggtgggcaagcttttggagcaagggaacactgaccttggttatgatgctgctaaaggtgaatacgtcgacatggtgaaggctggtatcatcgacccacttaaagtgattagaactgccctggttgatgctgctagcgtgtcgtccctgatgaccaccacggagtccatcattgtagagatccccaaggaggagacaccggcgccagcaatgggcggcatgggtgggatggactactaagggcatcacacccacggcaatacacatcagatcaacatgaactaggattctttttgctcagcggtgcaagttcatctttagtgtattttggtggttgatgaggtgattgtcaggcgatacaattttgagtctgcgtacggaagaccagttccaaacggaaccggtgtgggaataataaactgtagctgttgagagctggagcggtagatcaaaattcgattctgacaccttgtgccggactttctatactgaagcactacaagttttttggcggtgggtaaggtttcctttttgcgtgcatttgcatcgtcgtccaatcgacctcctcgactgaatgcctggcaaatgtggaaatgctcgtataatctgcctgagtgcgagttcgttgaattactgttcgggaccgctagttttgcgcatttcgctccatggcaacagttcgccgccgttcgctcctgggcagacaagtctgctgtttccatagaaagggagccggaacttggaaaatttgaagaattacagcaaaatctgtaggaactgctgcaacacagcaaaacaaag

SEQ ID NO: 1037 - DNA, 2279 bp, Cichorium intybus
ctagtctccgaagaaccctaaaccctaaaccgtatctggacttcttctggatccttctcttactctgctattttaatatctctctctagtctctacccattccacactctagcattttctcttttaatttctctgttccgtcgtcgccgccgccgccaccatgtatcgtctcgccgccaatcttgcgtctaaatcaaggatcgctagaaacaatgctcagcagattagctcgaatttaagctcgaggcgaaactacgccgcgaaagatattagattcggagtagaagcgagagctttgatgcttagaggtgttgaagagcttgcagatgctgtcaaagtcaccatgggtcctaagggacgtaatgttgtcattgaacaaagctatggagcccccaaggtgacaaaggacggtgtcactgtagcaaagagtatcgagttcaaagacagggtgaagaatgtaggtgctagtcttgttaagcaggttgctaatgccaccaacgatgttgctggtgatggtaccacttgtgcaacagttcttacacgtgcaatctattctgaaggctgcaagtcagttgcagctggaatgaacgccatggatcttagacgtgggatcaccatggctgttgattcagttgtaacaaacttgaagagcagagctaggatgatcagtacatctgaagaaatagcacaggttgggacaatatcagcaaatggagaacgtgagatcggtgaacttatcgccaaggctatggagaaagttggcaaagaaggtgtcattaccatctctgatggcaaaacactttacaatgaattggaagtggttgagggaatgaagttggatagagggtatatatcaccttacttcatcaccaatacaaagaaccaaaaatgtgaattagatgaccctttgatcttaatacatgagaaaaagatctccagcttaaatgctatagtcaaagttctagagttggctttgaagaatcaaagatctttgctaattgttgctgaagatattgaaagtgaggcattagccactctcattcttaacaaacttcgtgccggtatcaaggtctgtgccattaaagcccctggatttggtgaaaaccgaaagtcaaacttgcaggatcttgcaactttgaccggaggagaggtcataaccgatgagcttggcatgaatcttgataaaatggcaccagaaatgctaggaacttgcaaaagggttacaatatcaaaggacgacacagttatccttgatggggctggtgacaaaaaatccattgaagaaagatgtgaacagttgagatcatcaatcgagttaagcacttcagattatgataaggagaagcttcaagagagattagcaaaactttctggtggtgttgctgttttgaagattggaggagctagtgaagctgaagttggtgagaaaaaggatagagttactgatgctctaaatgctacaaaggctgcagttgaggaaggaattgtaccaggtggcggtgttgctcttctatatgcttccaaggagcttgacaatcttgttaccgccaatttcgatcagaagattggtgttcaaatcattcaaaatgctctcaaggcaccagtgcacacaatcgctgccaatgcaggagtggagggtgctgttatagttgggaaactattggagcaagataaccccgaccttggatatgacgccgccaaaggtcaatatgtagacatggttaaggcaggaatcatcgaccccctaaaagtgatcaggacggctttagtggatgccgcaagtgtgtcatctttattgactacaacagaggctgtgattgttgaactcccaaaggacgagaaggatgcaccagcaatgggcccaggcatgggtgactattgaaggaaacggtaactcattctttccatatatatcggcattgtacaacaaaacgaattagaagctggtggtggtagctagttggttagatccgattctctccactgatttgagcaattagagttttcttccttttttgattatacgcttattacgaatgtcagaccattatgtaatcatctagagggccaaaacaaattttcacccgttatgatatgacatcagcggtcatcaattttctttaataaacttttggatgtcgtatttctggtaacttggatgtcagttttcaatgtgatttacgaattaaaatctcacatatggatatgtttaagtggatccatgattaaatcatcatccaaatttatttctaatcaatatgagccacatcttgattgat

SEQ ID NO: 1038 - DNA, 2750 bp, Amborella trichopoda
aacatataaacgagaaagtttgaaaggggaaatttcattgatacccaaaaaccctaatcgatacttctagactattcccccatccaactcccagggttttagaatcctctccccgactctttaaattgtacacgtcctttcccaacgccgtcttctcttccgtgtcttaaacctccaaaaccctaacccagttccctctctctatcacagttgttctacctctctcactgtggctctacctctctctctctctctctcaatgtatcgtgcagctgcgagacttgcctccaaggcacggttctcaaatgccagccaacagattggtagcagagtgagttggaatagaaactatgcagcaaaggatattaagtttggggttgaggctcgtgctttgatgcttaagggtgtcgaggagcttgctgatgctgttcaagtaaccatgggaccgaagggccgtaatgttgttattgaacaaagctttggggctcctaaagtcacaaaagatggtgtgactgttgcaaagagcattgagtttaaggatagaattaagaacgtgggcgcaagccttgtcaaacaagttgcaaatgccacaaatgatgttgcaggagatggtaccacttgcgctactctcctaacacgtgcaatatatgctgagggttgcaagtcggtggcagctgggatgaatgcaatggacttgaggcgtggtatcaccatggctgttgatactgttgtcaccagcttaaagagcagggcacgaatgatcagcacatcagaagaaattgcacaggttggcaccatatcagcaaatggagaaagagagattggagagttgatagcaaaggctatggagaaggttggcaaagagggagtcatcaccattgctgatggaaagactttatacaatgaattagaggttgttgaaggaatgaaactcgataggggctatatatccccatatttcatcaccaaccaaaaaacccagaaatgtgaacttgataatcccctaattcttatacatgaaaagaaaatttcgagtttaaatgcaattgtcaaagtattggagcttgccttgaagttgcaacgccctttgttgatagttgcagaagatatcgaaagtgatgcgctcgcgacactcattttgaacaagctccgtgctgggattaaagtttgtgccattaaagctcctggctttggagaaaacaggaaggctagcatgcaggatcttgccacactcactggtggagagcttattactgaggagcttggtttgaacctcgaaaaagtggaaccggatatgctgggtactgccaaaaaggtcactgtatctaaagatgatacagtggttctagatggggcaggtgaaaaaaaggccattgaggaaaggtgtgatcagttgcgatctgccatagaagccagcacttcggattatgacaaggaaaagttgcaagagagactagcaaaactttctggaggtgtggctgttctcaagattggaggagccagtgaagttgaagttagtgagaaaaaggacagagttacagatgctctaaatgccaccaaggcagctgttgaagaaggcatcgtaccagggggtggtgttgcacttctttatgcatcaagggagctagaaaagctgcatactgccaactttgatcagaagattggtgttcaaattattcagaatgcacttaagatgcctgtgcacactattgcatccaatgctggagtagaaggtgctgtggttgttgggaagttacttgaacaagataaccctgatcttggatatgacgcagctaaaggtgaatatgttgacatggttaaggcaggaataattgatcccttgaaggttatcagaactgcattggtggatgctgctagtgtatcttctttgatgacgacaactgaggctactgttgttgagcttcctaaagacgagaaagagatgactccgcccatgggtggtgggatgggtggaatggattactagaggcagtggaagagcatagtgtgcgtgtgtggaaatctgtcataaggcatttaaaatcccttgagtgaatccttctccaggctttggtgtgttctccaattctcggattacaggaacatttggagctaacttgtaatcaaagaggtgactaggaagttttggtttattttatctttgttcaccagtttattcttgtgggcgtatgcagcagtgatcattattggtctcatttccaatgtcttttctaaggtctgtttcaatggcgactctaatattgataaacttggttacgagttgtagcatttttccgaacatttagcatatgcatttttccgaacatttagcatgtagcacttttccgaacatttagcatgttagttgattataaatttataagggatacctatactataggagtctttaccattattaggttacgagcacggcgaactattagatgtggtttagagtgtgttatgaagttggagatttttttttgaaaaattatatacacatctgttatagtttctgtaggtacggttttatcgaatagttttcgttattatcactgtatttgtttttcatctccaaacaaaaatttttaaaaagtatttttttttttgaataattgaattgaaagtattcaggtcaatttcggtttttgaataacttaattttcggttttttttcgaattaacttaatttttggtttttcaagaactaaaagtttctctcttgtgggtgtgtatcttctctctatctc

SEQ ID NO: 1039 - DNA, 2197 bp, Musa acuminata
ggaaactacgaaggccccctttttaagaaccctcagctgtcgtcgcctccgctcttcgagtaccctaatctggtctctaccgaagcccaccatgtatcgcgccatggcctccctcgcctccagagcccgagtaatggagttttgtttggtgctgcagattggaagtagggttggttggagtagaaattacgctgcaaaggatatcagatttggggtcgaggctcgtgctttgatgcttaagggagtggaagagcttgctgatgcggtgaaggtgacgatgggcccaaagggtcgcaatgtcgtcttagagcaaagctttggtgcacccaaagttacaaaggatggtgtgactgttgcaaagagcatcgagttcaaggacagaataaagaatatgggtgctagtcttgtgaagcaggttgccaatgcaaccaatgatgttgctggtgatggaacaacatgtgctaccatccttacaaaagcaatatttgctgaaggatgtaagtcagtggctgccgggatgaatgcaatggatctgagacgtggcatttcaatggctgttgatgctgtggtgactaatttgaagagcagagcaagaatgattagtacctcagaagagatagctcaggttggaacaatatcagctaatggagaaagagaaattggtgaactaattgcaaaagctatggagaaagttggcaaagagggagtcatcacagtagcagatgggaaaactctagacaatgaactagaagtcgttgaaggaatgaaatttgatcgaggctacatatcaccctactttattactgatccaaagaaccaaaaatgtgaacttgaagatcctctgattttgattcatgagaagaaaatttcaagcatcaatgcagttgtgaaggtgttagagttgtctttgaagagacagagacctttgctgattgttgcagaagacatagaaagtgatgcactggccactctcatccttaataagcttcgtgctgggattaaggtttgtgctgtgaaagctcccggctttggggagaacaggaaagccaatttgcaagaccttgctattctcactgggggatctctcataacagaagaacttggtttgaaccttgagaaagtggaacttgacatgcttggcacatgcaaaaaggtgacaatctcaaaagacaacactgtgattcttgatggatctggtgaaaagaaggctatagaagagagatgtgaccagataagatctgcaattgaattgagcacatcagactatgacaaagagaagcagcaagagaggttggcaaagctttctggtggagttgctgtcctcaagattggaggggccagtgaagcagaagttggtgagaaaaaagacagagtcacagatgccttaaatgcaacaaaagcggctgttgaagagggaattgtcccaggtggtggtgttgcacttctttatgcatctaaagagctggataagttacagactgcaaactttgatcaaaagattggtgtccaaataattcagaatgctctgaagactccagttcacaccattgcatccaatgctggagtagagggggctgtggttgttggcaagcttttggaacaggatgaacttgaccttggctatgatgcagccaaaggcgagtacgtcgacatggtgaaagctggtattattgacccgttgaaggtcatcagaactgcattggtggatgctgcaagtgtttcgtccttgatgaccacgactgagtcggtcatcgttgaactccccaagaatgaggatgctcctgctatgggtgctggaatgggaggaatgggaggaatggactactaatttcttcaagttttgcaggttcattgagaacatttgaaattttgagtactgattggaggaggcaagttgatgtgtctattgattggcagcactccttttcctttgctcttcgaggtacgtaccaattactgtgatttaaaaatggaacacttgtttctgcttccattggagaaaagttgtctttcttgctgccagaaggactgttttttgtgattgtaacaaacgtttagatgataatttccattggaagattggaagactataaatggttcatcaatgtttcttatttgaacagctaaagctgcaaaaagacacgtatcttctgctgcatgtggtcgatatgttacatgctgatatgagaaaaactat

SEQ ID NO: 1040 - DNA, 2108 bp, Manihot esculenta
tcgtgtaatctttttgttaattcactcgcttcctcatttcccaatccagaactcttcattgtttttgcagtctgtacactatgtatcgtttcgcctctagcctcgcttctaaggctcggatcgctaggaacagcacgcatcagattggaagtagactaaactggagcagaaactatgcggctaaagacatcaaatttggtgtagaagcccgtgccttgatgcttaagggtgttgaagagcttgctgatgctgtaaaagtcaccatgggtcctaaggggcggaacgtagttatcgaacaaagctttggagcccccaaagtgacaaaagatggggtgactgttgcaaagagcattgaattcaaggataaagtcaagaatattggtgctagccttgtaaagcaggttgcaaatgccaccaatgatgttgctggagatgggaccacttgtgccactgttcttactcgagcaatattcacagagggatgcaagtctgttgcagcaggaatgaatgcaatggacctgagacgaggcatcagcatggctgttgatgctgttgttaccaatttgaagagcagagcacggatgatcagcacatctgaagaaatagcacaagttggtacaatatctgcaaatggagagagagaaattggtgagttaattgcaaaggccatggagaaggtcggcaaagagggagttattacaatccaagatgggaagacactagataatgagctggaagttgttgaaggaatgaagctggacaggggctacatatccccttatttcatcaccaaccagaaaaaccaaaaatgtgaattagaagatcctctcattttgatccatgagaagaaaatctctagcatacatgctatggtgaaagtattagagttagctttgaagagacaaaggcctttgttaattgtttctgaagacgtggaaagtgaggcattagcaacccttattttaaacaagcttcgtgctggaataaaggtttgcgccataaaagctcctggttttggagagaacaggaaggctgggttacaggatcttgctgttctcacagggggtgaggtgataaccgaagaacttggcctcaatcttgaaaaggtggatttagatatgcttggaagttgcaaaaagattacggtgtcaaaggatgatacaattattcttgatggcgctggtgacaagaaagccattgaggaaagatgcgaacagataaggtctgcgatagagttgagcacttcaaactatgacaaagagaaattgcaagagagactggcaaagctttctggaggtgttgctgttcttaagattggaggagctagtgaagctgaagttggtgagaagaaagacagggttacagatgccttaaatgctacaaaggcagctgtagaagagggtattgtggcaggtggtggtgttgctcttctttatgccacaaaagagttggctgagttacagactgacaacttcgaccaaaagattggtgtccaaatcattcagaatgctctaaagactccagtacatacaatcgcgagtaatgcaggagtggaaggagctgttgtgattggcaagctattagagcaggatgaccataaccttggttatgatgctgccaaaggtgaatacgttgatatggtgaaagcagggattgttgatcctttgaaagtaattagaactgctttaattgatgcagcaagtgtgtcatcattgatgacaacaactgaggcaattgtatctgaacttccaaaggatgagaaggacgctccaggaatggcaccgggcatgggcatggattattgatggtcatcatgaagcatcggtcctagttaggagtgaacagtcaccaaaatccatacgggtcttataataattttttttttcaaaaaaaaatttttaaacagatcattgtcatggtccaaaggcatctgtgtaatcatattgaggtctgtaggtagcaagtccggggatcggacagtttcaagataaaactcatctcgagttgtcctttgcagggacaatgtagcggcacttttgtcatccccttgaaataaaacaatgttactgtttttgagagatgcaagtgttttgcagtggacgttcttc

SEQ ID NO: 1041 - DNA, 2198 bp, Oryza sativa
gagcctcctcgcgtcttctcctctctcatcaaatcccctcgccctcctctctttcctcctccccaagaaaaaaaaaggcttcatagctcaacctcctcgccgccgccgctcacctcccctcccctcccatccctcctcctccctagccccaggtcgctgctcggctccgccatgtaccgcgcggccgccagcctcgcctccaaggctcggcaagccgggagcagcgctcgccaggttggaagcaggcttgccttgagcaggaactatgctgccaaggatatcaagtttggagttgaggcccgtgctttgatgctgaggggtgttgaggagttggcagatgcagtcaaagtgacaatgggtcctaagggacgcaatgtggttattgagcagagctatggttcaccgaaagtcacaaaggacggtgtgactgttgccaagagcattgagttcaaggatagagtcaagaatgttggtgcaagccttgtaaagcaggttgctaatgcgaccaatgatactgctggagatggtaccacttgtgctactgtattgactaaagcaatatttactgaggggtgcaagtctgttgctgctggcatgaatgcaatggatttaaggcgtggaatttcaatggctgttgatgctgttgtaactaacctaaagggcatggctagaatgatcagcacatcagaggaaatagctcaggtgggcacaatatcagcaaatggggaaagggaaattggtgagcttattgcaaaggctatggagaaggttggcaaggagggtgtaatcaccattgcggatggtaacaccctttacaatgagcttgaagttgtggaaggcatgaaacttgacagaggctacatctctccttactttgttaccaacccaaagacccagaaatgtgaactggatgaccccttgatcctgatacatgacaagaaggtttcgaacctgcatgcagtagttaaagtcttggagttggctctgaagaagcaaaggcctctgctgattgttgctgaagatgtagagagcgaggcattgggtactctgattattaacaagcttcgtgcaggcatcaaggtctgtgctgttaaagctcctgggtttggggagaacaggaaagcaaacttacaggaccttgcgatccttactggaggagaagtcataactgaagagctaggaatgaatcttgagaagttcgagcctcagatgttgggtacatgcaagaaggtaactgtatctaaggacgacactgttattcttgatggagctggagacaagaaatccattgaagagagggctgagcagattagatctgcaattgagctaagcacttctgattacgacaaggaaaagctacaggagcggttggcaaagctctctggaggtgttgctgttctaaagatcggaggagccagtgaagctgaagttggtgagaagaaggatagagtgacagatgcattgaatgccactaaagctgctgtggaagagggtattgtaccaggtggaggtgttgcacttctttatgcatcaaaggagctggataaattgccgactgctaactttgatcaaaagattggtgtacaaatcattcagaatgctttgaagacaccggtgcacactattgcttccaacgcaggtgtagaaggggctgttgttgtcggtaagcttttggaacaagataacaccgaccttggctatgatgcggctaaaggtgaatatgtggacatggtgaaggctggtatcattgacccactaaaagtgatcagaactgccttggtggatgctgcaagcgtatcatctctgatgacaaccacggaatccatcatcgtagagatcccaaaggaagagaaggaggcgccagcgatgggaggcatgggtggaatggattactaatcaacacccattaaagtaaactaaaaacatactcctgggatttaggattttttttgcggtgcaagttcatcgtcgatgtattttttgttcttgttgatgaggtggttgtcagacaattttgattccactggcggtaggacgggttggaacgaataaaattttagttcagagctaggagttcttgagagctgaggactgcacttcgatcaaaattgaatctgacaccttgtgccggaacatttttatgagctgatctgaaagattacgccttttggcctgaggtggtgtgcagttgtttttat

SEQ ID NO: 1042 - DNA, 1919 bp, Tabernaemontana elegans
ttttccctcctcgacaataacagagaggaggaaggaaacaaacaagaactgcagtgcatcaacatgtatcgtttggctgcccatcttgcctctaaagccagtgttgctcggaataccagtcgacaggctggaagtagactggcttggagtaggaattatgcggccaaggacattaagtttggggttgaagcgcgtgccctgatgctacagggtgttgaggagcttgccgaggctgttaaaatcacaatgggccctaaaggtcgcactgttgttatagaacagagttttggtgcccctaaagtcacaaaggatggtgtcactgttgcaaagagtattgaatttaaagacagagtaaaaaatattggtgctagccttgtgaagcaggttgcaaatgctacgaatgacgttgcaggagatggcaccacttgtgcaacaatcctcacacgggcaatatatactgaaggctgtaagtcagttgcagctggaatgaatgccatggatctgaggcgtggaatctcaatggcagttgattctgtagttacaaacttgaagagcagagcaaggatgatcagtacatctgaggaaatagctcaggttggaacaatttcggcaaatggtgaaagggagattggggaactcatagccaaggctatggaaagagttggcaaagagggtgttattaccattgctgatgggaaaaccctgtacaatgagttggaagtggttgaaggaatgaagcttgataggggatacatatcaccttactttatcaccaaccaaaaaacccaaaagtgtgaaatggatgatcctctgattctaatccatgagaagaaaattggaagtttaaatgcggtgattaaagtgcttgagttggcgttgaagaggcaaaaacctttgttgattgttgctgaagatgtggaaagcgaagctttggctactttgattctaaacaagcttcgcgctggaattaaggtctgtgccataaaagcccctggttttggagaaaacagaaaggcctacttacaggaccttgccattcttacgggaggacaactcataacagaagaacttggtttgaaccttgagaacgtgacaatagatgtgcttggttcatgcaagaaggttacggtgtcaaaggatgatacagttattcttgatggtgccggtgacaaaaatgctattgaggagagatgcgagcagatacgctctgcaacagaattaagcacatctgattatgacaaggagaagcttcaggagagactagctaagctttctggtggtgttgctgttttgaagattggaggggcaagtgaagcagaggttagcgagaagaaagacagagttacagatgctttaaatgctacaaaggcagctgtggaggaagggattgtgccaggtggtggtgttgcccttctttacgccgcaaaggagctggagaagctgcaaactgccaactttgatcagaagattggtgtgcagattatccagaatgctcttaaggccccagtgcagacaattgcctcaaatgctggagtggagggtgctgtagtcattggtaaactattggagcaggacaatcacgacctgggatatgatgcagctaaaggtgaatatgttgacatggtgaaggctggaattattgacccattgaaagttatcagaacagctttggttgatgctgccagtgtatcttctttattaaccacaactgaggctgttgttgtcgaacatcctaagaacgagaaagaatccccagcaatgggtgcaggcatggatggcatggattattgaggttacggggtgtagctcagtgatcttactcttctaccttatcttgcaaggaaaaattaatgtaactgtagttagaggtagaaagtaggaggttcattcgtttgatatttgactgccattccatgaag

SEQ ID NO: 1043 - DNA, 1918 bp, Eutrema parvulum
aggattgcaagtaacacacgacaggtacatttgattttgctggtctataattcccgggtaagagatttctctttcgcctcattagtaacttgatgtctcgcgtgctcaggtttccagcagaatgagctggagcaggaactatgcagcgaaagagattaagtttggggttgaagctcgagccttgatgcttaggggtgttgaagagcttgccgatgctgtcagggtcactatgggtcccaagggacgtaatgttgtgattgagcaaagctggggtgctcctaaagttactaaagatggtgtcaccgttgccaaaagcattgagttcaaagataaagttaagaacgttggtgccagtcttgtgaaacaagttgcaaatgcaactaatgatgttgctggtgatggtactacttgtgctactgtactcacccgagcaatattcaccgaaggttgcaaatcagttgctgcaggaatgaatgcgatggacctaaggagaggtatttccatggcagtcgatgctgttgtgacaaaccttaaaagcagggctaggatgatcagcacatccgaagagattgcacaggttggtaccatttctgcaaatggagagagggaaatcggtgaactgatcgcaaaggctatggagagggtcggcaaagagggtgtaatcacaatacaagatgggaagacattgagtaacgagttggaagttgtggaagggatgaagttggacagaggttatacatccccttactttatcaccaatcaaaaaacccaaaaatgtgaactggaagaccctctcattcttatccatgagaagaagatctccaccatcaactccatagtgaaagtgttggagttggctctaaagaaacaaagaccgctattgattgtttctgaagatgtggaaagtgaagctcttgcaactcttatcgttaacaagctacgcgccggaatcaaggtttgtgccatcaaggcccctggctttggagagaataggaaggccaatttgcaagaccttgctgcccttactggtggagaggttatcacggatgagcttggcatgaatctggagaaggtggacttgagcatgctagggacatgcaaaagggttactgtctccaaggacgacactgttattcttgatggggctggcgacaaggcagccattgaggaaagatgtgagcagattaggtcagcaattgaactgagcacttcagattatgacaaggagaaactgcaagaaaggttggctaagctctctggaggagttgcagttttgaagattggaggtgcaagtgaagctgaagttggtgagaagaaagacagagtgacagatgctttgaatgccactaaagcagctgttgaagagggtattttgccaggaggaggtgtggctcttctatacgcagcgagagagttggaaaaacttccaacagccaactttgaccagaagattggtgtgcagatcattcagaacgctttgaagactcctgttcacacaatagcttcaaatgctggagtagaaggtgctgttatcgttggcaagctcttggagcaagataacccagaccttggttatgatgctgctaaaggtgagtatgtggatatggtgaaagctggtatcatagatcctctgaaagtgatcaggacggctttggttgatgctgcgagtgtgtcatctctgttgacaacaactgaagcagtagtggtcgagcttcccaaagacgaaagtgagtcagcaggagctggagcaggcatgggtggaatgggaggcatggattattaattacatcactaaactcttttatgttttcttttcaccttaacgttgagagaagagagacgattcttttaggagtctttttgcctttgttgctcaataacaataaataaacagcacatttggcaaatgttatgatat

SEQ ID NO: 1044 - DNA, 1942 bp, Musa acuminata
ggaaactacgaaggccccctttttaagaaccctcagctgtcgacgcctccgctcttcgagtaccctaatctggtctctatcgaagcccaccatgtatcgcgccatggcctccctcgcctccagagcccgagtaatggagttttgtttggtgctgcaggttggaagtagggtcggttggagtagaaattacgctgcaaaggatatcagatttggggtcgaggctcgtgctttgatgcttaagggagtggaagagcttgctgatgcggtgaaggtgacgatgggcccaaagggtcgcaatgtcgtcttagagcaaagctttggtgcacccaaagttacaaaggatggtgtgactgttgcaaagagcatcgagttcaaggacagaataaagaatatgggtgctagtcttgtgaagcaggttgccaatgcaaccaatgatgttgctggtgatggaacaacatgtgctaccatccttacaaaagcaatatttgctgaaggatgtaagtcagtggctgctgggatgaatgcaatggatctgagacgtggcatttcaatggctgttgatgctgtggtgactaatttgaagagcagagcaagaatgattagtacctcagaagagatagctcaggttggtacaatatcagctaatggagaaagagaaattggtgaactaattgcaaaagctatggagaaagttggcaaagagggagtcatcacagtagcagatgggaaaactctagacaatgaactagaagtcgttgaaggaatgaaatttgatcgaggctacatatcaccctactttattactgatccaaagaaccaaaaatgtgaacttgaagatcctctgattttgattcatgagaagaaaatttcaagcatcaatgcagttgtgaaggtgttagagttgtctttgaagagacagagacctttgctgattgttgcagaagacatagaaagtgatgcactggccactctcatccttaataagcttcgtgctgggattaaggtttgtgctgtgaaagctcctggctttggggagaacaggaaagccaatttgcaagaccttgctattctcactgggggatctctcataacagaagaacttggtttgaaccttgagaaagtggaacttgacatgcttggcacatgcaaaaaggtgacaatctcaaaagacaacactgtgattcttgatggatctggtgaaaagaaggctatagaagagagatgtgaccagataagatctgcaattgaattgagcacatcagactatgacaaagagaagcagcaagagaggttggcgaagctttctggtggagttgctgtcctcaagattggaggggccagtgaagcagaagttggtgagaaaaaagatagagtcacagatgccttaaatgcaacaaaagcggctgttgaagagggaattgtcccaggtggtggtgttgcacttctttatgcatctaaagagctggataagttacagactgcaaactttgatcaaaagattggtgtccaaataattcagaatgctctgaagactccagttcacaccattgcatccaatgctggagtagagggggctgtggttgttggcaagcttttggaacaggatgaccttgaccttggctatgatgcagccaaaggcgagtacgtcgacatggtgaaagctggtattattgacccgttgaaggtcatcagaactgcattggtggatgctgcaagtgtttcgtccttgatgaccacgaccgagtcggtcatcgttgaactccccaagaatgaggatgctcctgctatgggtgctggaatgggaggaatgggaggaatggactactaatttcttcaagttttgcaggttcattgagaacatttgaaattttgagtactgattggaggaggcaagttgatgtgtctattgattggcagcactccttttcctttgctcttcgag

SEQ ID NO: 1045 - DNA, 1926 bp, Euphorbia peplus
gctgcggaagctgcctgtttctagagggttcctcctcgttcattagaaaagtagtccaccattctttccacttgatctccattactacacaatccctaaagcttctgcctttctactcctccttgtgcaattttcacaccatgtatcgtttagcctccaaccttgcttctaaagctaggattgctaggagcagcacccaccaggtcagaaactatgctgctaaagatatcagatttggtgttgaagctcgcgctttaatgcttcagggcgttgaagagttagctgatgccgtcaaagtcaccatgggtcctaagggccgcaatgtggttattgaacaaagctttggtgcccccaaagtcacaaaggacggtgtcactgttgcaaaaagcattgaatttaaagatagagtcaagaacgttggtgctagccttgtcaagcaggttgcaaatgccactaatgatgttgctggcgatggaaccacttgcgccacagttcttacaaaagctatattcacagaaggatgcaagtcggttgcagcagggatgaatgcaatggacctaagacgtgggatcagcatggctgttgataatgttgttaccactttgaaaagcagagccaaaatgatcagcacatccgaagagattgctcaagttggaaccatatctgccaatggagagagagaaattggtgaattaattgcaaaggcaatggagaaggttggcaaagagggtgttatcactatccaagatggaaagacattatataatgagttggaagtcgttgagggaatgaaattggataggggttatatatcccttattttatcaccaaccaaaagaaccaaaaatgtgaactagatgatcctcttattctgatccacgagaaaaaaatctcaagtatacaagctattgtgaaagtattagaattggctttgaagaaacaaagaccattattgataatcgctgaagatgtggaaagtgatgcactggccacactcgttataaacaagcttcgtgctggcattaaggtatgtgccataaaagctcctggttttggagaaaacagaaaatccgggctccaagatcttgcagttctcactggcggtgaggttattacagatgaacttggcctcaatcttgaaaaggtggatttaaatatgcttggcagttgcaaaaaggttacagtctcaaaagatgacactgttgttctcgatggtgctggtgacaagaaggcccttgaagaaagatgtgaactgataaggtctgcaatagaattgagtacttctgattatgacaaagagaagttgcaagaaagactagccaagctttctgggggcgttgctgttctcaagattggaggagctagtgaagctgaagttggtgagaaaaaagatagggttacagatgctctaaatgccacaaaggcagccgtcgaggagggtattgtaccaggtggtggtgttgccctcctttacgcgtcaaaagagttggataaattgcagaccgctaactttgaccagaagatcggtgtccaaatcattcagaacgccctaaagactccagtgtacacaatcgctagtaatgcgggagttgaaggagctgttgttgttggtaagctattggagcaggacgattatgagcttggctacgatgctgccaaaggtgaatatgtggatatggttaaatcagggatcatagatccattgaaagtaatcagaactgctttggttgatgctgctagcgtgacttcgttgatgacaacaactgaagctgttatatgtgaactgccaaaggaagagaaggatggaccagcaatgccttctggaatgggaatggattactgattcccctcgtagtgtaggtgtagaactttaagaacatttaccaaaattcatacataaaatggtttggttattgattttttttc

SEQ ID NO: 1046 - DNA, 1848 bp, Capsicum annuum
tctccaacttcagcatttttcagtagcaaaatgtatcgttttgcagcaaatcttgcttccaaagccagagttgcaagaaccagttcccaacaggtgagtggaaggttgaattggagtagaaactatgctgctaaggatattagatttggagttgaagctagggcgttgatgcttaaaggtgttgaagagcttgctgatgctgttaaagtaactatgggtccaaaggggcgtactgtggtgattgagcaaagttggggtgcacccaaagtaacaaaagatggtgtcactgttgcaaaaagtgttgaattcaaggacaagatacaaaatgttggtgctagcctcgtgaaacaggttgccaatgccacgaacgatgttgctggtgatggtaccacttgtgcaacaattctcacccgagcaatatttgctgaaggatgcaagtcagtggcagctggtatgaatgccatggaccttagacggggtattaccatggctgtagattctgttgtaacaaacctgaaaagcagagcaaagatgatcagcacatctgaggagattgcacaggttgggactatctctgcaaatggagaaagagaaattggtgaactaattgccagagctatggagagagtaggcaaggagggagtcattactattcaagatgggaagacactggaaaatcagttggaagttgttgaagggatgaagttggataggggttacatatcaccatacttcatcacaaatcagaagaatcagaaatgtgaactcgaggacccactaattcttattcatgagaaaaagatctcaagtgttaatgctgttgtgagagcattagagttggctctgaagagacaaaagcccctcttaattgtggctgaagatgtggacagtgaagcacttgctactcttattttgaacaagcttcgtgctggaatcaaggtttgcgccatcaaagcaccgggcttcggtgaaaacaggaaggccaatttgcaagatcttgctattttaactggaggccaagtcgtaacagaagagcttggactgagcattgaaaatgtggagttcgagatgctgggaacatgtaaaaaggtgaccatctccaaggatgatactgtcattcttgatggtgctggtgagaagaagtccatagaggaacgatgtgaacagattagatcagccattgaatcgagcacatctgactatgacaaggagaagttgcaggaaagactagctaagatttctggaggtgttgctgtgttaaagattggtggagccagcgaaactgaggtcggtgaaaagaaagatagagtaactgatgctttgaatgccacaaaggcagcagtggaggaaggaattgttgcaggcggtggtgttgctcttctttatgcagcaagagaattggataatttgaaaacagccaactttgaccagcagattggtgtgcaaattattcagaatgctctgaagacgccagtacatacaatagcgtctaacgcaggagtagagggtgctgttgtagtgggtaagctgttggagcaggataaccttgatcttggatatgacgcggccaagggtgaatatgtagatatggtaaaggcaggaatcatcgatccattgaaagtaattaggacagctttggtcgatgctgccagcgtctcttctctcttgaccacaactgaagcagttgtcgttgaacttcctaaggacgagaaagaatctccagcaatgggcggtggcatgggcggtatgggtggcatggacttctgatggaaaaggcaagaagagtaatcgcagctgctgcttgacatacaattgtttagaacaaaaagaaaataaatttgcccattt

SEQ ID NO: 1047 - DNA, 2001 bp, Centaurea maculosa
cgtcatgtatcgttttgcagtcagtctcgcatccaaatcaaggattgccagaaacaatgctcaacagatcagctctaacttaagctggaggcggaactatgctgcgaaagacattaaatttggagtggaagcgagagctttgatgcttagaggtgttgaagagctcgctgatgccgtcaaagtcactatgggtccaaagggaagaaatgttgttatagaacaaagttatggagctccgaaggtgaccaaggatggtgtcactgttgcaaagagtatcgagtttaaggatagggtgaagaatgttggtgctagtcttgtcaagcaggttgctaatgccaccaacgatgttgctggtgacggtaccacctgcgcaacggttcttacccgtgctatttattccgaaggctgcaaatccgttgcagctggaatgaacgccatggatcttagacgtgggatcaccatggctgtcgattcagttgttacaaacttgaaaagcagagcgaggatgatcagcacatccgaagaaatagcacaggttgggacaatatcagcaaatggagaacgagagattggtgagcttattgccaaggctatggagaaagttggcaaagagggtgttattaccatatctgatggaaaaacactctacaatgaattggaagtggttgaaggaatgaagttggacagagggtatatatcaccttacttcatcacaaacccaaagaaccaaaaatgtgaactagacgaccctttgatcctaattcacgagaaaaaaatctctagcttgaacgctattgttaaagttctagagttagctttgaagaatcaaagatcattgctgattgttgccgaagatattgaaagcgaggcattagccactctcattcttaacaaactccgtgctggtatcaaggtctgtgccataaaagcccctggatttggagagaaccgaaagtcaaatttgcaggaccttgctactctcactggcggagaggtcataactgatgagcttggcatgaaccttgaaaaaatggcaccagagatgcttggaacttgcaaaagggttacaatatcaaaggatgataccgttattcttgatggggctggtgacaagaaatctattgaagaaagatgtgaacagttgagatcatcgatcgaattaagcacttctgattatgataaagagaagctccaagagagattagcaaagctttctggaggtgttgctgttttgaagattggaggagccagtgaagctgaggttggtgagaagaaagatagagttaccgatgctttaaatgctacaaaggctgcagttgaggaaggaattgtaccaggtggtggtgttgctcttttatatgcttccaaggaactggaaaagcttcctaccgccaattttgatcagaagattggtgttcaaataattcaaaatgctctcaaggcaccggtgcacacaattgcttgcaatgctggagttgagggtgctgttgttgttgggaaactattagagcaagataaccccgatcttggatatgatgctgctaaaggtctatacgtagatatggtcaaggaaggaatcatcgaccccctgaaagtaattaggacggccttggtagatgcagcaagcgtgtcgtctttattgaccacaacggaggccgtgattgttgaacttcccaaagacgagaaggaagcaccatccatgggtggcggcatgggcgactattgaagtcaacggtggtaactctcgtatcattcttttgcatacatgatgagaatttgcaaactgtacaacgaatcgaattattattaggtggtagttgcgtatcttagatccgatccgattctccgcattgatttcgagagttttcttttcgtttttcgttctatattacggatgataactatcatgtagagggatcggatcttgaacaattttcacctgtgcttttcgatatgaagtcaaagcccattattactctgtaaaaaagaaaaaaaataccg

SEQ ID NO: 1048 - DNA, 2142 bp, Capsicum annuum
tcagcatagtagtgtttttctccaacttcagtctatttttactagttagcaaaatgtatcgttttgcagcaaatcttgcttccaaagccagagttgcaagaaccagttcccaacaggtgagtggaaggttgaattggagtagaaactatgctgctaaggatattagatttggagttgaagctagggcgttgatgcttaaaggtgttgaagagcttgctgatgctgttaaagtaactatgggtccaaaggggcgtactgtggtgattgagcaaagttggggtgcacccaaagtaacaaaagatggtgtcactgtcgcaaaaagtgttgaattcaaggacaagatacaaaatgttggtgctagcctcgtgaaacaggttgccaatgccacgaacgatgttgctggtgatggtaccacttgtgcaacaattctcacccgagcaatatttgctgaaggatgcaagtcagtggcagctggtatgaatgccatggaccttagacggggtattaccatggctgtagattctgttgtaacaaacctgaaaagcagagcaaagatgatcagcacatctgaggagattgcacaggttgggactatctctgcaaatggagaaagagaaattggtgaactaattgccagagctatggagagagtaggcaaggagggagtcattactattcaagatgggaagacactggaaaatcagttggaagttgttgaagggatgaagttggataggggttacatatcaccatacttcatcacaaatcagaagaatcagaaatgtgaactcgaggacccactaattcttattcatgagaaaaagatctcaagtgttaatgctgttgtgagagcattagagttggctctgaagagacaaaagcccctcttaattgtggctgaagatgtggacagtgaagcacttgctactcttattttgaacaagcttcgtgctggaatcaaggtttgcgccatcaaagcaccgggcttcggtgaaaacaggaaggccaatttgcaagatcttgctattttaactggaggccaagtagtaacagaagagcttggactgagcattgaaaatgtggagttcgagatgctgggaacatgtaaaaaggtgaccatctccaaggatgatactgtcattcttgatggtgctggtgagaagaagtccatagaggaacgatgtgaacagattagatcagccattgaatcgagcacatctgactatgacaaggagaagttgcaggaaagactagctaagatttctggaggtgttgctgtgttaaagattggtggagccagcgaaactgaggtcggtgaaaagaaagatagagtaactgatgctttgaatgccacaaaggcagcagtggaggaaggaattgttgcaggcggtggtgtagctcttctttatgcagcaagagaattggataatttgaaaacagccaactttgaccagcagattggtgtgcaaattattcagaatgctctgaagacgccagtacatacaatagcgtctaacgcaggagtagagggtgctgttgtagtgggtaagctgttggagcaggataaccttgatcttggatatgacgcggccaagggtgaatatgtagatatggtaaaggcaggaatcatcgatccattgaaagtaattaggacagctttggtcgatgctgccagcgtctcttctctcttgaccacaactgaagcagttgtcgttgaacttcctaaggacgagaaagaatctccagcaatgggcggtggcatgggcggtatgggtggcatggacttctgatggaaaaggcaagaagagtaatcgcagctgctgcttgacatacaattgtttagaacaaaaagaaaataaatttgcccattttgatgcatctttacgcgagaaaacgcacccattgtacccatagcaagagagaccattgtgaattcatgtttttgtaggttcagaatttgtagtctttcgtcgaaaactcagctttttagttgacaaaatttacagtttgttgttagtgcaattggtccatttcagtctctccacttgtgttttgttgtcttttctggttaaactgttattttgtagtcataaattcatacctctggcagcagattatatattaatcaaagttccctcgtgc

SEQ ID NO: 1049 - DNA, 2136 bp, Triphysaria pusilla
tttcaatgggccggcgtcaactttaaaaccctaaaaccctaacttgttctagatccttcgccagttctcagttttaaaagcactcaacaaaccaaatccaacacaatcctgttctctgtttttctctgcaaatcatcccgccgcagttcattcattttcttcaaccgagatctaatcatgtatcgttttgcagcaaacctagcctccaaagccagcgttgcgagaaacagcagccagcagattggtagtagatttggttggagtagaaactatgcagcaaaagacatcagatttggtgtggatgcaagagctctgatgctcaaaggtgttgaagagctcgccgatgcggttaaagtgactatgggtccaaagggtcgtaatgtagtgattgaacaaagttggggtgctcctaaagtgaccaaggatggtgtgacagttgcaaagagcattgaatttaaggacaaagttaaaaatattggtgcaagccttgtcaaacaggttgcaaatgctacaaatgatgttgctggtgatggtacaacatgtgctactgtgcttactcgtgcaatatttgctgagggctgcaaatcagtggcagctggcatgaactcaatggatcttagacgtggcatcagcatggccgttgatgcggtggttacaaacttgaaaagcagagcaagaatgattagcacatcagaggagattgcacaggttggaaccatctctgcaaatggagacagagaaattggtgagctgattgcaaaggctatggagaaagtaggcaaagagggtgtcatcacaattcaagatgggaagacattgttcaatgaattggaagtggtcgagggaatgaaattggacagaggttacatttccccatacttcattacaaaccagaagaaccagaaatgtgaattggatgaaccgttgattttaattcacgagaagaaaatatcaagcatgaatgcaattgtgaaagttttagaattggctttgaagagacaaagacctcttttgatagttgctgaagacattgagagtgaggcacttgcaactcttatccttaacaagcttcgagctggaataaaggtttgtgctgtaaaagctcctggatttggcgaaaacaggaaatctaatttgcaggaccttgctgttttaactggaggccaggttattacggaagagcttggaatgactcttgaggatgtggaattggatattctgggctcatgcaagaaggttaccatttcaaaggatgatactgttatccttgatggttctggtgagaagaaatccatagaagagagatgtgaacagattaaatcaacaattgaattgagcacttccgattacgacaaggagaagttgcaagaaaggcttgctaagctatctggtggtgtagctgttttgaagattggtggtgctagtgaagcagaggttggtgagaaaaaggacagagtgactgatgctttaaatgccacaaaagctgcagttgaagaaggaatcgtgcctggtggaggtgttgctctactctacgcgtcgaaagtattggaaactttgccaacggcaaactttgaccagaaaatcggtgttcaaattattcaaaacgcattaaagacacctgtttacacaattgcatcgaatgccggagtggaaggagctgttgtcgtcggcaagttattagaatcggacaaccctgatcttggatatgatgcagctaaaggtgaatatgttgatatggtgaaatctggaattatcgacccactcaaagttattagaactgcccttgtagatgctgctagcgtgtcatcattgatgacaactacagaagcaattgtggttgaacaagctaaggaagacaaggcgggcccaccaatgggaggcggcgaaatggattactgagtgaaatgatgttgaacgtatatctgtttacagaaaaagaataaatttatctagggtttctgccattttgacgagtttggcttgtgaccttaggtaccagtgtaatcttattgagaatttgagacaagactcgtattttttccataggtttgagacagtagttgtgtttagattgagatttttttatgttaattagtgactgtctttcttgcatgatttaaactgaattgatgtttc

SEQ ID NO: 1050 - DNA, 2148 bp, Echinochloa colona
cccctcgccctccctctaaaatccaaccgtccccgacctcctcggcgcctcgcgtcctctttcctcctccgcaagaaagaagcgaagcagctcgcctccgcctcctcccccaccccgctagccgtcaaccggcccgcccccgcgtctccccctcgccgtcatgtaccgcgcggcagccagcctcgcctccaaggcgcggcaagtcgggaacagcgccgccgctcgtcaggttgggagcaggcttgcctggagcagaaactatgctgccaaggatatcaagtttggtgttgaggcccgtgctctgatgctcaggggtgttgaggaattggctgatgcagtcaaagtgacaatgggtcctaagggtcgcaatgtggttattgaacaaagctttggtgccccaaaggtcacaaaggatggtgtgaccgttgctaagagcattgaattcgaagatagagtaaagaatgttggtgcaagccttgtgaagcaggttgccaatgcaactaatgacactgctggagatggtaccacatgtgcgactgttttgacaaaagcaatatttactgagggttgcaaatctgttgcggccggaatgaatgcaatggatttaaggcgtggaatctcaatggctgttgatgctgttgtgacaaatctgaagggcatggccagaatgatcagcacgtcggaagagattgctcaggtgggtacaatatcagcaaatggggaaagggaaattggtgagcttattgccaaggctatggagaaggttggcaaagagggtgtaatcaccattgcggatggtaacaccctttacaatgagcttgaggttgtggaaggcatgaaactcgacagaggttacatctccccgtacttcattaccaactcaaaaacccagaaatgtgaactggaggacccattgatcttgattcatgacaagaaggttaacaacatgcacgcgacggttaaagttctagagatggctctaaagaagcaaaggcctcttctgattgttgcagaagatgtggaaagtgaagcattgggcactctgattcttaacaagcttcgtgcaggcatcaaggtctgtgctgtcaaagctcctggtttcggggaaaacaggaaggcaaacttacaagaccttgctatccttaccggaggagaggtcataactgaagagcttggaatgaaccttgagaacgttgagcctcacatgttgggttcatgcaaaaaggtgaccgtctctaaggatgacactgttattcttgatggagctggagacaagaagttcattgaagagagggcagagcagattagatctgcaattgagaatagcacatctgattatgacaaggaaaagctacaggagcggttggcaaagctctctggaggtgttgctgttctaaagattggaggagccagtgaagcagaagttggtgagaagaaggatagagtgacagatgcgctgaacgcaactaaagctgctgtggaagagggcattgtaccaggtggtggtgttgctcttctttatgcgtcaaaggagctcgacaaattgcagactgccaactttgatcagaagattggtgtacagatcattcagaatgctctgaagacacctgtgcacaccattgcctccaatgctggtgttgagggagcagttgttgttggcaagcttttggagcaaggaaacactgaccttggttatgatgctgccaaaggtgaatatgttgacatggtgaaggctggtatcatcgacccactaaaagtcatcagaactgccttggtggatgctgctagcgtgtcatccctgatgaccacaacggaatccatcattgtagagatccccaagaaagaggcaccagcgcccgcaatgggcggcatgggtggaatggagtactaaggaatcacacccttgataacacacatcagagctacatggactaggattctttgtttggcggtgcaagttcatcttttctgtattttggtcgttgatgaggtgattgtcaggcgatacaattttgagtctgcggacgaaggacctcgcagagttccaaacggagcagtgttggaataataagtggtagtggggagatgggacagtagatcaaaattggattctgacaccttgtgccggactttctgtacaacactaca

SEQ ID NO: 1051 - DNA, 2314 bp, Pennisetum glaucum
tccctctaaaatccatccgcccctcgcctcctcggcgcctcgcgttctctttccccctccgcaagaaagaagcgacacagctcgccttcgtctccacccctgccccccaaactcggcctcgctcgccggcgacagccctccgcccccgctccccctcctcgccgtcatgtaccgcgcagcagccagcctcgcctccaaggcgcggcaagccgggagcagcgccgccgctcgccaggttggtagcaggcttgcctggagcagaaactatgctgccaaggatatcaagtttggtgtcgaggcccgtgcccagatgctcaggggtgttgaggaattggctgatgcagtcaaagtgacaatgggtcccaagggtcgcaatgtggttattgaacaaagctttggtgcaccgaaagtcacaaaagatggtgtgaccgttgctaagagcattgaattcaaagatagagtaaagaatgttggtgcaagccttgtgaagcaggtggccaatgcaaccaacgacactgctggagatggtaccacatgtgcaactgttttgacaaaggcaatatttactgaggggtgcaaatctgttgcggccgggatgaatgcaatggatttaaggcgtggaatctcaatggctgttgatgctgttgtgaccaatctgaagggcatggctagaatgatcagcacctcggaagagattgcacaggtgggtacaatatcagcaaatggggaaagggaaattggtgagcttattgccaaggctatggagaaggttggcaaagagggcgtgatcaccattgcggatggtaacaccctttacaatgagcttgaagtcgtggaaggcatgaaactcgacagaggttacatctctccgtacttcattaccaactcaaaaacccagaaatgtgaactggaagaccctttgatcttaattcacgacaagaaggtctcaaacatgcatgcagtggttaaagttttggaaatggctctaaagaagcaaaagcctctgctgattgttgcagaagatgtggaaagtgaagcattgggcactctgattcttaacaagcttcgtgctggcatcaaggtctgtgctgtcaaagctcctggttttggggaaaacaggaaggcaaacttgcaagatcttgctatccttaccggaggagaagtcataaccgaagagcttggaatgaaacttgagagtgttgagcctctaatgttgggttcatgcaaaaaggtgactgtctctaaggatgacactgttattcttgatggagctggagacaagaaggcgattgaggagagggcagagcagattagatctgcaattgagaatagcacatctgattatgacaaggaaaagctacaggagagattggcaaagctctctggaggtgttgctgttctaaagattggaggagccagcgaagcagaagttggtgagaagaaggatagagtgactgatgcattaaacgctactaaagctgctgtggaagagggcattgtaccaggtggtggtgttgctcttctctatgcgtcaaaggagctcgacaaattgcagacagcgaactttgatcagaagattggtgtgcagatcattcagaacgccctgaagacacctgtgcacactattgcttccaatgctggtgtggagggagcagtggtggtgggcaagcttttggagcaaggaaataccgaccttggttatgatgctgccaaaggtgaatatgttgatatggtgaaggctggtatcatcgacccactaaaagtcatcagaactgcattggtggatgccgctagcgtgtcatccctgatgaccacaacggaatccatcattgtagagatccccaaggaagaggcggctccggcaccagcaatgggcggcatgggtggaatggactactagaagcatcacaccctcgatagcacacatcgaagctacgaggactaggattttaattttttttgagcggtgcaagttcatctttactgtattttggtcgttgatgaggtgattgtcaggcgatacaattttgagtctgcggacgaaaggacctcaccgagttccaaacggagctactgttggaataataagcggtagttgacttgagagctggagcggtagatcaaaattggattctgacaccttgtgccggacatgtactgaaacactacaattttatttggtggtggtggtggtatatcgtggggtcccttgtggcgtggttgctgctgcgtattttgcacgcagcatcaatgattacaaaatcccaccgcaacattatctcatgtttcatgcaacatttgttagccaagatga

SEQ ID NO: 1052 - DNA, 2351 bp, Papaver somniferum
ctccatttatccgtgccctaaatcttttttttatttattatttacgtctctttgcccttttcttttcttccgctacaagtccaatcttataaaaccctagaaaaatcatttcctccgtctctccaagattcacattgtaaatcccttacatcccttaaaatgtatcgcgctgttgcaaatcttgcttccaaggctaggatcgctagaaatgcttcccagcaaatcggtagtagagcgagttggaccagaaattattcagcaaaagatattaaattcggtgtcgaagcaagggctatgatgcttaagggtgtggaagaccttgctgatgctgttaaagtgactatgggacctaaggggcgtaacgttgtaattgaacaaagctttggtgcacccaaagtgactaaagatggtgtcactgttgctaaaagcattgagtttaaggacagagttaagaacattggtgccagccttgtaaagcaagtagcaaatgccaccaacgatgtagctggtgatggtacgacttgtgccacagtccttacacgtgcaatttttgccgagggatgcaaatctgttgcagctggtatgaatgcaatggacctaaggagaggaatatcaatggcagtagactcggtggtgacaaatttgaagagcagaacaagaatgatcagcacatccgaagaaatagctcaggttggtactatatcagcaaatggcgatagagacattggtgaaatgattgccaaggctatggaaaaagttggcaaagagggcgttatcactataactgatgggaagaccttaaacaatgaaattgaagttgttgaaggaatgaagctggataggggatatatatctccatatttcattacaaatcagaagaatcagaaatgtgaattagaagatccactcatcctaatccatgagaagaaaatctctagcataaattctgtggtgaaagtcttagaactggccctaaagaggcaaagacctttgttgattgtcgctgaagatatagaaagtgatgcacttgcaactctcatattgaataagcttagggctggaatcaagatctgtgctattaaggctccaggttttggagaaaacaggaaatctagtatgcaagatcttgcagtcttgactgggggtcaactcataactgaagaactaggcatgaatcttgagaaggttgagttggagatgcttggcacgtgcaagaaggtgacaatatctaaggatgatactgtagttcttgacggggctggtgacaagaaatccatcgaggaacgatgtgaacagctaagagctggagttgaaatgagcacatctgattatgataaagataagttgcaagagaggctagctaagctttctggtggtgttgctgttttaaagatcggaggagctagtgaagctgaagttggtgagaaaaaagacagagtaactgacgctctaaatgccaccaaagcagctgttgaggagggcattgttcctggaggtggtattgcactgttatatgcatcaagggagctggacaaattggaaaccgccaacttcgaccagaaaattggtgttcagatcatacagaatgcgttaaaggcccctgtgcaaacaattgcatcaaatgccggagttgagggtgctgtagttgttggcaagctactggagcaggaaaacactgaccttggatatgatgcagctaagggtgaatatgttgacatgatcaaggctgggattattgatccactaaaagtaattagaactgctttgacagatgctgccagtgtatcatcgttgatgacaaccacggaggctattgttgttgagcttcccaaggatgacaaagaaatgccagcaatgggtggcggcataggtggcatggattactgaggagaaaattattattatctgattcccttcttgatgcatatgttttttttttttttttacgaaagttgcataatgatggaagaactctaggtagcaaagtagaacgaagtttggtgttgattgaacctttggtttggattgttcccttggctctgctaggacgttttaagattgagaatatcttttccaacatcaaactagaaggctcgtgtaaaccacattgatagagagtgagaaataatgctaaattgggggttttattttgtgaaccctaacttcataactttttagaagcaatattgattcagattggagtgtcaaaaatgcattctggccccacaaaaatgataattgaaaccagaaatactcaattctcctaacctgttgctgattctttgtgacatgagggcgagaccatcacaaatgtaccgggggtgcacattccggaaaaccggcagtacaac

SEQ ID NO: 1053 - DNA, 1942 bp, Papaver somniferum
tagagccttcaatccatttatttatccgtgccctaaacctctttattttttttatttactttacgtctgtccgcccttttcttttcttccgctgcaagtccaattttataaatataaaaccctagaaaaatcatttcctccaagattcacactgtaaaccccttacatccctcaaaatgtatcgcgctgttgcaaatcttgcttccaaggctaggatcgctagaaattcttcccagcaaatcggtagtagagcgagttggaccagaaattatgcagcaaaagatattaaatttggcgttgaagcaagggctatgatgctcaagggtgtcgaagaccttgctgatgctgttaaagtgactatgggacctaaggggcgtaacgttgtaattgaacaaagctttggtgcacctaaagtgactaaagatggtgtcactgttgctaaaagcgttgaatttaaggacagagttaagaacatcggtgccagccttgtaaagcaagtagcaaatgccaccaatgatgtagctggtgatggtacgacttgtgccacagtcctcacacgtgcaatttttgccgagggctgcaaatctgttgcagctggtatgaatgcaatggacctaaggagaggaatatcaatggcagtagattcggtggtgacaaatttgaagagcagaacaagaatgatcagcacatcggaagaaatagctcaggttggtactatatcagcaaatggtgacagagacattggtgagatgattgccaaggctatggaaaaagttggcaaagagggtgttatcactataactgacgggaagaccttaaacaatgaaatagaagttgtcgaaggaatgaagctggataggggatatatatctccatatttcatcacaaatcagaagaatcagaaatgtgaattagaagatccactcatcctaatccatgagaagaaaatctctagcataaattctgtggtgaaagtcttagaactggccctaaagaggcaaagacctttgttgattgttgctgaagatatagaaagtgatgcacttgcaactctcatattgaataaacttagagctggaatcaaggtttgtgctattaaggctccaggttttggagagaacaggaaatctggtatgcaagatcttgccgtcttgactgggggtcaactcataactgaagaactaggcatgaatcttgagaaggttgagttggagatgcttggcacgtgcaagaaggtgacaatatctaaggatgatactgtagttcttgacggggctggtgacaagaaattcattgaggaacgatgtgaacagctaagagctggagttgaaatgagcacttctgattatgataaagataagttgcaagagaggctagctaagctttctggtggtgttgctgttttaaagattggaggagctagtgaagctgaagttggtgagaaaaaagacagagtaactgatgctctaaatgccaccaaagcagctgttgaggagggcattgttcctggaggtggtatcgcactgttatatgcatcaagggagctggacaaactggaaacagccaacttcgaccagaagattggtgttcagatcatacaaaatgcattaaaggcccctgtgcaaacaattgcatcaaatgccggagttgagggtgctgtagttgttggcaagttactggagcaggaaaacaccgaccttggatatgatgcagctaagggtgaatatgttgacatgatcaaggctggtattattgatccactaaaagtaattagaactgctttgacagatgctgccagtgtatcatcattgatgacaaccacggaggctattgttgttgagcttcccaaagatgacaaagaaacgccagcaatcggtggcggcattggtggcatggattattgatcagaacataacccctcctgatacatatattttctttc

SEQ ID NO: 1054 - DNA, 2154 bp, Secale cereale
aaatccgcctctcccttcccattccctttcctcctccccaagaaacaaccgaagctcgcacatcatctcacctcggcgcctcgccgccctagcctctacgcacctcgactccggcgccatctcgctgcattcgccatgtaccgtgcggccgccagcctcgcctccaaggctcggcaagccgggagcagcgctcgccaggttggaagcaggcttgcctggagcaggaactatgctgccaaagacatcaggtttggtgtcgaggcccgtgcctcgatgttgaagggtgtcgaggagttggcagatgcggtgaaagtgaccatgggtcctaaggggcgcactgtgatcattgagcagagctttggtgccccaaaagtcacaaaggatggtgtgactgttgccaagagcattgaatttaaagatagagtcaagaacgttggtgcaagccttgtgaaacaggttgctaatgcaacaaatgatactgctggagatggtaccacatgtgccactgttttgacaaaagcaatatttactgagggttgcaagtctgtagctgctggaatgaacgcaatggatctaaggcgtggaatctcaatggcagttgatgatgttgtgacaaacctaaagggcatggctagaatgatcagcacttcagaggaaatagcacaggtgggtacaatatcagcaaatggcgaaagggaaattggtgagctgattgctaaggctatggagaaggttgggaaagaaggtgtaatcaccatcgcggatggtaacaccctttataacgagcttgaagttgtggaaggcatgaagctcgacaggggttacatctctccttactttattaccaaccaaaagacccagaaatgtgaactggaagaccccttgatcttgatccatgacaagaaggtttcgaacatgcatgcggtagttaaagtgttagagatggctctgaagaagcaaaagcctctactgattgttgcagaagatctagaaagcgaggcattgggcactctgattatcaacaagctccgtgcaggcattaaggtctgtgctgttaaagctcctggttttggggagaacaggaaagcaaatttacaggaccttgctatccttactggtggagaagtcataactgaagagcttgggatgaaccttgagaattttgaccctgagatgttaggtacatgcaaaaaggtgactgtttctaaggatgacactgttattcttgatggagctggagacaagaagaacattgaggagagagcagatcagattagatctgcaattgagcaaagtacttctgattatgacaaggaaaagctgcaagagcggttggcaaagctttctggaggtgttgctgttctaaagattggaggagccagtgaagctgaagttagcgagaagaaggacagagttacagacgcactaaatgccactaaagctgctgttgaagagggtatcgtgccaggaggtggtgttgcccttctatatgcatcaaaggctctggataaattgcagactgcaaactttgaccagaagatcggtgttcagatcattcagaatgctttgaagacaccagtgtacacgatcgcttgcaatgcaggtgtagaaggggcagttgttgttggcaagcttttggagcaagataacactgatcttggatatgatgcagctaaaggtgaatatgtggacatggtgaaggtcggtatcattgacccactgaaggtgatcagaactgccttggtggatgctgctagtgtgtcatctctgatgaccacaacagaggccatcatcgtagaggttcctaaagaggagaaagaggcacctgcaatgggcggcatgggtggaatggattactaagccatggattcgcacgatatgtgaagcaaactggaacatattgattaggggatttttttgggtgtagtcccatctttgatgtaattttattgtcgatgggtgacagttttgatcgtgcggacgatgttccaaacggaagaagtgttgggacgaataataaagagtagcggaaacacttgatcggaactgattaatgacatctgctgaaggcaattgatgaagagttgcgcattttgaagtatgttttttttactcacttgtttattctcgtctataatatgagtatatgactct

SEQ ID NO: 1055 - DNA, 2244 bp, Triticum aestivum
ttactgcacaatgctcttcctctcccttctcctccctctaaaatccgcctcctcacccttggcattccctttcctcctccccaagaaacagccgaagctcgcacatcatctcacctcggcgcctcgcccccctagcctctacgcacctcgactccggcgccatctcgctgcattcgccatgtaccgcgcggccgccagcctcgcctccaaggctcggcaagccgggagcagcgctcgccaggttggaagcaggcttgcctggagcaggaactatgccgccaaagacatcaggtttggtgtcgaggcccgtgcctcgatgttgaggggtgtcgaggagttggcagatgcggtgaaagtgaccatgggtcctaaggggcgcactgtgatcattgagcagagctttggtgccccaaaagtcacaaaggatggtgtgactgttgccaagagcattgaatttaaagatagagtcaagaacgttggtgcaagccttgtaaaacaggttgctaatgcaacaaatgatactgctggagatggtaccacatgtgccactgttttgacaaaagcaatatttactgagggttgcaagtctgtagccgctggaatgaacgcaatggatctaaggcgtggaatctcaatggcggttgatgatgttgtgacaaacctaaagggcatggctagaatgatcagcacttcagaggaaatagcacaggtgggtacaatatcagcaaatggcgaaagggaaattggtgagctgattgctaaggctatggagaaggttgggaaagaaggtgtaatcaccattgcggatggtaacaccctttataacgagcttgaagttgtggaaggcatgaagctcgacaggggttacatctctccttactttattaccaaccaaaagacccagaaatgtgaattggaagaccccttgatcttgatccatgacaagaaggtttcgaacatgcatgcagtagttaaagtgttagagatggctctgaagaagcaaaagcctctactgattgttgctgaagatctagaaagtgaggcattgggcactctgattatcaacaagctccgtgcaggcattaaggtctgtgctgttaaagctcctggttttggggagaacaggaaagcaaatttacaggaccttgctatccttactggcggagaagtcataactgaagagcttgggatgaaccttgagaactttgacccggagatgttaggtacatgcaaaaaggtgactgtttctaaggatgacactgttattcttgatggagctggagacaagaagaacattgaggagagagcagatcagattagatctgcaattgagcaaagtacttctgattatgacaaggaaaagctgcaagagaggttggcaaagctttctggaggtgttgcggttctaaagattggaggagccagtgaagctgaagttagcgagaagaaggacagagttacagacgcacttaatgccactaaagctgctgttgaagagggtatcgtgccaggaggtggtgttgcccttctatatgcatcaaaggctctggataaattgcagactgcaaactttgaccagaagatcggcgtgcagatcattcagaacgctttgaagacaccagtgtacaccatcgcttgcaatgcaggcgtagaaggggcagttgttgttggcaagcttttggagcaagagaacactgatcttggatatgacgcagctaaaggtgaatatgtggacatggtgaaggtcggtatcattgacccactgaaggtgatcagaactgccttggtggatgctgctagtgtgtcgtctctgatgaccacaacagaggccatcatcgtggaggttcctaaagaggagaaagaggcacctgcaatgggcggcatgggtggaatggattactaagccatgaacacgcacgatatatgaagcaaactggaacatattgattaggggatttttttgggtgtagtcccatctttgatgtaattttattgtcgatgggttgacagttttgatcgtgcggacgatgttccaaacggagccagtgttgggacgaataaagagtagtcgtcgagagctgaaacacttgatcggaaactgattaatgacgcctgctgaaggccaattgatgaagagttgcgcgttttgaagatgttttttcacttcacttgtttgttctctcgtctatgttacgactctaatcgtcccttgttctgcacgtttcattgtaaaataaataatga

SEQ ID NO: 1056 - DNA, 2045 bp, Allium cepa
ctcattttcaatttaagcagcccagcggaggaaaagaaaatactgtaatatcatatcaaagagcgatttcaatctactttcagcaaattaactatttcaaattatcatgtatcgcccagctttgtacgccgcttcaaaagccaggtctgcttgcatcagcgggaaacaggttggaagccgacttagttggagaagaaactatgcggcaaaagatattaggtttggagttgatgctcgtgctttgatgcttaaaggcgttgaagagcttgccgatgctgtcaaagttactatgggaccaaagggacggaatgttgttattgagcaaagctttggtgcacctaaagttacaaaggatggagttactgttgcaaaaagcattgaattcaaggacagagtgaagaatatgggtgccagtcttgtgaaacaagttgctaacgcaaccaatgacagtgctggtgatggtacaacttgtgctactgttcttacaaaagcaatattctctgaaggatgcaagtcagtagctgctggaatgaatgcaatggatttaaggagaggaatcacaatggctgttgattctgttgttaccaatttgaagagcagggctaggatgatcagcacctcggaagagattgctcaggttggaacaatatctgctaacggagatagagaaatcggtgaacttattgcaaaggccatggaaaaagttggcaaagaaggagtcataaccattcaagatggcaaaacgctatataatgaactagaagtggtagagggcatgaaacttgataggggatacatatcaccttacttcatcaccaacccaaagaaccagaaatgtgaactcgataatcctcttattttgatccatgagaagaaaatttctagcatgaatgctatagttaaagtgcttgagttggcgctcaagagacaaaggcctttacttattgttgctgaagacatcgaaagtgaggcattagcaactcttatcattaataaacttcgggctggaataaaggtttgtgccattaaagcacctggattcggagaaaataggaagaacagcatgcaagatcttgcaactttaactgggggtgaactcattacagaggaacttggcatgaatctggaaaaggtggagcttgagatgcttggtacatgtaaaaaggttacagtatcaaaagatgatacggttatccttgatggtgccggtgataagaaagctattgaagaaagatgtgatcaactaagatctgctattgatgcgagtacatctgactatgacaaagagaagctgcaagagcggttggcaaagttatctggtggcgttgcagttctaaagattggaggagcgagcgaagctgaagttggtgagaagaaggatagagttaccgatgccctgaatgcaactaaagctgctgtcgaagagggaattgtgcctgggggtggtgttgccttgctgtacgcatccaaagaattagagaagttgcagacagctaactttgaccagaaaattggtgttcaaatcattcaaaatgctttgaagatgccagcgtatattattgcttcaaatgctggagtggagggtgctgttgttgtcggcaagcttttggaacaggatcatgcagacgttggctatgatgctgctaaaggtgaatatgttgatatggtaaaggctggtattatagacccattgaaagtgatcagaactgcactggtggatgcagcaagtgtttcttcactaatgacaactacagaagcggtggtagtggaacaacccaaggacgagaaggatgcagctcctgcaatgcctggaatgggcggcatggattactaatcatatcaccgtaaatgatattatcagttacgatttaggaattaatcgattttttaaatagccattatggtattttgagtgtaattttcgaggccaaaaactcttgtagcccgtttatgggggaaaaacatttcttgtactctggacgttaccatgaataattgttacttgttttgaataaaaaatataaaggcgttagaattgcaaattt

SEQ ID NO: 1057 - DNA, 2441 bp, Allium cepa
caatacaattatagcaagtgaatcaaaatttaggatggatatacaaataaaatttcaatgaataaatagatgtaatgtatcgttaacgtgaatacctcggtaaaacatgactaattgaacagaattgtaaatcgaaaataaacatctttacagaaccgtacagattcgacggtaggagaacactctggagtcacgataacctgtatcctcccgcgatgcattggaactaaaccataaaccctaatagaagcttccagagtctccagctgctactacgttcacttgcgtctcctttaatttaagcagggtagacgctaaattttgatttcgcttcacgttttgtctctaattcatctaagttatcattctcgatcatcgtcattatgtatcgtgcagcattaagcgccgcttcaaaagtcagggctgctggcggaagtgggaaacagattggaagcagacttaattggagcagaaattatgcggctaaggatattaaatttggagttgatgcacgtgctttgatgcttagaggtgttgaagagcttgctgacgctgttaaggttactatggggccaaagggacgaaatgttgtaatagagcaaagttttggtgctccaaaagttacaaaagatggtgttaccgttgcaaaaagcattgaattcaaggacagagtgaagaacatgggtgctagtcttgtgaaacaagttgctaatgcaaccaatgatgttgctggtgatggtacaacttgcgcaactgttcttacaaaagcaatattctctgaagggtgcaaatcagttgctgctggaatgaacgcaatggatttgaggagaggaatttcactggctgttgattcagttgtcaccaatttgaagagtagagccaggatgatcagcacatcagaagaaatcgctcaggttgggaccatatcagctaacggagaaagagaaattggtgaacttattgcaaaagccatggagaaagttggcaaggagggagtcatcacaattgaagatggtaaaaccctatacaatgaactggaagttgtcgagggaatgaaacttgataggggttacatatcaccttactttgtcaccaaccccaagaaccaaaaatgcgaactagatgatcctctaatccttattcatgagaaaaaaatttctagcataaatgctgtggtgaaagtgcttgagctggcactcaagagacaaaggcctttactaatagttgctgaagatattgaaagtgatgcactagcaactcttatcattaataagcttcgcgctggactaaagatttgtgccattaaagcacctggatttggtgataataggaagaacagtatgcaagatcttgcaactctaactgggggtgttctcattactgaagaattaggcatgaacctagagaaagtcgagttggacatgcttggaacatgtaaaaaggtaacagtatcgaaagatgataccgttattcttgacggagctggtgacaagaaagcccttgaagaaagatgcgatcaactaagatctgctattgatttaagtacgtcagactatgataaagaaaagttacaagagagactggcaaaactttctggtggtgttgcagtcctcaagattggaggagccagtgaagctgaagttggtgagaagaaggatagagttaccgatgcgctgaatgcaacaaaggctgccgtagaggagggaattgtgccagggggtggcgttgctctgctttatgcatccaaagaattagagaaattgcataccgccaactttgatcagaaaattggtgttcaaattattcaaaatgctttgaaggctccagtgcatattattgcttccaacgctggagtagagggtgctgttgttgttggcaagcttttggaacaggataacacagatcttggttatgatgcggctaaaggtgaatatgttgacatggtaaaggctggtattattgatccactgaaagttattagaactgcattggttgatgctgcaagtgtttcttcattgatgacgaccacggaagctgtggtggtagaactaccaaaagatgagaaggaaggtgctgcagcagcgcctggtatgggtggcatgggaggaatggattactaaaccgagcatcatgtaaaagcattgaactgtttcaatatcaaattttggttagagttcttttagcggtgttattttgtaatttggtgaaagaacaagaatcgattgtagtgcacatgttctgcagatttactttgttgtctttcatggctgatggaacaaattacgtgagtctatgaaaatagcaagcaaatgttacgaactacaattgttattttaggtaataaagccattaagttcttatgttatcatatttttggttgactggcatgtactgttttcatgaggaactttcatcgtagctatgaattttgcaatcagtac

SEQ ID NO: 1058 - DNA, 1814 bp, Euphorbia peplus
tttcgcctccggcatcgcctccaaatccaggttggctaagaacactacccaacagattggtagtaaattggcttggagcagaaattatgcggctaaagatatcaaatttggcgttgaagctcgtgctttgatgcttaaaggtgttgaggaacttgctgatgccgttaaagttactatgggccctaagggacgaactgttgttatagagcaaagctggggagcaccaaaagtgacaaaagatggtgttacagtagcaaagagcattgaatttaaaaatagagtaaagaacataggtgctagtctcgtaaagcaggttgcaaatgctacaaatgatgtggcaggcgatggcacaacatgtgctacagttctcacacgagcaatctttgcggaaggctgcaagtctgtggcagctggtatgaatgctatggatctaaggcgtgggatttccatggcagttgattccgttataactagtttgaagagcagagccaggatgataagcacatctgaagaaatagcacaggttgggaccatatcagcaaatggagaaagagagatcggtgaactcatagccaaagcaatggagaaagttggcaaagagggtgtcattaccatttctgatgggaagacattgtacaatgagttagaggtagttgagggaatgaagctggacagaggctacatatccccttattttatcactaatactaaaaaccaaaaatgtgaactagaagatccactcattttaatccatgagaagaagatctcaaatttgaatcccattgtcaaagttttagagctgtcattgaagatgcaaagacctttactgattattgctgaagatgtggatagtgatgcattagcagctcttgttctgaacaagcttcgagctggactcaaggtctgtgcaattaaagccccgggatttggagaaaataggaaagccaatatgcaagaccttgccattctcaccggtggtgagattataacagaggagctcggcatgaacctcgaaaaggtgggactggaatcgcttggctcatgcaaaaaggttacagtttcaaaggatgacacaattatccttgatggcttaggtgacaagaaagctatcgaagaaagatgtgaacagttaagatccgctgtcgaatcaagtacttctgattatgacaaggaaaagatacaagagcgtcttgcaaaactttctggaggtgttgcagttctgaagattggtggagctagtgaagctgaagttagtgagaagaaagacagagttactgatgctctaaatgctactaaggctgctgttgaagaaggaattgttcccggtggtggcgttgcacttctttatgcttctaaagaactggacaaattgcaaactgcaaactttgatcagaagattggtgtccagattatccagaatgctcttaagatgccagtgcatactatcgcaatgaatgcaggagtagagggggcagttgtcgttggcaagctattagagcaggacgatcctgaccttggatatgatgcagccaaaggcgaatatgttgatatggtgaaggcaggaatcatcgatccgttgaaagtcattcgaacagccttgttagatgctgcaagtgtctcttcgttgatgactactactgaagccattatttctgagatccctaatgataaggaagctgaggccagccccgggatgggtggaatgggcggcatgggaggcatgggcttttaaacctcttttcatgacatttatgcggtaacctgaacaaacaacaaagttgagttatgaattgagtgttctatatttagtagtg

SEQ ID NO: 1059 - DNA, 2218 bp, Setaria italica
ctccgttcgcctccccccgccctccctctaaaatccatccgtcccccacctcctcggcgcctcgcgtcctcttccccctccgcaagaaagaagcgacgcagctcgcctccatccccgccccaaactcgagctcgctcgccggcgaccgcctccgcacccgcgcctcctcctcgccgtcatgtatcgcgcagcagccagcctcgcctccaaggcgcggcaagccgggagcagcgccgccgctcgccaggttgggagcaggcttgcctggagcagaaactatgctgccaaggatatcaagtttggcgttgaggcccgtgccctgatgctgaggggcgttgaggaattggctgatgcagtcaaagtgacaatgggtcctaagggtcgcaatgtggttattgaacaaagctttggtgcaccaaaagtcacaaaagatggtgtgaccgttgctaagagcattgaattcaaagatagagtaaagaatgttggtgcaagccttgtgaagcaggtcgccaatgcaactaacgacactgctggagatggtaccacatgtgctactgttttgacaaaagcaatatttactgaggggtgcaaatctgttgcggccggaatgaatgcaatggatttaaggcgtggaatctcaatggctgttgatgctgttgtgaccaatctgaagggcatggccagaatgatcagcacgtcggaagagattgcacaggtgggtacaatatcagcaaatggggaaagggaaattggtgaacttattgccaaggctatggagaaggttggcaaagagggtgtgatcaccattgcggatggtaacaccctttacaatgagcttgaagttgtggaaggcatgaaacttgacagaggttacatctccccgtacttcattaccaactcaaaaacccagaaatgtgaactggaagaccctttgatcttgattcatgacaagaaggtctcgaacatgcacgcggtggttaaagttttggagatggctctaaagaagcaaaagcctctactgattgttgcagaagatgtggaaagtgaagcattgggcactctgattcttaacaagcttcgtgcaggcatcaaggtctgtgctgttaaagctcctggttttggggaaaacaggaaggcaaacttacaagaccttgctgtccttaccggaggagaagtcataactgaagagcttggaatgaaacttgagagtgttgaacctctaatgttgggttcatgcaaaaaggtgactgtctctaaggatgacactgttattcttgatggagctggagacaagaaggccattgaagagagggcagagcagattagatctgcaattgagaatagcacatctgattatgacaaggaaaagctacaggagaggttggcaaagctctctggaggtgttgctgttctaaagattggaggagccagcgaagcagaagttggtgagaagaaggatagagtgacagatgcactgaacgctactaaagctgctgtggaagagggcattgtaccaggtggtggtgttgctcttctctatgcggcaaaggagcttgacaaattgcagaccgcgaactttgatcagaagattggtgtccagatcattcagaacgccctgaagacacctgtgcacaccattgcttccaatgctggtgtggagggagcagtggtggtgggcaagcttttggagcaaggaaatactgaccttggttatgatgctgccaaaggtgaatatgttgacatggtgaaggccggtatcatcgatccactaaaagtcatcagaactgccttggtggatgctgctagcgtgtcatccctgatgaccacaacggaatccatcattgtagagatccccaaggaagaggcacccgcaccggcaatgggtggcatgggtggaatggagtactagaggcatcacaccctcgataacacacagcagtcagagctacgtggactaggattttaattttttgggcggtgcaagttcatctttgctgtattttggtcgttgatgaggtgattgtcaggcgatacaattttgagtctgcggacgaaaggacctcaccgagctcccaacggagctagtgttggaataataagcggtagctgagagctggagcggtagatcaaaattggattctgacaccttgtgccggactttctgtactgaaaaactacatttttttggtggtggtatatcgtgggtttcctttctgca

SEQ ID NO: 1060 - DNA, 2125 bp, Setaria italica
gcaagaaagaagcgacgcagctcgcctccatccccgccccaaactcgagctcgctcgccggcgaccgcctccgcacccgcgcctcctcctcgccgtcatgtatcgcgcagcagccagcctcgcctccaaggcgcggcaagccgggagcagcgccgccgctcgccaggttgggagcaggcttgcctggagcagaaactatgctgccaaggatatcaagtttggcgttgaggcccgtgccctgatgctgaggggcgttgaggaattggctgatgcagtcaaagtgacaatgggtcctaagggtcgcaatgtggttattgaacaaagctttggtgcaccaaaagtcacaaaagatggtgtgaccgttgctaagagcattgaattcaaagatagagtaaagaatgttggtgcaagccttgtgaagcaggtcgccaatgcaactaacgacactgctggagatggtaccacatgtgctactgttttgacaaaagcaatatttactgaggggtgcaaatctgttgcggccggaatgaatgcaatggatttaaggcgtggaatctcaatggctgttgatgctgttgtgaccaatctgaagggcatggccagaatgatcagcacgtcggaagagattgcacaggtgggtacaatatcagcaaatggggaaagggaaattggtgaacttattgccaaggctatggagaaggttggcaaagagggtgtgatcaccattgcggatggtaacaccctttacaatgagcttgaagttgtggaaggcatgaaacttgacagaggttacatctccccgtacttcattaccaactcaaaaacccagaaatgtgaactggaagaccctttgatcttgattcatgacaagaaggtctcgaacatgcacgcggtggttaaagttttggagatggctctaaagaagcaaaagcctctactgattgttgcagaagatgtggaaagtgaagcattgggcactctgattcttaacaagcttcgtgcaggcatcaaggtctgtgctgttaaagctcctggttttggggaaaacaggaaggcaaacttacaagaccttgctgtccttaccggaggagaagtcataactgaagagcttggaatgaaacttgagagtgttgaacctctaatgttgggttcatgcaaaaaggtgactgtctctaaggatgacactgttattcttgatggagctggagacaagaaggccattgaagagagggcagagcagattagatctgcaattgagaatagcacatctgattatgacaaggaaaagctacaggagaggttggcaaagctctctggaggtgttgctgttctaaagattggaggagccagcgaagcagaagttggtgagaagaaggatagagtgacagatgcactgaacgctactaaagctgctgtggaagagggcattgtaccaggtggtggtgttgctcttctctatgcggcaaaggagcttgacaaattgcagaccgcgaactttgatcagaagattggtgtccagatcattcagaacgccctgaagacacctgtgcacaccattgcttccaatgctggtgtggagggagcagtggtggtgggcaagcttttggagcaaggaaatactgaccttggttatgatgctgccaaaggtgaatatgttgacatggtgaaggccggtatcatcgatccactaaaagtcatcagaactgccttggtggatgctgctagcgtgtcatccctgatgaccacaacggaatccatcattgtagagatccccaaggaagaggcacccgcaccggcaatgggtggcatgggtggaatggagtactagaggcatcacaccctcgataacacacagcagtcagagctacgtggactaggattttaattttttgggcggtgcaagttcatctttgctgtattttggtcgttgatgaggtgattgtcaggcgatacaattttgagtctgcggacgaaaggacctcaccgagctcccaacggagctagtgttggaataataagcggtagctgagagctggagcggtagatcaaaattggattctgacaccttgtgccggactttctgtactgaaaaactacatttttttggtggtggtatatcgtgggt

SEQ ID NO: 1061 - DNA, 2154 bp, Zea mays
aagaaagaagcgaagcaactctccgccgtctccgtttctccacaccacccaaagctctctccgaccacagcctcgcccccagcgcctccttccgcagtcatgtaccgcgcggccgctagcctcgcctccaaggcgcggcaagccgggaacagcctcgccgcccgccaggttggaagcaggcttgcctggagcaggaactatgctgcgaaggacatcaagtttggtgttgaggcccgtgctctgatgttgaggggtgttgaggagttggcagatgctgtcaaagtgacaatgggacctaagggccgcaatgtggttattgagcaaagctttggtgcaccgaaagtcacaaaggatggtgtgactgtagcaaagagcattgaatttaaggatagagtaaagaatgttggtgcaagccttgtgaaacaggttgctaatgcaactaatgacactgctggcgatggtaccacatgtgccactgttttgacaaaagcaatatttactgaggggtgcaaatctgttgcggctggaatgaatgcgatggatttaaggcgcggaatctcaatggctgttgacgctgttgtgaccaatctgaaaggcatggccagaatgatcagcacttcagaagaaattgcacaggtgggtacaatatcagcaaatggggaaagggaaattggtgagcttattgccaaggctatggagaaggttggcaaagagggtgtcatcactattgcggacggtaacaccctttataatgagcttgaagttgtggagggtatgaaactagacagaggttacatctctccgtacttcattaccaactcaaaaacccagaaatgtgaattggaagacccattgatcttaattcatgacaagaaggttacgaacatgcatgctgtggttaaggttttagaaatggctctgaagaaacaaaagcctctactgattgttgcagaagatgtggaaagtgaagcattgggcactttgattattaacaagcttcgtgcaggcatcaaggtctgtgctgtcaaagctcctggttttggggaaaacaggaaggcaaacttacaggaccttgcaatccttactggaggagaggtaataactgaagaactaggaatgaaccttgagaattttgagcctcacatgctgggtacatgcaaaaaggtgaccgtctctaaggatgacactgttattcttgatggagccggagacaagaagtccattgaagagagggcagagcagattagatcagcaattgagaatagcacttcagattatgataaggaaaagctccaggagcggttggcaaaactctctggaggtgttgctgttctgaagattgggggagctagcgaagcagaagttggtgagaagaaggatagagtgacagatgcactgaatgctactaaagctgctgttgaagagggtattgtaccaggtggtggtgttgctcttctctatgcatcgaaggagcttgataaattgcagacagcgaacttcgatcagaagattggtgtgcaaatcattcagaatgctttgaagacacctgtacacacaattgcctccaatgctggggtggagggagcagtagttgtaggaaagcttttggagcaagaaaatactgacctgggttatgatgctgctaaaggtgaatatgttgacatggtgaagaccggtatcattgacccgctaaaggttatcagaactgctttggtggatgctgctagtgtgtcgtccctgatgacaaccacggaatccataattgtagagattcccaaggaagaggcaccggctccagcaatgggtggcggcatgggtggcatggattactaatgcatcacacccacatacacatcaatgcaggttttttttagcggtgaagttcatcttcactgtttagcggtgcaagttcatctctactgtattttgttcgatgatgaggtggttgtcaggcggatacagttttgagtctgcggacgtaggacctcacaatagttccaaacggaatagtgtgagaataataaatatgaacagtagttctttgagatatgaagttgtagatcaagattggcttccgggcattttgtgtggaaccaactgtattctgatcgttacattttttggctggggtaaaatcggattgccgttctgttt

SEQ ID NO: 1062 - DNA, 2122 bp, Sorghum bicolor
gcaagaaagaaacgaagcaaactctccgccgcctccgttcttccgcaccacccaaagctctcgccgaccacagcctcggtccccgcgcctccttccgcagtcatgtaccgcgcggccgctagcctcgcctccaaggcgcggcaagccgggagcagcgccgccgctcgccaggttggaagcaggcttgcctggagcaggaactatgctgccaaggacatcaagtttggtgttgaggcccgtgctctgatgttgaggggtgttgaggagttggctgatgcggtcaaagtgacaatgggtcctaaggggcgcaatgtggttattgagcaaagctttggtgcccctaaagtcacaaaggatggtgtgactgttgcaaagagcattgaatttaaggatagagtaaagaatgttggtgcaagccttgtgaaacaggttgctaatgcaactaatgacactgctggtgatggtaccacatgtgccactgttttgacaaaagcaatatttactgagggctgcaaatctgtcgcggctggaatgaatgcaatggatttaaggcgtggaatctcaatggctgttgatgctgttgtgaccaatcttaagaacatggccagaatgatcagcacttcagaagaaattgcacaggtgggtacaatatcagcaaatggggaaagagaaattggtgagcttattgcaaaggctatggagaaggttggcaaagagggtgtgatcactattgcggacggtaacacgctttataatgagcttgaagttgtggagggtatgaaacttgacagaggttacatctctccgtacttcattacaaactcaaaaacccagaaatgtgaattggacgacccattgatcttaattcatgacaagaaggttacgaacatgcatgctgtggttaaggttttagaattggctctaaagaaacaaaagcctttactgattgttgcagaagatgtggaaagcgaagcattgggcactctgattattaacaagcttcgtgcaggcatcaaggtctgcgctgtcaaagctcctggttttggagaaaacaggaaggcaaacttacaggacctcgctatccttactggaggagaggtaataactgaagagctaggaatgaaccttgagaatgttgaacctcacatgctgggtacatgcaaaaaggtgaccgtctctaaggatgacactgttattcttgatggatctggagacaagaaatctattgaagagagggcagagcagattagatcggcaattgagaatagcacttcagattatgacaaggaaaagctccaggagcggttggcaaagctctctggaggtgttgctgtactgaagattggaggagccagcgaagcagaagttggtgagaagaaggatagagtcacagatgcactgaatgctacaaaagctgccgttgaagagggtattgtaccaggtggtggtgttgctcttctctatgcatccaaggagcttgataaattgcagacagcaaactttgatcagaagattggtgtgcaaatcattcagaatgctttgaagacacctgtacacaccattgcctccaatgctggggtggagggagcagtagttgtgggcaagcttttggagcaagaaaatactgacctgggttatgatgctgctaaaggtgaatacgttgacatggtgaaggctggtatcattgacccgctaaaggtgatcagaactgctttggtggatgctgctagcgtgtcgtccctgatgaccaccacggaatccataattgtagagatccccaaggaagaggcgccggctccagcaatgggtggtggcatgggtggaatggattactaagacatcacacccatgatacacatcaaagcagggactttttttttccgtttttggcggtgcaagttcatctttactgtattttggtcgatgatgagttggttgtcaggcggatacaattttgagtctgcggacgtaggacctctcaatagctccaaacggagctatagtgtgggaataataaatatatgaacagtaggttctttgagatctgaagctgtagatcaagattggattcagacaccttgtgccgaacaaacagtagtctgattattacattttttggctg

SEQ ID NO: 1063 - DNA, 2165 bp, Allium cepa
acgttcacttgcgtctcctttaatttaagcagggtagacactaaattttgatttcgcttcacgttttgtctctaattcatccaagttatcattctcgatcatcgtcattatgtatcgtgcagcattaagcgccgcttcaaaagtcagggctgctggcggaagtgggaaacagattggaagcagacttaattggagcagaaattatgcggctaaggatattaaatttggagttgatgcacgtgctttgatgcttagaggtgttgaagagcttgctgacgctgttaaggttactatggggccaaagggacgaaatgttgtaatagagcaaagttttggtgctccaaaagttacaaaagatggtgttaccgttgcaaaaagcattgaattcaaagacagagtgaagaacatgggtgctagtcttgtgaaacaagttgctaatgcaaccaatgatgttgctggtgatggtacgacttgcgcaactgttcttacaaaagcaatattctccgaagggtgcaagtcagttgctgctggaatgaatgcaatggatttaaggagaggaattacactggctgttgattcagttgtcacaaatttgaagagtagagccaggatgatcagcacttcagaagaaatcgctcaggttgggaccatatcatccaatggagaaagagaaattggtgaacttattgcaaaagccatggagaaagttggcaaggagggagtcatcacaattgaagatggtaaaaccctatacaatgaactggaagttgtcgagggaatgaaacttgataggggttacatatcaccttactttgtcaccaaccccaagaaccaaaaatgcgaactagatgatcctctaatccttattcatgagaaaaaatttctagcataaatgctgtggtgaaagtgcttgagctggcactcaagagacaaaggcctttactaatagttgctgaagatattgaaagtgatgcactagcaactcttatcattaataagcttcgcgctggactaaagatttgtgccattaaagcacctggatttggtgataataggaagaacagtatgcaagatcttgcaactctaactgggggtgttctcattactgaagaattaggcatgaacctagagaaagtcgagttggacatgcttggaacatgtaaaaaggtaacagtatcgaaagatgataccgttattcttgacggagctggtgacaagaaagcccttgaagaaagatgcgatcaactaagatctgctattgatttaagtacgtcagactatgataaagaaaagttacaagagagactggcaaaactttctggtggtgttgcagtcctcaagattggaggagccagtgaagctgaagttggtgagaagaaggatagagttaccgatgcgctgaatgcaacaaaggctgccgtagaggagggaattgtgccagggggtggcgttgctctgctttatgcatccaaagaattagagaaattgcataccgccaactttgatcagaaaattggtgttcaaattattcaaaatgctttgaaggctccagtgcatattattgcttccaacgctggagtagagggtgctgttgttgttggcaagcttttggaacaggataacacagatcttggttatgatgcggctaaaggtgaatatgttgacatggtaaaggctggtattattgatccactgaaagttattagaactgcattggttgatgctgcaagtgtttcttcattgatgacgaccacggaagctgtggtggtagaactaccaaaagatgagaaggaaggtgctgcagcagcgcctggtatgggtggcatgggaggaatggattactaaaccgagcatcatgtaaaagcattgaactgtttcaatatcaaattttggttagagttcttttagcggtgttattttgtaatttggtgaaagaacaagaatcgattgtagtgcacatgttctgcagatttactttgttgtctttcatggctgatggaacaaattacgtgagtctatgaaaatagcaagcaaatgttacgaactacaattgttattttaggtaataaagccattaagttcttatgttatcatatttttggttgactggcatgtactgttttcatgaggaactttcatcgtagctatgaattttgcaatcagta

SEQ ID NO: 1064 - DNA, 2061 bp, Allium cepa
agcaaaataaaagctgaactttgatttggcttcttgttttgtcactaattcagctaagttatcatctcagtcatcgtcattatgtaccgtgcagcgttaagcgccgcttcgaaagtcagagctgctggcggaagaggaaaacagattggaagcagacttaactggagccgaaattatgctgctaaggatattaaatttggagttgatgcacgtgctttgatgcttagaggagttgaagagcttgctgatgctgttaaggttactatggggccaaagggaagaaatgtcgtaatagagcaaagttttggcgctccaaaagtgacaaaagatggtgttaccgttgcaaaaagcattgaattcaaggacagagtgaagaacatgggtgctagtcttgtgaaacaagttgctaatgcaaccaatgatgttgctggtgatggtacaacttgcgcaactgttcttacaaaagcaatattctctgaagggtgcaaatcagttgctgctggaatgaacgcaatggatttgaggagaggaatttcactggctgttgattcagttgtcaccaatttgaagagtagagccaggatgatcagcacatcagaagaaatcgctcaggttgggaccatatcagctaacggagaaagagaaattggtgaacttattgcaaaagccatggagaaagttggcaaggagggagtcatcacaattgaagatggtaaaaccctatacaatgaactggaagttgtggagggaatgaaacttgataggggttacatatcaccttactttgtcactaacccaaagaatcaaaaatgcgaactagatgatcctctaatccttattcacgagaaaaaaatttctagcattagtgctgtggtgaaagcgcttgagctggcactcaagagacaaaggcctttgctaattgttgctgaagatattgaaagtgatgcactagcaactcttatcattaataagcttcgtgctggactaaagatatgtgctattaaagcacctggatttggtgataataggaagaacagcatgcaagatcttgcaactctaacggggggcgtgctcattactgaagaattaggcatgaacctggagaaagtcgagttggacatgtttggaacatgtaaaaaggtaacagtatcgaaagatgataccgtgatccttgacggagctggtgacaagaaagcgcttgaagaaagatgtgatcaactaagatctgctattgatttaagtacatcagactatgataaagaaaagttacaagagagactggcaaaactctctggtggtgttgcagtactcaagattggaggagctagtgaagctgaagttggtgaaaagaaggatagagttaccgacgcattgaatgcaacgaaggctgctgtagaggagggaattgtgccagggggtggtgttgctctgctctatgcatccaaagagctagagaaattgcatactgccaacttcgatcagaaaattggtgtccaaattattcaaaatgctttgaaggctccagcgtatattattgcttccaatgctggagtagagggtgctgttgttgttggcaagcttttggaacaggataacactgatcttggttatgatgcggctaaaggcgaatatgttgacatggtaaaggctggtattattgatccactgaaagttattagaactgcattggttgatgctgcaagtgtttcttcattgatgacgaccacggaagctgtggtggtagaactaccaaaagatgagaaggaaggtgctgcagcagcgcctggtatgggtggcatgggaggaatggattactaaaccgagcatcatgtgaaagcattgaattgtttcagtatcaaatttttgttagtttttgtagcagtgctattttgtaatttggtgaaagatcaagaaccgattgtagtgcacatgttctgcagatttactttgttgtctttcatggctgatggaacaaattacgccagtctataaaaatagcgagcaaatgttacgaagtataattgttatttcaggtaataaagccattaagttcttatgtta

SEQ ID NO: 1065 - DNA, 2274 bp, Papaver somniferum
aaaaatcatttcctccgtctctccaagattcacattgtaaatcccttacatcccttaaaatgtatcgcgctgttgcaaatcttgcttccaaggctagaatcgctaaaaatgcttcccagcaaatcggtactagagcgagttggactagaaattatgcagcaaaagatattaaattcggtgtcgaagcaagggctatgatgctgaagggtgtggaagaccttgctgatgctgttaaagtgactatgggacctaaggggcgtaacgttgtaattgaacaaagctttggtgcacccaaagtgactaaagatggtgtcactgttgctaaaagcattgagtttaaggacagagttaagaacatcggtgccagtcttgtaaagcaagtagcaaatgccaccaacgatgtagctggtgatggtacgacttgtgccacagtccttacacgtgcaatttttgccgagggatgcaaatctgttgcagctggtatgaatgcaatggacctaaggagaggaatatcaatggcagtagactcggtggtgacaaatttgaagagcagaacaagaatgatcagcacatccgaagaaatagctcaggttggtactatatcagcaaatggtgatagagacattggtgagatgattgccaaggctatggaaaaagttggcaaagagggcgttatcactataaccgatgggaagaccttaaacaatgaaattgaagttgttgaaggaatgaagctggataggggatatatatctccatatttcattacaaatcagaagaatcagaaatgtgaattagaagatccactcatcctaatccatgagaagaaaatctctagcataaattctgtggtgaaagtcttagaactggccctaaagaggcaaagacctttgttgattgtcgctgaagatatagaaagtgatgcacttgcaactctcatattgaataagcttagggctggaatcaagatctgtgctattaaggctccaggttttggagaaaacaggaaatctagtatgcaagatcttgccgtcttgactgggggtcaactcataactgaagaactaggcatgaatcttgagaaggttgagttggagatgcttggcacgtgcaagaaggtgacaatatctaaggatgatactgtagttcttgacggggctggtgacaagaaatccatcgaggaacgatgtgaacagctaagagctggagttgaaatgagcacttctgattatgataaagataagttgcaagagaggctagctaagctttctggtggtgttgctgttttaaagatcggaggagctagtgaagctgaagttggtgagaaaaaagacagagtaactgatgctctaaatgccaccaaagcagctgttgaggaaggcattgttcctggaggtggtattgcactgttatatgcatcaagggagctggacaaattggaaaccgccaacttcgaccagaaaattggtgttcagatcatacagaatgcgttaaaggcccctgtgcaaacaattgcatcaaatgccggagttgagggtgctgtagttgttggcaagctactggagcaggaaaacactgaccttggatatgatgcagctaagggtgaatatgttgacatgatcaaggctgggattattgatccactaaaagtaattagaactgctttgacagatgctgccagtgtatcatcattgatgacaaccacggaggctattgttgttgagcttcccaaggatgacaaagaaatgccagcaatgggtggcggcataggtggcatggattactgaggagaagataattattattatctgattcccctcttgatacatttttttttcccgaaagttgcataatgatggaagaactctaggtagcaaagtagaaggaagtttggtgttgatcattgaacctatggtttggattgttcccttgctctgctaggacgttctaagattgagaatatcttttccaacatcaaactagaaggctcgtgtaaaccacattgatagagagagtgagaaataatgctaaactgggggttctgttttgtgaaccctaacttcataacttcttagaagcaatattgattcaaatcggtgtcaaaatgcatcctttcaccttgctgcagtgaaacacaatcaacgtagttaatatcggttttgtctcggctgggaccggtacactggtacaacattgtattggggagatctcggtttcaaatatcggtacggttccaaattttatatctataacttttgtgaaattatttttcac

SEQ ID NO: 1066 - DNA, 2165 bp, Secale cereale
gggctcgcacactcactactctaccgcgcgcctcgcgccctacgccgcctacgcacctcgactccggcgccatctcgctgcattcgccatgtaccgtgcgcgccagcctccctccaaggctcggcaagccggagccagcgctcgccaggttggaagcaggcttgcctggagcaggaactatgctgccaaagacatcaggtttggtgtcgaggcccgtgcctcgatgttgaagggtgtcgaggagttggcagatgcggtgaaagtgaccatgggtcctaaggggcgcactgtgatcattgagcagagctttggtgccccaaaagtcacaaaggatggtgtgactgttgccaagagcattgaatttaaagatagagtcaagaacgttggtgcaagccttgtgaaacaggttgctaatgcaacaaatgatactgctggagatggtaccacatgtgccactgttttgacaaaagcaatatttactgagggttgcaagtctgtagctgctggaatgaacgcaatggatctaaggcgtggaatctcaatggcagttgatgatgttgtgacaaacctaaagggcatggctagaatgatcagcacttcagaggaaatagcacaggtgggtacaatatcagcaaatggcgaaagggaaattggtgagctgattgctaaggctatggagaaggttgggaaagaaggtgtaatcaccatcgcggatggtaacaccctttataacgagcttgaagttgtggaaggcatgaagctcgacaggggttacatctctccttactttattaccaaccaaaagacccagaaatgtgaactggaagaccccttgatcttgatccatgacaagaaggtttcgaacatgcatgcggtagttaaagtgttagagatggctctgaagaagcaaaagcctctactgattgttgcagaagatctagaaagcgaggcattgggcactctgattatcaacaagctccgtgcaggcattaaggtctgtgctgttaaagctcctggttttggggagaacaggaaagcaaatttacaggaccttgctatccttactggtggagaagtcataactgaagagcttgggatgaaccttgagaattttgaccctgagatgttaggtacatgcaaaaaggtgactgtttctaaggatgacactgttattcttgatggagctggagacaagaagaacattgaggagagagcagatcagattagatctgcaattgagcaaagtacttctgattatgacaaggaaaagctgcaagagcggttggcaaagctttctggaggtgttgctgttctaaagattggaggagccagtgaagctgaagttagcgagaagaaggacagagttacagacgcactaaatgccactaaagctgctgttgaagagggtatcgtgccaggaggtggtgttgcccttctatatgcatcaaaggctctggataaattgcagactgcaaactttgaccagaagatcggtgttcagatcattcagaatgctttgaagacaccagtgtacacgatcgcttgcaatgcaggtgtagaaggggcagttgttgttggcaagcttttggagcaagataacactgatcttggatatgatgcagctaaaggtgaatatgtggacatggtgaaggtcggtatcattgacccactgaaggtgatcagaactgccttggtggatgctgctagtgtgtcatctctgatgaccacaacagaggccatcatcgtagaggttcctaaagaggagaaagaggcacctgcaatgggcggcatgggtggaatggattactaagccatggattcgcacgatatgtgaagcaaactggaacatattgattaggggatttttttgggtgtagtcccatctttgatgtaattttattgtcgatgggtgacagttttgatcgtgcggacgatgttccaaacggaagaagtgttgggacgaataataaagagtagcggaaacacttgatcggaactgattaatgacatctgctgaaggcaattgatgaagagttgcgcattttgaagattgtttttttactttcctttgtttattctcgtctataatatgagtatatgactcttatcgtcccttgttctccacgttttcattagtaaaataataatgtaaagttctttaagga

SEQ ID NO: 1067 - DNA, 2160 bp, Solanum phureja
ctaggcccttcctcactaaataaaatacctttgaagcttcttcttcatccccacttctctctttgttcttcaaaaccccttccattttcactttcagcagcatttctcagtttcaaaatgtatcgttttgcagcaaatcttgcttctaaagccagagttgcaagaatcagttcccaacagattggtgggaggttcaattggagtagaaactatgctgcaaaggatatcagatttggagttgaagctagagctttgatgcttcaaggtgttgagcagcttgctgatgctgttaaagtcactatgggtccaaaggggcgtaatgtggtgattgaacaaagttggggtgcacccaaagtaacaaaagatggcgtgactgttgcaaaaagtattgaattcaaggacaagatacaaaatgttggtgctagccttgtaaaacaagtcgccaatgcaacgaatgatgttgctggtgatggtaccacttgtgcaacagtcctcacccgagcaatatttgctgaaggatgcaagtcagtggcagctggtatgaatgcaatggaccttagacggggtattaccatggctgtagattctgttgtgacaaacctgaaaagcagagcacggatgatcagtacatctgaggaaattgcacaggttgggactatctctgcaaacggagaaagagaaattggcgacctaattgcaagggctatggagaaagtaggcaaggagggagtcatcactattcaagacgggaagacattgctcaatgaattggatgttgttgaagggatgaagttggatagaggttacatatcaccatacttcatcacaaatcagaagaatcagaaatgtgaactggataacccactaattctgattcatgagaaaaagatctcaagcgttaatgctgttgtgaaagcattggagttagctctgaagagacaaaggcccctcttaattgtggctgaagatgtggacaatgaagcactcgccactcttattttgaacaaactccgtgctggaatcaaggtttgtgccatcaaagcaccaggctttggtgaaaacaggaaagcttatttgcaagatcttgctattttaactggaggccaagtcataacagaagagcttggactgaacattgaaaatttggagttcgagatgctgggaacaagtaaagaggcgactatctctaaggatgatactgtcattcttgatggtgctggtaagaagaagtccatagaggaacgatgtgaactgattagatcaaccattgaacagagcacatctgactatgacaaggagaagttgcaggaaagactagctaagctttcagggggtgttgctgtgttaaagattggaggtgccagtgaagctgaggttggtgaaaagaaagatagagtaactgatgctttgaatgccacaaaggctgcagtggaggaaggaattgttccaggtggtggtgttgctcttctttatgcagcaagagaattggataatttgacaacagccaactttgaccagaagattggtgtacaaattattcagaatgctctgaagacaccagtacatacaatagcctctaacgcaggagtagagggtgctgtcgtggttggtaaactgttggatcaggacaaccttgatcttggatatgatgcggccaagggtgaatatgtagatatgataaaggcagggattatcgatccagtgaaagtgattaggacagctttggttgatgctgccagcgtctcgtctctcttgaccacaactgaagcagttgttgtcgagcttcctaaggatgagaaggaatctcctgcaatgggtggcggtatgggtggcatggacttctaattgaaaagccaaaaacagtaattgcagctgcttgacaacatttgtttagaacaaagcaaaaaaataaatttagagttgtttcctattttgatgaaatctttacgatagaaaacgcgcctattgtatcaatagcaagagagaccattgtgaattcatgtttttgtaggttcaaaatttgtagtcttcatttgaatacgcagcattttggttagcaaaatataggtccatttcagtgttctcttttgttttggtgtcctttctggtttaactatttttttgaggtgatgaatttatacctgttctacttttcttttt

SEQ ID NO: 1068 - DNA, 1694 bp, Cirsium arvense
atgtatcgttttgctgtaaatcttgcttctaaagctagggttgcaaagaatggcacccaactgattggaagtaggttgagttggagcagaaactatgcagctaaagacatcagatttggagtagatgctagggctttaatgcttagaggtgttgaagagcttgctgatgctgttagagtaaccatgggtccaaaggggcgtaatgtggtgattgaacaaagttatggagcaccaaaagtaacgaaagacggtgtaacagtggcaaaaagcatcgaatttaaagataaagtcaagaatgttggtgcaagcctagtgaaacaggttgctaatgctacaaatgatgtggctggtgatggtactacttgtgcaacagtcctcacaggggcaatattttcagaggggtgcaaatcagttgcagctggtatgaatgcaatggacctccgccgtggtatttccatggccgttgattcagtggtagcaaacttgaagagtagggcccgtatgataagcacatctgaggaaatcacacaggtgggtacgatttctgcaaatggagaacgtgagataggggagctaatagccaaggctatggagaaagtggggaaagagggtgtcatcacaattcaagatggaaagacattgtataatgaactagaagttgttgagggaatgaagctggacaggggctacatatctccacatttcattacaaatcaaaagaatcagaagtgtgaactagaggaccctcttgttctaatccatgagaagaagatatcaaacattaattctgtgattaaagtgttagagttggcattgaagagacaaaggccgctgctaattgttgctgaagacgtggaaagcgatgcattggctaccttaattcttaacaagcttcgagctggcataaaggtttgcgccataaaagctcctggttttggtgagaacagaaaggcaaatctggaagatctcgccactctcaccggcggccagcttataaccgaagaacttggtatgaaccttgacaatgtggagctggaaatgcttggatcttgtaaaaaggtcactgtatctaaagatgacacggttgtgcttgacggtgctggcgataagaagtctatagaagagcggtgcgaacagattaggtcagcaatcgagtccagtacatctgattatgataaagagaaattccaagagagattggcgaaactttctggtggtgttgctgtactgaagatcggaggagccagtgacagtgaagtaggtgaaaagaaagatagagttacagatgctctaaatgccacaaaggccgccgttgaggaaggcatcgtaccaggtggtggtgttgctcttctttatgcatcgaaagaattggataagttgccaacagccaactttgatcaaaaaataggtgttcaaataatccagaatgcgctaaagatgcccgtttatatgattgcatctaacgctggagtggagggttcggttgtcgttggtaagcttttagagcaggatgacccggatcttggatatgatgccgcaaaaggtgaatatgtggatatggtgaaaaatggaatcattgacccattgaaagtgataagaactgccttggttgatgcagcaagtgtgtcgtctttgatgacaacgactgaagctatcgtggttgaactcccaaagcccgctagtgaagctgctcc

SEQ ID NO: 1069 - DNA, 2092 bp, Zea mays
agaaagcgaagcaactctccgccgcctccattcctccacagcccacaccaaccaaacctctcgccgacaacagcctcggtccccgcgccaccatccgcaatcatgtaccgcgcggccgctagcctcgcctccaaggcgcggcaagccgggagcagctccgccgctcgccaggttggaagcaggcttgcctggagcaggaactatgctgccaaggacatcaagtttggtgttgaggcccgtgctctgatgttgaggggtgttgaggagttggcagacgctgtcaaagtgacaatgggtcctaaggggcgcaatgtggttattgagcaaagcttcggtgcaccgaaagtcacaaaggatggtgtgactgttgcgaagagcattgaatttaaggatagagtaaagaatgttggtgcgagccttgtgaaacaggttgctaatgcaactaatgacactgctggtgatggtaccacatgtgctactgttttgacaaaagcaatatttactgaggggtgcaaatctgttgcggctggaatgaatgcaatggatttaaggcgtggaatctcaatggctgttgatgctgttgtgaccaatctgaagggcatggccagaatgattagcacttcagaagaaattgcacaggtgggtacaatatcagcaaatggagaaagggaaattggtgagcttattgccaaggctatggagaaggttggcaaagagggtgtgatcactattgcggatggcaacaccctttataatgagcttgaagttgtggagggtatgaaacttgacagaggttacatctctccgtacttcattaccaactcaaaagcccagaaatgtgaactggaagacccattgatcttaattcatgacaagaaagtgacaaatatgcatgctgtggttaaggttttagaaatggctctaaagaaacaaaggcctctactgattgttgcagaagatgtggaaagtgaagcattgggtactctgattattaacaagcttcgtgcaggcatcaaggtctgtgctgtcaaagctcctggttttggggaaaacaggaaggcaaacttacaggacctcgctatccttaccggaggagaggtaataactgaagagctaggaatgaaccttgagaatgttgagcctcacatgctgggttcatgcaaaaaggtgactgtctctaaggatgacactgttattcttgatggcgctggagacaaaaagtctattgaagagagggcagaccagattagatcagcagttgagaacagcacttcagattatgacaaggaaaagctccaggaacggttggcaaagctctctggaggtgttgctgttctgaagattggaggagccagcgaagcagaagttggtgagaagaaggatagagtgacagatgcactgaatgctactaaagctgctgttgaagagggcattgtaccaggtggtggtgttgctcttctctatgcatcgaaggagctcgataagttgcagacagcaaattttgatcagaagattggtgtgcaaatcattcagaatgctttgaagacacctgtacacaccattgcctccaatgctggggtggagggagcagtagttgtgggcaagcttttggagcaaggaaatactgaccttggttatgatgctgctaaagacgaatacgttgacatggtgaaggctggtatcattgatccgctaaaggtcatcagaactgcattggtggatgctgctagtgtgtcgtccctgatgaccaccacggaatccataattgtagagatccccaaggaagaggcaccggctccagcaatgggtggcatgggtggaatggattactaagtgtcaagcacacccacgatacaacaacatcaaagcagagatgacgaggtggttgtcaggaggatacaattttgaggctgcggacgtaggacctctcaatatctccaagcaatagtggggggataataaacatgagcagtagttgtttgagatctgatgctgtagatcaagattggattctgacaccttgtgctgaaccaactgtagtctgattattacacattttttggctgagtaaaatcggattgccgttctgttt

SEQ ID NO: 1070 - DNA, 1968 bp, Ambrosia trifida
cgccgtcatgtatcgtctcgccgtcaatatcgctaccaaatcaagggttgcaagaaacagtgctcagcagatcagttctaatttgagatggaatagaaactatgctgctaaagatattaagtttggagtggatgctagggctttgatgcttagaggtgttgaagagcttgctgatgctgttaaagttactatgggtcctaagggacgaaacgtggtcatagaacaaagttatggagcacctaaggtgacaaaggatggtgtcacagtggcaaaaagtatcgagtttaaagacagggtgaagaatgttggtgcaagtcttgtgaagcaggttgctaatgccaccaatgatgttgctggtgatggtaccacttgtgcaacggttctcacccgtgcaatttattctgaaggctgcaagtcagttgcagctggaatgaatgccatggatcttagacgtggcatcaccatggccgttgattcagttgtaacaaacttgaagagtagagctaggatgatcagtacatctgaagaaatagcgcaggttggtacaatatcagcaaatggagaacgtgaaattggtgagcttattgccaaggctatggaaaaagttggcaaagagggtgttattaccatatctgatggtaaaacactttacaatgaattggaagtggttgagggaatgaagttggatagaggttatatatcaccttacttcgtcaccaatacaaagaaccaaaaatgtgaattagatgaccccttgattttaatacatgagaaaaaaatactctagcttaaatgctattgttaaagttctagagttggctttgaagaatcaaagatcacttctgatcgtggctgaagatattgaaagtgaggccttagccacactcattcttaacaaacttcgtgctggtatcaaggtttgtgccatcaaagcccctggatttggagaaaaccgaaagtcaaatttgcatgaccttgcaactcttaccggaggagaggtcatcaccgaagaacttggcatgaaccttgagaaaatgtcaccagaaatgctagggacttgcaaaagggttacaatatcaaaggatgatacagttattcttgatggggctggtgataagaaagccattgaagaaagatgtgaacagatacgatcatcaatcgaattaagcacttctgattatgataaggagaagcttcaagagagattagcaaagctttctggtggtgttgctgttttgaagataggaggagctagcgaagctgaagtcggtgaaaagaaggatagagttactgatgctttgaatgccacaaaggctgcagttgaggaaggaatcgtaccaggtggaggggtggctcttctatatgcttccaaggaacttgataatcttcagacagccaattttgatcagaagatcggtgttcaaataattcagaatgctctcaaggctcctgtgcacacgattgccagcaatgctggagttgaaggtgctgttattgttggaaagcttttggagcaggataatcctgacctgggatatgatgctgctaaaggtcaatatgtagacatggtcaaggaaggaatcatcgacccactgaaagttatcaggacagcattaacagatgctgcaagtgtgtcatccttattaaccacaacagaagctgtgattgttgaactaccaaaggaagagaaggaatcacccgcaatgcctggcatgggtgactattgaaggcaataatagctacttgtttcattttcccatataattatgagaattttcaaactgtacaacggatcataagagtactttcgatatcattggtcgactggtctgagcttttagggttttcttacgcctctcacggatggataaccgtcatgtaatcatttaagaggaattgtgttttgacttgaaatttcaccatttgttcattgtgaagtaacattgtttggtaatgaacttgatgcta

SEQ ID NO: 1071 - DNA, 2128 bp, Helianthus annuus
aaccctaaaccctaaatcgaatctgaatttcttctcgatccttctttttcaccattataatactctctctgcagtcttcactctcaacccatttcacccaccacacttcctccattcaattctctgattaaccgccgtcatgtatcgtctcgctgccaatatcgccaccaaatcacggatcgcaagaaacagtgctcagcagattcggaactatgctgctaaagatattagatttggagtggatgctagggctttgatgcttagaggtgttgaagagcttgctgatgctgttaaagttactatgggtcctaagggacgtaacgtggtcatagagcaaagctatggagctcctaaagtgacaaaggacggtgtcaccgtggcgaaaagcatcgagtttaaagacagggtgaagaacgttggtgccagtcttgtgaagcaggttgctaatgccaccaacgatgttgctggtgatggtaccacttgtgcaacagttctcacccgtgcaatttattccgaaggctgcaagtcagttgcagcgggaatgaacgccatggatcttagacgtgggatcaccatggccgttgattcagttgtcacaaacttgaagagtagagctaggatgatcagtacatctgaagaaattgcacaggttggtacgatatcagcaaacggagaacgagaaatcggtgagcttattgccaaggctatggaaaaagttggcaaagagggtgttattaccatatctgatggtaaaacactttacaatgaattggaagtggtcgaaggaatgaagttggatagaggttatatatcaccttacttcgtcaccaacacaaagaaccaaaaatgcgaattagatgatcctttgattttaatacacgagaaaaaaatctctagcttaaatgccattgttaaagttctagagcttgctttgaagaatcaaagatcacttctgattgtagctgaagatatcgaaagcgaggccttagccactctcattcttaacaaacttcgtgctggtatcaaggtttgtgcgatcaaagccccgggatttggagaaaaccgaaagtcaaacttgcatgaccttgcaacgcttaccggaggagaggtcatcaccgaagaacttggcatgaaccttgagaaaatgtctccagaaatgctagggacttgcaaaagggttacaatatcaaaggatgatacagttattcttgatggggctggtgacaagaaagccattgaagaaagatgtgaacagattagatcatcaatcgaattaagcacttctgattatgataaggagaagcttcaagagagattagcaaagctttctggtggtgttgctgttttgaagattggaggagctagcgaagctgaagtcggtgaaaagaaggatagagttaccgatgctttgaatgccacaaaggctgctgttgaggaaggaatcgtaccaggtggaggtgtggctcttctatatgcttcaaaggagcttgacaatcttcagacagccaattttgatcagaagatcggtgttcaaatcattcaaaatgctctcaaggcaccagtgcacacgattgccagcaatgctggagtcgaaggtgctgttatcgttggaaagcttttggagcaagataaccccgacctcggttatgatgccgctaaaggtcaatacgtagacatggtcaaggaaggaatcatcgatccccttaaagttatcaggaccgcattgacagacgccgcaagtgtgtcatctttattaaccacaaccgaagccgtgattgttgaactaccgaaagaagagaaggaatcaccagcaatgccaccaggcatgggcgactactaaaggcgataataataactcgttccatttttctatatattatgagaattttcaaactgtacaacggatcgtaatagtacttttgatagttgttggtcgactggtttgagcttttagggttttctttcgcttctcacggatggacaatcgtcgtgtaatttagaggggttgggttttgacttgaaatttcgctattggagtacggagtcgcattgtttggtaataaacttgatgctatataaattggttcatgttaactttcttgattgcgcatttagggcttaaagacgg

SEQ ID NO: 1072 - DNA, 2092 bp, Chrysanthemum coronarium
ccccgtgccaccaccatttccacgtgggaaaccctccagagactctcatcagaccatttccactttctcccccatttccaccacagccgtcatgtaccgcttcgccgtcaatctcgcttctaaatcacggctacttaggaacaattctcatcagatagctagtaggtttgcttcgagtcgaaactatgcggcgaaagatattaggtttggagttggagctagggctatgatgcttagaggcgttgaagatcttgctgatgctgttcaagttaccatgggccctaaaggtcgtaatgttgttatcgagcaaagttatggagctcccaaggtgacaaaggacggtgtcaccgtggcaaaaagtattgagttcaaagacagggttaagaatgttggtgctagcctagtcaagcaggttgctaatgctactaatgatgttgccggtgacggtacaacttgtgcaaccgtcctcacacgtgcaatatattctgaaggctgcaagtcagttgcagctggaatgaatgccatggatcttagacgtggtatcaacatggcagttgattcggttgtcacacacttgaagagcaaagctaggatgattagtacatctgaagagatagcacaggttgggacgatatcagctaatggagaacgagagataggtgagcttattgccaaggccatggagaaagttggcaaagagggtgtcattactatttctgatggcaaaactctgcacaacgagttggaagttgttgagggaatgaaattggacagaggatatatctcaccttacttcgtcaccaatcctaagaaccaaaaatgtgaattagacgatcctttgattttgatacacgagaagaaaatctcaagcttgcattccattgttaaagttctagagttggccttgaaaaagcaaagaccattgctgattgtcgccgaagatattgaaagtgaagcattagccaccctcattctaaacaagcttcgtgctggtatcaaggtctgtgctattaaagccccaggattcggagagaaccggaagtctaatttgcaggatcttgcaaccctgacaggaggggaggtgatcacagaagagcttggtatgaaccttgagaaagtgggagttgaaatgctcgggacctgcaaaaaggtcactgtatcaaaagacgatacagttgttcttgatggtgctggtgacaagaaggccattgaagaaagatgcgagcagttgagatcgtcgatcgaattaagcacgactgactatgataaggaaaagtttcaagagagattagcaaagctttctggtggtgttgcggtcctaaagatcggaggagccagtgaagcagaggtgggcgagaaaaaagatagagttactgacgctttaaatgctacaaaggcagctgtagaggaaggaattgtccctggtggtggcgttgctcttttatatgcttcgaaagagctgtcaaatttggctacggccaattttgatcagaagattggtgtgcaaattatccaaaatgctctcaagtctcctgtgcacataatcgctagcaacgctggagttgagggcgctgttgttgttgggaaattgttggagcaggataacactgatcttggatacgatgctgctaaaggcttatatgttgatatggtgaaggaaggaatcattgatcccgttaaggttatcagaacggccttggtagatgcagctagtgtctcgtctttattgactacaacggaagctgtggttgttgaacttccaaaggatgagaaagaagcaccggaaatgcctggcatgggtggctatggaagccaattctgagcggcaaattctccctgattaacttgcaatgaatcgagatggaggggttttacttctattctgatatatattcttctttcggatgctggaccattcgtttatcattgagagttttggagtgtagaaagatggaaagaacaatttttgattggaaataaatacagaaattgactacttaccagcttagaggttaaccatggattgtcttggttgaactaaataatcctaatcagtttttggcatatgaacgttgaaaccgacgagtagtgt

SEQ ID NO: 1073 - DNA, 1692 bp, Cocos nucifera
ttgccgggagcagcagccgacagattggaagtaggcttggttggagcagaaactatgcggccaaggacatcagatttggagttgaagctcgtgctttgatgcttaagggtgtggaagagcttgctgatgccgtgaaggtgaccatgggacccaagggccgcaatgttgttttggagcaaagctttggtgcaccaaaagttacaaaggacggggtgactgttgcaaagagcattgagtttaaggacaaagtgaagaacgtgggtgcaagccttgtgaagcaggttgctaatgcaactaatgatgttgctggtgatggtacaacgtgcgctactgtccttacgagagcgatattcactgaagggtgcaagtcagtggcagctggcatgaatgcaatggatctaaggcgtggcatcacaatggctgttgatgctgtggtgaccaacctaaagagcagggctagaatgatcagcacttcagaagagatagcacaggttggtaccatatcagcgaatggagaaagagagattggcgagctaattgccaaggctatggagaaagttggcaaagagggagtaatcaccattgcggatggaaacactctgtacaatgaattggaagttgtagaaggaatgaaacttgacaggggctacatatctccctacttcattactaaccaaaagaaccaaaaatgtgaattggaagatcctctcattctgatacatgagaagaaaatttcaagcattaatgcggttgtgaaagcattggagttggccctgaaaagacaaaggcctctattaattgttgctgaggatgtagaaagtgatgcattggctaccctcatccttaataagcttcgtgcaggaattaaggtctgtgccattaaagctcctggttttggggagaacaggaaagccagcttgcatgaccttgctatcctcactgggggtgagctcatcactgaagaactcggtatgaaccttgaaaaagtagaatttgacatgcttggtgcatgcaagaaggtgacaatatcaaaagatgacactgttattcttgacggggctggagaaaagaaagccattgaagagagatgcgaccagctgagatctgcaattgaagcatgcacttctgactatgataaagaaaagctgcaggaaagattggcaaagctttccggaggcattgctgtcctaaagattggaggggccagtgaagccgaagttggtgagaaaaaagatagagtaaatgatgctttgaatgcaaccaaggctgctgtggaagagggtatcttgccaggtggcggtgttgctcttctctatgcatcaaaggagttggagaagctgcagattgctaactttgatcagaaaataggagttcaaataatccagaatgccctgaagaccccggtgcacaccattgctgcaaatgcaggagttgaaggggctgttgtagttggcaagcttttggagcaggataaccctgaccttggttatgatgcagccaaaggtgaatatgtggacatggttaaggcaggtatcattgacccactgaaagtgattagaactgcattggtggatgctgcaagtgtatcgtcgttgatgaccacgactgaggctgttgttgtagaacttcctaaagacgaggatgttcctgccccaggcggaggcatgggaggaatggattactaaatttttt

SEQ ID NO: 1074 - DNA, 2172 bp, Ambrosia trifida
tttaaaagctagaaggttcgggtttccacaaaaaccctaaaccctaaatcttcttatcaacttcttctggatccttctcttcctccatttatatattattattatcatcatcactctctctgcagtcttaactgaaccattaacaccaaccacacttcctccttccaatcctctacaccgccgtcatgtatcgtctcgccgtcaatatcgctaccaaatcaagggttgcaagaaacagtgctcaacagatcagttctaatttgaggtggaatagaaactatgctgctaaagatattaagtttggagtggatgctagggctttgatgcttagaggtgttgaagagcttgctgatgctgttaaagttactatgggtcctaagggacgaaacgtggtcatagaacaaagttatggagcacctaaggtgacaaaggatggtgtcaccgtggcaaaaagtatcgagtttaaagacagggtgaagaatgttggtgcaagtcttgtgaagcaggttgctaatgccaccaatgatgttgctggtgatggtaccacttgtgcaacggttctcacccgtgcaatttattccgaaggctgcaagtcagttgcagctggaatgaatgccatggatcttagacgtggcatcaccatggctgttgattcagttgtaacaaacttgaagagtagagctaggatgatcagtacatctgaagaaatagcgcaggttggtacaatatcagcaaatggagaacgtgaaattggtgagcttattgccaaggctatggaaaaagttggcaaagagggtgttattaccatatctgatggtaaaacactttacaatgaattggaagtggttgagggaatgaagttggatagaggttatatatcaccttacttcgtcaccaatacaaagaaccaaaaatgtgaattagatgaccctttggttttaatacatgagaaaaaaatctctagcttaaatgctattgttaaagttctagagttggctttgaagaatcaaagatcacttctgatcgtggctgaagatattgaaagtgaggccttagccacactcatccttaacaaacttcgtgctggtatcaaggtttgtgccatcaaagcccctggatttggagaaaaccggaagtcaaatttgcatgaccttgcaactctcaccggaggagaggtcatcaccgaagaacttggcatgaaccttgagaaaatgtcaccagaaatgctagggacttgcaaaagggttacaatatcaaaggatgatacagttattcttgatggggctggcgataagaaagccattgaagaaagatgtgaacagatacgatcatcaatcgaattaagcacttctgattatgataaggagaagcttcaagagagattagcaaagctttctggtggtgttgctgttttgaagataggaggagctagcgaagctgaagtcggtgaaaagaaggatagagttactgatgctttgaatgccacaaaggctgcagttgaggaaggaatcgtaccaggtggaggggtggctcttctatatgcttccaaggaacttgataatcttcagacagccaattttgatcagaagatcggtgttcaaataattcagaatgctctcaaggctcctgtgcacacgattgccagcaatgctggagttgaaggtgctgttattgttggaaagcttttggagcaggataatcccgaccttggatatgatgctgctaaaggtcaatatgtagacatggtcaaggaaggaatcatcgacccactgaaagtcatcaggacagcattaacagacgctgcaagtgtgtcatctttattaaccacaacagaagctgtgattgttgaactaccgaaagaagagaaggaatcacccgcaatgcctggcatgggcgactattgaaggcaataatagactactagtttcatttttccatataattatgagaattttcaaactgtacaacggatcgtaagagtgcttttgatagctattggtcgactggtctgagctttagggttttcttacgcttctcacggatggataaccgtaatgtaatcatttaagaggcattgtgttttgacttgaaatttcactattggttcattgtgaagtaacattatttggaaataaactcaatgctatttaaattggcttatgataaaaagaa

SEQ ID NO: 1075 - DNA, 1819 bp, Lotus japonicus
attggaagcagggcggcgtggagcaggaattatgcggccaaagacattaaatttggtgtggcggctcgggctctgatgcttaagggtgttgaagagcttgctgatgcagtccaagtaaccatgggccctaagggccgcaatgtggtgattgagcaaagttttggtgcccctaaagtgacaaaagatggagtaactgttgccaagagcattgaattcaaggataaagtcaagaatgtaggtgccagtcttgtaaagcaggttgcaaatgccaccaatgatgtggctggtgatggaaccacatgtgctacagttcttactcgagcaatatttgcggaagggtgcaaatcagttgcagctggtatgaatgcaatggacctgaggcgaggtataaatatggcggttgattcggtggtgacaaacctgaagagcagagcacgaatgattagtacttctgaagaaatagctcaggttgggacaatatctgctaatggggagagagagattggtgaattaattgcaaaagctatggagaaagttggcaaagaaggtgtaatcacaatagcagatggcaagacattggaaaatgagttggaagttgttgaaggcatgaagcttgacaggggctacatttctccatatttcataactaaccagaagaaccagaaatgtgaacttgaagatcctctcattataatccatgagaagaaaatctcgagtataaatgccatagttaaagtactagagttagcgttgaagaaacaaagacctctattgattgtggcagaggatgtggaaagtgaagccctggcaactcttattctaaataagcttcgtgctggaatcaaggtatgtgccatcaaagcccctggttttggtgaaaatcgaaaatctggtctccaggatcttgctgttcttacaggaggtcaacttatcactgaagagcttggcatgaatcttgaaaaagtggatctagagatgcttggctcttgcaaaaagattactatttccaaagatgacactgtcattcttgatggagctggtgataagaaagcacttgaggaaagatgtgagcagattaggtctgcaattgaaaatagcacttcagattatgacaaggaaaaattacaagaaagattagccaaactttctgggggtgttgcagtgcttaagattggaggagctagtgaggctgaagttagtgagaagaaggatagagtgacagatgccttaaatgcaactaaggcagctgtagaggagggcatattacctggtggtggtgttgctcttctgtatgcatctaatgagttgagtaagcttcaaactgccaactttgatcaaaagataggtgtccagattatccaaaatgctttgaagacacctgtgcacacaattgcagcaaatgctggagttgagggcgctgttgttgtcggtaaattattggaacaaaataatcctgatcttgggtatgatgcagccaaaggtgaatatgttgatatggttaaatctggaataattgatccattgaaggtgattagaaccgcactggttgacgcagccagtgtgtcttctttgatgacaacaactgaagcaattgtgactgaatttccaaaagaagataaagatgttcctgctatgggtggtggcatgggtggcatgggtggaatggattattagaggctatttcccctagtgattttttcttccgttggacctggattaaagtggtgcttcaccactattatagcattttttgcttatttattgagagaaggcatccatgtaatcatagtgagagttccaggatgtaggtaggagaaat

SEQ ID NO: 1076 - DNA, 1914 bp, Prunus persica
ttttttttttcctgtacagattggtagtagtttgatttcgagaaggaactatgcggccaaagatatcaaattcggtgtggaagcccgggcattgatgctcaagggtgtggaagagctcgctgatgctgttaaagtcacaatggggccaaaaggacgcaatgttgttctggaacaaagctttggggcccctaaagtgacaaaggatggtgtcactgtagcaaagagcattgagttcagagataaagtcaagaacattggtgctagtcttgtaaagcaggtcgcaaatgctacaaatgatgccgcaggggacggtaccacttgtgctacagtcctcacccgcgctatatttactgaaggatgcaaatcagtggcagctggaatgaatgctatggacctaagacgaggcatttcaatggcagttgattctgttgtgacaaacttgaagagtagggctcggatgatcagcacatctgaagaaatagctcaggttgggaccatatcagctaatggagagagagaaattggtgaactaatcgctaaggctatggagaaagttggcaaagagggtgttattaccattgctgatggaaaaacattgtataatgaattggaggttgttgaaggaatgaagctagataggggatatatatccccttactttattaccaatcctaagaaccaaaaatgtgaattagaagatccactcgtcttaatccacgagaagaaaatctcaaatctaaattcgatagtgaaaatattagagctggcattgaagaaacaaagacctcttttgattgttgctgaagatgtggaaagtgaagcacttgctacactcattataaacaagcttcgtgctggaattaaggtttgtgcaattaaagcccctggatttggagaaaacaggaaggcaaatttgcaggacctagccattcttacgggaggcgaggtaataactgaagagcttggtctgaaccttgacaaagttggagtagaaacacttggaacctgcaaaagggttacgatatcaaaagatgacactgttattcttgatggggctggtgacaagaaagccattgaagaaagatgtgaacagctgagatcatcaattgaattgagcacttctgattatgacaaggagaagttacaagagcggttggcaaagatttctggtggtgttgccgttttaaagattggcggagcgagcgaagcagaagttagtgaaaagaaggacagagtaactgatgctctaaatgccaccaaggctgctgtagaggaaggaatcgtacctggtggtggtgctgcactgctatatgcctcaaaggagctggacaagttggcaactgcaaactttgaccagaagattggtgttcaaattattcagaatgctcttaagatgcctgtatccacaattgcttctaatgctggagttgagggggcagttgttgttggcaaactattggagcaggacaatcctgaccttggatatgatgcagcaaaaggtgaatatgtagacatgataaaggcagggatcattgatccattgaaagtcatcagaaccgccttggtcgatgccgcaagcgtgtcctcgttaatgaccacgacagaggcagttgtcgtcgagcttcccaaggatgagaaggaaacccctggaatgggaggtggcatgggaggcatggattactagaagttctatcaacatgttggattcagtagaggctgcttactcaggctcacaccttgctcgtttatccttattcaaattgagttctccaatttctcgcttttatactcttttttttcttcaatggtattggaggctgaacatgaatgtaatcatagtgagagaggttaattgtgcaggaacattttacaccaggtgtagtctctggtggtatttatgattttgttgttctc

SEQ ID NO: 1077 - DNA, 2028 bp, Zostera marina
tttactcatcatatcaccactctattctcgacactctccgagcggaaaccctaggtttcgttcaacatgtaccgcgctgcagcaaagatcgcatccaatgcccggatcgctggagttcttggtcagcagatcggtggtaaatttggatatgcaaggaattatgcggccaaagatatcagatttggggttgatgcccgtgctttgatgcttaaaggtgttgaggaacttgctgatgctgtcaaagttactatgggacccaagggtcgcaatgttgttttagaacaaagttttggtgcaccaaaagtcaccaaagacggtgttactgttgcaaagagcattgaatttaaggacagggttaagaatatgggcgctagccttgtaaaacaggttgccaatgcaaccaatgatgttgccggtgatggtactacatgtgcaacagttcttacacgagcaatattttctgaaggctgtaaatcagttgcagctgggatgaatgcaatggatttaagacggggaatcacgatggcagttgataatgtggtgactaccctgaaaagtagagctcgaatgattagcacatctgaagagattgctcaggttggtacaatatcagcaaatggtgaaagagaaattggtgaactcattgcaaaggccatggaaaaagttggaaaagatggagttatcactattgctgatggaaaaacactttacaacgagcttgaagttgttgagggaatgaaacttgacagaggttatatttctccttacttcatcaccaatcagaaaaaccagaaatgtgaacttgaaaatcctctcattttaattcacgaaaagaaaatatcaaatattcaagctttggttaaagtgctagagatggcactaaaaattcaaagacctctgctaattatcgctgaagatgttgagagtgatatacttgcaactttaattcttaataagcttcgagcagggattaaggtttgtgctattaaagctccagggtttggagaaaacagaaaagcaaatatgcaggacttggctactctgactggtggcgaggttataactgaagagcttggcatgaatcttgataaggtggaatttgaaatgctcggaacatgcaaaaaggtgactatttccaaagatgacagtgttgtccttgatggtgctggtgatagaaaagcaattgaagagagatgcgaggagctgagatctgcaattgaagcaagtgattctgattatgaccgggagaaggtacaagaaaggctaggaaaactctcaggtggcgtcgctgttttgaagattggaggtgccagtgaagcagaagttggcgaaaagaaggatagagttactgatgccttaaatgcaacgaaagcagctgttgaggagggcattgtaccaggtggcggtgttgctctactctatgcatctaaagagcttgataagcttaatgttgcaaattttgatcagaaaattggtgtccagattatccagaatgcccttaagacaccagttcacacaatagcttccaatgctggagttgaaggagctgttgtggtcgggaagctcttggagagtgataactatgatcttggctatgatgccgcaaaagatgaatacgtagatatggtgaaggcaggtataatcgatcccttgaaagttatccgaactgcattggttgatgctgcaagtgtttcttctttgatgactactactgaagctgttgtcacagaactccctaaagatgagaaagatgcttcgccaatgcctggaggaggaatgggtgggatggattactgagaaatctattattcaaaaacattaggcatcgccgtattttgattgttgagctgaggtttaattttagtcgtaggttttattgcttgggctattgttcttcttttggtttagtttctaaacctcttttttgataaagttaatttttaataaataattgatgagaggttgagcattgtgctaaatacacaaaaatatttgggaagtagtacatttaatcttatacagttttct

SEQ ID NO: 1078 - DNA, 2106 bp, Allium cepa
ggcggtagtagctttctagaatccgcctcctcattttcaatttaagcagcccagcggttggaaagaaaatactgtaacatcatatcaaatagcgatttcaatctactttcagcaaattaactatttcaaattatcatgtatcgcccagctttgtacgccgcttcaaaagccaggtctgcttgcgtcagcgggaaacaggttggaagccgacttagttggagaagaaactatgcggcaaaagatattaggtttggagttgatgctcgtgctttgatgcttaaaggcgttgaagagcttgccgatgctgtcaaagttactatgggaccaaagggacgcaatgttgttattgagcaaagctttggtgcacctaaagttacaaaggatggagttactgttgcaaaaagcattgaattcaaggacagagtgaagaatatgggtgccagtcttgtgaaacaagttgctaacgcaaccaatgacagtgctggtgatggtacaacttgtgctactgttcttacaaaagcaatattctctgaaggatgcaagtcagtagctgctggaatgaatgcaatggatttaaggagaggaatcacaatggctgttgattctgttgttaccaatttgaagagcagggctaggatgatcagcacctcggaagagattgctcaggttggaacaatatctgctaacggagatagagaaatcggtgaacttattgcaaaggccatggaaaaagttggcaaagaaggagtcataaccattcaagatggcaaaacgctatataatgaactagaagtggtagagggcatgaaacttgataggggatacatatcaccttacttcatcaccaacccaaagaaccagaaatgtgaactcgacaatcctcttattctgattcatgagaaaaaatttctagcatgaatgctatagttaaagtgcttgagttggcactcaagagacaaaggcctttacttattgttgctgaagacattgaaagtgaggcattagcaactcttatcattaataaacttcgggctggaataaaggtttgtgccattaaagcacctggattcggagaaaataggaagaacagcatgcaagatcttgcaactttaactgggggtgaactcattacagaggaacttggcatgaatctggaaaaggtggagcttgagatgcttggtacatgtaaaaaggttacagtatcaaaagatgatacggttatccttgatggtgccggtgataagaaagctattgaagaaagatgtgatcaactaagatctgctattgatgcgagtacatctgactatgacaaagagaagctgcaagagcggttggcaaagttatctggtggcgttgcagttctaaagattggaggagcgagcgaagctgaagttggtgagaagaaggatagagttaccgatgccctgaatgcaactaaagctgctgtcgaagagggaattgtgcctgggggtggtgttgccttgctgtacgcatccaaagaattagagaagttgcagacagctaactttgaccagaaaattggtgttcaaatcattcaaaatgctttgaagatgccagcatatattattgctgctaatgctggagtagaaggtgcggttgttgttggcaagcttttggagcaggatcaagctgacgttggttatgatgctgctaaaggtgaatatgttgatatggtaaaggctggtattatagacccattgaaagtgatcagaactgcactggtggatgcggcaagtgtttcttcactaatgacaactacagaagcggtggtagtggaacaacccaaggacgagaaggatgcagctcctgcaatgcctggaatgggcggcatggattactaatcatatcaccgtaaatgatattatcagttacgatttaggaattaatcgattttttaaatagccattatggtattttgagtgtaattttcgaggccaaaaactcttgtagcccgtttatgggggaaaaacttttcttatactctggacgttaccatgaataattgttacttgttttgaataaaaaatagaaggcgttgaattgcatttatactattactcctgccatttgtcgaaaaacacacac

SEQ ID NO: 1079 - DNA, 2238 bp, Petroselinum crispum
tctctctctcacacacacatcgacaatgtatcgcttcgccaccaagctcgcctccaaatctctgattgctaggaatgctaatcaacagtttgctagtagattagcttggagtcgtaattatgctgccaaagatattaaatttggtgttgaagcacgtgcgatgatgcttcgaggcgttgaagagcttgcagatgctgttaaagttaccatgggacctaaagggcgcaatgttgtcttggaacaaagttatggggctcctaaagtgaccaaagatggtgtcactgttgcaaagagtatcgagttcaaggatagagtgaagaatgttggtgctagccttgtaaagcaggttgcaaatgctacaaatgatgttgctggggatggtaccacctgcgcaacaatcctcactcgtgcaatatactcagaaggatgcaaatctgtggcagctggaatgaacgcaatggatctcagacgtggaatcaatatggctgttgatgctgttgtcacaaacttgaagagccgagcacggatgattagcacatctgaggaaatagcccaggttggcacaatatcagcaaatggagatagagaaattggggaacttattgccaaggccatggaaaaagtcggaaaagagggagttattaccattgctgatgggaaaactctatacaatgaactagaagtggttgagggaatgaagttggacagaggctacatttccccttattttataaccaatactaaaaaccaaaaatgtgaattggatgatccattgattttgattcatgaggaaaaaatatccaacttgaatgctgtggtcaaagtgctcgagttggctttgaagaaacaaagacctttgttgatagtttctgaagatgttgaaagtgaagcgttagcaactctcatattgaataagcttcgtgctggaataaaggtttgtgccataaaagctcctggatttggagagaacaggaaagcgagtttgcaagaccttgcggtcctcactggaggcacagtcataactgaagagcttggtatgacacttgaaaaagttggaattgaaatgcttgggtcttgcaaaaaggttaccatttcaaaggatgataccgttatccttgatggggcaggtgacaagaaagctattgaagaacgctgtgagcaggtaagatcatcaatcgagttgagcacatctgattatgacaaggagaagcatcaggataggctagcgaagctttctggtggtgttgctgtcttaaagattggaggagctagcgaagtcgaggttggggaaaagaaggacagagtaactgatgccttaaatgctacaaaggcagcagttgaagaagggatagtaccaggtggtggtgtagctcttctttatgcctcaaaggaacttgagaacctgcatgctgccaatttcgatcagaagattggaattcaaattattcaaagtgctctcaaggcacctgtgcatacaattgtttccaatgctggagttgagggagctgttgtggtgggtaagcttctggagcaggatgatcccgatcttggatacgatgctgctaaaggtgcatatgtggacatggtcaagtctggaatcatagacccattgaaggtcatcaggacagctttggtagatgctgcaagtgtcgcgtctttgttgactaccactgaggctgtcatagtagaacttccaagtgatgacaaggaaatgacagcaccaggtggcatgggaggcatgggtggcatgggtttctaattaccattagctgacatatctgaagcttgtctcggtgacgatactttgaccataaaaatgagatgtacggagaaaactaatattaggtgaagtttattataatcacgggggcacctctttcattttcaattttcatttgtattaatatatataagtgcttctcggaaagtcgagtaccggcacaatcattctgagagccgaacctttaggaatgcctaaacaactgccttcctctgctggttcagaattagcagtcacccatttgtatatttccccatgtacaagttttacctttaaatcaaaagattcattttgcgaattgtgaggcagaatatattttttatttatctactggggattttctcctattatgtttgaattgaatatttgattaggaagattggaatatgaaggtagttttctagtacccttcgtcatgctactgaacaactgcttctctagttctattctcttgagca

SEQ ID NO: 1080 - DNA, 2014 bp, Triphysaria pusilla
ctcaacaatccagctccattataagccctccttcacagttcacaccatcctcactaagctaaatcaaatccagctcatcaccaccatgtatcgcttcgcctcttctctagcttctaaagcaaggactgccagaagcagccaactggttagcggcagtagattgtcgtggagcagaaattatgcggcaaaggacattagatttggcgttgatgctagggctgcaatgctcagaggcgtcgaagagcttgctgatgctgttaaagtaacaatgggacctaaaggtcgtaatgttattctagaacaaagttatggtggtccaaaagtgacaaaggatggtgttacagtggcaaaaagcattgagtttaaagataaggtcatgaatgttggtgctagccttgttaagcaggttgcaaatgccaccaatgatactgcaggagatggtaccacttgcgcaaccatactcactcgtgcgatatactccgagggctgcaaatcagttgcagctggaatgaatgctatggacttgagacgtgggatcaacatggcagttgatgcggttgtagaaaacttgaaaagcagggcccgaatgattagcacatctgaagagatagcccaggttggtacaatttcggcaaatggagaaagagagattggtgagcttatagccaaagctatggaaagagttggcaaagagggagtgattaccattgcagatggaaagacaatgagtaatgaacttgaagtggtagagggtatgaagcttgacaaaggctacacatcgccttacttcatcaccaacgataagaatcaaaaatgtgaactggaggattgtttaattttaatccatgagaagaaaattgataactttacttccatgatcaaagcactcgagttagctttgaaggatcaaaggcctttgttgattgtttctgaagatattgagagtgaggcattgggtgctctcattctaaacaagcttcgagctggtttgaaggtgtgtgccattaaagctcctggatacggagaaaacagaaaggcatttttacaggaccttgccgtcttaaccggaggcgaggtcatcaccagtgatctaggaatgaatcttgaagatttgactattgaaatgcttggttcgtgcaagaagattacagtatcaaaggatgacactgttattcttgatgggtctggtgataagaagtctattgaagaaagatgtgagcagttacgatcgggaattgagttgagcacttctgattatgacaaggagaagctccaggagaggctcgctaagctttctggtggtgttgctgttttgaagatcggtggagcaagtgaggctgaggttggtgagaagaaggatagagttaccgatgctctgaatgcaacaaaagcagctgttgaggaaggcattgtacctggtggcggtgctgctcttctttatgcttccaaggagctagaaaagttgccaactgccaactttgatcagaaagttggtgtccagataatccagaatgctctcaaggctccggtgtacacaattgcttcaaatgctggggttgagggatctgttgtggtgggcaagctattagagcaggacgatccagaccttggatatgatgcggctaaaggtgaatatgtagacatggtaaaggctggaatcattgatccattgaaagttattagaactgctttggtagatgctgcaagtgtgtcgtccctgttaacaactacggaggctgttgttgttgaacttccaagtagtgagagatcatctccaccaatgggcggcggtggtggaggcatgggtggtatgggcggcatgggaggaatgggtggcatgcgcttttaaggactagaatataattttttattcaaactcgaaactcattcgatttttgtaatgtctagtttcttttaggtttggttggaggtattaatgtttatatattattgaggtggtaggatggaatgcaagtttaggccaaatttcagagatttctcttaatgtttggaa

SEQ ID NO: 1081 - DNA, 1869 bp, Echinacea purpurea
tcaatttcttctggatccttctctttcaccagtatattatcatcctctctacagtctcaatcttcaactcatttcaaccaccacacttcatcctctcaatcctctgcacaaatcgccgtcatgtatcgtcttgccgccaatatcgccaccaaatcacggatcgcgagaaacagtgctcagcagatcggggctaatttgaggtggagtcggaactatgctgcgaaagatattaggtttggagtggatgctagggctttgatgcttagaggtgttgaagagcttgctgatgctgttaaagttacaatgggtcctaagggacgtaacgtggtcatagaacaaagttatggggcacccaaggtgacaaaggatggtgtcaccgttgcaaaaagtatcgagtttaaagacagggtgaagaatgttggtgccagtcttgtaaagcaggttgctaatgccaccaatgatgttgctggtgatggtaccacttgtgcaacagttctcacccgtgcaatttattctgaaggctgcaagtcagttgccgctggaatgaacgccatggatcttagacgtgggatcaccatggcagttgattcagttgtaacaaacttgaagagtagggctagaatgatcagtacatctgaagaaatagcacaggttggtactatatcagcaaatggagaacgagaaattggtgagcttatcgccaaggctatggaaaaagttggtaaagagggtgttattaccatatcggatggcaaaaccctctacaatgaattggaagttgttgagggaatgaagctggatagaggctatatatcaccttacttcgtcaccaatacaaagaaccaaaaatgtgaattagacgacccgttgattttaatacatgagaaaaaatctctagcttaaattctattgtgaaagttctagagctggctttgaagaatcaaagatcacttctgattgttgctgaagatattgaaagtgaggctttagctactctcattcttaacaaacttcgtgctggtatcaaggtttgtgctattaaagcacctggatttggagaaaaccgaaagtcaaatttgcaagaccttgcaactcttaccggaggagaggtcattactgatgaacttggcatgaaccttgagaaaatgtcaccagaaatgctagggacttgcaaaagggttacaatatcaaaggatgatacggttattcttgatggggctggtgacaagaaaaccattgaagaaagatgtgaacagataagatcatcgatcgaattaagcacttctgattatgataaggagaagcttcaagagagattagcaaagctttctggtggtgttgctgttttgaagattggaggagctagtgaagccgaagtcagtgaaaagaaggatagagttacagatgctttaaacgccacaaaggcagcagttgaggagggaatcgtaccaggtggcggtgtggcgcttttatatgcttctaaggagcttgataaacttcagacagccaattttgaccagaagattggtgttcaaattattcagaatgctctcaaggcacctgtgcacacgattgccagcaatgctggagttgaaggtgctgttattgttggaaagcttttggagcaggataaccctgacctcggatatgatgctgctaaaggtcaatatgtagacatggtcaaggaaggaatcatcgatcccttaaaagtaatcaggacagccttgacagatgccgcaagtgtgtcatcgttattaaccacaaccgaagcggtgatcgttgaactaccaaaagaagagaaggaatcagcagcaatgcctccaggcatgggcgactactaaaggcgataataacatcgtttcatttttt

SEQ ID NO: 1082 - DNA, 2342 bp, Populus trichocarpa
cttgacttcacttccgtgtgctcactgctccggattggtgccttagcccccacacaaaaccctaaaccctaaccagcttctctttccttcctcttccttctttgcttttctgcctcattattgttgtctctctctctctatctctcgccatcactaaaccctacgtctacttgctaataaacccgcactctctttctgtcactactctacttacagagccatgtatcgttttgcctctggcctcgcctccaaagccagtggggtggctggcaacaacgccaagcagattggtagtagattggcttggaggagaaattacgcggctaaagacatcaaatttggtgttgaagctcgtgctttgatgcttagaggtgttgaagagcttgctgatgctgttcaagttaccatggggcctaaaggacgtaatgtagttttggaacaaagctggggggctcctaaagtgacaaaagatggtgtaactgtagcaaagagcattgaattccaagacagagttaagaacattggtgctagccttgtgaagcaggttgcaaatgctactaatgatgtggcaggcgatggtaccacatgtgcaactgtccttacccgtgcaatattcgctgaaggatgcaagtctgtggcagctggaatgaatgccatggaccttagacgtgggatctcaatggcagttgaagctgttgtgacaagcttgaagagcagagcaaggatgatcagcacatctgaggaaatagcccaggttgggacaatatcagcaaatggagaaagagagattggtgaacttatagccaaggctatggagaaagttggcaaagagggtgtcattacaatctctgatggaaaaacaatggataatgaattggaggttgttgagggaatgaagctggacaggggctatatatccccttattttatcaccaatgacaagaaccagaaatgtgaattagaagatcctctcattttaattcacgaaaagaagatctcaagcatgagttctactgtcaaagttttagaattggccttgaagaggcaaagacctttgctgattgttgctgaagatttggagggtgaggtactcgcaactctcattttgaacaagcttcgtgctggaatcaaggtttgtgccatcaaagcacctggatttggagaaaataggaaggccagtctgcaggatctttccattctcacagggggtcaggttataaccgaagagctcggcttgaaccttgataatgtgggattggaaatgcttggctcatgcaaaaaggtgacggtatcaaaggatgacactattattcttgatgggcttggtgacaagaaaaccattgaagaaagatgtgagcagttgagatctgctatcggaaccagcacctccgattatgataaagagaagttacaggagcggctagcaaaactttctggtggtgttgcagttttaaagattggtggagccagcgaagctgaagttggtgagaagaaagacagagttactgatgctctgaatgccaccaaggctgctgtagaggagggcattgtacctggtgggggtgttgcacttctttacgcctctaaggagcttgacaaattgcatactgcaaattttgatcagaagatcggtgtccagattatccagaatgctctcaagacacctgttcacactattgctagcaatgcgggggtagagggagcagttgttgttggcaagctattggagcaggacaaccctgaccttggatatgatgcagccaaaggcgagtatgtagacatggtgaaatcaggaattatcgatcctttgaaagtcattagaacagccttggtagatgctgcgagtgtgtcttccttgatgactacaactgaggcaattgtgtatgaacttcccaaggttgaaaaggaaaccccagcaagcaatggcatgagcggcatgggattttgaaactctttagagcattacaaatcagcgctgatttaaacattattgacacaaattttacctgttcttcaattattcaaacatatgcttttataagttaagaaaggtgattcattttttcctgaaaattggccccttcataccagtgtaatcatgtaattttgtcctgctgatccttttctggatatgttctctgcttctactagccctggttactggctaggaatccatggcaaaaactgtcatccttgacagcaagtccatcgccattgatgagaacagatgaaagaacatggcatgcagtaacaataatggctgtagagaaggccaggcccacaactttgaaatgctgatttgatctggtaaaataagatacgatgcacacagcattcgattc

SEQ ID NO: 1083 - DNA, 1766 bp, Catharanthus roseus
caagaagttcagtgcatcaatatgtatcgtttcgctgccaatcttgcctccaaagccagtgttgcttcaagagccagtggacaggctggaagtagacttgcttggagtaggaattatgcggccaaggacattaagtttggtgtcgaagctcgtgctttgatgcttcagggtgttgaggagctagctgaagctgttaaagtcacaatgggtcctaaaggtcgtaatgtcgtcctagaacagagttttggtgcccctaaagtgacaaaggatggtgtaactgtcgcaaagagcattgaatttaaagacagagtaaaaaatattggtgctagcctcgtaaagcaggttgcaaatgctacaaatgatgttgcaggagatggaacaacttgtgcaacaatcctcacacgagcgatatattctgaaggctgcaagtcagttgcagctggaatgaacgccatggacctaaggcgtgggatctcaatggcagttgattctgtagttaccaatttaaagagcagagcaaggatgatcagtacatctgaggagatagcacaggttggcacaatttcagcaaatggtgagagggagattggagaacttatagccaaggctatggaaagagttggcaaagaaggtgttattaccattgctgatggaaaaaccttgtataacgagttggaagtggttgaaggaatgaagcttgatcgcggatatatatcaccttacttcatcaccaaccaaaagaaccaaaaatgcgaaatggatgatcctctgattctcatccatgagaagaaaattgggagtttaaatgctgttattaaagtgcttgagttggccttgaagaggcaaaaacctttgttgattgtgtctgaagatgtggaaagtgaagctttggctacattgattctaaacaagcttcgagctggaattaaggtttgcgccataaaagcccctggttttggagaaaacagaaaagcgaacttacaggaccttgccactcttacaggaggtcaactcataactgaagaacttggtttgaaccttgagaacgtgacaattgatatgcttggttcgtgcaagaaggttactgtttcaaaggatgatacagttattcttgacggtgccggtgacaaaaaaactattgaggaaagatgcgagcagatacgctctgcaatggaattaagcacgtctgactatgataaggagaagcttcaggagagactagctaagctttctggtggtgttgctgttttgaagattggaggagcaagtgaagcagaggttggtgaaaagaaagacagagttacagatgctttaaatgctacaaaagcagcagtggaagaagggattgtgccaggtgggggtgttgcccttctttttgcctcaaaggagctggagaagctgcaaacagctaactttgaccagaagattggtgttcagattatccagaatgcacttaaggccccagttcagacaattgcctcaaatgctggagtcgagggtgctgtagttgttggcaagctattggagcaagacaatgacgatctgggatatgatgcagctaaaggcgaatatgttgacatgggtgaaggcgtggaatcattgacccagtaaaagttatcagaacagctttagttgatgctgccagtgtattcttctttgtctgactacaactgaggctggtcgttgttgaacactacccgaagacggcgaagaaagattctaccagcaagtcgggtgcgaggcgaagtgggtggcagtggtattag

SEQ ID NO: 1084 - DNA, 1975 bp, Flaveria ramosissima
gcagtctccaccatctcacactctacatcttctcctccagttatctccaccaccgccgtcaaaccgccgttactccgccaggtatcgtctcgccgccaacatcgcctccaaatcaaggatcgctagaaacaatgcccagcagatcaactctagtttgagatggaatcggaactatgctgcgaaggatattaaatttggagtggatgctagggctttgatgcttaggggtgttgaagagcttgctgatgccgttaaagttacaatgggtcccaagggacgaaacgtggtcatagaacaaagttacggagctcccaaggtgacaaaggatggtgtcacagtggcaaaaagtattgagtttaaagacagggtgaagaatgttggtgccagtcttgtgaagcaggttgctaatgccaccaatgatgttgctggtgatggtaccacttgtgcaacagttctcacccgggcaatttattctgaaggctgcaagtcagttgcagctggaatgaatgccatggatcttagacgtggaatcaccatggctgttgattcagttgtcacaaacttgaagagtagagctaggatgatcagtacctcggaagaaatagcacaggttggtacaatatcagcaaatggtgaacgagaaattggtgagcttattgccaaggctatggagaaagtgggcaaagagggtgttattaccatatctgatggtaaaacactttacaatgaattggaagtggttgagggaatgaagttggatagaggctatatatcaccttacttcatcactaacacaaagaaccaaaaatgtgaattagacgatcctttgattttaatacatgagaagaaaatctctagcttaaatgctattgttaaagttctagagctggctttgaagaaccaaagatcacttctgattgtagctgaagatattgaaagtgaggccttagccactctcattcttaacaaacttcgtgctggtattaaggtttgtgccatcaaagcccctggatttggagaaaatcgcaagtcaaatttgcaagaccttgcaactcttactggaggagaggtcataactgatgaacttggcatgaaccttgaaaaaatgtcaccagaaatgctagggacttgcaaaaggattacaatatcaaaggatgatacagttattcttgatggggctggtgataagaaagccattgaagaaagatgtgagcagttgagatcatcaattgaattaagcacttcggattatgataaggagaaactccaagagagattggcaaagctttctggtggtgttgctgttttaaagattggagagctagcgaagccgaggtcggtgaaaagaaggatagggttactgatgctttaaatgccacaaaggctgcagttgaggaaggaatcgtaccaggtggtggtgtggctcttctatatgcttccaaggagcttgataatcttcagacagccaattttgatcagaagatcggtgttcaaataattcagaatgctctcaaggcacctgtgcatacgattgctaccaatgcgggagtcgaaggcgctgttattgttggaaagctattggagcaggataaccctgaccttggatatgatgctgctaaaggtcaatatgtagacatggtcaaggaagggattattgaccccctcaaagttatccggacagcattagtagacgctgcaagtgtttcatctttattaaccacaaccgaagctgtggtcgttgagcttccgaaagaagagaaggaaacaccagcaatgccttcaggcatgggtgactactaaaggcaaaagtaacccatttcatatttctccccagataccataaaagttttcaaactgtacaatgagtcgagtttgaactttgatggttgtcgcttagatctgattctctccattggttgagcttttaggattttctttccattctattactgacggacaaccattcatgtatatt

SEQ ID NO: 1085 - DNA, 2094 bp, Chrysanthemum coronarium
aaaatttcaacaaaaccctaaacccttgttctagatccttctttccccctcttcatttctacccacccactctctctctcacactctcattatccaatctctgatccgccgccatcatgtatcgtctagccgccagtctcgcatccaaatcaaggattgctagaaataatgctcaacagctgaggtattatgctgcgaaagatatacgatttggtgtcgatgcgagagcgttgatgctgagaggtgttgaagagctcgctgatgccgttaaagttaccatgggtcctaagggacgtaatgttgtcatagagcaaagttacggagctcctaaggttacaaaggatggtgtcaccgtggcaaagagtattgagtttaaagaccgtgtgaagaatgttggtgctagccttgtcaagcaggttgctaatgctaccaacgatgttgctggcgatggtaccacttgtgccacagttcttacccgtgcaatctattcggaagggtgcaagtcagttgcagctggaatgaatgccatggatcttagacgtgggatcaccatggctgttgattcagtggtcacaaacttgaaaagcagagctagaatgatcagcacatccgaagagattgcacaggttgggaccatatcagcaaatggagagcgtgagattggtgagcttattgctaaagctatggagaaagttggcaaagagggtgttatcaccatttctgatggaaaaacactttacaatgaattggaagtggtcgagggaatgaagttggacagaggttatatatcaccttacttcatcaccaacacaaagaatcaaaaatgtgaattggaagaccctttgatcttaattcacgagaaaaaaatctctagcttaaatgcaattgtgaaagttctagagttggctttgaagaaccaacgatcactgctgattgtttccgaagatattgaaagcgaggcgctggctactctcattcttaacaaactccgcgctggtattaaggtctgtgccattaaagctcctggatttggagagaaccgaaagtcaaacttgcaagaccttgcaactcttaccggaggagaggttataactgatgagcttggcatgaatcttgaaaaaatgtcgccagaaatgcttgggacttgcaaaagggtcacaatatcaaaggatgataccgttattcttgacggggctggtgacaagaaggggattgaagaaagatgtgaacagttaagatcatcgatcgagttaagcacttctgattatgataaggaaaagttccaggagagattagcgaagctttctggtggagttgctgttttgaagattggaggagcaagtgaggctgaggttggtgagaagaaagacagggttaccgatgccttgaatgcaacaaaggctgctgttgaggaaggaattgtgcctgggggtggtgttgctcttttatatgcttccaaggagctggagaaacttgtcaccgccaacttcgatcagaagattggtgttcaaataatccaaaatgctcttaaggcacccgtgcacacaattgcttccaatgctggagttgaaggtgctgttattgttggaaaactgttagagcaggataaccctgaccttggatatgatgctgctaaaggtcaatatgtagacatggttaaggaaggaatcatcgatcctcttaaagttatcaggacagcgttggttgatgctgccagcgtctcatctttattgactacaaccgaagctgtgatagttgaagctcccaaggacgagaaggaatcaccagcaatgactccaggaatgggcgactactgaagcaattgatagctcatttcaatatcatttatttgagaattccaaattgtacaacggattaaagtagtaggtgggttaggtggtatctagatccgattctcttcactgatttgaagtttttgggtttttgtttcgtttctatatatgctccttatggatgctaaacaatcatgtaatcatttgaagggattggaccttgactagaatattataaaggtgaaaaacagttttcaacaaggctttcgatatgaattcaaagatggtataatttttccgt

SEQ ID NO: 1086 - DNA, 1966 bp, Brachypodium distachyon
ccgcaagaaacatcccaagctcgcctcatctcacctcgcctactaagctccgaagcacctcggccccgcgagtcgtctcgacgcctcgccatgtaccgcgcggccgtcagcctcgcctccaaggctcggcaagccgggagcagcgctcgtcaggttggaagcaggcttgcctggagcaggaattatgccgccaaggacatcaagtttggtgttgaggcccgtgctttgatgctgaggggtgttgaggagttggctgatgcagtcaaagtcacaatgggtcctaaggggcgcactgtgattattgagcagagctttggtgcaccaaaagtcacaaaggatggtgtgactgttgccaagagcattgaattcaaggatagagtcaagaatgtcggtgcaagccttgtgaagcaggttgctaatgcaacgaatgatactgctggagatggtaccacatgtgctactgttttgacaaaagcaatatttagtgagggttgcaagtctgtagcagctggaatgaatgcaatggatctgaggcgtggaatctcaatggcggttgatgatgttgtgactaacctgaagggcatggctagaatgatcagcacaccagaggaaatagcgcaggtgggtacaatatcagcaaatggagagagggaaattggtgagcttatcgctaaggctatggagaaggttgggaaagaaggtgtaattacaattgcggatggtaacacactttataatgagcttgaagttgtggaaggcatgaaaattgacagaggttacatctctccttactttattaccaacccgaagacccagaaatgtgaaatggaagacccaatgatcttgatacatgaaaagaagatctcaaacttgcctgcatttgttaaagtgttagagttggctcatgcgaagcaaagacctctactggtcgttgcagaagatctagaaagtgaagcattgggtacgctgattcttaacaagcttcgtgtgggccttaagctctgtgctattaaagctcctggttttggggagaacaggaaagcaaatctacaggaccttgctatccttactgggggagaagtcataagtgaagagcttggaatgagccttgagaactttgatcctcagatgttaggtacatgcaagaaggttactgtttctaaggatgacactgttattcttgatggagctggagacaagaaaaacatggaagagagagcagaacagattaggtctgcaattgaggaaagcacttccgattatgacaaggaaaaactacaggagcggttggcaaagctttctggaggcattgctgttctaaagattggaggagccagcgaagctgaagttagtgagaagaaagacagagtcacagatgcactgaatgccacgaaagctgctgtcgaagagggtattgtgccaggaggtggtgttgcacttctatatgcgtcaaaggctctggataaattgcagactgcaaattttgatcagaagattggtgtgcaaatcattcagaatgctttgaagacaccagtgtacacgattgcctccaatgctggcgttgaaggggcagtggtcgttggtaagcttttggagcaggataacactgatcttggatatgatgcagctaagggtgaatatgtggacatggtgaaggttggcatcattgatccactgaaagtgatcagaactgccttggtagatgctgcaagtgtttcatctctgatgaccaccacagaatccatcatcgtagagatcccgaaagaggagaaagaggcacctgcaatgggcggcatgggtggaatggattactgaggaggcatcagacctacgaatctgggacatacggagtgcttagcaatttttttgcggtgtaggatcttatcttgtcggacagttttggtactgtgaacttagtatatctctcggaactactgtttgggcgaataaaaagttgttctgcaag

SEQ ID NO: 1087 - DNA, 2011 bp, Brachypodium distachyon
cctctcccttccccattcctttccccctccgcaagaaacatcccaagctcgcctcatctcacctcgcctactaagctccgaagcacctcggccccgcgagtcgtctcgacgcctcgccatgtaccgcgcggccgtcagcctcgcctccaaggctcggcaagccgggagcagcgctcgtcaggttggaagcaggcttgcctggagcaggaattatgccgccaaggacatcaagtttggtgttgaggcccgtgctttgatgctgaggggtgttgaggagttggctgatgcagtcaaagtcacaatgggtcctaaggggcgcactgtgattattgagcagagctttggtgcaccaaaagtcacaaaggatggtgtgactgttgccaagagcattgaattcaaggatagagtcaagaatgtcggtgcaagccttgtgaagcaggttgctaatgcaacgaatgatactgctggagatggtaccacatgtgctactgttttgacaaaagcaatatttagtgagggttgcaagtctgtagcagctggaatgaatgcaatggatctgaggcgtggaatctcaatggcggttgatgatgttgtgactaacctgaagggcatggctagaatgatcagcacaccagaggaaatagcgcaggtgggtacaatatcagcaaatggagagagggaaattggtgagcttatcgctaaggctatggagaaggttgggaaagaaggtgtaattacaattgcggatggtaacacactttataatgagcttgaagttgtggaaggcatgaaaattgacagaggttacatctctccttactttattaccaacccgaagacccagaaatgtgaaatggaagacccaatgatcttgatacatgaaaagaagatctcaaacttgcctgcatttgttaaagtgttagagttggctcatgcgaagcaaagacctctactggtcgttgcagaagatctagaaagtgaagcattgggtacgctgattcttaacaagcttcgtgtgggccttaagctctgtgctattaaagctcctggttttggggagaacaggaaagcaaatctacaggaccttgctatccttactgggggagaagtcataagtgaagagcttggaatgagccttgagaactttgatcctcagatgttaggtacatgcaagaaggttactgtttctaaggatgacactgttattcttgatggagctggagacaagaaaaacatggaagagagagcagaacagattaggtctgcaattgaggaaagcacttccgattatgacaaggaaaaactacaggagcggttggcaaagctttctggaggcattgctgttctaaagattggaggagccagcgaagctgaagttagtgagaagaaagacagagtcacagatgcactgaatgccacgaaagctgctgtcgaagagggtattgtgccaggaggtggtgttgcacttctatatgcgtcaaaggctctggataaattgcagactgcaaattttgatcagaagattggtgtgcaaatcattcagaatgctttgaagacaccagtgtacacgattgcctccaatgctggcgttgaaggggcagtggtcgttggtaagcttttggagcaggataacactgatcttggatatgatgcagctaagggtgaatatgtggacatggtgaaggttggcatcattgatccactgaaagtgatcagaactgccttggtagatgctgcaagtgtttcatctctgatgaccaccacagaatccatcatcgtagagatcccgaaagaggagaaagaggcacctgcaatgggcggcatgggtggaatggattactgaggaggcatcagacctacgaatctgggacatacggagtgcttagcaatttttttgcggtgtaggatcttatcttgtcggacagttttggtactgtgaacttagtatatctctcggaactactgtttgggcgaataaaaagttgttctgcaagtagttcttgagagctga

SEQ ID NO: 1088 - DNA, 2061 bp, Festuca arundinacea
ctcgcctcctagctccgaagcacctcgactcccgcgccatctctttgcccagccatgtatcgtgcggccgccagcctcgcctccaaggctcggcaagccgggagcagcgctcgtcaggttggaagcaggcttgcctggagcaggaactatgcagccaaggacatcaagtttggtgtcgatgctcgtgctttgatgctgaggggtgttgaagagttggccgatgctgtgaaagtgacaatgggtcctaagggacgcactgtcatcattgaacagagctttggtgcaccgaaagtcacaaaggacggtgtcactgttgccaagagcattgaattcaaggacagagtcaagaatgttggtgcaagtctagtaaagcaggttgctaatgcaactaatgatactgctggagatggtacaacatgtgctactgttttgacaaaagcaatttttactgagggttgcaagtctgtagcggctggaatgaatgcaatggatctaaggcgtggaatctcaatggcggttgatgatgttgtgacaaacctaaagggcatggctaaaatgatcagcacatcagaggaaatagcacaggtgggtacaatatcagcaaatggggaaagagaaattggtgagctgattgctaaggctatggagaaggttgggaaagaagatgtaatcaccattgcggatggtaatacccttcataatgagcttgaagttgtggaaggcatgaagcttgacaggggttacatctctccatactttgttaccaaccaaaagacccagaaatgtgaattagaagaccccttgatcttgatacacgacaagaagatttcaaacatgcatgcagtagttaaagtgttagagatggctctgaagaaacaaaggtctctactgattgttgcagaagatctagaaagtgaagcattgggcactctgattcttaacaagcttcgtgcaggcattaaggtctgtgctgttaaagctcctggttttggggataacaggaaggcaaatttacaggaccttgctgtccttactgggggagaagtcatatctgaagagattgggatgaaccttgagaactttgattttcagatgttaggtacctgcaaaaaggtgactgtttctaaggatgacactgttattcttgatggagctggggataagaagaacattgaagagagagcagaacagattagatctgcaattgagcaaaccacttctgattatgacaaagaaaaactggaggggcggttggcaaagctttctggaggtgttgctgttctaaagatcggaggagccagtgaagctgaagttagcgagaagaaagacagagttacagatgcactcaatgccactaaagctgctgttgaagagggtattgtgccaggaggtggtgttgcacttctatatgcatcaaaggctctggacaaactgcagactgcaaacttcgatcagaagattggagtacaaatcattcagaatgctttgaagacaccagtgtacacgattgcttccaatgcaggcgtagaaggggcagtggttgttggtaagcttttggagcaagataacactgatcttggatatgatgcagctaaaggcgaatatgtggacatggtgaaggtcggtatcattgaccctctaaaggtgatcagaactgccttggtggatgctgccagtgtatcatctttgatgaccaccacagaagccatcatagtagagtctcctaaagaggagaaagaggcacctgcaatgggcggcatgggtggaatggattactaagctctcacccacgacatatggaagcagtctgggatatattataactaggaattttttgcggtgtactcccatctctgatgtaattctattttcggtgggtatattgtcggacagttcttgttcctgcggacttagtatatctcagttccaaacggaactagtgttggggtgaataaaagtagagctaaaactgttcatcggaattgacatgacaccttctgcagaagatccaatctttcataaaagagtgtactttgtaacaaaaaaaaaaaaaaaaaaaaa

SEQ ID NO: 1089 - DNA, 2076 bp, Chrysanthemum coronarium
cttgttctagatccttctttccccctcttcatttccacccacccacccactctctctctcacactctcattatccaatctctgatccgccgccatcatgtatcgtctagccgccagtctcgcatccaaatcaaggattgctagaaataatgctcaacagctgaggtattatgctgcgaaagatatacgatttggtgtcgatgcgagagcgttgatgctgagaggtgttgaagagctcgctgatgccgttaaagttaccatgggtcctaagggacgtaatgttgtcatagagcaaagttacggagctcctaaggttacaaaggatggtgtcaccgtggcaaagagtattgagtttaaagaccgtgtgaagaatgttggtgctagccttgtcaagcaggttgctaatgctaccaacgatgttgctggcgatggtaccacttgtgccacagttcttacccgtgcaatctattcggaagggtgcaagtcagttgcagcgggaatgaatgccatggatcttagacgtgggatcaccatggctgttgattcagtggtcacaaacttgaaaagcagagctagaatgatcagcacatccgaagagattgcacaggttgggaccatatcagcaaatggagagcgtgagattggtgagcttattgctaaagctatggagaaagttggcaaagagggtgttatcaccatttctgatggaaaaacactttacaatgaattggaagtggtcgagggaatgaagttggacagaggttatatatcaccttacttcatcaccaacacaaagaaccaaaaatgtgaattggaagaccctttgatcttaattcacgagaaaaaaatctctagcttaaatgcaattgtgaaagtcctagagttggctttgaagaaccaacgatcactgctgattgtttccgaagatattgaaagcgaggcgttggctactctcattcttaacaaactccgcgctggtattaaggtctgtgccattaaagctcctggatttggagagaaccgaaagtcaaacttgcaagaccttgcaactcttactggaggagaggttataactgatgagcttggcatgaatcttgaaaaaatgtcgccagaaatgcttgggacttgcaaaagggtcacaatatcaaaggatgataccgttattcttgacggggctggtgacaagaaggggattgaagaaagatgtgaacagttaagatcatcgatcgagttaagcacttctgattatgataaggaaaaattccaggagagattagcgaagctttctggtggagttgctgttttgaagattggaggagccagtgaggctgaggttggtgagaagaaagacagggttaccgatgccttgaatgcaacaaaggctgctgttgaggaaggaattgtgcctgggggcggtgttgctcttttatatgcttccaaggagctggagaaacttgtcaccgccaacttcgatcagaagattggtgttcaaataatccaaaatgctcttaaggcaccggtgcacacaattgcttccaatgctggagttgaaggtgctgttattgttggaaaactgctagagcaggataaccctgactttggatatgatgctgctaaaggtcaatatgtagacatggttaaggaaggaattattgaccctcttaaagttatcaggacagcgttggttgatgctgccagtgtctcatctttattgactaccaccgaagctgtgattgttgaagctcccaaggacgagaaagaatcaccagcaatgactccaggaatgggtgactactgatgcaattgatggctcatttcaatatcattctttccatatattttgagagtgctgaaactgtacaacggattaaagtagtaggcgggttaggtgttatctagatccgattctcttcactgatttgaagttttttgggtttttgtttcgtttctatatacgatgctaaacaatcctgtaatcatttgaagggattggaccttgactaaaattttataaaggtgaaaaacagttttcaacaaggctttcgatatgaattcaaagatggtataatttttccgt

SEQ ID NO: 1090 - DNA, 1740 bp, Chrysanthemum coronarium
cttcgccgtcaatctcgcttcaaaatcacggctacttaggaacaattctcaacagataagtagtaggttaggttggagtcgaaactatgcggcgaaagatattagatttggagttgaagcaagggctatgatgcttagaggtgttgaagatcttgctgatgctgttcaagtcactatgggccccaaaggtcgtaatgttgttatcgagcaaagttatggagcccccaaggtgacaaaggacggtgtcaccgtggcaaaaagtattgagttcagagacagggttaagaatgttggtgctagccttgtcaagcaggttgctaatgctactaatgatgttgctggtgacggtacaacatgtgcgaccgtcctcacacgcgcaatatattctgaaggctgcaagtcagttgcagctggaatgaacgccatggatcttagacgtgggatcactatggctgttgattcagtggtcacaaatttgaagagcagagctagaatgatcagcacatccgaagagatagcacaggttgggacaatatcagcaaatggagaacgcgagattggtgaacttattgctaaggctatggagaaagttggaaaggagggtgttattactatatctgatggaaaaacactttacaatgaattggaagtggtcgagggaatgaagttggacagaggttatatatcaccttacttcatcaccaacacaaagaatcaaaaatgtgaattggaagaccctttgatcttaattcatgagaaaaaaatctctagcttaaatgcaattgtgaaagttctagagttggctttgaagaaccaacgatcactgctgattgtttccgaagatattgaaagcgaggcgctggctactctcattcttaacaaactccgcgctggtattaaggtctgtgccattaaagctcctggatttggagagaaccgaaagtcaaacttgcaagaccttgcaactcttactggaggagaggttataactgacgagcttggcatgaatcttgaaaaaatgtcgccagaaatgcttgggacttgcaaaagggtcacaatatcaaaggatgataccgttattcttgacggggctggcgacaagaaggggattgaagaaagatgtgaacagttaagatcatcgatcgagttaagcacttctgattatgataaggaaaaattccaggagagattagcgaagctttctggtggagttgctgttttgaagattggaggagcaagtgaggctgaggttggtgagaagaaagacagggttaccgatgccttgaatgcaacaaaggctgctgttgaggaaggaattgtgcctgggggtggtgttgctcttttatatgcttctaaggagctggaaaaacttgtcaccgccaacttcgatcagaagattggtgttcaaataatccaaaatgctcttaaggcacccgtgcacacaattgcttccaatgctggagttgaaggtgctgttattgttggaaaactgttagagcaggataaccctgaccttggatatgatgctgctaaaggtcaatatgtagacatggttaaggaaggaatcatcgatcctcttaaagttatcaggacagcgttggttgatgctgccagcgtctcatctttattgactacaaccgaagctgtgatagttgaagctcccaaggacgagaaggaatcaccagcaatgactccaggaatgggcgactactgaagcaattgatagctcatttcaatatc

SEQ ID NO: 1091 - DNA, 1829 bp, Arnica chamissonis
tccttctccctctccaaaatcttgagcaagcaatcatgtatcgtttcgcagtaaatcttgcctccaaatctaggatcgcaaacaacacaactcaacagattggaagtaggttgaattgtagcagaaactacgcagctaaagacatcagatttggagttgatgctagggctttaatgcttagaggtgttgaagagcttgctgatgccgttagagtaactatgggtccaaaggggcgtaatgtggtgattgaacaaagttatggagcaccaaaagtaacaaaagatggtgtaactgttgcaaaagccattgagtttaatgataaagtcaagaatgttggtgcaagtcttgtgaaacaagttgctaatgctacaaacgatgttgctggtgatggtactacttgcgcaacagtccttacacatgcaatattttcagaagggtgcaaatcggttgcagctggtgtgaatgcaatggacctcaggcggggtatttccatggcggttgatgcggttgtaacaaacttgaagagtagggcctgcatgataagcacgtctgaggaaatcacacaggtgggtacaatttctgcaaatggagaacgtgaaataggtgagctaattgccaaagctatggagaaagttgggaaagagggtgtcatcacaattcaagatgggaagacattgtataatgaacttgaagttgttgagggaatgaagttggacaggggatacatatctccacatttcattacaaaccaaaaaaatcaaaaatgtgaactagatgatcctattgttctaatatacgagaagaagatttcaaacattaattcggttatcaaagtgttagaattggcactgaagaaacaaaggcccctgttgatagttgctgaagacgtggaaagtgaagcattggctactttaattcttaacaagcttcgtgctggaattaaggtttgtgctataaaagcacctggttttggcgagaacagaaaggcaaacttgcaagatcttgccactcttaccggtggtcagcttataactgaagaactcggtatgaatcttgacaatgtggagcccgaaatgcttggctcttgtaaaaaggtcactgcatctaaagatgatacagttgtgcttgatggtgctggtgataagaagtctatagaagaacggtgtgaacagataagatcagcaattgaatctagcacgtctgattatgataaagagaaattgcaagaaaggttagccaagctttctggtggcgttgctgtactcaagattggaggagctagtgacactgaagtaggtgaaaaaaaagatagagttacggatgctttaaatgccacaaaggcagctgttgaggaaggaattgttccaggtggtggtgttgctcttctgtatgcttctaaagaattggataagttgcaaacagccaattttgatcagaaaataggggtccagattattcaaaatgcactaaagatgcctgttcatacaattgcttctaatgctggagtggagggttcagttgtggttggtaagcttttagagcatgatgacccggatctggggtatgatgcagctaaaggtgaatatgtggatatggtgaaaaatggaatcattgacccgctgaaagtgattagaacagccttggttgatgcagcaagtgtgtcttctctgatgacaaccactgaagctattgtggtagaattccccaaaccggctagtgaagcggctccaggaatgggcggtggaatgggtggcatgggcggcatgggctttttgacctgccatgtgatacttcaaccattgacatacatgttactgacaaaataaaca

SEQ ID NO: 1092 - DNA, 2039 bp, Brachypodium distachyon
cgccgcctcctagctccccggaaccacccgcaagatccaacacttccttccctccttcgccatgtaccgcgcggccgccagcctcgcctccaaggcccggcaagccgggagcagcgcccgccaggttgggagcaggctagcctggagcaggaactatgctgccaaggacatcaggtttggcgtcgaagcccgggccttgatgctgagtggtgtcgaagagttggctgacgcagttaaagtgaccatgggtcctaagggacgcactgtcattattgagcaaagctttggtgctccaaaagttacaaaggatggagtgaccgttgcaaagagcatcgaattcactgacagggtaaagaatgttggtgcaagtcttgtgaagcaggttgctaatgcgactaatgatactgctggggatggtacaacatgcgctactgttctgacaaaggctatattcactgagggttgcaagtctgtagcagctggaatgaatgcaatggatctgagacgaggtatctcgatggctgttgattctgtggtgacaaacctgaagggtatggcgagaatgatcaacacgccggaggagatagcacaggtgggtactatatcagctaatggggaaagggagattggtgagctcattgcaaaggctatggagaaggttggtaaggagggagttatcaccattgcggatggtaaaactctttacaatgagcttgatgttgtggaaggcatgaagtttgagaggggttacatctctccgtacttcattaccaaccaaaagagccagaagtgtgaactagaggatcccttaatcttgatacatgagaagaagatatccagttttcccgcgatggtcaaggtgttggaatatgctctcaagatgaaaaagcctctgcttattgttgcagaagatttagaaagtgaagcactgggtaccctgattattaacaagcttcgcataaacatgaaggtctgtgcagtgaaagctcctggttttggagagaacaggaaatctaacttacaggaccttgctatccttacagggggtgaagtcataaccgaggaacttggaatgaaccttgagaactttgagcctcatgtgctgggtacttgcaagaaggttacggtatctaaggatgacacagttgtccttgatggagctggagataagaaagccattgaagagagagctgaacagctgagatctgcaattgaggaaagcacttctgactatgataaggaaaagatacaggagcgattggcaaagctttctggtggtatcgctgttctgaagattggtggagcgagtgaacctgaagttggtgaaaagaaggacagagtgactgatgccctaaatgctacaaaagctgcagtagaggagggcattgttccaggtggtggtgttgcccttctttatgcctcaagagatctcgataagttgcagactgccaactttgaccaaaagattggtgtccagatcattcaaaatgctttgaagaccccagtacacaccattgcgtcaaatgctggtgtagaaggagctgtcattgttggcaagctcttggaacaggataatactgacctaggctatgatgctgccaaaggtgagtatgtggacatgataaaggctggtatcattgacccactcaaagtgatcagaacagccctggtggatgctgcaagtgtgtcgtctctgatgaccaccacagaagctatcattgttgagacccccacggaagagaagtcggcacctgcaatgggtggtggcatgggcgggatgggtttctaactcacggattcgtgccaaaacaatgtgattatgtgaaacacttaggctagtatcattgggcagtatggattcttcgctatggacttgccagtgtctttttgcagtacggattcatctctatggatgaggaggctatcacattttgtattcttcgacaagaagattcaaacttgaaacagagtttatggtggttccatacaagcattggacttgaaattaagaactgaagctcttttatgcctagatggct

SEQ ID NO: 1093 - DNA, 2122 bp, Brachypodium distachyon
ccccctcccgctcgccgcctcctagctccccggaaccacccgcaagatccaacacttccttccctccttcgccatgtaccgcgcggccgccagcctcgcctccaaggcccggcaagccgggagcagcgcccgccaggttgggagcaggctagcctggagcaggaactatgctgccaaggacatcaggtttggcgtcgaagcccgggccttgatgctgagtggtgtcgaagagttggctgacgcagttaaagtgaccatgggtcctaagggacgcactgtcattattgagcaaagctttggtgctccaaaagttacaaaggatggagtgaccgttgcaaagagcatcgaattcactgacagggtaaagaatgttggtgcaagtcttgtgaagcaggttgctaatgcgactaatgatactgctggggatggtacaacatgcgctactgttctgacaaaggctatattcactgagggttgcaagtctgtagcagctggaatgaatgcaatggatctgagacgaggtatctcgatggctgttgattctgtggtgacaaacctgaagggtatggcgagaatgatcaacacgccggaggagatagcacaggtgggtactatatcagctaatggggaaagggagattggtgagctcattgcaaaggctatggagaaggttggtaaggagggagttatcaccattgcggatggtaaaactctttacaatgagcttgatgttgtggaaggcatgaagtttgagaggggttacatctctccgtacttcattaccaaccaaaagagccagaagtgtgaactagaggatcccttaatcttgatacatgagaagaagatatccagttttcccgcgatggtcaaggtgttggaatatgctctcaagatgaaaaagcctctgcttattgttgcagaagatttagaaagtgaagcactgggtaccctgattattaacaagcttcgcataaacatgaaggtctgtgcagtgaaagctcctggttttggagagaacaggaaatctaacttacaggaccttgctatccttacagggggtgaagtcataaccgaggaacttggaatgaaccttgagaactttgagcctcatgtgctgggtacttgcaagaaggttacggtatctaaggatgacacagttgtccttgatggagctggagataagaaagccattgaagagagagctgaacagctgagatctgcaattgaggaaagcacttctgactatgataaggaaaagatacaggagcgattggcaaagctttctggtggtatcgctgttctgaagattggtggagcgagtgaacctgaagttggtgaaaagaaggacagagtgactgatgccctaaatgctacaaaagctgcagtagaggagggcattgttccaggtggtggtgttgcccttctttatgcctcaagagatctcgataagttgcagactgccaactttgaccaaaagattggtgtccagatcattcaaaatgctttgaagaccccagtacacaccattgcgtcaaatgctggtgtagaaggagctgtcattgttggcaagctcttggaacaggataatactgacctaggctatgatgctgccaaaggtgagtatgtggacatgataaaggctggtatcattgacccactcaaagtgatcagaacagccctggtggatgctgcaagtgtgtcgtctctgatgaccaccacagaagctatcattgttgagacccccacggaagagaagtcggcacctgcaatgggtggtggcatgggcgggatgggtttctaactcacggattcgtgccaaaacaatgtgattatgtgaaacacttaggctagtatcattgggcagtatggattcttcgctatggacttgccagtgtctttttgcagtacggattcatctctatggatgaggaggctatcacattttgtattcttcgacaagaagattcaaacttgaaacagagtttatggtggttccatacaagcattggacttgaaattaagaactgaagctcttttatgcctagatggctagatgtagtcttttgaggttcactgtgttgactatgccaatgcgcaattcgcaagatgtggttatatctgt

SEQ ID NO: 1094 - DNA, 2117 bp, Theobroma cacao
tggattcttctgtcctcccttcatttatgctctctctttctctcgctctctaagacctctcttaaactctaaaacgttgtccgctgctttgccaccgcgctccgccaccatgtaccgctttgccacgtcccttgcctctaaagctaggttggctaagaacaacacccaattgattgctagtagattgagttggagtcgaaactatgcggctaaagacattaaatttggtgtagaagcacgcgccttgatgcttaggggagttgaagagctggccgatgctgttaaagtgaccatgggtccaaaagggcgtaatgttgttttggaacaaagttttggggccccgaaggtgacaaaagatggtgttaccgtagccaagagcattgaatttaaagacagagtaaaaaatattggtgcttccctagtaaagcaggttgcaagtgccaccaatgatgttgctggggatggcaccacttgtgcgacagtcctcacccgtgcaatatttgttgaaggatgcaagtcagtggcagctggaatgaatgccatggacctcaggcgaggaattacaatggccgttgatgcagtggtgacaaacttgaagagcagagcacggatgattagcacatctgaggaaattgctcaggttggaactatatctgcaaatggagagagggagattggtgagctaattgccaaggctatggagaaagttggcaaagagggtgttattaccattgctgatggaaaaaccttgtgcaatgaattggaggttgttgagggaatgaagcttgacaggggctacatatccccttactttatcaccaaccagaagaaccaaaaatgtgaattagaaaacccactcattttgatccatgagaagaagatctcaaacttgcctgctttggttaaatttttggaattgtccttgtcaaagcaaaggcctttactaatcgttgctgaagatcttgaaagtgaagcacttgcaactctcattctgaacaagcttcgtgttggaatcaaggtgtgtgccattaaagccccagggtttggagaaaataggaaagctggtttgcaggaccttgctgctctcactggaggcgaggtagtgactgaagaacttggtcttaatatcgaaaaggtgggagcagaagtgcttggctcttgcaaaaaggttacagtatcaaaggatgacacaattatccttgatggggctggagacaaggctgccattgaagaaagatgcgaccaaataagatctgcaatggaatcaagcacttctgattatgataaggacaagttacaagagcggcttgcaaagctttctggtggtgttgcagttttgaagattggaggagcaagtgaagcagaagttggtgaaaagaaggatagagttactgatgccctaaatgcgacaaaagctgctgtggaggaaggaattgttcctggtggtggtgttgcacttctttatgcctcaaaggagcttgaaaacctacacactgcaaactttgatcagaagattggtgttcagatcatccagaatgctcttatgatgcctgtacacgcaattgcttccaatgctggagtagagggggcagtgattgttggcaagctactggaacaggataatcctgaccttggatatgatgcagctaaaggtgagtacgtagacatggtaaaagcgggaatcattgatccattgaaagtcataaggacagccttggtagatgctgcaagtgtgtcctctttgatgaccacaactgaagcaattgttaccgaacttcccaacgatgagaaggcaggcccagcagccccaggtggcatgggcggcctagattactaagctttcacaattcacaggcaggaagagtggggatgctgtattccaaatttcttgatacaaattttttatatgacaaaactgtaacaagagaagagaatattctagggcagagaggagctggcatccttccttgagaactttcttgtctcccctgttcattgagtaatccaattttttgcttgtggttgtttctcttttctcctgcaagactcccaacatcacctgatcatagtggcgcaaggtgtttgtattccgtggttagacttgtagtaatgatctg

SEQ ID NO: 1095 - DNA, 1963 bp, Arnica chamissonis
ctcctttcaattctccgcaccaccgccgtcaatccgtcatgtatcgtctcgccgccaatatcgcgtccaaatcaaggatcgcaagaaacaatgctcagcagatcagctctaatttgagctggaatcggaactatgccgcgaaagacattagatttggagtggatgctagagctttgatgcttaggggtattgaagagcttgctgatgccgttaaagttacaatgggtcccaagggacggaacgtggtcatagaacaaagttatggagctcccaaggtgacaaaggatggtgtcactgtggcaaaaagtatcgagtttaaagacagggtgaagaatgttggtgccagtcttgtgaagcaggttgctaatgccaccaatgatgttgctggtgatggaaccacttgtgcaacagttctcacccgggcaatttattctgaaggctgcaagtcggttgcagctggaatgaacgccatggatcttagacgtgggatcaccatggccgttgattccgttgtcacaaacttgaagagtagagctaggatgatcagtacatctgaagaaatagcacaggttggtacaatatcggcaaatggagaacgagagattggtgagcttattgccaaggctatggagaaagttggcaaagagggtgttataaccatatctgatggtaaaacactttacaatgaattggaagtggttgagggaatgaagttggatagagggtatatatcaccttacttcatcaccaatacaaagaaccaaaaatgtgaattagatgaccctttggttttaatacatgagaaaaaaatctctagcttaaattctattgttaaagttctagagttggctttgaagaatcaaagatcacttctgattgtagctgaagatattgaaagtgaggccttagccactctcattcttaacaaacttcgtgctggtatcaaggtttgtgccatcaaagcccctggatttggagcaaaccgaaaatcaaatttgcaagaccttgcaactcttactggaggagaggtcataactgatgaacttggcatgaaccttgaaaaattggcaccagaaatgctagggacttgcaaaagggttacaatatccaaggatgatacagttattctgatggggctggtgataagaaagccattgagaaagatgtgaacagctgaggtcatcaattgaattgagcacttctgattatgataaggagaagcttcaagagagattagcaaagctttctggtggtgttgctgttttgaagattggaggagcaagtgaagctgaggttagtgaaaagaaggatagggttactgatgcgttaaatgccacaaaggctgcagttgaggaaggaatcgtaccaggtggtggtgtggctcttctatacgcttccaaggagcttgataatcttcaaacagccaattttgatcagaagattggtgttcaaataattcagaatgctctcaaggcacccgtgtacacgattgccagcaatgctggagtcgaaggtgctgttatcgttggaaagctattggagcaggataaccctgactttggatacgatgctgctaaaggtcaatatgtagacatggtcaaggaaggaatcatgaccccctgaaagttatcaggaccacattagtcgatgccgcaagtgtgtcatctttattaaccacaactgaagctgtgattgttgaacttccaaaagatgagaaggaatcagcagcaatgcctggaggcatgggtgactattaaagacgacaataactcattccattttttctatcataatgagaattttcaaactgtacaactgatcggattagtagttctgatagttttcatctagagtgctcgggttttgactggtaatttattatccccacaaacaagttccaactattggtttgtgtctgattgtatgaagtcgcattttcggtaataaagttgaagctataata

SEQ ID NO: 1096 - DNA, 2266 bp, Oryza sativa
ggatccttctagaaaccccacccgcccgcctctccctcttcctcgcgtttctttccccctccacaagtagctctctccccgccggtctccgggtagccgcctccgaacccagccgagagctcgaagcctttccttactctcttgccatgtaccgcgcggcggccagcctcgcctccaaggcccgtcaagccgggagcagcgctcgtcagattgggagtaggctcgccttgcatagaaactatgctgccaaggacatcaagtttggtgtcgaggcccgggccttgatgttgaggggtgttgaggagttggctgatgcggtcaaagtgacaatgggtcctaaggggcgcactgttgttattgagcaaagctttggtgctcctaaagttacaaaggatggagttactgttgccaagagcattgaattcagtaacagggttaagaatgttggtgcaagccttgtgaagcaggttgctaatgcgactaacgacactgctggggatgggacaacatgtgctactgttcttacaaaagctatattcgctgagggatgcaagtctgtagcagctggaatgaatgcgatggatttgagacgtggtatctcgatggctgttgatgaagtagtgacaaatttaaaaggcatggccagaatgattagcacatcagaggaaatagcacaggttggtactatatcagctaatggggaaagggaaattggtgagctcattgcaaaagctatggagaaggttggcaaagagggagtcatcactattacggatggtaacaccctctacaatgagcttgaagttgtagaaggcatgaaacttgacagaggttatatctctccttacttcattaccaaccaaaagaaccagaaatgtgaactagacgacccactgatcttgatacatgacaagaaagtgtccaaccttcatgctgtggtgaaagtgttggagttagctctgaagaagcaaaggcctctgcttattgttgcagaggatgtagaaagtgaagcattgggtactctgattattaacaagcttcgtgcaggcattaaggtttgtgcagtcaaagctcctgggtttggggagagcaggaaagccaacttacaggacctcgctatccttactgggggagaagtcataactgaagaacttggaatgaaccttgagaattttgagcctcagatgctggggacttgcaagaaggttacagtatctaaggatgacacagtcatccttgatggagctggagataagaaggccattgaagagagagctgagcagctgagatctgcaattgagctaagcacttctgactatgataaagagaagcttcaggagcggttagcaaagctttctggtggtgttgctgttctaaagattggtggagctagtgaagcggaggttggtgagaagaaggatagagtgactgatgcactaaatgctaccaaagctgctgtagaggagggtattgtaccaggtggtggagttgcccttctgtatgcatcaaaagatctggataaattgcagactgcgaactttgaccaaaagattggtgtccagatcattcaaaatgctttgaagaccccagtgcacacaattgcttcgaatgcgggtgtagaaggatctgtcattattggcaagcttttggaacaggataatactgatctaggttatgatgctgctaaaggtgaatacgttgacatggtgaagtctggtatcattgacccactaaaagttatcagaacagctctggtggatgctgcaagtgtgtcctctctaatgactaccacagaatctattattgttgagatccccaaggaagaggaggcagcagccgcagcacccgcaatgggtggcatgggcgggatgggtttctagcttactctccggctcatgcaaagttattgtgtgataaatttattcactagattagattatttttgcggtgcggacatctttaactgatgaggtggctgtcagattttgattctgctgcaagagaattgtaacttgaagtagtagaattgaactttggaatttgggatgcataaaatccttctatataggtggtgcaagttggattttgtgatttgctctgggtttgcctattttcgcttttgctcgagcaatccaagaacagtactacttcgataaatgtgcgagttccctgtgactggtccgtttagaattagtttaatcttaactttcagccacttctaactcaaagcaaagaatgaagctactgtggcaatttttccggattt

SEQ ID NO: 1097 - DNA, 2364 bp, Prunus mume
gttagagaatccgacccgagaaaaatattgggtcagagaaaattggtctacagagggtccaaatgaaagcccacagtccagcattgtcaacagaagggtccgtggctttcggctttagtaaatggatcatgccttctccaaaccctccaaaaccctaaaccctaacatacaccaattccttctagacttttctctgctccacaatttatactctccttctctctgtctctttcttttacctgagagctcatactttctcattctattttctctcttctctgcaagttcatcatgtaccgcttcgccggcagcctcgcctctaaagccaggttggctaggaactgtacccaacagattggcagtagtttgatttcgagaaggaactatgcggccaaagatatcaaattcggtgtggaagcccgggcattgatgctcaagggtgtggaagagctcgctgatgctgttaaagtcacaatggggccaaaaggacgcaatgttgttctggaacaaagctttggggcccctaaagtgacaaaggatggtgtcactgtagcaaagagcattgagttcagagataaagtcaagaacattggtgctagtcttgtaaagcaggtcgcaaatgctaccaatgatgctgcaggggatggtaccacttgtgctacagtcctcacccgcgctatatttactgaaggatgcaaatcagtggcagctggaatgaatgcaatggacctaagacgaggcatttcaatggcagttgattctgttgtgacaaacttgaagagtagggctcggatgatcagcacatctgaagaaatagctcaggttgggaccatatcagctaatggagagagagaaattggtgaactaatcgctaaggctatggagaaagttggcaaagagggtgttattaccattgctgatggaaaaacattgtataatgaattggaggttgttgaaggaatgaagctagataggggatatatatccccttactttattaccaatcctaagaaccaaaaatgtgaattagaagatccactcgtcttaatccatgagaagaaaatctcaaatctaaattcgatagtgaaaatattagagctggcattgaagaagcaaagacctcttttgattgttgctgaggatgtggaaagtgaagcacttgctacactcattataaacaagcttcgtgctggaattaaggtttgtgcaattaaagcccctggatttggagaaaacaggaaggcaaatttgcaggacctagccattcttacgggaggcgaggtaataactgaagagcttggtctgaaccttgacaaagttggagtagaaacacttggaacctgcaaaagggttacaatatcaaaagatgacactgttattcttgatggggctggtgacaagaaagccattgaagaaagatgtgaacagctgagatcatcaattgaattgagcacttctgattatgacaattaccatttgcaatatactggtgctagctcttgaaaacaagtctgattgagacctactttgtagattggcggagcgagcgaagcagaagttagtgaaaagaaggacagagtaactgatgctctaaatgccaccaaggctgctgtggaggaaggaatcgtacctggtggtggtgctgcactgctttatgcctcaaaggagctggacaagttggcaactgcaaactttgaccagaagattggtgttcaaattattcagaatgctcttaagatgcctgtatccacaattgcttctaatgctggagttgagggggcagttgttgttggcaaactattggagcaggacaatcctgaccttggatacgatgcagcaaaaggtgaatatgtagacatgataaaggcagggatcattgatccattgaaagtcatcagaaccgccttggtcgatgccgcaagcgtgtcctcgttaatgaccacgacggaggcagttgtcgttgagcttcccaaggatgagaaggaaacccctggaatgggaggtggcatgggaggcatggattactagaagttctatcaacatgttggattcagtagaggctgcttccttgctcaggctcacaccttcctcgtttatccttattcaaactgagttctccaatttctcgcttttatgctctctttttttcttcaatggtattggaggctgaacatgaatgtaatcatagtgagagaggttaattgtgcaggaacatttttcaccagttgtagtctctggtggtatttatgattttgttgttctcaccttctactttcttagtctgcattgcgaggaaaaaaaaactaatcttgataataaaatatataaaatactgggttaacccgtgatttataagattctgtg

SEQ ID NO: 1098 - DNA, 2250 bp, Aristolochia fimbriata
aacctaaaccccaggagacgcttctagaatctaaagcttcgtttttgccaggagcgtcttcgttcgccgccgttctgctgtttttaattcattcctcgaacttggaccagaactgtaacataacttgttttggaagtagcaggaggtttatttcatttcagctttctgttgccaaagtttctagtcaggtgcatcatgtacaggattgctgcaagcgttgcttctaaagccaaggtggcgagtaagacatatcaggtccgtagccgcttgagctggagtaggaattatgcggcgaaagaaatcaagttcggagttgatgctcgggcattgatgcttagaggggtggaggaactcgcagatgctgtgaaagttacgatgggtcctaagggccgtactgttgttatagagcaaagctttggtgcacctaaggtgacaaaagatggtgtgactgttgcaaagagtattgaattcaaggacaggactaaaaatgtgggagcaagtcttgtaaagcaagtggctaatgcaaccaatgatgtagctggagatggtactacttgtgcaacagtcctcactagggccatatttgctgagggctgcaagtccgttgctgctgggatgaatgccatggatctcagacgtggaatctcaatggccgttgattcagtggtgactaacttgaagagtagagctcgaatgattagcacatctgaggagattgcccaggttggtacaatatcagctaatggtgaaagagagattggagagttgatagcaaaagcgatggagaaggttgggaaagagggggttattactattgctgatgggaacaaacttgaaaatgagcttgaagtggttgagggaatgaagttagagagaggctacatttctccatatttcatcacaaaccagaaaacccaaaaatgtgagcttgaggatccgttgattcttattcatgagaagaagatttcaaacatgaatgcagtagtgaaggtgttagagttggctttgaagaggcaaaggcctttgttaattgttgcagaagacgttgaaagtgatgcattggcaactctcattgtcaataagcttcgagctggtattaaggtctgtgctattaaagctcctggctttggagaaaacaggaaagccaatttgcaggatcttgccacactcactgggggtgtgcttataactgaagatctgggcatgaaccttgagaaagttgaatttgacatgctaggtaattgcaaaaaggtgactgtttccaaggacgacactgtcattcttgatggagctggtgataagaaagttattgaggagagatgtgatcagctgagagcaggcattgcctcgtgcacttctgattatgacagggagaaacttgaggaaagattggctaagctttctggtggagttgctgttcttaaggttggaggagctagtgaaacagaagttggggagaagaaagatagagttgttgatgcattgaatgctacgaaggcagccgtttcagaaggtattgttcctggtggtggtgttgctcttctctacgcatccagggatctggagaaactgcagactgcgaactttgaccagaagattggagtccaaatcattcaaaatgctctaaagatgccagtgcacgcaattgctagcaatgctggagtcgagggggctgtggttgtaggcaagttattggagcaagatgatcttgatctgggatatgatgctgcaaaaggtgagtacgttgacatggttaagtctggaataattgacccactcaaagtgattagaacagcactggttgatgctgccagtgtatcttctttgttgacgactacagaagctgtggtcgttgaacttcccaaggatgagaaggaggcacctgcaatggctcctggcatgggtggattggattactgatgttcttttgggagatgaagaaaagtgctctactagttataatttaagtatttaaggaagcgtcgtcattcacatttgctcccttttatggggagatcaggctaaacattcatgtaatcatttcgagagcggccttaccgcaactagaaggtaagcgcaattgacagttttgttacataatacgagagctcgattttttcccgtagggaatgcctcatttttcataattacacgaggccgttgaatttcggttccctctgccgtttttggagtcagccattttgtacaataccagaggccctgaaacatttgatcttttctttaattttg

SEQ ID NO: 1099 - DNA, 1864 bp, Cyclamen graecum
ctccacacgatgtatcgatttgcagcaaatcttgcttctaaagctcgtgtggccaagagttgcacccaacaggtgggtggtagattgagttggagcagaaactatgccgcgaaagatatcagatttggggataaagctcgtgaggcaatgctgaagggcgtgacagagcttgccgatgctgtgaaagtaactatgggccccaagggtcgtcatgttgtgattgagcaaagctacggtgctcccaaggttacaaaggatggtgttactgtggcaaagagcgttgagttccaggacaaagtcaagaatgttggtgcaagccttgtaaaacaggtcgctaatgcaaccaatgatgttgctggtgatggtaccacatgtgctactgtccttaccagagcgatattttctgaaggttgtaagtcagttgcagctggaatgaatgccatggacctaagacgtggtattaatatggcagttgattctgtgattactaacctaaagagcaaggctcgaatgatcagcacatctgaagaaatagcacaggttggaacaatatcagcaaatggtgaaagagagataggcgagcttatagcaaaagccatggagaaagttggcaaggagggagtcatcacaattgctgatggaaagaccttatataacgagttggaagttgttgaaggaatgaaattagatagaggttacatatccccatatttcatcaccaacacaaagaaccagaaatgtgaactagatgatcctcttattctaatccatgagaaaaaatctcaaatttaaatgcgattgtgaaagtactggagctctccttgaagaggcaaaggccactgttaatcgttgcagaagatattgaaagtgaggctctggcaactcttattttgaacaaactccgtgctggtatcaaggtttgtgctatcaaagccccaggatttggtgagaacagaaaagctggtttgcaggatcttgctactcttaccggtggcgaactaataactgaagaacttgggatgaatttggaggatgtaaatctggatatgcttggctcgtgcaaaaaggtaactatatcgaaggacgacactgttattctagatggtgctggtgacaagaagtccctagaagaacgatgcgaacagattagatcttcaattgaattgagcacttctgattatgacaaggagaagctgcaagagagattagccaagctttctggtggtgttgcggtgttgaaggttggaggtgccagtgaagttgaagtcagcgagaagaaagatagatttacagatgctcttaatgccactaaagccgctgttgaagaagggattgtacctggtggtggtgttgctcttctctatgccacaaaggatttgaagaatcttccaacagctaacttcgaccaaaagattggtgtccagataattgagaatgcactaaagatgccggtgcacacaattgcttccaatgctggagttgagggagctgtagtagttggcaagcttttggaacaagatgacactgaccttgggtatgatgcagccaaaggtgaatacgttgatatggtgaaagctggaattatcgacccactaaaagtgattagaactgcattggttgatgctgctagtgtttcgtcattgatgactaccaccgaagcagtgatagtcgaacttccaaaggaggagaaggagagcccagcaatgggtggaatgggcggaatgggtggcatggactattaaagatggttacattgctccctagttttagaaatacttcacaattttgtctttcgagttatgtattattgtgaactgatcaaaatcggacaaatgtaatcattcgagattctcctgagcagggt

SEQ ID NO: 1100 - DNA, 1849 bp, Panicum virgatum
gtaggttgggagcagacttgcctggaccagaaactatgcggccaaggatatcaagtttggtgttgaggctcgtgctctgatgctgaggggtgttgaggaattggctgatgcggtcaaagtgacgatgggtcctaagggtcgcaatgtggttattgaacaaagctttggtgcacctaaagtcacaaaggatggtgtgactgttgctaagagcattgaattcaaggatagagtaaagaatgttggggcgagccttgtgaagcaggttgccaatgcaactaatgacactgctggagatggtaccacatgtgcaactgttttaacaaaagcaatattcactgaggggtgcaagtctgttgcggctggaatgaatgctatggatttaaggcgtggaatctcaatggctgttgatgctgttgtgaccaatctgaagggtatggccagaatgattagcacgtcagaagagattgcacaggtgggtacaatatcagcaaacggggaaagggaaattggtgagctaattgccaaggccatggagaaggttggcaaagagggtgtaatcaccattgcggatggtaacaccctttacaatgagcttgaagttgttgagggcatgaaactcgacagaggttacatctctccgtacttcattaccaactcaaaaacccaaaaatgtgaactggatgacccattaattttgattcatgacaagaaggtttcgaacatgcatgcagtggttaaagttttagagatggcccttaagaagcagaggcctctactaattgttgcagaagatgtggaaagtgaagcattgggcactctgattattaacaagcttcgtgctggcatcaaggtctgtgccgtcaaagctcctggttttggggaaaacaggaaggcaaacttacaagaccttgctatccttactggaggagaagtcataaccgaagaacttggaatgaaccttgagaatgttgagcctcacatgttgggtacatgcaaaaaggtgacggtctctaaggatgacactgttattcttgatggagctggagacaagaagtccattgaagagagggcagagcagattagatctgcaattgagaatagcacatctgattacgacaaggaaaagctacaagagcggttggcaaagctctctggaggtgttgctgttctaaagattggaggagccagcgaagctgaagttggtgagaagaaggatagagtgacagatgcgttgaacgctactaaagcagctgtggaagagggcattgtgccaggcggcggtgttgctcttctctatgcatcaaaggagctcgataaattgcagactgcgaacttcgatcagaagattggtgtacagattattcagaatgccctgaagacccctgtgcacactattgcttccaatgctggtgtggagggagcagtggtcgtgggcaagcttttggagcaaggaaacactgaccttggttatgatgctgctaaaggtgaatacgttgacatggtgaaggccggtatcattgacccactaaaagtgatcagaactgccctggttgatgctgctagcgtgtcatccctgatgaccaccacggagtccatcattgtagagatccccaaggaggagacaccggcgccggcaatgggaggcatgggtggaatggactactaaggcaccacacccaattttgagtctgcggatggaggacctctcgggagttccaaacggaaccggtgtgggaataataaacggtagctgttgagagctggagcggtagatcaaaattggattctgacaccttgtgccggactttctgtactgaaaaaccacaatttttttggcggtgggtatatc

SEQ ID NO: 1101 - DNA, 2346 bp, Pinus pinaster
tgggacggcacagtttgcattgtggtttttccaattgatacaaccctaaaccgaaaccaacgatgctgtaaaaattcaatgtgatgcaacatgcaagtcaataaaaccttgttggaccaaagccctaatggagccttctagactcttggtctctcaaacaaatttcgatatatttgagcgtactgctctgtggctaacatgataaaactatagccgtgctcaatccagacgggtctctcttgttctatttccggcctcgacttcaagtttctctgctcaaaatgtacagagcagcagctgcactggcttccagaattggaagcaggagtagtagctacggacagaatttcagcagactcggctggaggagaaactatgctgcaaaagatatcagatttggtgttgacgctagagctgcaatgctgcaaggtgtggaacatctggcagatgctgtaaaggtgacaatgggaccaaagggtcgcaacgttattattgaacaaagttatggtgctccaaaagtaacaaaggatggtgttactgtggcaaaaagtatcgagttcagtgacaagttaaagaatgttggtgcaagtcttgtgaagcaagttgccaatgctacaaatgatgttgcaggagatggcactacctgtgcgaccatccttacacgtgcaatattcacagaaggctgtaagtcagttgcagctgggatgaatgcaatggacttgagacggggcattagcatggcaattgatgcagttgtggcgcatttgaaaagcagagcaaggatgataagcacatctgaggaaattgcacaggtaggcaccatctcagcaaatggtgaaagggaaattggtgaactgattgccaaagcaatggaaaaagttggcaaggagggagtcataactattgcagatgggaagacattgtacaatgaattggaggttgttgaaggaatgaagctagacaggggttatatatccccgtattttatcacaaatgagaaagcccaaaaatgtgaattagagaaccctctgatcttgatacatgaaaagaaaatttcaaatttgaatgcagttgtccgagcaatggagttggccttgaaaaagcaaagagctcttctgattgtttctgaggatgtagagagtgatgcactagcaaccctaattctaaataaaattcgtgccggagtcaaggtctgtgcaatcaaagctccaggctttggagaaaacagaaaagccaacttggaggatcttgctgtacttactggtggtcaaatgattacagaagaacttggcatgaagcttgaaaaggttgaagctgatatgtttggttcagcaaagaaggtaactgtatcgaaggatgacactattgttcttgacggaggtggtgataagaaggctatagaagaaagatgtgagcagattcgggctgccattgaagccagcacgacagactatgataaggataagtatcaggagaggttggcaaagctttcaggaggagttgcagttctgaagattggtggagctagtgaggcagaagtaggggagaagaaagacagagttacagatgccttgaatgccaccaaggcagcagttgaggagggtattgtgccaggaggtggcgttgctcttctttatgcgacaaaggaactagaaaaacatcagactgctaactttgaccaaaagattggagtgcaaattattcagaatgcattgaagatgccggcatatacaatcgctgcaaatgccggtgtggaaggtgcagtggttgttgggaaattattggagcaagataatcttgaccttggctacgatgctgctaaaggtgaatacgttgacatggtgaaggcagggattattgatcccctgaaagtgatcagaactgctttggttgatgctgcaagtgtgtcttcgctgttaaccacaacagagtgcgttgttgttgagattccgaaggatgagaaggaaggcccagctatgggcggtggtatgggtggcatggactactaaagagcataactagagcggtgtgccttctaggtggtgtcctgtttggaaagtaggcttaaagttcaggttatctggtgtcatagttttgaagggtaaactttgggtcaattagtttgatagcagttagtttgacccttgttattgtctaaaacattacattccccttgctgggcgcaattgcttgtgtattcaagctaacttaaaaggaaaattcgtcgattgaagtgtcctgcagtttttacaacctagggcaaaagtgtaatcaaagagagaccggggaaatttttccttaattcacccactggagatgacaatttattcaaagagctattttttt

SEQ ID NO: 1102 - DNA, 1801 bp, Chrysanthemum coronarium
ccgccactacagccgccgtcatcatgtatcgtctagccgccagtctcgcatccaagtcaaggattgctagaaataatgctcaacagttgagatattatgctgcgaaagatatacatttcggtgtcggtgcgagagcgttgatgctaaaaggagtcgaagagcttgctgatgctgttaaagttactatgggtcctaagggacgtaatgtcgtcatagaacaaagctacggagctcccaaggtgacaaaggatggtgtcaccgtggcaaagagtatcgaatttaaagacagggtgaagaatgttggtgctagccttgtcaagcaggtagctaatgctaccaacgatgctgctggtgatggtaccacctgtgcgacagttcttactcgtgcaatttattctgaaggctgcaagtcagttgcagctggaatgaacgccatggatcttagacgtgggatcactatggctgttgattcagtggtcacaaacttgaagagcagagctagaatgatcagcacatccgaagagatagcacaggttgggacaatatcagcaaatggagaacgcgagattggtgaacttattgctaaggctatggagaaagttggaaaggagggtgttattactatatctgatggaaaaacactttacaatgaattggaagtggtcgagggaatgaagttggacagaggatatatatcaccctacttcatcaccaacacaaagaaccaaaaatgtgaattagaagaccctttgatcttaattcacgagaaaaaaatctctagcttaaatgcaattgtgaaagtcctagagttggctttgaagaaccaacgatcactgctgattgtttccgaagatattgaaagcgaggcgctggctactctcattcttaacaaactccgcgctggtattaaggtctgtgccattaaagctcctggatttggagagaaccgaaagtcaaacttgcaagaccttgcaactcttactggaggagaggttataactgatgagcttggcatgaatcttgaaaaaatgtcgccagaaatgcttgggacttgcaaaagggtcacaatatcaaaggatgataccgttattcttgacggggctggtgacaagaaggggattgaagaaagatgtgaacagttaagatcatcgatcgagttaagcacttctgattatgataaggaaaaattccaggagagattagcgaagctttctggtggagttgctgttttgaagattggaggagcaagtgaggctgaggttggtgagaagaaagacagggttaccgatgccttgaatgcaacaaaggctgctgttgaggaaggaattgtgcctgggggtggtgttgctcttttatatgcttccaaggagctggagaaacttgtcaccgccaacttcgatcagaagattggtgttcaaataatccaaaatgctcttaaggcacccgtgcacacaattgcttccaatgctggagttgaaggtgctgttattgttggaaaactgttagagcaggataaccctgaccttggatatgatgctgctaaaggtcaatatgtagacatggttaaggaaggaatcatcgatcctcttaaagttatcaggacagcgttggttgatgctgccagcgtctcatctttattgactacaaccgaagctgtgatagttgaagctcccaaggacgagaaggaatcaccagcaatgactccaggaatgggcgactactgaagcaattgatagctcatttcaatatcatttatttgagaattccaaattgtacaacggattaaagtagtaggtgggtt

SEQ ID NO: 1103 - DNA, 2031 bp, Allium cepa
gctggcggaagtgggaaacagattggaagcagacttaattggagcagaaattatgcggctaaggatattaaatttggagttgatgcacgtgctttgatgcttagaggtgttgaagagcttgctgacgctgttaaggttactatggggccaaagggacgaaatgttgtaatagagcaaagttttggtgctccaaaagttacaaaagatggtgttaccgttgcaaaaagcattgaattcaaagacagagtgaagaacatgggtgctagtcttgtgaaacaagttgctaatgcaaccaatgatgttgctggtgatggtacgacttgcgcaactgttcttacaaaagcaatattctccgaagggtgcaagtcagttgctgctggaatgaatgcaatggatttaaggagaggaattacactggctgttgattcagttgtcacaaatttgaagagtagagccaggatgatcagcacttcagaagaaatcgctcaggttgggaccatatcatccaatggagaaagagaaattggtgaacttattgcaaaagccatggagaaagttggcaaggagggagtcatcacaattgaagatggtaaaaccctatacaatgaactggaagttgtcgagggaatgaaacttgataggggttacatatcaccttactttgtcaccaaccccaagaaccaaaaatgcgaactagatgatcctctaatccttattcatgagaaaaaaatttctagcataaatgctgtggtgaaagtgcttgagctggcactcaagagacaaaggcctttactaatagttgctgaagatattgaaagtgatgcactagcaactcttatcattaataagcttcgcgctggactaaagatttgtgccattaaagcacctggatttggtgataataggaagaacagtatgcaagatcttgcaactctaactgggggtgttctcattactgaagaattaggcatgaacctagagaaagtcgagttggacatgcttggaacatgtaaaaaggtaacagtatcgaaagatgataccgttattcttgacggagctggtgacaagaaagcccttgaagaaagatgcgatcaactaagatctgctattgatttaagtacgtcagactatgataaagaaaagttacaagagagactggcaaaactttctggtggtgttgcagtcctcaagattggaggagccagtgaagctgaagttggtgagaagaaggatagagttaccgatgcgctgaatgcaacaaaggctgccgtagaggagggaattgtgccagggggtggcgttgctctgctttatgcatccaaagaattagagaaattgcataccgccaactttgatcagaaaattggtgttcaaattattcaaaatgctttgaaggctccagtgcatattattgcttccaacgctggagtagagggtgctgttgttgttggcaagcttttggaacaggacaacacagatcttggttatgatgcggctaaaggcgaatatgttgacatggtaaaggctggtattattgatccactgaaagttattagaactgcattggttgatgctgcaagtgtttcttcattgatgacgaccacggaagctgtggtggtagaactaccaaaagatgagaaggaaggtgctgcagcagcgcctggtatgggtggcatgggaggaatggattactaaaccgagcatcatgtgaaagcattgaattgtttcagtatcaaatttttgttagtttttgtagcagtgctattttgtaatttggtgaaagatcaagaaccgattgtagtgcacatgttctgcagatttactttgttgtctttcatggctgatggaacaaattacgccagtctataaaaatagcgagcaaatgttacgaagtataattgttatttcaggtaataaagccattaagttcttatgttattatatttttggttgactggtatgtactgtgttcattgaggaacttaaaacgtagcgatgaattctgcaatcggtacaatttcatttctttcc

SEQ ID NO: 1104 - DNA, 2712 bp, Aristolochia fimbriata
cccttggagacgcttctagacacttctcttcccttcacttctctgctgtcacgcctgcgcgtcacactcctatttacgcctttcttgttccatattccttctctcattttcgaagaaggccgaagctcccaagatactgctccgtctgtcaaagactccaagtgtcttcatttgtaaaatcagtctttgcatcatgtaccgtgctgcagcaagccttgcttcaaaagccaggagggtaagccaaggcagccaacagttgggaagtcatttaaattggaaaagaaattatgctgctaaagagatcaaatttggcgttgaggcgcgtgcattgatgctcaaaggtgttgaagacctcgcagatgctgtaaaagtcactatgggaccgaagggtcgtaatgtggtcatagaatctagttatggagggcctaaagtgacaaaagatggtgtcacagtagcaaagagtgtagaattcaaggatagagttaagaatgtgggagcaagccttgtgaagcaagttgctaatgcaactaatgatgcggctggagatggtaccacatgtgcaacagttcttacacgtgcaatattcactgaaggatgcaagtctgttgcagcagggatgaatgcaatggatctgagacgaggaatcacaatggctgttgatgcagtagtaactagcttaaaaagcagagctcgaatgatcagcacatccgaagagatagcacaggttggtacaatatcagcaaacggggaaagagagataggtgagctgattgcaaaagccatggagaaagttggcaaagagggagtcatcactattgctgatggaaaaactcttgacaatgaacttgaagttgtggaaggaatgaaattggacaggggttacatctctccctatttcatcaccaaccagaaaaaccaaaatgtgagttggaagaccactaattcttatccatgagaagaaaatttcaagtattcattcagtggtgaaggtgttggagttggctttgaagaagcaaagaccattgttaattgttgcagaagatattgaaagtgaagcactggcaactctcattgtgaataagcttcgtgcgggaattaaggtatgtgccattaaagcccctggttttggagaaaacaggaaagctagtctgcaggatcttgctatactcacaggtggtgagcttataactgaagaacttggcatgaaccttgagaaagtagaagcaaaaatgcttggtgcatgcaaaaaggtgactgtttctaaagatgacactataattctagatggagctggtgagaaaaaagctattgaagaaaggtgtgagcagctgagatcggctattagcgacagctcttcagattatgacaaggggaagcatcaagaaagattagcaaagcttttaggaggggttgctgtgcttaagattggtggggcaagtgaagcagaagtaggggagaaaaaagatagagttacggatgcgctaaatgcaacaaaggcggctgttgaggagggaatagttgctggtggtggtgtagctcttctttatgcatcaaaggagctagacaagttgcagactgctaactttgatcagaagattggtgttcaaattatccagaacgctctcaagacacctgttcacaccatagcttctaatgccggagtggaaggggcagtagttgttggcaaattattggagcaagataactacgaccttggatatgatgcagccaaaggtgagtacgtagatatggttaaagcgggtatcatagacccactgaaggtgattagaacagcattggttgatgcagccagtgtctcgtctctgttaactaccactgaggctgtggttgttgaacttcccaaggatgaagatgcccctgcggctgctggcatgggtggaatggattattgaagaccttcaccagtatagtgtagaataagttagtgtagatcttactcgaagaagataaaagagtcttagatttcctcatccattgtcactcttgtagggaacgggacacattttattgtaaacacaagaggtgccagggttgttgaacttttagccgctagagggaattttgtttagtctcttatcattgcatcaaacaaaaatcataacggagatcgaatgaatggctcttcaaaggaaatgtttgttcagagtattgtcggtaagaatgtccatggattcatgatggagggttgaatgactaacaacctcaaaaattggacactgccaatttcattattttatctttaacaactaataagtacaacaatacatgcttgtatttttatttattttacagcctaatgcaacagcaattgcattacttggacagagatcatttgtcgcagaattgaaatgtgtatgatagatatatgtatcattccaataactcctttggaatatggagctgatcacactccttggtatgtatatatatatatacttcagctggctcaatgtatatgtcatcaagcagcgtgcaccttggagcagtcggtggaaggggtgagtttgaaggaaatggagaagtggcacttctgtgggagggtgttgacgagatcgtagttgacgccgggaatggcggcggcggtccactgcatgcaggcacatgcctggcggcagagctcggtggtgggggcggcggccttcacggccttgaggccggagcagcactccgcgggcacgtccccgccggcaa

SEQ ID NO: 1105 - DNA, 1976 bp, Gossypium hirsutum
ccctctaaaacctcccttcaaccctagaacttcctcacttcctttgcctttgccgccgctaactccgccaccatgtaccgccatctcacttccctcgcctccaaagccaggttggctaagaaccgaatccaattgaatggtactagactgagttggagtagaaactatgcggctaaagacatcaaatttggtgtagaagcacgagcattgatgcttggcggcgttcaagagctagccgatgctgttaaagtcaccatgggtccaaaagggcgtaatgttgttttggaacaaagtttcggggctcctaaggtgacaaaagatggtgttactgtagccaagagcattgaatttaaagacagagtgaaaaacattggtgcttcccttgtaaagcaggttgccaatgccaccaatgacgttgctggtgatggcaccacttgtgcaacagtccttacccgcgcaatatttgttgaaggatgtaaatcagtggcggctggaatgaatgccatggacctcagacgaggaatcacaatggcagttgatgcagttgtgaccaacttgaagagtagagcgcggatgatcagcacgtccgaggaaattgcacaggttggaacaatatctgcgaatggagaaagggagattggcgagctcattgccaaggccatggagaaagttggcaaagaaggtgttattaccattgctgatgggaaaaccttgtacaatgaattagaggttgttgagggaatgaagcttgatagaggctacatatccccttactttatcaccaaccagaagaaccagaaatgcgaattggagaacccacttattttgatccatgagaaaaagatctctaacttgcctgctttggtgaaatttttggaattgtccttgacgaagcaaaggcctttactaattgttgctgaagatcttgaaagtgaagcacttgcaactctcattctgaacaagcttcgtgccggaatcaaggtgtgtgccattaaggccccaggttttggggaaaataggaaagctggcttgcaggaccttgctgctcttaccgggggcgaggtaataactgaagaacttggtcttgacattgagaaagttggagcggaagtgcttggctcttgcaaaaaggttacagtatcaaaggatgacacaattatccttgatggcgctggagacaaggctaccattgaagaaagatgcgatcagataagatcagcaattgaatcaagcacttctgattacgacaaggacaaattacaagagaggcttgcaaagctctctggtggcgttgcagttttgaagattggaggagcaagtgaagcagaagttggtgaaaagaaggatagagttaccgatgccctaaatgccacgaaagctgctgtggaggaaggaattgttcctggtggtggtgctgcacttctttatgcctctaaggaacttgaaaacctggagactgcaaactttgatcagaagatcggtgttcagatcatccaaaatgctcttaagatgcctgtacatacaattgcatctaatgctggagttgagggtgcagtggttgttggaaagctactggaacaggacaatcccgacctcggttatgatgctgccaagggtgagtatgtagatatggttaaagctggaattatcgatcctttgaaagtcataagaacagccttggtagatgctgcaagtgtgagttcattgatgaccacaactgaagccattgttactgaacttccaaaggatgacaaggaaggggcagccaccgcaggcggcatgggcggtctagattactaagggctttcacagggtacctccattgctgctctgttaagacacaatttttatatgatgaagccttgtaaacatgagatgagaacaagagaatatttaataatttactttaggtccccagactgggcaaggggatggcttttattcattgagtaaaatccatataataaatttgaatc

SEQ ID NO: 1106 - DNA, 2015 bp, Gossypium raimondii
acgtgtcttccaaatctctccctctaaaacctcccttcaaccctacaacttcctcacttcctttgcctttgcctttgcctttgcatttgccgccgctaactccgccaccatgtaccgccatctcacttccctcgcctccaaagccaggttggctaagaaccgaatccaattgaatggtactagactgagttggagtagaaactatgcggctaaagacatcaaatttggtgtagaagcacgagcattgatgcttagcggcgttcaagagctagccgatgctgttaaagtcaccatgggtccaaaagggcgtaatgttgttttggaacaaagtttcggggctcctaaggtgacaaaagatggtgttactgtagccaagagcattgaatttaaagacagagtgaaaaacattggtgcttcccttgtaaagcaggttgccaatgccaccaatgacgttgctggtgatggcaccacttgtgcaacagtccttacccgcgcaatatttgttgaaggatgtaaatcagtggcggctggaatgaatgccatggacctcagacgaggaatcacaatggcagttgatgcagttgtgaccaacttgaagagtagagcgcggatgatcagcacgtccgaggaaattgcacaggttggaacaatatctgcgaatggagaaagggagattggcgagctcattgccaaggccatggagaaagttggcaaagaaggtgttattaccattgctgatgggaaaaccttgtacaatgaattagaggttgttgagggaatgaagcttgatagaggctacatatccccttactttatcaccaaccagaagaaccagaaatgtgaattggagaacccacttattttgatccatgagaaaaagatctctaacttgcctgctttggtgaaatttttggaattgtccttgacgaagcaaaggcctttactaattgttgctgaagatcttgaaagtgaagcacttgcaactctcattctgaacaagcttcgtgccggaatcaaggtgtgtgccattaaggccccaggttttggggaaaataggaaagctggcttgcaggaccttgctgctcttaccgggggcgaggtaataactgaagaacttggtcttgacattgagaaagttggagcggaagtgcttggctcttgcaaaaaggttacagtatcaaaggatgacacaattatccttgatggcgctggagacaaggctaccattgaagaaagatgcgaccaaataagatcagcaattgaatcaagcacttctgattacgacaaggacaaattacaagagaggcttgcaaagctctctggtggcgttgcagttttgaagattggaggagcaagtgaagcagaagttggtgaaaagaaggatagagttaccgatgccctaaatgccacgaaagctgctgtggaggaaggaattgttcctggtggtggtgctgcacttctttatgcctctaaggaacttgaaaacctggagactgcaaactttgatcagaagatcggtgttcagatcatccaaaatgctcttaagatgcctgtacatacaattgcatctaatgctggagttgagggtgcagtggttgttggaaagctactggaacaggacaatcccgacctcggttatgatgctgccaagggtgagtatgtagatatggttaaagctggaattatcgatcctttgaaagtcataagaacagccttggtagatgctgcaagtgtgagttcattgatgaccacaactgaagccattgttactgaacttccaaaggatgacaaggaaggggcagccaccgcaggcggcatgggtggtctagattactaagggctttcacagggtacctccattgctgctctgttaagacacaatttttatatgatgaagccttgtaaacatgagatgagaacaagagaatatttaatattttactatggcttttattcattgagtaaaatccatataataattttgaatccgtctttaagttaatataatgttcttt

SEQ ID NO: 1107 - DNA, 1744 bp, Allium cepa
aaaagccaggtctgcttgcatcagcgggaaacaggttggaagccgacttagttggagaagaaactatgcggcaaaagatattaggtttggagttgatgctcgtgctttgatgcttaaaggcgttgaagagcttgccgatgctgtcaaagttactatgggaccaaagggacggaatgttgttattgagcaaagctttggtgcacctaaagttacaaaggatggagttactgttgcaaaaagcattgaattcaaggacagagtgaagaatatgggtgccagtcttgtgaaacaagtcgctaacgcaaccaatgacagtgctggtgatggtacgacttgtgctactgttcttacaaaagcaatgttctctgaaggatgcaagtcagtagctgctggaatgaatgcaatggatttaaggagaggaatcacaatggctgttgattctgttgttaccaatttgaagagcagggctaggatgatcagcacctcggaagagattgctcaggttggaacaatatctgctaacggagatagagaaatcggtgaacttattgcaaaggccatggagaaagttggcaaagaaggagtcataaccattcaagatggcaaacgctatataatgaactagaagtggtagagggcatgaaacttgataggggatacatatcaccttacttcatcaccaacccaaagaaccagaaatgtgaactcgataatcctcttattttgatccatgagaagaaaatttctagcatgaatgctatagttaaagtgcttgagttggcgctcaagagacaaaggcctttacttattgttgctgaagacatcgaaagtgaggcattagcaactcttatcattaataaacttcgggctggaataaaggtttgtgccattaaagcacctggattcggagaaaataggaagaacagcatgcaagatcttgcaactttaactgggggtgaactcattacagaggaacttggcatgaatctggaaaaggtggagcttgagatgcttggtacatgtaaaaaggttacagtatcaaaagatgatacggttatccttgatggtgccggtgataagaaagctattgaagaaagatgtgaccagctaaggtctgctattgatttgagtacatcggactatgacaaagagaagctgcaagagcggttggcaaagttatctggtggtgttgcagttctaaagattggaggagcgagcgaagctgaagttagtgagaagaaggatagagttaccgatgccttgaatgcaactaaagctgctgtggaagagggaattgtgcctggtggtggtgttgccttgctgtatgcatccaaagaactagcaaatttgcagacggctaattttgatcaaaaaattggtgttcaaatcattcaaaatgctttgaagatgccagcatatattattgctgctaatgctggagtagaaggtgcggttgttgttggcaagcttttggagcaggatcaagctgacgttggttatgatgctgctaaaggtgaatatgttgatatggtaaaggctggtattatcgatccgttgaaagtgatcagaactgcattagtggatgctgcgagtgtttcgtcactaatgacgactacagaagccgtggtggtagagcaacccaaagatgagaaggatgcagctcctggaatgggtggaataggtggcatggactactaatttaatcatacgtgttattatcagttaccatttacggaataatcta

SEQ ID NO: 1108 - DNA, 2092 bp, Cephalotaxus harringtonia
gcaaaatgcatagggcggcgtccgcgctggtttctagagccgggagcaggagctcgcgctctcgattgcagagtgctagcagacttggatggagcagaaattatgctgcaaaagagatccgattcggaagtgatgcacgcatagcaatgctacaaggtgtggaacaacttgcggatgcagtaaaggtgaccatggggcctaagggtcgcaacgtcattattgaacaaagttttggagccccaaaggtcactaaggacggggtcactgtagcaaaaagtattgagtttaaggatagagtgaagaatgttggtgcaagtcttgttaagcaagtagctaatgcaacaaatgatgtagctggagatggtacaacatgtgcaactgtacttactcgagcaatattcactgagggttgtaaatcggtagcagctggtatgaatgcaatggacttaagacgtggtatcaacatggcagttgatgttgttgtgacacatttgaaaagcagggcacgtatgataagtacatctgaagaaatcgcacaggtaggaaccatttcttcaaatggtgacagagagataggtgaattacttgctagagcaatggaaaaagttgggaaggaaggagtcattactgttgcggatggaaaaacattgtataatgagttagaagttgtggagggaatgaagcttgacaggggctatatatctccatattttatcactaatcaaaagactcagaaatgtgaaatggagaatcctctgattttgatacatgaaaagaaagtatcaagcttgcaagcagtggttcgagtgatggagctagcactggagagacaaaggcctcttttgattgtagcagaggatgtagagagtgaagcattggctactctgatcttgaataagcttcgtgcaggggtgaaggtttgtgctattaagaccccaggttttggtgaaaatagaaaaaataacttgcaggatcttgctgcactcactggtggtcaggtcatatcagaggatcttggtatgaagctcgacaaagtggaacttggcatgctgggatcagcaaagaaggtgaccgtctctaaggatgataccatcattcttgatggaggtggtgacaaaaaggcaattgaagagagatgtgagcagatccgatctactattgaagcaagtacatcagattatgacaaagaaaagctgcaggagaggttggcaaagctatcaggaggagttgccgttctcaagattggtggagccagtgagcttgaagtgggagagaaaaaagatcgagtcactgatgcactgaatgccacaaaggcagcagtggaggagggtattttaccaggtggtggtgttgctcttctttatgcaacaaaagagcttgataaaattcaaacagcaaactttgaccagaagattggagttcaaataatacagaatgcattgaagtctcctgtgcatataattgcttccaatgctggtgtcgagggtgctgttgtagtgggaaagctactggaacaagagaatcttgactatggctatgatgctgccaaaggtgagtatgttgatatgataaaggctggaattattgatcctttaaaagttatcaggactgcattggttgatgcagcaagtgtatcttcattgctgacaacaacagaagcagtggttgttgaacttccaaaagacgagaaggcaagcccaggtatgggtggcatgccacccatgggtggaatggatttctgagaaagtgagaggaacaccagaagtatctagctggggagatttttggagaagtggttatataggaggttgcagtgtctcatgttctgcaattacaattgatcctaaatgggcaagtggaggttttgtgctatgttcttatttatgcaattggatattttattatttcaagctgggtagtttattttcattgaaccacccggtagaggctctatatgagcgtggaaaactgtaatcatagaggaggctgaacagttttgtaattagaccggattaaatgcaataaagtagaaaacatccttctttatttatattaggaccattactttagttttaattctacccgtagtatt

SEQ ID NO: 1109 - DNA, 2053 bp, Chrysanthemum coronarium
ccgccactacagccgccgtcatcatgtatcgtctagccgccagtctcgcatccaagtcaaggattgctagaaataatgctcaacagttgagatattatgctgcgaaagatatacatttcggtgtcggtgcgagagcgttgatgctgaaaggagtcgaagagctcgctgatgctgttaaagttactatgggtcctaagggacgtaatgtcgtcatagaacaaagctacggagctcccaaggtgacaaaggatggtgtcaccgtggcaaagagtatcgaatttaaagacagggtgaagaatgttggtgctagccttgtcaagcaggtagctaatgctaccaacgatgctgctggtgatggtaccacctgtgcgacagttcttactcgtgcaatttattctgaaggctgcaagtcagttgcagctggaatgaacgccatggatcttagacgtgggatcactatggctgttgattcagtggtcacaaatttgaagagcagagctagaatgatcagcacatccgaagagatagcacaggttgggacaatatcagcaaatggagaacgtgagatcggtgaacttattgctaaggctatggagaaagttggaaaggagggtgttattactatatctgatggaaaaacactttacaatgaattggaagtggtcgagggaatgaagttggacagaggatatatatcaccctacttcatcaccaacacaaagaaccaaaaatgtgaattagatgaccctttgatcttaattcacgagaaaaaaatctctagcttaaatgctattgtgaaagttctagagttggctttgaagaaccaaagatcactgctgattgttgctgaagatattgaaagcgaggcattggctactctcattcttaacaaactccgcgctggtattaaggtctgtgccattaaagctcctggatttggagagaaccgaaagtcaaacttgcaagaccttgcaactctcacaggaggagaggtcataactgatgagcttggcatgaatctggaaaaaatgtcaccagaaatgctagggacatgcaaaagggttacaatatcaaaggatgatactgttattcttgacggggctggtgacaagaaaggaattgaagaaagatgtgaacagctaagatcatcgatcgagttaagcacttctgattatgataaggaaaagctccaggagagattagcgaagctttctggcggagttgctgttttgaagattggaggagccagcgaggctgaggttggggagaagaaagacagggttactgatgccttaaacgctactaaggctgcagttgaggaaggaattgtacctggtggtggtgttgctcttctatatgcttccaaggagcttgacaaacttgtcaccgccaattttgatcagaagattggtgttcaaataatccaaaatgctctcaagtcacccgtgcacacaattgcttccaatgctggagtcgaaggtgctgttattgttggaaaactgttggagcaggataatcctgaccttggatatgatgctgctaaaggtcaatatgtagacatggtcaaggaaggaatcattgaccctcttaaagtgatcaggacagcgttggtggatgctgcaagcgtttcatctctattgactacaaccgaagctgtgattgttgaatctcccaaggacgagaaggaatcggcagcaatgagtccaggaatgggtgactattgaagcaaatgataactcgtttcagtcttttcctgcaggcaatctcattcttttcatatattttgagaattattaaactgtacaacggattaaagtagtaggtggtttaggtttcatttagatccgattctcttcactgatttgagctttttggtcttttgtttccttttatatatatgctccttatggatgcaaaaccgttatgtaatcatttgaagggatcggacctcgactagataatttacaaaggtcaaaaactaatttcaccaaggctttggatatggattcaaagatcatcttttttccgtaataaagttaatgccatatataac

SEQ ID NO: 1110 - DNA, 1860 bp, Avena sativa
ccctaaaccctagtggatgcattagagcctcctcgcgtctcttcccttctggtctcctccctctaaaatccgcctctcccttcccaagaaacgaccaaagctcgcatcatctcacctcgcctcctagctccgaagcacctcggctcccgcgccatctcgttgccccgctatgtatcgtgcggccgccagcctcgcctccaaggctcggcaagccgggagcggcgctcgccaggttggaagcagacttgcctggagcaggaactatgctgccaaggacatcaagtttggtgttgaggcccgtgctttgatgctgaggggtgttgaggagttggccgatgcagtgaaagtgacaatgggtcctaagggtcgcactgtcattattgagcagagctttggtgcaccaaaagtcacaaaggatggtgtgacggttgccaagagcattgaatttaacaatagagtcaagaatgttggtgcaaatcttgtaaagcaggttgctaatgcaactaatgatactgctggagatggtaccacatgtgctactgttttgacgaaagcaatctttactgagggttgcaagtctgtagcggctggaatgaatgcaatggatctaaggcgtggaatctcaatggccgtcgatgatgttgtaacaaacctaaagggcatggctaaaatgatcagcacctcagaggaaatagcacaggtgggtacaatatcagcaaatggggaaagagaaattggtgaactgattgccaaggctatggagaaggttgggaaagaaggtgtaatcaccattgcggatggtaataccctttataatgagcttgaagttgtggaaggcatgaagctcgacagaggttacatctctccatactttgttactaacccaaagacccagaaatgtgaattagaagaccccttgatcttgatacatgacaagaagatatcgaacatgcatgcagtagttaaagtgttggagatggctctgaagaagcaaaggcctctacttatagttgcagaagatttagaaagcgaagcattgggcactctgattattaacaagcttcgtgctggcattaaagtctgtgctgttaaagctcctggttttggggagaacaggaaagcaaatttacaggaccttgctgtccttaccgggggagaagtcatatctgaagagattgggatgaacctcgagaactttgattctcagatgttaggtacctgcaaaaaggtgactgtttccaaggatgacactgttattcttgatggagctggggacaagaagaacattgaagagagagcagaccagattagatctgcaatcgagcaaagcacttctgattatgacaaggaaaagctgcaggagcggttggccaagctttctggaggtgttgctgttctaaagattggaggagccagtgaagctgaggttagtgagaagaaagacagagtgacagatgcactgaatgccactaaagctgctgttgaagagggtatcgtgccaggaggcggtgttgcacttttatatgcatcaaaagctctggacaaactgcagacagcaaactttgatcagaggatcggcgtacaaatcattcagaatgctttgaagacaccagtgtacaccattgcttccaatgcaggcgtagaaggggcagttgttgttggcaagcttttggagcaagataacactgagcttggatatgacgcagctaaaggtgaatatgtggacatggtgaaggtcggtatcattgaccctctaaaggtgatcagaactgccttggtggatgctgctagtgtatcatctctgatgaccaccacagaagccatcatcgtagagattcctaaagaggagaaagaggcacc

SEQ ID NO: 1111 - DNA, 2582 bp, Pinus taeda
tgttatttttccaattgatacaacccaaccgaaaccaacgatgctgtaaaaattcaatgtgattgcaacatgcaagtcaataaaaccttgttggaccaaagccctaatcgagccttctagactcttggtctctctaaacaaatttcgatatatttgagcgttctactccgtcaccaacatgataaaactatagccgtgctcagtccacacgggtctctcttgttctaatccgggctcgacttcaagtctctctgctcaaaatgtacagagcagcagctgcactggcttccagaattggaagcaggagtagtggctacggacagaatttcagcagactcggttggaggagaaactatgctgcaaaagatatcagatttggtgttgacgccagagctgcaatgctgcaaggtgtggaacaactggcagatgctgtaaaggtgacaatgggaccaaagggtcgcaatgttgttattgaacaaagttatggtgctccaaaagtaacaaaggatggtgttaccgtggcaaaaagtattgagttcagtgacaagttaaagaatgttggtgcaagtcttgtgaagcaagttgccaatgctacaaatgatgctgcaggagatggcactacctgtgcgaccatccttactcgtgcaatattcacagaaggctgtaagtcagttgcagctgggatgaatgcaatggacttgagacggggcattagcatggcaattgatgcagttgtggcgcatttgaaaagcagagcaaggatgataagcacatccgaggaaattgcacaggtaggcaccatctcagcaaatggtgaaagggaaattggtgaactgattgccaaagcaatggaaaaagttggcaaggagggagtcataactattgcagatgggaagacattgtacaatgaattggaggttgttgaaggaatgaagctagacaggggttatatatcaccgtattttatcacaaatgagaaagcccaaaaatgtgaattagagaaccctctgatcttgatacatgaaaagaaaatttcaaatttgaatgcagttgtccgagcaatggagttggccttgaaaaagcaaagagctcttctgattgtttctgaggatgtagagagtgatgcactagcaaccctaattctaaataaaattcgtgccggagtcaaggtctgtgcaatcaaagctccaggctttggagaaaacagaaaagccaacttggacgatcttgctgtacttactggtggtcaaatgattacagaagaacttggcatgaagcttgaaaaggttgaagctgatatgtttggttcagcaaagaaggtaactgtatcgaaggatgacactattgttcttgatggaggtggtgataagaaggctatagaagaaagatgtgagcagattcgggctgccattgaagccagcacgacagactatgataaggataagtatcaggagaggttggcaaagctttcaggaggagttgcagttctgaagattggtggagctagtgaggcagaagtaggggagaagaaagacagagttacagatgccttgaatgccaccaaggcagcagttgaggagggtattgtgccaggaggtggcgttgctcttctttatgcgacaaaggaactagaaaaacatcagactgctaactttgaccaaaagattggagtgcaaattattcagaatgcattgaagatgccggcatatacgattgctgcaaatgccggtgtggaaggtgcagtggttgttgggaaattactggagcaagataatcttgaccttggctacgatgctgctaaaggtgaatacgttgacatggtgaaggcagggattattgatcccctgaaagtgatcagaactgctttggttgatgctgcaagtgtgtcttcgctgttaaccacaacagagtgcgttgttgttgagattccgaaggatgagaaggaaggcccagctatgggcggtggtatgggtggcatggactactaaagggcatatctagaccggtgtgccttctacgtggtgtcctgtttggaaagtaggcttaaagttcaggttatctggtgtcatagttttgaagggtaaactttgggtcaattagtttgatagcagttagtttgacccttgttattgtctagaacattacattccccttactgggctcaattgcttgtgtattcaagctaacttaaaaggaaaatttgtcgattgaagtgtcctgcagtttctacaacctagggtaaaagtgtaatcaaagagagaccggggaaattttttccttaattcacccactggagatgacaatttattcaaagagctattttttaagaaagattcgtgttttcgaacaaaaatggattcgtgcaatatctgggttcagctaattgagcaagggcataatcactgaatgcctacgcaactaccattctcgcatataccttcaccccatgaagggttacagaacattatattcatgcattcagagtccagacaacagagtaatcttgccatttgcctatgtttttgaaacttatttttgttatcacatatagaaacagtaacatttaaagtgttttccaagct

SEQ ID NO: 1112 - DNA, 1855 bp, Plantago ovata
gcagaaactatgcggccaaagacattagattcggagttgaggcgagagctttgatgctcaagggtgtcgaagagcttgctgatgccgtgaaagtcaccatgggccctaaggggcgtaccgtggtgattgagcaaagttggggagcccctaaagtgaccaaggatggtgttacagtcgcaaaaagcattgaattcaaggacaaagtgaagaatattggtgctagcctagtaaagcaggttgcaaatgccacaaatgatgttgctggtgatggtacaacttgtgctacagtccttacccgcgccatatttgctgagggctgcaagtctgtagcagctggcatgaatgccatggatcttagacgcggtattaccatggcagttgatgctgtggttaccaaccttaaaagtagagcgagaatgataagcacatcggaggagattgcacaggtcggtacaatttcagccaatggagaaagagaaatcggtgagctgattgcgaaagccatggaaaaagtaggcaaagagggtgttatcacgatccaagatgggaagacattgtataatgaattggaagttgttgagggtatgaagttagacagagggtacatttccccgtacttcattacaaaccagaagaaccagaaatgtgagctggatgatgctctagttctgattcatgagaagaaaattacgagcctaaatgctattgtgaaggttcttgagttggctttgaagaggcaaagaccacttctgatagttgctgaagatgtcgagagtgaggcacttgcaactcttatccttaacaagcttcgggcaggattaaagatttgtgctatcaaagcacccgggtttggtgaaaacaggaaggctaatttacaggatcttgctgttctaacaggaggccaggtcattactgaggagcttggaatgaacctagatgatgtagatttggatatactgggctcatgcaaaaaggtcacaatatctaaagatgatactgttgtgcttgacggtgctggtgaaaagaaatctatcgaagaaagatgcgagcagattaggaatggaattgaattgagcacttctgattatgacaaagagaaactgcaagaaagacttgcaaagctttctggtggtgtagctgtattaaagattggaggagctagtgaagcagaggttggtgagaagaaagacagggtgacagatgctttgaatgcgaccaaggcagctgtagaagaaggaattgttcccggaggaggtgttgctctactatacgcatcaaaagaactcgataaattgccaactgccaactttgatcagaagattggtgttcaaatcattcaaaacgctttgaagacaccagtttatacaatcgcagcgaatgctggagttgaaggtgctgttgttgttggcaagttgatggagtcggacaaccctgaccttggatacgatgcagctaaagatcagtacgttgacatggttaaagctggcattattgatccattgaaagttatcagaacagccctaacagatgctgccagtgtgtcctctctgatgacaactacggaagcagttgtggtggaacaaccgaaggacgagacagccgcaccagcccctggaatgggcggtggcatgggtggaatggattactgaagcgaacaatgaactgatattaacacatcgttcgaactacaaaaaaaataaaaagattcaggatcttgccttgctgatgagtccaggcgtcagtgttctaattctgagatgagattgagatttgacatataattgtattgcgtaggattagttggtcaagttattattgaaacatgaacatggtgttggcatattgatgatttctt

SEQ ID NO: 1113 - DNA, 2139 bp, Secale cereale
aaccttcctccccaagcagaggacaccgccctccagatccaacaccaccctccctccctccgtcgccatgtaccgcgcggcagccagcctcgcctccaaggcccggctagccgggagcagcgcccgacaggtcgggagcaggctcgcctggagcaggaactatgccgccaaggacatcaggttcggcgtcgaggcccgggccttgatgctcaagggtgtcgaagacctggctgatgcggtcaagctgactatgggccccaaggggcgcactgttattattgagcaaagctttggtgctcccaaggttacaaaggatggagtcaccgttgccaagagcattgaattcagtgacagagtcaagaatgtaggtgcaagtcttgtgaagcaggtcgctaatgcgactaatgacactgctggagatggtacaacatgcgctactgttctgacaagggcaatattcaccgagggatgcaagtccgtagcagctggtatgaatgcaatggatctgaggcgcggtatctcaatggctgttgattctgtggtagcaaacctaaagggcatggccagaatgatcaacacgtctgaggaaatagcacaggtgggaactatatcagctaacggtgaaagggaaattggtgagctcattgcaaaggctatggagaaggttggtaaagagggagttatcaccattgcggatggtaacactctatacaacgagcttgaagttgtggaaggcatgaagcttgacagaggttacatctctccatactttattaccaaccagaagaaccagaaatgtgaactagatgatcccttgatcttgatacatgataagaaagtatccaaccttcgctcgttggtcaaagtgttggagtttgctctccagaagcaaaagcctctgcttattgttgcagaagatctagaaagtgaagcactgggcacactaattcttaacaagcttcgtggaggcttcaaggtctgtgctattaaagctcctggttttggagagaacaggaaatccaacttacaggaccttgctatccttactggtggagaagtcataactgaagaacttggaatgaaccttgagaactttgagccaaacatgctgggtacctgcaagaaggttaccatatctaaggatgacacagtcatccttgatggagcgggtgataagaaggccatcgaagagagagctgagctgctgagatcttcaattgaacaatgtacttctgactatgacaaggaaaagatacaggagcggttggcaaagctttctggtggtgtcgcagttctgaagattggtggagcgagtgaagcagaagttggagagaagaaggacagagtgacggatgcgctaaatgctacaaaagccgcagtagaggagggtattgtgccaggtggtggtgttgcccttctttatgcgtcaaaggacttggataaattgcctacagcaaacttcgaccaaaagatcggtgtccagatcattcaaaatgctttgaagaccccagtacacaccattgctacaaatgcgggtgtagaaggggctgtcattgttggcaagctcttggagcaggataataccgacctgggctatgatgctgccaaaggtgaatatgtggatatggtgaaggctggtatcattgacccacttaaagtgatcagaacagccctggtggatgctgcaagtgtgtcatctctgatgactaccacggaagccatcattgtcgagatccccaaggaagacaaggcggcacccgcaatgggaggcggcggcatgggcgggatggatttctaactttcctcaggctcgtgtcaaaacaatgtgattatatgagacatctaggttagaactttttgcagtgtggatgtggattcattgctatgtactgtgggcaaatgaggaggccttcatactttttgttctggtggaagaggatttttgcaacttgaatcaatgtatgaacatggctgatagagcctacaactgttaagcctgaaatatccccatagccatatttttcagctttgctcatcgctttgatgccgtgtttgcttttgaacctaggtttgctcccactaaatattggctggactttggcaatggaatggacgaaattagcttgaattaaaaaagtc

SEQ ID NO: 1114 - DNA, 1811 bp, Vinca minor
aaagtttggagtggaagcccgggctttgtatgttgtaagggtggttgaggatcttgctgctgcagttcaagtcaccatgggtccaaagggccgaaatgtggtgattgaacaaagttggggtgctccaaaagtgacaaaagacggtgtgactgttgcaaaaagtattgaattcaaggacagagttaagaatgttggtgcaagtctagtgaaacaagtggctaatgcaactaatgacaatgctggtgatggtactacttgtgcgacaatccttacacgagctatattcgctgaaggttgcaagtcagttgcagctggtatgaatgccatggacctaaggcgtggaatcaacagtgctgtggattctgttgtgacacatttgaaaagcagagcacgaatgataagcacatcagaagaaattgcacaggttggcacaatttctgctaatggcgaaagagagattggagagctgattgcgaaggccatggggaaagtaggaaaagaaggagttatcacaatccaagatgggaaaacattgtataatgagttggaagttgttgagggaatgaagctggacaggggctacatatccccatatttcattacgaatcagaaaacccaaaaatgtgagttggaagatcccctcattgtaatctatgagaagaagatttcaagcattaatgcaattgtaaaggtgttagagttggctttaaagagacaaaggccccttctaattatttctgaagatgtggagagtgacgccctggctactctgattctcaacaagcttcgtgcgggaatcaaggtttgtgccgttaaagctccggggtttggtgaaaacagaaaggctagtctgcatgatctcgctgctttgaccggagcccaagtcataactgaagagctggggctgaaccttgacaacttggagttggagatgttaggctcgtgcaaaaaggtaacaatatccaaggatgatacagttcttcttgatggtgctggggagaagaaggccttagaggaaagatgtgaacagatccgatcttcaattgaattaagtacgtctgactatgacaaagagaagctgcaagagagactagctaagctttctggtggtgtggctgttctaaagattggaggggctagtgaagccgaagttggtgagaagaaagacagagtcactgacgctctgaatgcaacaaaggccgctgtagaagaaggaattcttccaggcggtggcgtcgctcttttgtacgcatccaaagaattggaaaagctatcaacagccaacttcgatcagaagattggcgtgcagattattcagaacgcccttaagatgccagtacatacaattgcctcaaatgccggtgtagagggtgccgttgttgttggcaaattgttggagcaagataatcccgatcttggatatgacgctgcaaaaggtgaatatgttgatatggttaaatcaggaatcatcgatccattgaaagttataagaacagccctggttgatgccgcaagtgtatcatccttgttgacgacaacagaggcggtcgtggttgaacttccaaaggatgagaaggcagctccggccatgggcggcggaatgggtgatatggactattgataatcctagtactaaaaatgcctgacagaaagaaactaattaatcaaaccaggaaataagctttagggggaggatgatctcgtcattttgttcaattggttgagcaaagcttcctttttgtacttcaccaaaaggaatatctttgtaatcatagtgagggtaattgtgtcataatggttaggaacatttg

SEQ ID NO: 1115 - DNA, 2550 bp, Triticum aestivum
ggctgcaggcaattcggcacgaggtttcacccctgaccccccatcccgctcgccgcctccatcctcaccccctcccagcagagagaccgcccgcgagatccaaacagtcgcctccctccctccctccgtcgccatgtaccgcgccgccgccagcctcgcctccaaggcccggctagccgggagcagcgcccgacaggtcgggagcaggctcgcctggagcaggaactatgccgccaaggacatcaggttcggcgtcgaggccagggccatgatgctcaagggggtcgaagacctggctgatgcggtcaagttgactatgggtcccaaggggcgcactgttattattgagcaaagctttggtgctcccaaagttacaaaggatggagtcaccgttgccaagagcattgagttcagtgacagagtcaagaatgtaggtgcaagtcttgtgaagcaggtcgctaatgcgacaaatgatactgctggagatggtacaacatgtgctactgttctgacaaaggcaatattcactgagggatgcaagtccgttgcagctggtatgaatgcaatggatctgagacgcggcatctcaatggctgttgattctgtggtaacaaacctaaagggcatggccagaatgatcaacacgtctgaggaaatagcacaggtgggtactatatcagctaatggtgaaagggaaattggtgagctcattgcaaaggctatggagaaggttggcaaagagggagttatcaccattgcggatggtaacactctatacaatgagcttgaagttgtggaaggcatgaagcttgacagaggttacatctctccatactttattaccaaccaaaagaaccagaaatgtgaactagacgatcccttaatcttgatacacgataagaaagtatccaaccttcgctcattggtcaaagtgttggagtttgctctccagaagcaaaggcctctgcttattgttgcagaagatctagaaagtgaagcactgggtacactaattcttaacaagcttcgtggaggcttcaaggtctgtgcgatcaaagctcctggttttggagagaacaggaaatccaacttacaggaccttgccatccttactggtggagaagtcataactgaagaacttggaatgaaccttgagaactttgagccaaacatgctgggtacctgcaagaaggttaccatatctaaggatgatacagtcatccttgatggagcgggtgataagaaggccatcgaagagagagctgagctgctgagatcttcaattgagcaatgcacttctgactatgataaggaaaagatacaggagcggttggcaaagctttctggtggtgtcgcagtcctgaagattggtggagcgagtgaagcagaagttggtgagaagaaggacagagtgacagatgcgctaaatgctacaaaagctgcagtagaggagggtattgtaccaggtggtggtgttgcccttctttatgcgtcaaaggacttggataaattgcctacagcaaactttgaccaaaagattggtgtccagatcattcaaaatgctttgaagaccccagtacacacaattgctaccaatgcgggtgtagaaggggctgtcattgttggcaagctcttggagcaggaaaataccgacctgggctatgatgctgccaaaggcgaatatgtggatatggtgaaggctggtatcattgacccacttaaggtgatcagaacagcactggtggatgctgcaagtgtgtcgtctctgatgactaccacggaagccatcatcgttgagatccccaaggaagacaaggcggcacccgcaatgggaggcggcggcatgggagggatggatttctaacttgctcccaggctcatgtcaaaacaatgtgattagatggaacatctaggttagaactttttgtagcgcggatgtggattcatcgttatttactgtgggtgaatgaggctgtcacattttttgttctgctgcaagatgattttgcaacttgaatcatgtatgaacatggcgaacagagcctacagttgttaacaagcccgaaatgtccccatctcgtctcaatcatcatttttcatgttgctattcctgcatccaggggggagtacgttagatggaataatttcttggatgtattaccctatccccagggtttgggaccccttttgacgggtcaatggaatcttatgcccaaaaccctgattcgagtaatcattattgtacgctcaaggtagcggaactgccattctaaactcttacttggggattccatcacaaacacaaagtttgtggcttgaccgatatcggactcaccatcatttagctattgcatttattttctacaagtttgaccggtcacgatcgtaactcgaacctaacttcggaattgggacacagtattaaagctcttttagaagcgcatactcctacggggggtcattagggtcgtgggacaagttaaggggcctttttaagcggaaaccaaacgtaaaacgttaccgaaaaacctaaagttttaccgggaaaac

SEQ ID NO: 1116 - DNA, 2020 bp, Artemisia annua
aatcatgtatcgcttcgcagtaaatcttgcttccaaatcaagaattgctactaagacaacccaacagattgggagtaggttgaatataagcagaaactatgcggcaaaagatattagatttggagttgatgctagggcgttaatgcttagaggcgttgaagagcttgctgatgctgttaaagttaccatgggcccgaaggggcgtaatgtggtgattgaacaaagttatggagcgccaaaagtaacgaaagacggtgtaacggttgcaaaagccattgaatttaatgataaggtgaagaatgttggcgcgagtcttgtgaaacaggttgctaatgctacaaatgatgtggctggtgatggtacaacttgtgcaacagttcttacacgtgcaatattttcagagggttgcaagtcggttgcagctggtatgaatgcaatggacctcaggcgtggtattaccatggctgttgattcggttgtaactaacttgaaaagtagagcccgtatgataagcacatctgaggaaatcacacaggtgggtacaatttccgcaaatggagaacgtgaaatcggtgaactaattgctaaggctatggaaagagttgggaaagagggtgtcatcactattcaagacggaaagacattgtataatgaactagaagttgttgagggaatgaagttggacaggggatatatatctccacattttatcacgaacaccaagaatcagaaatgtgaactagacaaccctattgttctaatctacgagaagaagatgtcaaccgttacttccgtggacaaagtgttagacctggcactgatgcatcaaaggcctctattaatcgttgctgaagatgtggaaagtgaagcgctggctaccataattctggacattctccgtatcggcgtcaaggtctgtgccataaaagctcctggttttggtgagaacagaaaggccaacttgcaagatcttgccactctcaccggaggccagattataacagaagaacttgatataaaccttgacaacgtggagttggaaatgctgggcctgggctcgtgtaaaatggttactgtatcgaaagatgacacagttatgctttatggtgacggtgatatgacgtcgatagaagaacggtgtgaacagattaggtcagcaatcgagtctagcacatctgattatgatagagagaagttccaagagaggttagctaagctctcgggtggtgttgctgtaattaagattggaggagccagtgatactgaagtaagtgaaagaaagacagggttactgatgctctaaatgccacaaaggctgctgttgtggaaggaatcgtaccaggtggtggtgttgctcttctgtatgcatctaaagaattggacaaattgcaaacagccaacttcgatcagaaaataggggttcagattattcagaaagcactaaagatgccagttcatacaatagcatctaatgctggagtggaaggttcagttgtggttcgtaagcttttagggcaagatgacccagatcttggatatgatgccgccaaaggtgaatatgtggacatggtgaaaaatggtatcattgacccgttgaaagtgataaggacagccttggtcgatgcagcaagtgtggcttctttgatgacgactactgaagcaattgtgactgaactccctaaaccggctagtgaagcagctccaggaatgggcggcagaatgggttgaatgggcggaatgggtggcatggacttttgatcaaccctgtgatagcaaaaaagattgacatagattttactgacaaaggcctaagtgtgtttacagtgtgagaactagtacattattagcattcggaatattatctaagggcaagtgtttgaaaaattcttgatcattattttgataccatttgaatataagagttgcgatcataataaacaaaattaaaaaggcttgaaagcaactcacaatgtgacaagtgtcccccacatactccttcctatattattaaattcggtta

SEQ ID NO: 1117 - DNA, 2068 bp, Saccharum officinarum
caaacaccggtccggtattcccaggtcgaccgcacgcgtccgggcgcggcaagccgggagcagctccgccgctcgccaggttggaagcaggcttgcatggagcaggaagtatgctgccaaggacagcaagtttggtgttgaggcccgtgctctgatgttgaggggtgttgaggagttggcagatgcggtcaaggtgacaatgggtcctaaggggcgcaatgtggttattgagcaaagctttggtgcaccgaaagtcacaaaggatggtgtgactgttgcgaagagcattgaatttaaggatagagtaaagaatgttggtgcaagccttgtgaaacaggttgctaacgcaactaatgacactgctggtgatggtaccacatgtgccactgttttgacaaaagcaatatttactgagggttgcaaatctgttgcggctggaatgaacgcaatggatttaaggcgtggaatctcaatggctgttgatgctgttgtgaccaatctgaagagcatggccagaatgatcagcacttcagaagaaattgcgcaggtgggtacaatatcagcaaatggggaaagggaaattggtgagcttatcgccaaggctatggagaaggttggcaaagagggtgtgatcactattgcagacggtaacaccctttataatgagcttgaagttgtggagggtatgaaacttgacagaggttacatctctccgtacttcattaccaactcaaaaacccagaaatgtgaattggatgacccattgatcttaattcatgacaagaaggttactaacatgcacgctgtggttaaggttttagaaatggctctaaagaagcaaaagcctctactgattgttgcagaagatgtggaaagtgaagcattgggcactttgattattaacaagcttcgtgcaggcatcaaggtctgtgctgtcaaagctcctggttttggggaaaacaggaaggcaaacttacaggaccttgctatccttactggaggagaggtaataactgaagagctaggaatgaaccttgagaatgttgagcctcacatgctgggtacatgcaaaaaggtgaccgtctctaaggatgacactgttattcttgatggagccggagacaagaagtctattgaagagagggcagagcatattagatcagcaattgagaatagcacttcagattatgataaggaaaagctccaggagcggttggcaaagctctctggaggtgttgctgttctgaagattggaggagccagtgaagcagaagttggtgagaagaaggatagagtgacagatgcactgaatgctactaaagctgctgttgaagagggtattgtaccaggtggtggtgttgctcttctctatgcatcaaaggagcttgataaattgcagacagcgaactttgatcagaagattggtgtgcaaatcattcagaatgctttaaagacacctgtacacaccattgcctccaatgctggggtggagggagcagtagttgtgggcaagcttttggagcaaggaaatactgacctgggttatgatgctgctaaaggcgaatacgttgacatggtgaaggctggtatcattgacccgctaaaggtgatcagaactgccttggtggatgctgctagtgtgtcgtccctcatgaccaccacggaatccataattgtagagattcccaaggaagaggcaccggctccagcaatgggtggcatgggtggaatggattactaagacatcacacccacgatacacatcaaagcagggacttttttttttctctggcggtgaagttcatcttcactgttcggcggtgcaagttcatctttactgtattttggtcgacgatgagtggtggccgggcggatacaattttgagtctgcggacgtaggacctctgaatagctccaaacgtagctatagtgtggtaataataaatatgaacagtagttctttgagatctgaagctgtagatcaagattggaatctgacaccttgtgccgaaccaactgtagtctgattattacattttttggctgaggtaaaatcgattgacgttct

SEQ ID NO: 1118 - DNA, 2250 bp, Mimulus guttatus
atgaatgcagacttttgggggaaatcgcatccgtgtgtctgggttggtaatagtaggttgttgtggagcagaaattatgctgcgaaggaaatcagatttggtgtggaagctagggccagaatgcttagaggcgtcgaagagctcgctgatgctgtcaaagttacaatgggtcctaaaggtcgtaatgttgtactggaacaaagttacggtgctcccaaagtgacaaaggatggtgttactgtggcgaagagcatcgagttcaaagataaagttatgaatgtaggtgctagcctcgtcaaacaggttgcaaatgccactaatgatgttgcaggagatggtaccacgtgtgcaaccatcctcacacgtgcaatatattccgaaggatgcaaatcagttgcagctggaatgaatgccatggacttgaggcgtgggatcaacatggcagttgatgccgtggtgaataacttgaagagcagagcaagaatgattagtacatctgaagagatagcacaggttggtacaatatcggcaaatggagaaagagagatcggagagcttatagccaaggctatggagaaagttgggaaagacggagttattactattgcagacggaaagacgttatataatgaactggaagtggtagaaggaatgaagcttgatagaggctacatatctccttacttcatcaccaatcaaaagaaccaaaaatgtgaaatggaggatgcactaattctaatccatgagaagaaaataaacaacttaaatgccatggtgaaagtgttggagttagcgatgaagaggcaaaaacctttgttgatcgtttctgaagatgtggagagtgaagcattggctaccctaattctaaacaagcttcgagttgggctgaaggtttgtgccattaaagctccagggtttggagaaaacagaaaggcgtatttacaggacctagctgtcataacaggaggacaggtaatcacaagcgagctaggaatggatcttgaaaatttgacgggtgaaatgcttggttcgtgcaaaaaggtcacagtatcaaaggatgacactgttattcttgatggagctggtgacaagaagtctattgaagaaagatgtgaacagttacgatcgggaattgaagtaagcacttctgaatacgacaaggagaaactccaggaaagactcgctaagctttctggtggtgttgctgtcttgaaaatcggtggagccagtgaagttgaggtgggtgagaagaaggatagagttaccgacgctctgaatgcaacaaaagcagctgttgaggaaggcattgtacctggtggtggtgttgctctcctttatgcttccaaggaactggagaagttgcaaactgccaactttgaccaaaaagtcggtgttcagattatccagaatgccctcaaggctccagtacatacaattgcatcaaacgctggagttgagggctcagttgttgtaggtaagctattagagcaggacaatcccgaccttggctatgatgctgctaaaggtgaatatgtggacatggtcaaggctggaataatcgatccattgaaggttattagaactgctttggtagatgctgcaagtgtgtcgtctttgttaactaccacggaggctgttgttgttgaactccccaaggacgagaaagaatcgccgccaacggggcccggtatgggcggaatgggctattgaaggaggtgatatttttaaaattttcttttgaaactcgaaattcgttcgctttttgcaattttaattattttagcgaatttctgaaaaatatcaaatgtagttaatatcgaggtggaaaaaggtaggtagtccctagttaaacaaaatcctttcatttgcttgaactccgatggaactttgacgcgtcttgatagtaaatacctcgtaaaaccgtagctctttcgattcattatgaaaagttgcttgagttataaaatctttttcatccatgtttcagttaaaagcaatattttgtttttaaaaaataaaaaatcggttttaggaaaactattatcgtgttatcatgggttttattaagttgaagggtattttagtctttatagaggcctcttaatgtaacatataacgtacaatcattgattagcggccgtagttacatttgtttttttaatatttgtaatggaagtgagtatctaacgcatcagattaattaattaaacagattagatgcttaattattttaatcatcagatatttgca

SEQ ID NO: 1119 - DNA, 2159 bp, Abies balsamea
gctggcttccagaattggaagccggagtagtagctacagaaagagtgcgagtggactcaattggaggagaaactatgctgcaaaagatatcagatttggtgttgacgccagagctgcaatgctgcaaggtgtggaacatctcgcggatgctgtaaaagtgacaatgggaccaaagggtcgcaatgttgttatcgagcaaagctatggtgctccaaaagtaacaaaggacggtgttactgtggcaaaaagtatcgagttcagtgacaaattaaagaatgttggtgcaagtcttgtgaagcaagttgccaatgctacaaatgatgttgcaggagatggcacaacctgtgctaccatccttactcgtgcgatattcacagaaggctgtaagtcagttgcagcggggatgaatgcaatggacttgagacggggcattagcatggcaatcgatgcagttgtgacgcatttgaaaagtagaacaaggatgataagcacatccgaggaaatcgcacaggtaggcaccatctcatcaaatggtgagagggaaattggtgagttgatcgccaaagcaatggaaaaagttggcaaggagggagttataactatcgcagatgggaagacgttgtacaatgaattggaggtcgtggaaggaatgaagctagacaggggttatatatctccgtattttattacaaatgaaaagacccaaaaatgtgaattagagaatcctctgatcttgatacatgaaaagaaaatttcaaatttgaatgcagttgtccgagcaatggagctcgcattgaaaaagcaaagagctcttctgattgtttctgaggatgtagagagtgatgcactggcaactttaattactaaataaaattcgtgcgggagtcaaggtgtgtgcaatcaaagctccaggctttggagaaaacagaaaatccaacttgcaggatcttgctgtacttactggtggtcaaatgattacagaagaacttggaatgaagcttgagaaggttgaagttgatacgtttggcacagcaaagaaggtaactgtatcaaaagatgacactattattcttgatggaggtggcgacaaaaaggctatagaagaaagatgcgagcagattcgggctgccattgaagccagcacaacagattatgataaggaaaagtatcaggagaggttggcaaagctttcaggaggagttgcagttctcaagattggtggagccagcgaggcagaagtgggggagaagaaagacagagttacagatgccttgaatgctactaaggcagcagtagaggagggtattgtgccaggtggtggtgtcgctcttctatatgcgacaaaggagctagaaaaacttcagactgctaactttgatcaaaagatcggagtgcagataattcagaatgcactgaagatgcctgcatatactattgctgaaaatgccggtgtggaaggtgccgtggtagttgggaagttactggagcaagataatcttgaccttggttacgatgctgccaaaggtgaatatattgacatggtgaaggcagggatcatcgatcccctgaaagtgatcagaactgcgttggttgatgctgcaagtgtctcttcgctgttaaccacaacagagtgcgtcattgttgagcttcccaaggatgaaaaggaaggcccaggtatgggtggaggtatgggtggcatggactactgaaaaacatatctagaccttgtgccatcaaaatgatgtcctgttcggaaagtagggttaaacatcaggttctttggattccccgttctgaaagtagggttaaaaactcaggttataaatttagtttgagagcatttagtttgaccttgtcactgtctagaacattacatttcccctttttggggacaatttattgtggatttaaggcaacctaaagaaaacttgtcgattgaagtgtcctgcagtttctacaacttagctttttctacagggcaaaaatgtaatcaaagagagatcagagctaattttttttgtaataccttctggagattcagagatccaagaacaaaaattgccttgtttagtatttgggttcaactaattggaaaaaggcatattatgaatgctaatgtaactaccattagcatatactttcactccatgaaggattac

SEQ ID NO: 1120 - DNA, 2091 bp, Artemisia annua
tacagccgccgtcatcatgtatcgtctagccgccagtctcgcatccaagtcaaggattgctagaaataatgctcaacagttgagacattatgctgcgaaagatatacatttcggtgtcggtgcgagagcgttgatgcttaaaggagtcgaagagctcgctgatgctgttaaagttactatgggtcctaagggacgtaatgtcgtcatagaacaaagctacggagctcccaaggtgacaaaggatggtgtcaccgtggcaaagagtatcgagtttaaagacagggtgaagaatgttggtgctagccttgtcaagcaggttgctaatgccaccaatgatgccgctggtgatggtaccacctgtgcaacagttcttactcgtgcaatttattctgaaggctgcaagtcagttgcagctggaatgaatgccatggatcttagacgtgggatcactatggctgttgattcagtcgtcacaaacttgaagagcagagctagaatgatcagcacatccgaagagatagctcaggttgggacaatatcagcaaatggagaacgcgagattggtgaacttattgctaaggctatggagaaagttggaaaggagggtgttattactatatctgatggaaaaacactttacaatgaattggaagtggtcgagggaatgaagttggacagaggatatatatcaccctacttcatcaccaacacaaagaaccaaaaatgtgaattagatgaccctttgatcttaattcacgagaaaaaaatctctagcttaaattccatcgtgaaagttctagagttggctttgaagaaccaaagatcactgctgattgttgctgaagatattgaaagcgaggcattggctactctcatccttaacaaactccgcgctggtattaaggtgtgcgccattaaagctcctggatttggagagaaccgaaagtcaaacttgcaagaccttgcaactcttacaggaggagaggtcataactgatgagcttggaatgaatttggaaaaaatgtcaccagaaatgctagggacatgcaaaagggttacaatatcaaaggatgataccgttattcttgacggggcaggtgacaagaaaggaattgaagaaagatgtgaacagctaagatcatcgatcgagttgagcacttctgattatgacaaggaaaagctccaggagagattagcgaagctttctggcggagttgctgttttgaagattggaggagccagcgaggctgaggttggggagaagaaagacagggttactgatgccttgaacgctacaagttgaagaaggaattgtacctggtggtggcgttgctcttctatatgcttccaaggagcttgataaacttgtcaccgccaactttgatcagaagattggtgttcaaataatccaaaatgctctcaagtcaccggttcacacaattgcttccaatgctggagtcgaaggtgctgttattgttggaaaactgttggagcaggataaccctgaccttggatatgatgctgccaaaggtctatatgtcgacatggtcaaggaaggaatcattgaccctcttaaagtgatcaggacagcgttggtggatgctgcaagcgtttcatctctattgaccacaaccgaagctgtgattgttgaatctcccaaggacgagaaggaatcagcagcaatgagtccaggaatgggtgactattgaagcaaatgataactcgtttcagtctcttcctgcaggcaatctcattctttccatatattttgagaattattaaactgtacaacggattaaagtcgtaggtggtttaggtttcatttagatccgattctcttcactgatttgagctttttggtcttttgtttccttttatatatatgctccttatggatgcaaaaccgttatgtaatcattgaagggatcggaccttgactagatatttacaaaggtcaaaaactaatttcaccaatgctttggatatggattcaaagatcatcttttttccgtaataaagttaacatttagggtattcgttttgtgtttggtcccaaattggtagacattgaaataaaccatgttttgggct

SEQ ID NO: 1121 - DNA, 2127 bp, Podocarpus macrophillus
atttttgtagcttatctctgcaaaaatgtacagagctgcagctgttatagcttctcgactcgggagcaggaactctcgttctcatttgcagagtgctagcagacttggatggagcagaaattatgcggcgaaagagatcagatttggaagtgatgcacgtgcagcaatgctgcaaggtgtggaacaacttgcagatgcagtaaaagtgaccatgggaccaaagggtcggaatgttatcattgaacaaagttatggggctccaaaggttactaaggatggggttactgtagcaaaaagcatagagttcaaggataaagtgaagaatgttggtgcaagtcttgttaagcaagtggccaatgcaacaaatgatgtggctggagatggcacaacatgtgctactgtacttacccgagcaatattcacggaaggatgcaaatcagtagcagctggtatgaatgcaatggacttgaggcgtggtatcaacatggcagttgatgctgttgtgattcatttgaaaagcagggcacgaatgataagtacatccgaggaaattgctcaggtgggtaccatttcttcaaatggtgaaagagagataggtgaattaattgctagagcaatggaaaaagttgggaaggaaggtgtcattacagttgcggatgggaagacattgtataatgagttagaagtggtggagggaatgaagcttgacaggggttatatatctccatactttattactaatcaaaagactcagaaatgtgaattggaaaatcctctaattttgatctatgaaaagaaaatatcatcattgccagcggttgttcgagtgatggagttagccctggagagacaaaggcctcttctaattgtagcagaggatgtggagagtgaagcattggctactttgatcttgaataagcttcgagcaggggtgaaggtttgtgctattaaagctcctggatttggggaaaatagaaaaataatttgcaggaccttgctgcactcactggtggtcaggtgatttctgaagatcttggcatgacgcttgacaacgtggaacctggaatgtttggaactgcaaagaaggtgaccgtctccaaagacgataccatcattcttgatggaggtggtgacaaaaaggcaattgaagagagatgtgagcagattcgggctagtattgaatcaagtacgtcagattatgacaaagaaaagcttcaggagagactagcaaagctgtcagggggaattgctgttcttaagattggtggagccagtgaggctgaagtgagtgagaaaaaggatcgtgttaatgatgcattaaatgctacaaaggcagcagttgaggagggtatcttaccaggtggtggtgttgctcttctctatgcatcaagggagcttgataaaattccaacagctaactttgaccagaaaattggagttcaaataattcagaatgcgttgaagacacctgtgcacataattgcttccaatgccggtgttgaaggtgccgttatagtgggcaaactgcttgaacaagagaatcttgattatggatatgatgctgctaaaggtgaatttgttgatatggtaaaggctggtattatcgatcctttaaaagttatcaggactgcattagttgatgcagcaagtatatcttcattgctgaccacaacagaggcagtggttgctgaacttccaaaggatgataagccaagcccaggaatgggtggcatgccacctatggggggaatggacttttaaggaagtcacaggatacacaaggaagattatgctagtctgttgatttggtaaagcagcaggatatagttgcactggagtttgtacaagcatcttataattagcaaatggatattgtgctttccttctggtgtaagtggaatgctttatttaagctgcccatgtcattttatttgaacacccagggaggctttttgcaacgaggaaaattgtaaacatagaagagactgaacagttttgtaattgctcctttattgaaggaataaagtaaaaattggttctaaccttaatttatgaccagcactcaattctcattcagcattagcatattgctttcctaggggctgtaaaccattctatccactgcta

SEQ ID NO: 1122 - DNA, 1985 bp, Chrysanthemum coronarium
tggaagcaggttgaatttaagcagaaactatgctgcaaaagatattagatttggagttgatgctagggcgttaatgcttagaggtgttgaagagcttgctgatgctgttaaagttactatgggtcctaagggacgtaatgtcgtcatagaacaaagctacggagctcccaaggtgacaaaggatggtgtcaccgtggcaaagagtatcgaatttaaagacagggtgaagaatgttggtgctagccttgtcaagcaggtagctaatgctaccaacgatgctgctggtgatggtaccacctgtgcgacagttcttactcgtgcaatttattctgaaggctgcaagtcagttgcagctggaatgaatgccatggatcttagacgtgggatcactatggctgttgattcagtggtcacaaacttgaagagcagagctagaatgatcagcacatccgaagagatagcacaggttgggacaatatcagcaaatggagaacgcgagatcggtgaacttattgctaaggctatggagaaagttggaaaggagggtgttattactatatctgatggaaaaacactttacaatgaattggaagtggtcgagggaatgaagttggacagaggatatatatcaccctacttcatcaccaacacaaagaaccaaaaatgtgaattagatgaccctttgatcttaattcatgagaaaaaaatctctagcttaaatgctattgtgaaagttctagagttggctttgaagaaccaaagatcactgctgattgttgttgaagatattgaaagcgaggcattggatactctcattcttaacaaacttcgtgctggtattaaggtctatgccattaaagctcctggatttggagagaaccgaaagtcaaacttgcaagaccttgcaactcttacaggaggagaggtcataactgatgagcttggcatgaatctggaaaaaatgtcaccagaaatgctagggacatgcaaaagggttacaatatcaaaggatgatactgttattcttgacggggctggtgacaagaaaggaattgaagaaagatgtgaacagctaagatcatcgatcgagttaagcacttctgattatgataaggaaaagctccaggagagattagcgaagctttctggcggagttgctgttttgaagattggaggagccagcgaggctgaggttggggagaagaaagacagggttactgatgccttaaacgctacaaaggctgcagttgaggaaggaattgtacctggtggtggtgttgctcttctatatgcttccaaggagcttgacaaacttgtcaccgccaattttgatcagaagattggtgttcaaataatccaaaatgctctcaagtcacccgtgcacacaattgcttccaatgctggagtcgaaggtgctgttattgttggaaaactgttggagcaggataatcctgaccttggatatgatgctgctaaaggtgaatatgtagacatggtcaaggaaggaatcattgaccctcttaaagtgatcaggacagcgttggtggatgctgcaagcgtttcatctctattgactacaaccgaagctgtgattgttgaatctcccaaggacgagaaggaatcagcagcaatgaatccaggaatgggtgactattgaagcaaatgataactcgtttcagtctcttcctgcaggcaatctcattcttttcatatattttggaattattaaactgtacaacggattaaagtagtaggtggtttaggtttcatttagatccgattctcttcactgatttgagctttttggtcttttgtttccttttatatatatgctccttatggatgcaaaaccgttatgtaatcatttgaagggatcggacctcgactagataatttacaaaggtcaaaaactaatttcaccaaggctttggatatggattcaaagatcatcttttttccgtaataaagttaatgccatatataac

SEQ ID NO: 1123 - DNA, 1972 bp, Avena sativa
tctctcaccatgtaccgcgccgccgccagcctcgcctccaaggcccggcaagccgggagcagcgcccgccaggtcgggagcaggctcgcctggagcaggaactatgccgccaaggacatcaggttcggcgtcgacgcccgggcccagatgctcaggggtgttgaagagttggctgatacggttaagttgactatgggtcctaagggacgcactgttattattgagcaaagctttggtgctcccaaagttacaaaggatggagtgactgttgccaagagcattgagttcagtgacagggttaagaatgttggtgcaagccttgtgaagcaggttgctaatgccactaatgatactgctggggatggtacaacatgtgctactgttctgacaagggcaatattcaccgagggttgcaagtccgtcgcagctggaatgaatgcaatggatctgagacgtggtatctcaatggctgttgattctgtggtgacaaacctaaagggcatggccagaatgatcaatacatctgaagaaatagcacaggtgggtactatatctgctaatggtgaaagggaaattggtgagctcattgcaaaggctatggagaaggttggtaaagagggggttatcaccattgcggatggtaacacgctatataacgagcttgaagttgtggaagggatgaaacttgacagaggttatatctctccatactttgttaccaaccaaaagacccagaagtgtgaactggatgatccattaatcttgatacatgataagaaggtatccaaccttcaagctttggtcaaagtgttggagtatgcacaccagaagcaaaagcctgtgcttattgttgcagaagatctagaaagtgaagcattgggtatgttgatccttaacaagcttcgtgcaggccttaaggtctgtgcggtcaaagctccaggttttggagagaacaggaaatccagcctacaggaccttgctatccttacaggtggagaggtcataactgaagaacttggaatgaaccttgagaagtttgagcctaccatgctgggtacctgcaagaaggttactgtatctaaggatgacacagtcatccttgatggagccggagataagaaggctattgaagagagagctgagctgctgagatctgcaattgagcaaagcacttctgactacgataaggagaagatacaggagcgattggcaaagctttctggtggtatcgctgttctgaagattggtggagcaagtgaagctgaagttggtgagaagaaggacagagtgacagatgcactaaatgccacgaaagctgctgtagaggagggtattgtaccaggcggtggtgttgcccttctttatgcgtcaaaggacctggataagttggagaccgcaaactttgaccaaaagattggtgtccagatcattcaaaatgctttgaagaccccagtacacactattgctacaaatgctggtgtggaaggggctgtcattgttggcaagctcttggagcaggataacatcgacctggggtatgatgccgccaaaggtgaatatgtggatatggtgaaggcaggtatcatcgacccacttaaagtgatcagaacagccttggtggatgctgcgagtgtgtcctctctgatgactaccacagaagctatcatcgttgagagcccaaaggaagagaaggcggcacccgcaatgggaggtggcatgggcgggatggatttctaagttctcccttggtcatgtcgagacaatgtgattatatgaaacatttaggttagatcttttcgcagtggtgggctcattgttatgaactgtgcgcgtatgaggaagctgtcccttttttgttctgccgcaagaggatttacaacttgaaacacagtttatgctggtctcatgcaagcattgagatatgaatttatgaacaactgaagctgtggtgtagcttccataacctcctact

SEQ ID NO: 1124 - DNA, 4143 bp, Pseudotsuga menziesii
gttttagtggctttaaaagatgggtagtctgtctctgcctgcgacaacattgggagttacacatgtaaattgtattgctcataccaattgggtgccttccagcagacctcacaagcttactgcaatacctgtagcaaccaccttatgtactgagagagtatataaatttgcccatctgccatgctcttcttctgccaaagaacaattgcgggcaaggcgcagagttggtagatatagttattgtagttcttcaatggctttggaatctcctccagatcagtttgttgccaaggaaaatggcaagccacgacggattgccctgtttatagagccatctccatttgcatacatttcaggatacaaaaaccgcttccagaattttatcaaatatctacgggaaatgggtgatgaggtaattgtcgtgacaactcacaagggagtgcctcaggagttttatggtgctaaagtgataggatcatggagttttccttgcccttgttattcaaatgttcctctgtccctggctttgagtccccgaattatttgggaggttgcgaaatttaagcctgagattatacatgcatcatccccaggaattatggtgtttggtgccctcataattgcaaaactactgcgtgttcctcttgttatgtcatatcacactcatgttccaatatacattcccaaatacacgttcagctggcttgtcaagccaatgtggttaataatcaaatttcttcacagagctgcggaccttactctagttacatcaactgttcttgccaaggaactcaaagctgctagagtggctgcagcatgcaaaattcgtctttggcacaagggtgttgattctgagagttttcatcctcgttataaaagtcatgaaatgaggattcgcctcacggatggtgaacccctgaagccactgattgtacatgtgggacgccttggagttgaaaagaatttgggcttttttaaaatgctgatggatagactacctgaagtccgacttgcatttattggagatgggccctacagaaaggatctcgaagaaatgtttctaggcatgccagttgtctttactggtatgctgcacggggaggaactttccaaggcgtatgcaagtggggatgtttttgttacaccttcagaatcagaaacccttggccttgttgttctagaagctatgtcttccggcgttcccgttatagcagcacgtgcaggtggaatacctgacattgttcctcctgaagaagaaggaaaaataggctttctctttactcctggagacattaatgattgcctgtctaaagtcaaattgctacttaattctcctgaacttcggctaaattttggtcaaactggccgggcagaagttgaaaagcatgactggcgagctgctacgaagaaagtacgcaatgagcaatacaatgctgcaatctggttctggcagaaaaagcggtttcagctacttcgacggagatggtggtcgttacaacattctcctcgcggagctcctcgagtacatcatcattttcatttgcttgctgtacatagcctttggaggattttagatattgctcagaaaacatattcaaaaaccagtatatgatgccttccaaggggcatggagattgtaatcacattgagagtcgtccatgaaacataatggatttgttagatctgtatagtaatgtgatgacgtttctctagtggtcctctgacgtgtacaaaagtcttagtaaaccacaatgctaaaatatatttatttatgcataactagacgcataaaggtctttggctgaaaactgtgcctgctattttctctttgagtgaataattagtttacttattgtactattctgacacttaacttctaagttctgaccatagaaagaaagccagagacagagtgctagtggactaagctggaggagaaactatgctgcaaaagatatcagatttggtgttgaagccagagctgcaatgctgcaaggtgtggaacaacttgcagatgctagtaaaggtgacaatgggaccaaagggtcgcaatgttgttattgaacaaagttatggtgctaccaaaagtaacaaaggacggtgttactgtagcaaaaagtattgagttcagtgacaagttaaagaatattggtgcaagtcttgtgaagcaagttgccaatgctacaaacgatgctgcaggagacggcacaacgtgtgctaccatccttactcgtgcgatattcacagaaggctgtaagtcagttgcagctgggatgaatgcaatggacttgagacgaggcattacgatggcgatcaatgcagttgtgacacatttgaaaagtagagcaaggatgataagcacatccgaggaaattgcacaggtaggcactatctctgcaaatggtgaaagggaaattggtgaattgatcgccaaagcaatggaaaaagttggcaaggagggagtcataactattgcagatgggaagacattgtacaatgaattggaggttgtggaaggaatgaagttagataggggttatatatccccgtatttcattacaagtgaaaagacacaaaaatgtgaattagagaatcctctgatcttgatacatgaaaagaaaatttcaaatttgaatgcagttgtccgagcaatggagttggcactgaaaaagcaaagagctcttctgattgtttctgaggatgtagagagtgatgcactagcaactttaattctgaataaaattcgtgcaggagtcaaggtgtgtgcaattaaagctccaggctttggagaaaacagaaaatccaatttgcaggatcttgctgtacttactggtggtcaaatgattacagaagaacttggcatgaagcttgaaaatgttgaagctgatacgtttggcacagcaaagaaggtaactgtatcgaaggatgacactattattcttgatggaggtggcgataaaaaggctatagaagaaagatgtgagcagattcgggctgccattgaagccagcacgacagattatgataaggaaaagtacaaggagaggttggcaaagctttcgggaggagttgcagttctcaagattggtggagccagtgaggcggaggtaggggagaagaaagacagagttacagatgccttgaatgccactaaggcggcagtagaggagggtattgtgccaggtggtggcgttgctctgctatatgcaacaaaggagctcgaaaaacttcagactgctaactttgaccaaaagatcggagtgcagataattcagaatgcattgaagatgcctgcatatactattgctgcaaatgctggtgtggaaggtgcagtggtagttgggaagttactggaacaagataatcttgatcttggctacgatgctgccaaaggtgaatatgttgacatggtgaaggccgggattattgatcccctgaaagtgatcagaactgcattgggtgatgctgcaagtgtgtcttcactgttaaccacaacagagtgtgtcgttgctgagcttcctaaggatgagaaggaaggcccgggtatgggcggcggtatgggtggcatggattactgaagcatttcttgaccggtgtgccttatacatggcatcctgtttggatagtagggttaaagttaaggtttttgggtatccccgttctgaatgtagggttaaacttaaggttatttagtttgatggcattaagttttgaccttgatactgtctagaacattactttcccccttattggggacaattgattatgtattcaagccaacctaaaaatttgttgattgaagtcccctgtagtttctacaacccagctttttctgcagggaaaaatgtaatcaaagagagatcagagaatatttgttgttattgaccttctcgagatagtttgttgttattgaagtctgatgtttggataaaaaattgccgtgtctagtgtctgggctcaatcaattcaccgcaggcatgtcgcgaatactaatgcaactactgttctagcatgcacgtttactccataaagggttacaaaacattatcttcaaagagagatcagcgaattctttttgttattcagcttctggagatgggagttgattcaaaaatttatattgaagaaagtctgatgttttgg

SEQ ID NO: 1125 - DNA, 2066 bp, Pseudotsuga menziesii
ctgcaatatgtatagagcggcagcaactgtagcttcttcgatcgggaggcggagctctcgtatccagaatgccggcagattcggttggagcagaaattatgctgcaaaagagatccgttttggagttgatgcacgctcagcaatgttacaaggtattgaacaacttgcagatgcagtgaaggtgacaatgggaccaaagggtcgcaatgttattattgagcaaagttttggggctccaaaggtcacgaaggatggtgtcactgtagcaaaaagtattgagttcaaggacagagtaaagaatgtgggtgcaagtctcgttaagcaagtagccaatgcaactaatgatgttgctggagatggtacaacgtgtgcaactatactcactcgggcaatatttacagagggctgtaaatcggtagcagctggtatgaatgcaatggacttaaggcgtggtatcagcatggcagttgattctgtggtgactcatttgaaaagcagggcacgaatgataagcacatccgaggaaattgctcaggtagggactatctcagcaaatggtgaaagggagataggtgaattaattgccaaggcaatggaaaaagttgggaaagagggagtcataactgttgcggatgggaaaacattatataacgagttagatgtggtggagggaatgaagcttgacaggggttatatttctccatatttcattacaaatcaaaagactcagaaatgtgaattggaaaatcctctcattttgatacatgaaaagaaaatatctggcttgcaagcagtggttcgagttatggaactagcagtggagaggcaaaagtcccttttaatagttgcagaggatgtagagagtgaagccttggcaactttgattttaaacaagcttcgtgctggggtgaaggtctgcgctgttaaggcccctggctttggagataataggaaaaataacttgcaggatcttgctgcactcactgggggtcaggtgataacagaagatcttggtctaaagcttgagaaagtccaaattgagatgctgggatctgcaaagaaggtgacagtctcaaaggatgattcaatcattcttgatgggggcggtgacaaaaagggtcttgaagaaagatgtgagcagatccgatctagtattgaagcaagtacttcagactatgacaaggaaaagcttcaagagaggttggcaagactatcaggaggagttgctgttctcaagattggtggagccagtgagcttgaagtaggggagaagaaagatcgagtcactgatgccttgaatgctaccaaggcagcagtagaggagggcattttaccaggtggtggtgttgctcttctctatgcggcaagggagcttgacaaactacaatcagcaaactttgaccagaagattggagtccaaataatccagaatgcattgaagacacctgtgcatactattgctagcaatgctggtgtagagggcgctgtcgtagtgggcaaattacttgaacaggaaaattttgattatggctatgatgctgctaaaggtgaatatgtggacatggtaaaggctggcatcattgatcctttgaaagttatcaggactgcattggtcgatgcagcaagtgtgtcttcattgctgaccacaacagaggcagtggttgtcgaactcccaaaggatgacaaaccaagcccagctatggggggcatgccacccatgggtggtatggacttttaaaaggcttcttgagttgcgaggattctatcagaaaaaaagagcaagttttggggcgacgtggcaagtttaagtcacacgagaatttgttcaactgtcttctgctacgcggtgctcttttctttccaattagcagttgaatagtgcattctatttttccgtgattgcataagtgaataatttattttctatgttggctgaaaaattttcattgagctgcctggtgtgactacatccagagagaaattttgtaagcattgcggacattgaacagttttgtaattgtttcaatataaaagcaattacgttgacccttatttttaaatgcgac

SEQ ID NO: 1126 - DNA, 1703 bp, Citrullus lanatus
tcccgaatgagggatttcagatcaattctagattgaactctagtaggaattatgcagcgaaggacattaaatttggggttgaagcgcgcaccttgatgcttcggggtgtcgaagagcttgctgatgctgtcaaagttacaatggggccgaaaggacgtaatgtagtcttagagcaaagttttggtggcccaaaagtgacaaaagatggtgttactgttgcaaagagcattgaattcaaagataaagttaaaaatattggggctagtttggtgaagcaggttgcaaatgctaccaatgatgtggcaggagatggcacaacatgcgcaacagtccttactcgtgcaatatttactgaaggatgtaaatctgtggcttctggagtgaatgctatggatttaagacgtgggattacaatggcagttgattctgttattacaactctgaagagcagagtgcagatgatcagtacatctgaagaaatagcccaggttggaactatatcagcaaatggcgaacgagagattggtgagctaatagccaaggccatggaaaaagtaggcaaggatggagttatcaccatttcagatggtaacacacttgataatgaattggagattgttgagggaatgaagctggataggggttatatatctccttattttattaccaaccagaaaaaccagaaatgtgaattggaagatccactaattttaattcacgagaagaaaatctcaaatttaaatgctgtggtaaaagtcttggagttggcactgaagagacaaaggcctttacttattgttgctgaggatgtggaaagtgaggcattagctactcttattttaaacaagttacgtgctggtataaaggtttgtgcaattaaagcccccgggtttggagataataggaaggctagcatgcaggatttggcgattctcacaggaggccaagtcataactgaggaacttggtctagcccttgaaaaagttagttttgaatcactgggctcatgcaaaaaggttacggtgtcaaaagatgatactgtaattcttgatggggctggtgacaagaaggcaattgaagaacagtccgagcagttgagatccttgattgagttgagcacttcagactatgacaaggaaaagctgcaagaacggcttgcaaaactatctggtggagttgctgttcttaagattggcggggctagtgaagctgaagttggggaaaagaaggatagagttaccgatgcactaaatgctaccaaagctgctgtggaggagggaattgtagctggtggtggtgttgctctgctctatgcatcgaaggagttggagaagttgcagacagcaaatttcgatcagaaaattggtgttcaaatcattcaaaatgctctaaagatgcctatttatacaattgcttctaatgccggaattgaaggagcagtagtgattggcaagctactcgaacaggacaattctgaccttggatacgatgcagcaaaaggtgaatatgtagacatgatcaaggctggaattattgatcccttgaaagttatcagaaccgccctagtagatgccgcgagtgtatcttcgctgatgacaacaacggaagccgtggtggtcgaacaaccaaacgatgagaaggaagccacaccatctatgggaggcatgggttattgaaactgaaccagaatagctgattatgta

SEQ ID NO: 1127 - DNA, 1810 bp, Festuca arundinacea
atccaccttccctccctcgccatgtaccgcgccgccgccagcctcgcctccaaggcccggcaagccgggaccagcgctcgccaggtcgggagcaggctcgcctggagcaggaactatgctgccaaggacatcaggttcggcgtcgaagccagggcccagatgctccggggtgttgaagagttggctgatgcggttaagttgactatgggtcctaaggggcgcactgttattattgagcaaagctttggtgctcccaaagttacaaaggatggagtgactgttgccaagagcattgagttcagtgacagggttaagaatgttggtgcaagtcttgtgaagcaggttgcgaatgcgacaaatgacactgctggggatggtacaacatgtgccactgttctgacaaaggcaatattcactgagggttgtaagtcagttgcggctggaatgaatgcaatggatctgagacgtggtatctcaatggctgttgattctggggttacaaacctaaagggcatggccagaatgatcaatacatctgaggaaatagcacaggtgggtactatttctgctaatggtgagagggaaatcggtgagctcattgcaaaagctatggagaaggttggtaaagagggagttatcaccattgcggatggtaacacactatacaacgagcttgaagttgtggaaggcatgaagcttgacaaaggttacatctccccatacttcattaccaaccagaagacccagaaatgtgaactagatgatcccataatcttgatacatgataagaaggtatccaaccttcaagctctgatcaaggtgttggagtactctcaccagaagcaaaagcctctgcttattgttgcagaagatctagaaagtgaagcattgggtatgttgattctcaacaagcttcgtgcaggccttaaggtctgtgcggtcaaagctcctggttttggagagaacaggaaatccagcctacaggaccttgctatccttacaggtggagaagtcatatctgaagaacttggaatgaaccttgagaaatttgagcctaacatgctgggtacctgcaagaaggttacagtatcgaaggatgacacagtcatccttgatggagcgggagataagaaggctattgaagagagagctgagctgctgagatctgctattgagcaaagcacttctgactacgataaggaaaagatacaggagcgattggcaaagctttctggcggtatcgctgttctgaagattggcggggcgagtgaagcggaggttggtgagaagaaggacagagtgacggatgcactaaatgctacgaaagctgcagtagaggagggtattgtaccaggtggtggtgttgcccttctctatgcgtcaagaaacctcgataagttggagaccgcaaactttgaccaaaagattggtgtccaaatcattcaaaatgctttgaagaccccagtgcacaccattgctacaaatgcaggtgtagaaggggctgtcattgttggcaagctcttggagcaggaaaacaccgacctgggctatgatgctgccaaaggtgaatatgtggacatggtgaaggctggtatcatcgacccacttaaagtgatcagaacagccttggtggatgctgcaagtgtatcctctctgatgactaccacggaagctatcatcgttgagagccccaaagaagagaaggcggcacccgcaatgggaggaggcggcatgggcggcatggatttctaacttgctcccaggcacatgtcaaaacaatgtgattatatggaacacttaggctagatct

SEQ ID NO: 1128 - DNA, 1963 bp, Festuca arundinacea
atccaccttccctccctcgccatgtaccgcgccgccgccagcctcgcctccaaggcccggcaagcagggaccagcgctcgccaggtcgggagcaggctagcctggagcaggaactatgctgccaaggacatcaggttcggcgtcgaggccagggcccagatgctcaggggcgttgaagagttggctgatgcggttaagctgaccatgggtcctaaggggcgaaccgttattattgagcaaagctttggtgctcccaaagttacaaaggatggagtgactgttgccaagagcatagagttcagcgacagagttaagaatgttggtgctagtcttgtgaagcaggttgctaatgcgaccaatgatactgctggggatggtacaacatgtgccactgttctgacaaaggcaatattcactgagggctgcaagtcagttgcggctggaatgaatgcaatggatctgagacgtggtatctcaatggctgttgattctgtggttacaaacctaaagggcatggccagaatgatcaatacatctgaggaaatagcacaggtgggtactatttctgctaatggtgagagggaaatcggtgagctgattgcaaaagctatggagaaggttggtaaagagggagttatcaccattgcggatggtaacacactatacaacgagcttgaagttgtggaaggcatgaagcttgacagaggttacatctccccatacttcattaccaaccagaagacccagaaatgtgaactagatgatccaataatcttgatatatgataagaaggtatccaaccttcaagctctgatcaaggtgttggagtactcccaccagaagcaaaagcctctgcttattgttgcagaagatctagaaagtgaagcattgggtatgttgattctcaacaagcttcgtgcaggccttaagctctgtgcggtcaaagctcctggttttggagagaacaggaaatccagcctacaggaccttgctatccttacaggtggagaagtcatatctgaagaacttggaatgaaccttgagaaatttgagcctagcatgctgggtacctgcaagaaggttacagtatcaaaggatgacacagtcatccttgatggagcgggagataagaaggctattgaagagagagctgagctgctgagatctgcaattgagcaaagcacttctgactatgataaggaaaagatacaggagcgattggcaaagctttctggcggtatcgctgttctgaagattggcggggcgagtgaagcagaggttggtgagaagaaggacagagtgacggatgcactaaatgctacaaaagctgcagttgaggagggtattgtaccaggtggtggtgttgcccttctctatgcgtcaagaaacctcgataagttggagaccgcaaactttgaccagaagattggtgttcagatcattcaaaatgctttgaagaccccagtgcacaccattgctacaaatgcaggtgtagaaggggctgtgattgttggtaagctcttggagcaggataacaccgacctaggctatgatgctgccaaaggtgaatatgtggacatggtgaaggctggtatcattgacccacttaaagtcatcagaacagctttggtggatgctgcaagtgtttcctctctgatgaccaccacggaagctatcattgttgagagccccaaggaagataaggcggcacctgcagtgggaggaggcggcatgggtgggatggatttctaggcttgctcccctactgatgtcgaaacaatgtgattatgtgaaacatttaggctagacctttttgcagtctgggttcatctctatgtactgtccgtatgaggaggctgtcccatattttgttttgcggcaagaggatttaaaacctcaaaaatactttatgctgtggtctcatgcaagcattgagatatgaatttatgaagaactgaaagct

SEQ ID NO: 1129 - DNA, 1863 bp, Helianthus annuus
atgcgaaactatgctgcaaaagatattaaatttggagtggatgctagagctttgatgcttagaggtgttgaagagcttgctgatgctgttaaagttaccatgggtcctaaggggcgtaatgtggtcattgaacaaagttatggagctccgaaggtgacgaaggatggtgtcaccgtggcaaaaagtatcgagtttaaagacagggttaagaacgtcggtgctagtctcgtcaagcaggttgctaacgccaccaatgacgttgctggcgatggtaccacttgtgcaacggttctaacgaaggcaattcattccgaaggctgcaaatcagttgcagctggaatgaatgccatggatcttagacgtgggatcaccatggccgttgattcagtagtcacaaacttgaagagtcgagccagaatgatcagcacgtccgaagagatagctcaggttgggacaatatcagcaaacggagaacgagagattggcgagcttattgccaaagctatggagaaagttggcaaagagggtgttattaccatatctgatgggaaaacacttatcaatgaattggaagtggttgagggaatgaagttggacagaggctatatatcaccttacttcatcaccaatacaaagaaccaaaaatgtgaattagacgaccctttgattctaatacacgagaaaaaaatctctagcttaaattctattgttaaagttctggagttggctttgaagaatcaaagatcactgctgattgttgctgaagatattgaaagcgaggcattagccacactcattcttaacaagctccgcgctggtattaaggtttgtgccatcaaagcccctggattcggagaaagccgaaagtcaaatttgcaagaccttgcaattcttaccggaggagaggtcataaccgatgaacttggcatgaacctcgaaaaaatgtcaccagacatgctagggacttgcaaaagggttacaatatcaaaggatgatacggttattctcgacggggctggtgataagaaagccattgaagaacgatgtgaacagttgagatcatcaatcgaattaagcacttctgattatgataccgagaagctgcaagagagactagcaaagctctctggtggcgttgcggttttgaagattggaggagctagtgaagctgaggttggtgagaagaaggatagggttactgacgctttaaacgctacaaaagctgcagttgaggaaggaatcgtaccaggtggtggtgtggctcttctatatgcttccaaggagctcgaaaagcttcagactgccaattttgaccagaagatcggtgttcaaataatccaaaatgctctcaaggcaccggtgcacacgattgcttccaatgctggagtcgaaggtgctgttgttgtcggaaaactgttggagcaggataaccccgatatcggatatgatgctgctaaaggtcaatacgtagacatggtcaaagaaggaatcatcgaccccctgaaagtcatcaggacagcattagttgacgccgcaagcgtgtcatctttattgaccacaaccgaagcagtaattgttgagcttccaaaagatgagaaggaatcgccagcaatgagtccaggcatgggtgactattaatgtcaccagtaacccttttcatttcctccatcaatcattattttcaaactgtacaataattcaaattagtaccgattttggtaggcgtttagatccaattctcaaccgatccaaatttttaagggttttttttttcgatatatgctttttattgatgcaaaaccatcatgtaatcttcggaggggttgtgtttaactggaattaatgataaccaagaacgttttt

SEQ ID NO: 1130 - DNA, 1242 bp, Triticum aestivum
ctcgcccagagtgaataaacacggcggggccatgccccgtgcgctctcgccatcgagacgtaacgtacgtatcatgcagtgcaccgctcgcggcaatgcaccggccgcctctatttatagcctcccacgccccatccttttccacatcccagcctcaacaaccaccaaagtacacacaccacactaatcaagtacacatccaggccaccaagccaccgagcgagcgatcaccatatcacacatagcgccatgtctggcgtgtgggtgttccgcaacggggtggtgaagctggtggagaaccacccggcgtcggcggcggggccaccgggaggcggggcggtccggcgcaaggcgctactgcacacgcccacgggggaggtggtcgcctcctacgcctccctggagcgcaagctcgtcgcgcttggctgggagcgctactacgccggcgggggcggcgccgccggcgactgtatgctcaggttccacaagcgctcctccgtcgacctcatctccctccccaaggacttcggccagttcagctccgtccacatgtacgacgtcgttatcaagaaccgcgacgccttccgcgtcatcgacgtctagctgagctagctggctgatccggccattcgatgaagcaagcacagctaggtcgtgcaagccggcggccgctaccgtcgcatccatgtcgtcatcgatctccgctggttaacttttccaccttgtgtacgtgtgtgtatgtgtgtgtacgtaacctgcacgtatatacgtgtgtatgtatatgtactagtattaggctatggatgtgcagagaccttgtgcatcacttgccacttgcttgtcaagcttgtttggtaataatttggaaaggccatcaaaagactattcactcaaaactaacatgtggttgaatggttttagtggggtagttatataaccgttgtaccggagagcaaaccaaatgtagccgtgtctcataaggcggaatattattcagtagaaggtgatgtttccgccgagacgtctattatggcttcgtcattcttaaagcgaccacgactctgctcaatgttgtgtgagtacgtatgtgccgttagtggtggtgtatccgctatgttgtgttgtactcggtgtttcttttatctttcttttgtgaatgctaatgagtttctgaccaaattacacatatgaaacattttttggataacgtcatttttgttaaactgaatttcggacggaaaa

SEQ ID NO: 1131 - DNA, 807 bp, Triticum aestivum
agccacccagcgagcgatcaccatatcacacatagcgccatgtctggcgtgtgggtgttccgcaacggggtggtgaagctggtggagaaccacccggcgtcggcggccggaccgccgggcggcggggcggtgcggcgcaaggcgctgctccacacgcccacgggggaggtggtcgcctcctacgcctcgctggagcgcaagctcgtcgcgctcggctgggagcgctactacgccggcgggggcggcgccgccggcgactgcatgctcaggttccacaagcgctcctccgtcgacctcatctccctccccaaggacttcggccagttcagctccgtccacatgtacgacgtcgtcatcaagaaccgcgacgccttccgcgtcatcgacgtctagctgagctagctggctgatccggccattctatgaagcaagcacggctagctcgtgcgcgccggcggccgccaccgtcgcatccatgtcgtcatcgatctccgctgtttaacttgtcctccttgtgtctgtgtgtacgtaccctgcacgtatatacgtgtgtatgtatatgtactagtattaggctatcgatgtgcagagaccttgtgcatcacttgccatttgctcgtcaagcttgtgtggtaataatgtgggaaggccatcaaaaaatattcactcaaaactaacatgtggttgaatggttttagtggggtagttatataaccgttgtaccggagagcaaaccaaatgtagccgtgtctcataaggcggaatattattcagtagaaggtgatgtttccgccgagacgtctatta

SEQ ID NO: 1132 - DNA, 757 bp, Secale cereale
caaccaccagagtacacacaccacactaatcaagtacacatccaggccatcaagccacctagtagagaaagatcaccatatctcatagcgccatgtccggcgtgtgggtgttccgcaacggggtggtgaagctggtggagaaccacccggcgtcggcggcgggaccgcagggcggcggggcggtgcggcgcaaggcgctgctgcacacgcccacgggggagtggtcgcctcatacgcctcgctggagcgcaagctcgtcgcgctcggctgggagcgctactacgccggcgggagcggcgccgccggcgactgcatgctcaggttccacaagcgctcctccgtcgacctcatctccctccccaaggacttcggccagttcagctccgtccacatgtacgacgtcgtcatcaagaaccgcgacgccttccgcgtcatcgacgtctagccctgaagattcggccattcgatcgaagaaagcacggctagctcgtgcgcgccggcggccgccaccgtcgcatccatgtcgtcatcgatttccgctggttaacttgcccaccttgtgtatgtgtgtgtatgtcagtatgtgtgtacgtaccctgtacgtatatacgtgtgtatgtatatgtactacgtatatatagacatacatgctgcgtgtccattgtggttaattaatttgtgtactagtgttaggatatcaatgtgcaaggaccttgtgcatcacttggtacaaaacttggtgtggccgtaaaaaaaa

SEQ ID NO: 1133 - DNA, 566 bp, Lolium multiflorum
gtcctagacttcttctatctcccatcccagcatcaacaacctccaaattcaaagtacacacacactaatcatcaagtacacatccaggcaaccaagaagctaccagaagaaagcatgtcgggcgtgtgggtgttccggaacggggtggtgaagctggtggagaacccggcgtcggcggccgcggcggccggcggggtggtccggcgcaaggccctgctgcacacgcccaccggagaggtggtggcctcctacgcctcgctggagcgcaagctcaccgcgctcggctgggagcgctactatgccggcggcggcggggccgccggcgattgcatgctaaggttccacaagcgctcctccgtcgacctcatctccctccccaaggacttcggccacttcagctccgtccacatgtacgacgtcgtcatcaagaaccgcgacgccttccgcgtcatcgacgtctaggcctagctggctggccagttcgaccaaaggaagcatagctcgcgcacgcgcgtcgccgccaccgtctctcgcatatatctgtgacttcgtcgatctccgaccgt

SEQ ID NO: 1134 - DNA, 878 bp, Brachypodium distachyon
acacaccccagccgcaaacccccaaatccgcccaaagaacaatatacaaacaccagccaaacacacaaacccaaggcaaagaagcgctagccacaaacataaagagagactaattagccacaaacataaagctagagaggttatacagttagcgtgagacggatgtcgggcgtgtgggtgttccggaacggggtggtgaagctggtggagaacccgtcgtcggcgtcggcggcgcccggcggcggcgtggtgcggcggaaggcgctgctgcacacgccgacgggggaggtggtgtcgtcgtacgcgtcgctggagcgccggctgctggggctgggctgggagcggtactacggcggagggtcgtccggacatggagctgacggcgggggcatgctgcggttccacaagcggtcgtcggtggacctgatctcggtgcccaaggacttcgcccacttcagctccgtccacatgtacgacgtcgtcatcaagaaccgcgagagcttccgcgtcatcgacgtctagctaagctctccgcctccctccggatcagctgagccggccggccagtactggttggtgtatactgctaattgtgtgtatgcatgtttgtacatactctatctgcacgtatatgtacatctacgcgtgtataaacgtactcgctagctgtacgtgtgtaggagtattacagtattaattactgcagtatgtgcgtacgcgctgtacgtgtgtgttgacatttgtgtattaggtagattgttgatgtgcgcatggtcgttggtacctggatcgtgtgcatgcattggtgtgtggatgtatgtatcatcaggtgcttaattaatttcggctggaatgaataaatattgtaattcactctc

SEQ ID NO: 1135 - DNA, 668 bp, Brachypodium distachyon
cccaaactaagaacagaagaaaccagacagtagtacgcaatgtcgggcgtgtgggtgttccggaacggggtggtgcggctggtggagaacccggcatcggcggtgaccggcggcaccggcggcgggggtggaggcaggcgcaaggcgctgctgcacaccccgacgggggaggtggtggcctcctacgcgtcgctggagcgcaagctgctgggcctgggctgggagcgctactacggcggcggagacgacggcaagatgctgcagttccacaagcgctcgtccgtggacctcatctcgctccccaaggatttcgggaagttcaactccatgcagatgtacgacgtcgtcgtcaagaaccgcgacgccttccgcgtcatcgacgtctagaactaaagtcatatatggagctcgcgggcgctccgcgcagccccgccacgttaccacgtaccatggcatcgcatcaatgtcgtcgatcgtgtgtgtttgttgactagctagtctctgcacacgtacgtgcgtgcgcgtacgtacctgcattctcgtaccgtgtatatatatgtcactggtgtatcatacatcccccgcgcgtatacatataaattgtatgcataaaataattcggcgccacggtacgtgccacccacggaatggtaaagacgcttgcatga

SEQ ID NO: 1136 - DNA, 660 bp, Brachypodium distachyon
aagaacagaagaaaccagacagtagtacgcaatgtcgggcgtgtgggtgttccggaacggggtggtgcggctggtggagaacccggcatcggcggtgaccggcggcaccggcggcgggggtggaggcaggcgcaaggcgctgctgcacaccccgacgggggaggtggtggcctcctacgcgtcgctggagcgcaagctgctgggcctgggctgggagcgctactacggcggcggagacgacggcaagatgctgcagttccacaagcgctcgtccgtggacctcatctcgctccccaaggatttcgggaagttcaactccatgcagatgtacgacgtcgtcgtcaagaaccgcgacgccttccgcgtcatcgacgtctagaactaaagtcatatatggagctcgcgggcgctccgcgcagccccgccacgttaccacgtaccatggcatcgcatcaatgtcgtcgatcgtgtgtgtttgttgactagctagtctctgcacacgtacgtgcgtgcgcgtacgtacctgcattctcgtaccgtgtatatatatgtcactggtgtatcatacatcccccgcgcgtatacatataaattgtatgcataaaataattcggcgccacggtacgtgccacccacggaatggtaaagacgcttgcatga

SEQ ID NO: 1137 - DNA, 638 bp, Avena sativa
catgcgcccgtgcgctctccctatctcgatcgggacgtataccatgcaccgctcgcggcacggctagctgggcacgtaccgcctctcctatttataccctcccacgccccccatccttttccacatcccagccgtctcaacaacctccaatccaaagtacacacaccaatcatcatcaggtacacacatacatccaagccaagaagctaccagaagacaacaccatgtccggcgtgtgggtgttccggaacggggtggtgaagctggtggagaaccacccggcgtcggcggccacggcggccccccccccccccccccccccccccccccccccccccccccccccccccccccccccccccgggccgtccggcgcaaggccctgctgcacacgcccacgggggaggtggtcgcctcctacgcgtcgctggagcgcaagctgctcgcgctcggctgggagcgctactacgccggcggcggtggggcggccggcgacggcatgctcaggttccacaagcgctcctccgtcgacctcatctccctccccaaggacttcgcccacttcggctccgtccacatgtacgacgtcgtcatcaagaaccgcgacgccttccgcgtcatcgacgtctaggctggct

SEQ ID NO: 1138 - DNA, 1540 bp, Secale cereale
ccccgaccgcgcatggagctgttcgcgcacgccaaggcggtgcggctgaagagccggcacgacaagttcctgtacgcggacgaggacgagctgcacgtcacgcaggaccgcaacggctcctccccgagcgcgcgctggacggtggagcccgtgccgcacgcgcccggcgcggtgcgcctccgcagcaggtacggccgctacctggccgcctccaccgagccgttcctgctgggcatgacgggccgcaaggtgctgcaggccgcggcggcgcccgggggccgccccgacgcgtccgtcgagtgggagcccgtccgcgacggcttccaggtacgcttcaagtcccgcgccggcggcgtccgcggcggaggggacaagtacctccgcgccaacgggggcgtcccgccgtggcgcaactccgtcacgcacgacgtgcctcaccgcaccgccacccaggactgggtgctctgggacgtcgagatcgtgcaggtgctcacccctggcccggccacgcccgccccggagaaggccgtatccgcgccccccgccgccctcgcgcccgactcgccgcccgcgcccaagctcaggcccgcgccgacaccctacgaggcgcaccaccggcccaccaagtcccagacgtccccgccgccgccggactacgcgccgcccccgccgcccaagcccaagccggagcccaggctgtccaagctcgagtcttccgattccttctctgccccgttgcacaaggtgcagggccgtgcgatccactaccacattgcagacgataagggcgacgtagacgatgatatcgagagacgctcattcacatttaatggctctaacctggaggagctcacccagaagttacaagaggaaacaggcatcgatgatctgatcgtctgcacgcgcagccctatcagcgggaagctcactcctctccttctgcagctgcctccgaacaatgcagcaatgcacattgtgctcgtccgtgagtcctcaaaagtggcaaagacgtttccatggccatacggctcataatctccggagtgaaggcggtagcttcaagttgagcaatggaatgatgggctctgcatctggatctgcttaatactttgttctttggaactataccggtcattctggcttctgggtatcagaagcaactaggatcccgttcttgtgtgtataaagtgttagattaaattaaaccggcggaccgtgccaagaactggagagatgtttatactttacagactattagtagtatgtttatactttatagactagttggaggttggtgatggtacttggaactttgtattcccttggtttattgattggatcattggagatagtgctgtccatgaatattctggcctggaatactcagtagactcgttcctcgattggtattccagtctggtaagtggttacttttcgtcgtactccgtttagtagttaattgaaaaacttagaaaggcaagtatgtctgaccttaaacgaaaaaaaaaaaaaaaactgtaacggatgaccacggaacgca

SEQ ID NO: 1139 - DNA, 1579 bp, Brachypodium distachyon
acaacagctcagcggcgtctcgtctcgtcgtcaaccttggccgccccatagaaaccccgccgaggaaaatcaggagtcaggacgatccaattccccaccagaatccagatagccacgccggaatcgaaccgccggagagagagatggagctgttcgcgcacgccaaggcggtgcggctgaagagcaggcacgacaagttcctgtacgcggacgaggacgagctgcacgtcacgcaggaccggaacggctcctcccccaacgcgcggtgggcggtcgagcacgccgccccaggatgcgtgcgcctcaggagccgctacggccgctacctggccgcctccagcgagcccttcctgctcggaatgacgggccgcaaggtgctgcaggcggcggcccccgcgcccggagccggggccaggcccgacgcgtccgtggagtgggagcccgtcagggacgggttccaggcgcggctcaagacacggcagggagggaactacctccgcgccaacggcggcctcccgccgtggcggaactccgtcacccatgacgtgccgcaccgcaccgccacgcaggactgggtgctctgggatgtcgagatcgtgcaggtgctcacgccgggccccgccgaacacgccgcgtccgcgccggctgccgtcctcgcgcccgagtccccgcccgcgcccaagctcaggccgccgcccacgccgcacgaggcgcaccaccgccccaccaagtcgtacgcagccgcgacgccgccgccggagtacgcgccgcctccgccgccgccgaaacgagctgagcacgcagcgccgccaccgccggcacggccggatcccaggctctccaagctcgagtcctccaattctttctccgccccattgcacaaggtggagggccgtgcaatccattacctcatcgcagatgataagggaaacgtagatgatgatgttgagagacactcgttcacatttaatggctccaacttggaggagctcacccacaagctacaagaggagacaggccttgatgatctaattatctgcacacgcagccctatcaatgggaagctcactcctctgcttctgcagctaccaccaaacaatgcagcaatgcatattgtgctcgtccgtgagtcctcaaaagtggcaaaaacatttccttggccctatggctcataatcttcggaggggagacgatgactcttagttgagggatggaatgataggtcatatatctggtcagtacatcgttctttggttataccaattattctgggtatcagaagcaactatttccttgtgcttccagcgaggatcccgttcttgtgtataaagtctttagaattaagttatatcggcagagattgatcgtgccaaagactgtagagatatttatagagtatagactagttgggggttgatacttggaaatatatattcccttgatttatggaatcgttggagagatattagtacccatgaatattctagaccggaagactcgttttccagttggattccgcctgtatgtatcaggtataagtactccgagcatatgaattgtctgacttgactttttcttg

SEQ ID NO: 1140 - DNA, 1583 bp, Brachypodium distachyon
acaacagctcagcggcgtctcgtctcgtcgtcaaccttggccgccccatagaaaccccgccgaggaaaatcaggagtcaggacgatccaattccccaccagaatccagatagccacgccggaatcgaaccgccggagagagagatggagctgttcgcgcacgccaaggcggtgcggctgaagagcaggcacgacaagttcctgtacgcggacgaggacgagctgcacgtcacgcaggaccggaacggctcctcccccaacgcgcggtgggcggtcgagcacgccgccccaggatgcgtgcgcctcaggagccgctacggccgctacctggccgcctccagcgagcccttcctgctcggaatgacgggccgcaaggtgctgcaggcggcggcccccgcgcccggagccggggccaggcccgacgcgtccgtggagtgggagcccgtcagggacgggttccaggcgcggctcaagacacggcagggagggaactacctccgcgccaacggcggcctcccgccgtggcggaactccgtcacccatgacgtgccgcaccgcaccgccacgcaggactgggtgctctgggatgtcgagatcgtgcaggtgctcacgccgggccccgccgaacacgccgcgtccgcgccggctgccgtcctcgcgcccgagtccccgcccgcgcccaagctcaggccgccgcccacgccgcacgaggcgcaccaccgccccaccaagtcgtacgcagccgcgacgccgccgccggagtacgcgccgcctccgccgccgccgaaacgagctgagcacgcagcgccgccaccgccggcacggccggatcccaggctctccaagctcgagtcctccaattctttctccgccccattgcacaaggtggagggccgtgcaatccattacctcatcgcagatgataagggaaacgtagatgatgatgttgagagacactcgttcacatttaatggctccaacttggaggagctcacccacaagctacaagaggagacaggccttgatgatctaattatctgcacacgcagccctatcaatgggaagctcactcctctgcttctgcagctaccaccaaacaatgcagcaatgcatattgtgctcgtccgtgagtcctcaaaagtggcaaaaacatttccttggccctatggctcataatcttcggaggggagacgatgactcttagttgagggatggaatgataggtcatatatctggtcagtacatcgttctttggttataccaattattctgggtatcagaagcaactatttccttgtgcttccagcgaggatcccgttcttgtgtataaagtctttagaattaagttatatcggcagagattgatcgtgccaaagactgtagagatatttatagagtatagactagttgggggttgatacttggaaatatatattcccttgatttatggaatcgttggagagatattagtacccatgaatattctagaccggaagactcgttttccagttggattccgcctgtatgtatcaggtataagtactccgagcatatgaattgtctgacttgactttttcttgggaa

SEQ ID NO: 1141 - DNA, 2120 bp, Secale cereale
tgcgtctaaaccccccgccgccgaccatggcgtcctcccccgctaaaccctactgctgctcctccctaaaccccgccccctccacccccctcgccaggcgcgctgccctctccgccctccccgccgccaagccctgccgcttctcctatggcctcgccgccgtcgccgcgaaccctagggcctcccgctccgctgtcctccgccccgtccacgcgtgcctggcgccgccgcggcggccggagtacgtcccggaccgaatcgacgaccccaactacgttcgcatcttcgacaccacgctccgcgacggggagcaatccccgggggccaccatgaccagcgcggagaagctcgtcgtcgcgcgccagctcgcccgcctcggcgtcgacatcatcgaggcgggcttcccggcgtcctcgccggacgaccttgatgccgtgcgatccatcgccatcgaggtggggaacacacccgtcggggaggatggccatgtgcccgtcatctgcggcctttcgcggtgcaacaagagggacattgacgccgcctgggaggccgtgcgccacgcacgtaagccgcgcatccataccttcattgctaccagcgagatccacatgcagcacaagctgcggaagacgcccgaccaggtggtggccatcgcaagggagatggtggcttatgcgcgcagtcttggatgccccgatgtcgagttcagccccgaggacgccggcaggtcaaatcgagagttcctgtatcatatcctagaggaagtaataaaagctggagcgactactctcaacatcccggacactgttgggtacactctccctcatgaattcgggaaattaattgctgacataaaagcaaacactcctggaattgaaaatgcaattatatctactcattgccaaaatgatcttggtcttgcaagtgccaacacattagcgggtgcttatgcaggagcgcgacaattagaggtgactatcaatggtattggtgaaagagctggaaatgcttccttggaggaggttgtcatggcaattaaatgtcgacgagaactcttaggtggattatatactggaattaattcgcaacatattaccatgacaagcaaaatggtacaagagcacagtggacttcatgtacagccgcataaagctattgttggtgccaatgcctttgctcatgaaagtggaattcatcaggatgggatgcttaaatttaaaggaacttatgagataatatcgcctgatgatattggtttaacacgtgcaaatgagtttggtattgttcttgggaagctcagtggaaggcatgctgtcagaaccaaactagtggagcttggatatgaaatcaatgacaaagaatttgaggatttctttaaacgctacaaagaggttgcagagaaaaagaagcgtgtaactgatgaagacatagaagctttattgtctgatgagatatttcagcctaaggttatttggtcccttggtgatgtacaggcaacatgtggaacacttggtttatctacagcaactgtcaaattgataactatagatggagaggagaagataggatgttctgttggaactggcccagttgatgcagcatacaaggctgttgaccaaataatacagattccaactgttcttagagaatatagcatgacttcggtcacagaaggcattgatgcaattgcaaccactcgagtagtcatctctggagatgtcagcgccgataaacctgctttgactagtaactccaatcgatccttcagtgggagtggcgcagccatggatgttgtcgtatccagtgtccgagcttacctcagtgccctgaataagatgtccagttatgttggtgctgtaaaagccagcagcgaagcacctgaaaccacaagtgttcagagcacagcatgagcgtttacattacatttctttttggttatttcatccccggagcaatgtgaattccccggcaaagtgtttaaaatctggtattacatgttagtaaagagctgtttcgtgctgtaagggatgggttttccagctggtgtgcatctgaaggatattttgttctcattggtgaattgcaacttttgcttgaataatgaagcaattttacaacac

SEQ ID NO: 1142 - DNA, 2013 bp, Triticum aestivum
atcgccaggcgcgctgccctctccgccctccccgccgccaagccccgccgcttctcccatggcctcgccgccgtcgccgcgaaccctagggcctcccgctccgccgtcctccgccccgtccgcgcgtgcctggcggcgccgcggcggccggagtacgtcccggaccgaatcgacgaccccaactacgttcgcatcttcgacaccacgctccgcgacggggagcagtccccgggggccaccatgaccagcgcggagaagctcgtcgtcgcgcgccagctcgcccgcctcggcgtcgacatcatcgaggcgggcttcccggcgtcctcgccggacgaccttgatgccgtgcgatccatcgccatcgaggtggggaacacacccgtcggcgaggatggccatgtgcccgtcatctgcggcctctcgcggtgcaacaagagggacattgacgccgcctgggaggccgtgcgccacgcacggaagccgcgcatccataccttcattgctaccagcgagatccacatgcagcacaagctgcggaagacgcccgaccaggtggtggccatcgcaagggagatggtggcttatgcgcgcagtcttggatgccccgatgtcgagttcagccccgaggacgccggcaggtcaaatcgagagttcctgtatcatatcctagaggaagtaataaaagctggagcgacaactctcaacatcccggacactgttgggtacactctccctcatgaattcgggaaattaattgctgacataaaagcaaacactcctggaattgaaaatgcaattatatctactcattgccaaaatgatcttggtcttgcaagtgccaacacattagcgggtgcttatgcaggagcacgacaattagaggtgactatcaatggtattggtgaaagagccggaaatgcttccttggaggaggttgtcatggcaattaaatgtcgacgagaactcttaggtggattacacactggaattaattcgcaacatattaccatgacaagcaaaatggtacaagagcacagtggacttcatgtacagccgcataaagctattgttggtgccaatgcctttgctcatgaaagtggaattcatcaggatgggatgcttaaatttaaaggaacttatgagataatatcgcctgatgatattggtttaacacgtgcaaatgagtttggtattgttcttgggaagctcagtggaaggcatgctgtcagaaccaaactagtggagcttggatatgaaatcaatgacaaagaatttgaggatttctttaaacgctacaaagaggttgcagagaaaaagaagcgtgtaactgatgaagacatagaagctttattgtctgatgagatatttcagcctaaggttatttggtcccttggtgatgtacaggcaacatgtggaacacttggtttatctacagcaactgtcaaattgataactatagatggagaggaaaagataggatgttctgttggaactggcccagttgatgcagcatacaaggctgttgaccaaataatacagattccaactgttcttagagaatatagcatgacttcggtcacagaaggcattgatgcaattgcaaccactcgagtagtcatcgctggagatgtcagcgccgataaacctgctttgactagtaactccaatcgatccttcagtgggagtggcgcagccatggatgttgtcgtatccagtgtccgagcttacctcagtgccctgaataagatgtccagttatgttggtgctgtaaaagccagcagcgaagcacctgaaaccattagtgttcagaccacagaatgagcgtttacactacatttcttttcggttatgtcatccctggagcaatgtgaaatccccggcaaagtgtttaaaatatggtgttgcatgttagtaaagagctgtttggtggtgtaaggggatggtttttccagctgtcgtggatctgaaggatattttgttctcattggtgaattgcaacttctgtttgaataa

SEQ ID NO: 1143 - DNA, 2193 bp, Brachypodium distachyon
cttcccctaaacccccagcgccgcctccgacgaccatggccgcctcccccgctaaaccctgctgcttctcctccttaaaccccgcctcctccaccccgctcgccaggcgctcaaggaccctctcctcctccgccgctgccgccaagccccaccgcttctcccatggcctcgccgcagccgccgtcgccgcgaaccctagggccgccgcgctccgccgccccgtccgcgcgtgcctggcggcgggggcggcgccgcggcgccccgagtacgtcccggaccgcatcgacgaccccaactacgtgcgcatcttcgacaccacgctccgcgacggggagcagtccccgggggccaccatgaccagcgccgagaagctcgtcgtcgcgcgccagctcgcccgcctcggcgtcgacatcatcgaggccgggttcccggcctcctcgcccgacgacctcgacgccgtgcgctccatcgccatcgaggtcgggaacacgccgctcgggggggacggccacgtgcccgtcatctgcggcctctcccggtgcaacaagagggacatcgacgccgcctgggaggccgtgcgccacgcccgcaagccccgcatccacaccttcatcgctaccagcgagatccacatgcagcacaagctgcgcaagacgcccgagcaggtggtggccatcgccagggagatggtggcctatgcccgcagtcttggatgccctgatgtagagttcagccccgaggatgccggaaggtcaaatagagagttcctgtatcatattctagaggaagtaataaaagctggagcaacaaccctcaacatcccagacacagttggatacaatctccctcatgaatttgggaaactaattgctgacataaaagcaaacactcctggaattgagaatgcaattatttctactcattgccagaatgacctcggtcttgcatctgccaacacattagcgggtgcttatgcaggagcacggcagttagaggtgactatcaatggtattggtgaaagagccggcaatgcttccttggaggaggttgtcatggcaattaaatgtcgtcgagaactattaggtggcctttatactgggattagtacccagcatattactatgtcaagcaaaatggtacaagagcacagtggacttcacgtacagccacataaagccattgttggtgcgaatgcctttgctcatgaaagtgggatccatcaggatgggatgcttaaacacaaaggaacttatgaaataatatcacctgaagatattggtttagtacgtgtaaacgagtttggtattgttcttgggaagctcagtgggcggcatgctgtcaaaaccaaactagtggagcttggatatgaaattagcgacaaggaatttgaggatttctttaagcggtacaaagaggtcgcagagaaaaaaaagcgtgtcactgatgaagacattgaagcgttattgtctgatgagatatttcaaccgaaggttatttggtcccttggtgatgtacaggcaacatgtggaacacttggtttatctacagcaactgtcaaactgatagctatagacggagaggagaagatagggtgttcagttggaacaggtccagtcgatgcagcttacaaggctgtcgaccaaataatacagattcctactgttcttcgagaatatagtatgacatcggtcacagaaggcattgatgcaattgcaactactcgagtagtcattactggagatgttagcaacagtaaaaatgctctgattggtcagaacaaccgttccttcagtgggagtggtgcagcactggacgttgttgtctccagcgtccgagcttacctgagtgccctgaacaagatgtccagttatgttggtgccgtaaaagccagcagcgaagcacccgaaagcataagaactgttcaaacggcagagtgagtcttgatattgtcggctcatcacatccgcggagaaggaatgtttaaaatctggcatccatgttagcagaggacttgtccgtgctgtagaaactggggttcatttggtgtgcaaggataaagatgttttgtttttcttggtgggctgcaacttttagcttgaacaaccagcaatgttagaacatgtcgagtgtataatctctattttaataacaatgtactcccaataaggtcataataaacactgtttgttggac

SEQ ID NO: 1144 - DNA, 2231 bp, Brachypodium distachyon
aagctataacccgccgcattcgcccccaatctcttcccctaaacccccagcgccgcctccgacgaccatggccgcctcccccgctaaaccctgctgcttctcctccttaaaccccgcctcctccaccccgctcgccaggcgctcaaggaccctctcctcctccgccgctgccgccaagccccaccgcttctcccatggcctcgccgcagccgccgtcgccgcgaaccctagggccgccgcgctccgccgccccgtccgcgcgtgcctggcggcgggggcggcgccgcggcgccccgagtacgtcccggaccgcatcgacgaccccaactacgtgcgcatcttcgacaccacgctccgcgacggggagcagtccccgggggccaccatgaccagcgccgagaagctcgtcgtcgcgcgccagctcgcccgcctcggcgtcgacatcatcgaggccgggttcccggcctcctcgcccgacgacctcgacgccgtgcgctccatcgccatcgaggtcgggaacacgccgctcgggggggacggccacgtgcccgtcatctgcggcctctcccggtgcaacaagagggacatcgacgccgcctgggaggccgtgcgccacgcccgcaagccccgcatccacaccttcatcgctaccagcgagatccacatgcagcacaagctgcgcaagacgcccgagcaggtggtggccatcgccagggagatggtggcctatgcccgcagtcttggatgccctgatgtagagttcagccccgaggatgccggaaggtcaaatagagagttcctgtatcatattctagaggaagtaataaaagctggagcaacaaccctcaacatcccagacacagttggatacaatctccctcatgaatttgggaaactaattgctgacataaaagcaaacactcctggaattgagaatgcaattatttctactcattgccagaatgacctcggtcttgcatctgccaacacattagcgggtgcttatgcaggagcacggcagttagaggtgactatcaatggtattggtgaaagagccggcaatgcttccttggaggaggttgtcatggcaattaaatgtcgtcgagaactattaggtggcctttatactgggattagtacccagcatattactatgtcaagcaaaatggtacaagagcacagtggacttcacgtacagccacataaagccattgttggtgcgaatgcctttgctcatgaaagtgggatccatcaggatgggatgcttaaacacaaaggaacttatgaaataatatcacctgaagatattggtttagtacgtgtaaacgagtttggtattgttcttgggaagctcagtgggcggcatgctgtcaaaaccaaactagtggagcttggatatgaaattagcgacaaggaatttgaggatttctttaagcggtacaaagaggtcgcagagaaaaaaaagcgtgtcactgatgaagacattgaagcgttattgtctgatgagatatttcaaccgaaggttatttggtcccttggtgatgtacaggcaacatgtggaacacttggtttatctacagcaactgtcaaactgatagctatagacggagaggagaagatagggtgttcagttggaacaggtccagtcgatgcagcttacaaggctgtcgaccaaataatacagattcctactgttcttcgagaatatagtatgacatcggtcacagaaggcattgatgcaattgcaactactcgagtagtcattactggagatgttagcaacagtaaaaatgctctgattggtcagaacaaccgttccttcagtgggagtggtgcagcactggacgttgttgtctccagcgtccgagcttacctgagtgccctgaacaagatgtccagttatgttggtgccgtaaaagccagcagcgaagcacccgaaagcataagaactgttcaaacggcagagtgagtcttgatattgtcggctcatcacatccgcggagaaggaatgtttaaaatctggcatccatgttagcagaggacttgtccgtgctgtagaaactggggttcatttggtgtgcaaggataaagatgttttgtttttcttggtgggctgcaacttttagcttgaacaaccagcaatgttagaacatgtcgagtgtataatctctattttaataacaatgtactcccaataaggtcataataaacactgtttgttggacaaaacc

SEQ ID NO: 1145 - DNA, 2466 bp, Oryza sativa
ttctcccccgagccttgtgtgcaagtccgacttgtcttcttcgccgcaaaaaccacgccgccatcacagcattcgtgcatcccacgaaacccccgttgtcatgtccagataagagctccacctctgactcacacacacatcaccgagaagcagagcaagtgcatctccctctcccaccatttgattcgattcccctaaacccccgagtcgtcgacgccacaaaccccggcgaccaccatggcctcctccctcctctcctccccaaaaccctcctccttctcctccgcaaaccccacctccactccacgcccacgcgcccaaactctctcccccttccgcgccgccgccccacgcttctcccatggcctcgccaccgccgccgccgccgcaaaccctagcgcctcccgccgctgctaccaccgcgccttcgcccgccccgtccgggcgtccatggcgcagccgcggcgcccggagtacgtccccaaccgcatcgacgaccccaactacgtccgcatcttcgacaccaccctccgcgacggggagcagtcccccggggccaccatgaccagcgccgagaagctcgtcgtcgcgcgccagctcgcccgcctcggcgtcgacatcatcgaggccgggttcccggcctcctcccccgacgacctcgacgccgtgcgctccatcgccatcgaggtcgggaacacgcccgtcggggaggacggccacgtgccggtcatctgtggcctctcgagatgcaataagcgagacattgatgctgcctgggaggccgtgcggcacgcgcggcggccgcgcatccacaccttcattgccaccagcgagatccatatgcagcacaagctaaggaagacgcccgagcaggtggtggccattgccaaggaaatggtggcctacgcccgcagcctaggctgccctgatgtcgagttcagccctgaagacgctggcaggtcaaacagagagtttctatatcatatactagaggaagtcataaaagctggagcaacaacactcaatatcccagacactgttggatacactcttccttatgaatttgggaaactaattgctgatataaaagcaaacactccaggaattgaaaatgccattatttctactcattgccagaatgaccttggtctagcaaccgcaaatacattagcgggcgctcatgcaggagcacggcaattagaggtgactatcaatggtattggtgaaagggctggaaatgcttctttggaagaggttgtgatggcaattaaatgtcgtcgagaactcttaggaggtctgtatactggaatcaatacccaacatatcactatgtcaagcaaaatggtacaagagcacagtggacttcatgtacaaccacataaagctattgtcggtgccaatgcctttgcacatgaaagtggaattcatcaggatgggatgcttaagtacaaaggaacttatgaaataatttctcctgatgatattggtctaacacgtgcaaatgagtttggtattgttcttgggaagctcagtggaaggcatgctgtgagatctaaactagtggagcttggatatgaaatcactgacaaggaatttgaggatttctttaaacgctacaaagaggttgcagagaagaaaaagcgtgtaactgatgaagacattgaggcgctgttgtctgatgagatatttcagcccaaggttttttggtcccttgctgatgtacaggcaacttgtggaacacttggtctgtctacagcaactgtcaaactgataggtccggatggagatgagaagattgcatgtgcagttggaacaggtccagttgatgcagcttacaaggctgttgatgatataatacagatcccaactgttcttcgagaatatagcatgacatcggtcacagaaggcattgatgcaattgcaactactagagtggttgtcactggagatgtcagcgactctaaacatgctttgactggtcactccttcaaccgggcattcagtgggagtggtgccgcactggatattgttgtttccagtgtgcgagcttacctgagtgccctgaacaagatgtccagttttgttggggctatcaaggctagtagtgaagtatctgaaagccaaagagttcaaaccacagaatgagtcttgacgctccttggttttcatatcggatggttctatgtttcacattcccagcaaggagtatgtgcttgttgaaacatggtttttccgtttagtgcatctggaggatgttctgggtttctttggtggagcctgacttaaggttgaacatccaggaagttttggggtatgtagtgtataattcatatttgaaaattgtatttccaataagacaataataaataattgtttgacatatgagtattgcaaaactattactgtaagaaattaatcgtgagaccaacctacggttgtacagtatcgagaacttctgaattgagg

SEQ ID NO: 1146 - DNA, 2421 bp, Oryza sativa
ttgtcttcttcgccgcaaaaaccacgccgccatcacagcattcgtgcatcccacgaaacccccgttgtcatgtccagataagagctccccctctgactcacacacacatcaccgagaagcagagcaagtgcatctccctctcccaccatttgattcgattcccctaaacccccgagtcgtcgacgccacaaaccccggcgaccaccatggcctcctccctcctctcctccccaaaaccctcctccttctcctccgcaaaccccacctccactccacgcccacgcgcccaaactctctcccccttccgcgccgccgccccacgcttctcccatggcctcgccaccgccgccgccgccgcaaaccctagcgcctcccgccgctgctaccaccgcgccttcgcccgccccgtccgggcgtccatggcgcagccgcggcgcccggagtacgtccccaaccgcatcgacgaccccaactacgtccgcatcttcgacaccaccctccgcgacggggagcagtccccgggggccaccatgaccagcgccgagaagctcgtcgtcgcgcgccagctcgcccgcctcggcgtcgacatcatcgaggccgggttcccggcatcctcccccgacgacctcgacgccgtgcgctccatcgccatcgaggtcgggaacacgcccgtcggggaggacggccacgtgccggtcatctgtggcctctcgagatgcaataagcgagacattgatgctgcctgggaggccgtgcggcacgcgcggcggccgcgcatccacaccttcattgcaaccagcgagatccatatgcagcacaagctgaggaagacgcccgagcaggtggtggccattgccaaggaaatggtggcctacgcccgcagcctaggctgccctgatgtcgagttcagccctgaagacgctggcaggtcaaacagagagtttctatatcatattctaaaggaagtcataaaagctggagcaacaacactcaatatcccagacactgttggatacactcttccttatgaatttgggaagctaattgctgatataaaagcaaacactccaggaattgaaaatgctattatttctactcattgccagaatgaccttggtctagcaaccgccaatacactagcgggcgctcatgcaggagcacggcaattagaggtgactatcaacggtattggtgaaagggctggaaatgcttctttggaagaggttgtgatggcaattaaatgtcgccgagagctcttaggaggtctgtatactggaatcaatacccaacatatcactatgtcaagcaaaatggtacaagagcacagtggacttcatgtacaaccacataaagctattgtcggtgccaatgcctttgcacatgaaagtggaattcatcaggatgggatgcttaaatacaaaggaacttatgaaataatttctcctgatgatattggtctaacacgtgcaaacgagtttggtattgttcttgggaaactcagtggaaggcatgctgtgagatctaaactagtggagcttggatatgaaatcactgacaaggaatttgaggatttctttaaacgctacaaagaggttgcagagaagaaaaagcgtgtaactgatgaagacattgaggcgctgttgtctgatgagatatttcagcccaaggttttttggtcccttgctgatgtacaggcaacttgtggaacacttggtctgtctacagcaactgtcaaactgataggtccggatggagaggagaagattgcatgtgcagttggaacaggtccagttgatgcagcttacaaggctgttgatgatataatacagatcccaactgttcttcgagaatatagcatgacatcggtcacagaaggcattgatgcaattgcaactactagagtggttgtcactggagatgttagcgactctaaacatgctttgactggtcactccttcagccgggcattcagtgggagtggtgccgcactggatattgttgtttccagtgtgcgagcttacctgagtgccctgaacaagatgtccagttttgttggggctatcaaggctagtagtgaagtatctgaaagccaaagagttcaaaccacagaatgagtcttgacttccttttgggttttcatatccgatggttctatgtttcacattcccagcaaggagtatgtgcttgttgaaacatggtttttccgtccagaaaaaacatggttccgtttagtgcatctggaggatgttctgggtttcttggtggagcctgacttaaggttgaacatccaggacgttttgggatatgcagtgtataattcatatttgaaaaccgtatttacaataagacaataataaataattgtttgacatatgagtattgcaaaactattactgtaagaaattaatcgtgagaccaacc

SEQ ID NO: 1147 - DNA, 1824 bp, Lolium multiflorum
cgccgccgcacctccatctctcggctctccccatcccctaaacccccgcgcgccgcctccgaccaccatggcgtccgcccccgctaaaccctactgctgctcctccctgaaccccgccgcctccgccccgctccccaggcgcgccgccctctcccccttccccttccccgccgccaagccccgccgcctctcccatggcctcgccgccgccgcgaaccctaggcacccccgcgccgccgtccgcgcctgcctggcggcggcgccgcggcggccggagtacgtcccggaccgcatcgacgaccccaactacgtgcgcatcttcgacaccacgctccgcgacggggagcagtccccgggggccaccatgaccagcgccgagaagctcgtcgtcgcgcgccagctcgcgcgcctcggcgtcgacatcatcgaggccggattcccggcctcctcgcccgacgacctcgacgccgtgcgctccatcgccatcgaggtcgggaacacccccgtcggggacgacggccacgtccccgtcatctgcggcctctcgcgctgcaacaagagggacatcgacgccgcctgggaggccgtgcgacacgcgaggaagccgcgcatccacaccttcatcgccaccagcgagatccacatgcagcacaagctcaggaagacgccagagcaggtcgtggccatcgccaaggagatggtggcgtatgcccgcagtcttggatgccctgatgttgagttcagcccagaggacgctggcaggtcaaacagggagttcctttatcatattctggaggaagtaataaaagctggagcaacaactctcaacatcccagacactgttggatacacccttcctcacgaattcgggaaactaattgcagacataaaagctaacacccctggaattgaaaatgcaattatttctactcattgccaaaacgatcttggtcttgccagtgccaacactttagcgggtgctgatgcaggggcacggcagttggaggtgactatcaatggtatcggtgaaagagctggaaatgcttccttggaggaggttgtcatggcgattaaatgtcgccgagaactcttagatggcctatatactggaattaattcccaacatatcactatgacaagcaaaatggtacaagagcacagtggacttcatgtgcagccgcataaagctattgttggcgccaatgcctttgctcatgaaagtggaattcatcaggatgggatgcttaaattcaaaggaacttatgaaataatatcgcctgatgatattggtttaacacgtgcaaatgagtttggcattgttcttgggaagctcagtggaaggcatgctgtcagaactaaactagtggagcttggatatgaaatcaacgacaaggaatttgaggatttctttaaacgctacaaagaggttgcagagaaaaagaagcgtgtaactgatgaagacatcgaagctttattatcagatgagatatttcagcctaaggttatttggtcccttggtgatgtacaggcaacatgtggaacacttggtttatctacagcaaccgtcaaactgataggtctagacggagaggagaagataggatgttcagttggaacaggcccagttgatgcagcttacaaagctattgatcaaataatacagattccgactgttcttaaggaatatggcatgacttctgtcacagaaggcattgatgcaattgcaactactcgagtactcatcactagagatgtcaccggtgatgaacatagtgcatccggttactccagtcgttccttcagtgggagcggtgcagctatgga

SEQ ID NO: 1148 - DNA, 2018 bp, Avena sativa
cgcgccgccgtccgcgcttgcctggcggcgccgcggcgcccggagtacgtcccgcaccgcatcgacgaccccaactacgtgcgcatcttcgacaccacgctccgcgacggggagcaatccccgggggccaccatgaccagtaccgagaagctcgtcgtcgcgcgccagctcgcccgcctcggcgtcgacatcatagaggcgggcttcccggcctcctcgcccgacgaccttgacgccgtgcgatccatcgccatcgaggtggggaacacgcccgtcggggaagagggccatgtgccggtcatctgcgggctctcgcgatgcaacaagagggacatcgacgccgcctgggaagccgtgcgacacgcgaggaagccgcgcatccacaccttcattgctaccagcgagatccacatgcagcacaagctgcggaagacccccgagcaggtggtggccatcgccaaggagatggtggcttatgcccgcagtcttggatgccccgatgttgagttcagccctgaggacgctggcaggtcaaatcgagagttcctgtatcatattctggaggaagtaatacaagctggagcaacaactctcaacatcccagacactgttggatacacccttcctcacgaattcgggaaattaattgctgacataaaagcgaacactcctggaattgaaaatgcaattatttctactcattgccaaaatgatcttggtcttgcaagtgccaacacactagcgggtgcttatgcaggagcacgacagttagaggtaactatcaatggtatcggtgaaagagccggaaatgcttccttggaggaggttgtcatggcaattaaatgtcgtcgagaactcttagatggcctatatactgaattaataccaacatattactatgtcgagcaaaatggtacaagagcacagtggacttattgtgcagccgcataaagctattgttggtgccaatgcctttgctcatgaaagtggaattcaccaggatgggatgcttaaattcaaaggaacttacgaaataatatcgcctgatgatattggtttaacacgttcaaatgagtttggaattgttcttgggaagctcagtggaaggcatgccgtcagaactaaactagtggagcttggatatgaaatcaatgacaaggaatttgaggatttctttaaacgctacaaagaggttgcagagaaaaaaaagcgtgtaactgatgaagacattgaagctttattatctgatgagatttttcagcctaaggttatttggtcccttggtgatgtacaggcaacatgtggaacacttggtttgtctacagcaactgttaaactgatagctctagatggagaggagaagataggatgctcagttggaacaggcccagttgatgcagcttacaaggctgttgaccaaataatacagattccaactattcttcgggaatatagcatgacttctgtcacagaaggcattgatgcaattgcaactacccgagtactcatcactagagatgtcagcggtgatgaacatactacgcctggttactccaaccgttccttcagtgggagtggtgcggctatggacgttgtagtgtccagtgtccgagcttacctgagtgccttgaacaagatgtccagttttatcggtgccataaacgccagcagcgaagcaccggagaccataagcgctcagagctcagaatgagcgacgacatcccttttcggttgtctcatctcaagagcatcgtgaactgccaggcgagaagtgttcaaattcctgcattccatgttactagtaaaagtcacatccgtgttgtagaaactgggtattccaattggtgttcatctgaaggttcttttgttcttggtgggcttgaactctaggctgaacaatcagcaattcgagaacatataatatccagtggatacttcctatttaagaactatactcctaataagtgaataataaatgacttgcttgacagaacatgtctaatgtaatcattttttta

SEQ ID NO: 1149 - DNA, 2270 bp, Saccharum officinarum
aatcactcctcacaaagtcacaatttccacatccgatttaacaccaggccgcggcggcgccgcccgcccgccccctcctaaaccccgcgacgaccctcccccggcgaccaaccatggccttctccgctaaaccctacggctccaccaccaccacccacctctccccctccccctccctctccctctccgtccgcgccgccgccgccccccgcgccccgcgctccgcccatggcctctccgccgccgctgccgccggcaaggcgacccccagcatcgtccgcctccgcgcgtttgcccagcgcatccgggcgtcgcagcagcagcggcggcggcccgagtacgtgccgaaccgcatcgacgacccaaactacgtgcgcatcttcgacaccacgctccgcgacggggagcagtcccccggcgccaccatgacgagcgccgagaagctcgtcgtcgcgcgccagctggcccgcctcggcgtcgacatcatcgaggccgggttcccggcctcctcccccgacgacctcgacgccgtgcgctccatcgccatcgaggtcggcaacccgcccgcgggggccgaccacgtgcccgtcatctgcggcctctcgcggtgcaataggagggacatcgacgccgcctgggaggccgtcaggcacgcgcgcaggccccggatccacaccttcatcgcgaccagcgagatccacatgcagcataagctcaggaagacgcccgagcaggtcgtcgccattgctaaggagatggtggcgtatgcacgcagcctcggctgccctgatgtcgaattcagccccgaggatgctggaaggtcaaatcgagaattcctgtatcatatactggaagaagttataaaagctggggcaacaactcttaatatcccagacactgtcggatatactcttccttatgaatttgggaagttaattgctgacataaaggcaaacactcctggaattgaaaatgctatcatttccactcactgccagaatgacctaggtcttgcgactgccaacacattagcgggcgctcgtgcaggagcacgacagttagaggtgactattaatggtattggtgaaagagctggaaatgcttcattggaagaggttgtcatggcaattaaatgtcgtggggagctcttagatggtctatatactggaatcaattcccaacatattactttgacaagcaaaatggtacaagagcacagtggacttcatgtacaaccacataaagctattgttggtgccaatgcctttgctcatgaaagtggaattcatcaggatgggatgctaaaatataaaggaacatatgaaataatatcgcctgatgatattggtttaacacgttcaaatgaatttggtatgttcttgggaaacttagtggaaggcatgcagtgagatctaagctagtggagcttggatatgaaatcagtgacaaggaatttgaagatttctttaaacgctacaaagaggtcgcggagaagaaaaagcgtgtaactgatgaagacatagaagcgttattgtcagatgagatattccaacctaaggttatttggtcccttgctgatgtacaggcaacatgtggaacacttggcttatctacagcaactgtgaaactgatagcaccagatggagaggagaaaatagcatgttcagttggaacaggtccagttgatgcagcttacaaggctgttgaccaaataatccagattccaactgttctccgagaatatggtatgacttcagtcacagaaggcattgatgctatcgcgacaactcgagttgttgtcactggagatgtgaccaacaactccaaacatgccttgactggtcactctttcaaccgctccttcagcgggagcggggcagcaatggacatcgttgtgtccagcgtcagagcttacctgagtgccctgaacaagatgtgcagctttgctggtgctgcgaaagccagcagcgaggtacctgagagcgcaagcgttcaacgcacagagtgagcttggtgttcctgttggttctcatgtgggcttggcgatgtaagagcttgagccactgtaatagagtgacatttcgtttcagtaacaggctgttcaatatcgggggtttccccttgtcattgtggtggttgtgctgttcttttttgggaggataatcccttaagcttagaacatgcaggaaattttggccctatgtagtgtacaatttgtatgttatatgaaccatactttcaataatgaaataatattagggtccatctag

SEQ ID NO: 1150 - DNA, 2281 bp, Setaria italica
ccccctgagtccgccgacgagacccaccccgacgaccatggcctccgccgctaaacccttctgctccacctcccaaacccccacccccatcgccaaccgcttcccatcccaatccccatccctctcctcccgcgccgccccccgcttcgcccatggcctctccgccgccgccgtcagggcgagccccggcgcccgccgccgcctcggcgcgctggcccgccccatccgggcgtcgtctcagcagcagcagcagccgccgcggcggcccgagtacgtccccggccgcatcgacgatcccaactacgtccgcatcttcgacaccactctccgcgacggggagcagtccccgggcgccaccatgaccagcgccgaaaagctcgtcgtcgcgcgccagctcgcccgcctcggcgtcgacatcatcgaggccggcttcccggcctcatcccccgacgacctcgacgccgtgcgctccatcgccatcgaggtcggcaacacccccgtcggggaggatgggcacgtgcccgtcatctgcggcctctcgcggtgcaataggaaggacattgacgccgcctgggaggccgtcaggcacgcgcggcgcccgaggatacacacgttcattgccaccagcgagatccatatgcagcacaagctcaggaagacgcccgagcaggtggtggccattgccagggagatggtggcgtacgcccgcagcctgggatgccctgatgtcgaattcagccccgaggatgccggaaggtcaaatagagagtttctgtatcatatactagaggaagtcataaaagctggagctacaactctcaacatcccggacactgttggatacactcttccttatgaatttgggaacttgattgctgacataaaggcaaacactcctgggattgaaaatgctatcatttccactcattgccagaatgaccttggtcttgcgactgccaacacattagcaggtgctcgtgcaggagcgcgtcagttagaggtgactattaatggtattggtgaaagagccggaaatgcatctttggaggaggttgtcatggcaattaagtgtcgtggggaactcttaaatggcctgtatactggaatcaattcccaacatattactttgacgagcaaaatggtacaagagcacagtggacttcacgtacaaccacacaaagctattgttggtgccaatgcctttgctcatgaaagtggaatccatcaggatgggatgcttaaatataaaggaacttatgaaataatatcacctgacgatattggtttaactcgtgcaaatgaatttggaattgttcttgggaaactcagtggaaggcatgctgtgagatctaagctagtggagcttggatatgaaatcagtgacaaggaatttgaggacttctttaaacgctacaaagaggttgcggagaagaaaaagcgtgtaactgatgaagacatagaagcattattgtcagatcagatattccagcctaaggttatttggtcccttgctgatgtacaggcaacatgtggaacacttggtttatctacagcaactgtgaaactgatagcaccagatggagaggagaaaatagcatgttgtgtgggaacaggcccagtcgatgcagcttataaggctgttgacgaaataatccagattccaactgttctccgagaatatggtatgacttcagtcacagaaggcattgacgcaattgcaaccactcgagtgattatcactggagatttgagcaacaactccaagcatgccttgactggtcactctttcaatcgctccttcagtgggagtggggcatcaatggacgttgttgtgtccagcgtcagagcctacctgagtgccctgaacaagatgtgcagttttgctggtgttgtaaaagccagcagcgaagtacctgagagcacaagtgtttaaagtgagctcggcgttccctttggttctcatatgggctgagcatgtaagagctctggaccaactccgggcgacatttcgtttcagtataggctgggttgatattgggtttttcccttcgtcagcgtgaagattgtgccgttcgttttggaggatcgtctggttaggacagtcatgaagcttttggcctatgcagtgtacaatttgtatgttatagaccatactttcaataaggaaatgatagggtctatgtagccatctgttggatgatttcgcaaccccaaatctgtcgtcttttctgataattgggaataccatggaccggatttacctcctttttccttctgcccc

SEQ ID NO: 1151 - DNA, 2624 bp, Setaria italica
ggcagtcaccactctcgcatgctcgccgcggcggcacctgctcaagtcagcccgccgagctagctgcctccgtgccggttacgaaacctcccccgtccagatgaggatacaagaaggtatctgagtcatccaccggttgcccgtggctgcctctgccttgtcggccgccgcctcctctccctttccatttgggccttcggcggtttccttccttaattaagccagagccgccgccaccgtcccctaaacccccgtgcgccccccctgagtccgccgacgagacccaccccgacgaccatggcctccgccgctaaacccttctgctccacctcccaaacccccacccccatcgccaaccgcttcccatcccaatccccatccctctcctcccgcgccgccccccgcttcgcccatggcctctccgccgccgccgtcagggcgagccccggcgcccgccgccgcctcggcgcgctggcccgccccatccgggcgtcgtctcagcagcagcagcagccgccgcggcggcccgagtacgtccccggccgcatcgacgatcccaactacgtccgcatcttcgacaccactctccgcgacggggagcagtccccgggcgccaccatgaccagcgccgaaaagctcgtcgtcgcgcgccagctcgcccgcctcggcgtcgacatcatcgaggccggcttcccggcctcatcccccgacgacctcgacgccgtgcgctccatcgccatcgaggtcggcaacacccccgtcggggaggatgggcacgtgcccgtcatctgcggcctctcgcggtgcaataggaaggacattgacgccgcctgggaggccgtcaggcacgcgcggcgcccgaggatacacacgttcattgccaccagcgagatccatatgcagcacaagctcaggaagacgcccgagcaggtggtggccattgccagggagatggtggcgtacgcccgcagcctgggatgccctgatgtcgaattcagccccgaggatgccggaaggtcaaatagagagtttctgtatcatatactagaggaagtcataaaagctggagctacaactctcaacatcccggacactgttggatacactcttccttatgaatttgggaacttgattgctgacataaaggcaaacactcctgggattgaaaatgctatcatttccactcattgccagaatgaccttggtcttgcgactgccaacacattagcaggtgctcgtgcaggagcgcgtcagttagaggtgactattaatggtattggtgaaagagccggaaatgcatctttggaggaggttgtcatggcaattaagtgtcgtggggaactcttaaatggcctgtatactggaatcaattcccaacatattactttgacgagcaaaatggtacaagagcacagtggacttcacgtacaaccacacaaagctattgttggtgccaatgcctttgctcatgaaagtggaatccatcaggatgggatgcttaaatataaaggaacttatgaaataatatcacctgacgatattggtttaactcgtgcaaatgaatttggaattgttcttgggaaactcagtggaaggcatgctgtgagatctaagctagtggagcttggatatgaaatcagtgacaaggaatttgaggacttctttaaacgctacaaagaggttgcggagaagaaaaagcgtgtaactgatgaagacatagaagcattattgtcagatcagatattccagcctaaggttatttggtcccttgctgatgtacaggcaacatgtggaacacttggtttatctacagcaactgtgaaactgatagcaccagatggagaggagaaaatagcatgttgtgtgggaacaggcccagtcgatgcagcttataaggctgttgacgaaataatccagattccaactgttctccgagaatatggtatgacttcagtcacagaaggcattgacgcaattgcaaccactcgagtgattatcactggagatttgagcaacaactccaagcatgccttgactggtcactctttcaatcgctccttcagtgggagtggggcatcaatggacgttgttgtgtccagcgtcagagcctacctgagtgccctgaacaagatgtgcagttttgctggtgttgtaaaagccagcagcgaagtacctgagagcacaagtgtttaaagtgagctcggcgttccctttggttctcatatgggctgagcatgtaagagctctggaccaactccgggcgacatttcgtttcagtataggctgggttgatattgggtttttcccttcgtcagcgtgaagattgtgccgttcgttttggaggatcgtctggttaggacagtcatgaagcttttggcctatgcagtgtacaatttgtatgttatagaccatactttcaataaggaaatgatagggtctatgtagccatctgttggatgatttcgcaaccccaaatctgtcgtcttttctgataattgggaataccatggaccggatttacctcctttttccttctgccccttttgagtattccaccctagcagtaaaacaaccttagttcatctattgcttaataaggtaaagcgatatatctatcgatcggc

SEQ ID NO: 1152 - DNA, 2767 bp, Sorghum bicolor
agtacaccggcgtcttgtgctgtgggacactgggacaggtcgagtgcacgacagcacgagttggttgcggcggcgctcgagctcgagtacaagccgcgcacgaccacggcacggcacctcaccgctctcgcgtgctcgccgcggcggccgccgtgctcgtgtcgtgtcacagccagcagctcgctccgacgacctccgatccgtgccgcctacgaaaccaccacccgtccggatcctccaggatatataccagccagctagtcatccccttgctggctgctgccttttccaaatccactcacattttccacatccaccgtcgatttaacacagtcccccgccgccgccgcccgcccgtccgtcccctcctaaaccccgcgacgaccctgagcgagcccgagccgagtccccggcgaccaacaaccatggccttcaccgctaaaccctactgctcaaccaccaccaaaccccccaccctctccgcccgcgccccgcgctccgcccatggcctatccgccgccgccgccgcaaccccgagcaccgtccgcctccgcgcgttcgcccagcgcatccgggcgcagtcgcagcaacagcaacagcggcggcggcggcccgagtacgtgccgcaccgcatcgacgacccaaactacgtgcgcatcttcgacaccacgctccgcgacggggagcagtccccgggagccaccatgacgagcgccgagaagctggtggtcgcgcggcagctggcccggctcggcgtcgacatcatcgaggcggggttcccggcgtcctcccccgacgacctcgacgccgtgcgctccatcgccatcgaggtcggcaacccggtggaggaaggcgcccacgtgcccgtcatctgcggcctctcgcggtgcaacaagagggatattgatgccgcctgggaggccgtcaggaacgcgcgcaggccccggattcataccttcatcgccaccagtgagatccatatgcagcataagcttaggaagacgcctgagcaggtcgttgctattgctaaggagatggtggcgtatgcacgcagccttgggtgccctgatgtcgaattcagccctgaggatgccggcaggtcaaatcgagaattcctgtatcatatactggaggaagtcattaaagctggggcaactactcttaatatcccagacactgtcggatacactcttccttatgaatttgggaagttgattgctgacataaaggcaaacactcctggaattgaaaatgctatcatttccactcattgccagaatgaccttggtcttgcaactgccaacacattagcgggcgctcgtgcaggagcacgacagttagaggtgactattaatggtattggtgaaagagctggaaatgcttcgttggaagaggttgtcatggcaattaaatgtcgtggggagctcttagatggtctatatacgggaatcaattcccaacatattactttgacaagcaaaatggtacaagagcacagtggacttcatgtacaaccacataaagctattgttggtgccaatgcctttgctcatgaaagtggaattcatcaggatgggatgcttaagtacaagggaacatatgaaataatatcacctgatgatattggtttaacacgtgcgaatgaatttggtattgttcttgggaaactcagcggaaggcatgcagtgagatctaagctagtggagcttggatatgaaatcagtgacaaggaatttgaagatttctttaaacgctacaaagaggttgcagagaagaaaaagcgtgtaactgatgaagacatagaagcgttattgtcagatgagatattccagcctaaggttatttggtcccttgctgatgtacaggcaacatgtggaacacttggcttatctacagcaacagtgaaactgatagcaccagatggagaggagaaaataggatgttcagttggaacaggtccagttgatgcagcttacaaggctgttgaccaaataatccagattccaactgttctccgagaatatggtatgacttcagtcacagagggcattgacgctatcgcgacaactcgagtggttgtcactggagatgtgaccaacaactccaagcatgccttgactggtcaatctttcaaccgctccttcagtgggagtggggcagctatggacatcgttgtgtccagcgtcagagcttacctgagtgccctgaacaagatgtgcagctttgctggtgctgcgaaagccagcagcgaggtacctgagagcgcaagcgttcaacgcacagagtgagcttggcgctcctctttgttctcatgcgggcttggcgacgtaagagcttgagcaactgttatagagtgatatgtcgtttcagtaacaggctgctcaatattggggttttcccttgtcagtgtggagtgattgtgctgttctattttggaggatagtccctttagcttagaacatgcaggaaattttggccctatgtagtgtacaatttgtgccttatatgaaccatactttcaataatgaaataatattagggtccatccagccacccatatctaccccaactttgttgggttttttcgtctgaaaatccaacgtaccggagttaacataaactcccttgttttcatttgttatcccactcggctcaccttccacataatttcctccccttcatctataatcaaataaataccagaccatttgttgagattatgtgtttagataaagagagatttggtcaggatcattgcgtttgtttt

SEQ ID NO: 1153 - DNA, 2368 bp, Setaria italica
ccttaattaaggccaaagcagccgccaccgtcccctaaacccccgtgctccccccctgagtccgccgacgagacccaccccgacgaccatggccgcctccgctaaacccttctgctccaccacccaacaaccccctacccccatcgccaaccgcctgccatccccatcccaacccccagccctctcctcgcgcgccgccccccgcttcgcccatggcctctccgccgccgcgggcgtcagggcgagccccagcgcccgccgcctccgcgcgctggcccggcccatccgggcgtcgtctcagcaccagcagcagcagcagctgccgcggcggcggcccgagtacgtcccgagccgcatcgacgaccccaactacgtccgcatcttcgacaccacgctccgcgacggggagcagtccccgggcgccaccatgaccagcgccgagaagctcgtcgtcgcgcgccagctcgcccgcctcggcgtcgacatcatcgaggccggcttcccggcctcctcccccgacgacctcgacgccgtgcgctccatcgccatcgaggtcggcaacacccccgtcggggaggaagggcacgtgcccgtcatctgcggcctctcgcggtgcaataggaaggacattgacgcagcctgggaggccgtcaggcacgcgcggcgcccgaggatacatactttcatcgccaccagcgagatccatatgcagcacaagctcaggaagacgcccgagcaggtggtggcgattgccagggagatggtggcgtacgcccgtagcctgggatgccctgatgtcgaattcagccccgaggacgctggaaggtcaaatagagagtttctgtatcatatactagaggaagtcataaaagctggagctacaactctcaacatcccggacactgttggatacactcttccttatgaatttgggaacttgattgctgacataaaggcaaacactcctggaattgaaaatgctatcatttccactcattgccagaatgaccttggccttgcgactgccaacacattagcgggtgctcgtgcaggagcgcgtcagttagaggtgactattaatggtattggtgaaagagccggaaatgcatctttggaggaggttgtcatggcaattaagtgtcgtggggaactcttagatggtctatatactggaatcaattcccaacatattactttgacgagcaaaatggtacaagagcacagtggacttcatgtacaaccacacaaagctattgttggtgccaatgcctttgctcatgaaagtggaatccatcaggatgggatgcttaaatataaaggaacttatgaaataatatcacctgatgatattggtttaactcgtgcaaatgaatttggaattgttcttgggaaactcagtggaaggcatgccgtgagatctaagctagtggagcttggatatgaaatcagtgacaaggaattcgaggacttctttaaacggtacaaagaggttgcagagaaaaaaaagcgtgtaactgatgaagacatagaagcattattgtcagatgagatattccagcctaaggttatttggtcccttgctgctgtacaggcaacatgtggaacacttggtttatctacagcaactgtgaaactgatagcaccagatggagaggagaaaatagcatgttgtgtcggaacaggcccagtcgatgcagcttacaaggctgttgacgaaataatccagattccaactgttctccgagaatatggtatgacttcagtcacagaaggcattgacgcaattgcaacaactcgagtggttatcactggagatgtgagcagcaactccaagcatgccttgacttctttgaatcgctccttcagtgggagtggggcatcaatggacgttgttgtgtccagcgtcagagcttacctgagtgccctgaacaagatgtgcagttttgctggtgctgtaaaagccagcagcgaagtacctgagagcacaagcgtttaaagcaaggagtgagctcggcgttccctttggttctcatatgggctgagcgatgaaagagctctcgaccaactcttcagagcaacatttggtttcagtataggctgggttaatattggggttttcccttcgtcagcgtgaagattgtgccgttcgttttggaggatcggctgcttaggacaggcatgaagattttggcctatgcagtgtacaatttgtatgttatagaccatactttattgaaggaaataatactagggttctatgtctatcgacgatttcacaacccccaaatctgtcgtcttttctggtaattgggattataatggatcggatttacctcctttttccttttatatataccccttttggctc

SEQ ID NO: 1154 - DNA, 2342 bp, Setaria italica
ccaccgtcccctaaacccccgtgctccccccctgagtccgccgacgagacccaccccgacgaccatggccgcctccgctaaacccttctgctccaccacccaacaaccccctacccccatcgccaaccgcctgccatccccatcccaacccccagccctctcctcgcgcgccgccccccgcttcgcccatggcctctccgccgccgcgggcgtcagggcgagccccagcgcccgccgcctccgcgcgctggcccggcccatccgggcgtcgtctcagcaccagcagcagcagcagctgccgcggcggcggcccgagtacgtcccgagccgcatcgacgaccccaactacgtccgcatcttcgacaccacgctccgcgacggggagcagtccccgggcgccaccatgaccagcgccgagaagctcgtcgtcgcgcgccagctcgcccgcctcggcgtcgacatcatcgaggccggcttcccggcctcctcccccgacgacctcgacgccgtgcgctccatcgccatcgaggtcggcaacacccccgtcggggaggaagggcacgtgcccgtcatctgcggcctctcgcggtgcaataggaaggacattgacgcagcctgggaggccgtcaggcacgcgcggcgcccgaggatacatactttcatcgccaccagcgagatccatatgcagcacaagctcaggaagacgcccgagcaggtggtggcgattgccagggagatggtggcgtacgcccgtagcctgggatgccctgatgtcgaattcagccccgaggacgctggaaggtcaaatagagagtttctgtatcatatactagaggaagtcataaaagctggagctacaactctcaacatcccggacactgttggatacactcttccttatgaatttgggaacttgattgctgacataaaggcaaacactcctggaattgaaaatgctatcatttccactcattgccagaatgaccttggccttgcgactgccaacacattagcgggtgctcgtgcaggagcgcgtcagttagaggtgactattaatggtattggtgaaagagccggaaatgcatctttggaggaggttgtcatggcaattaagtgtcgtggggaactcttagatggtctatatactggaatcaattcccaacatattactttgacgagcaaaatggtacaagagcacagtggacttcatgtacaaccacacaaagctattgttggtgccaatgcctttgctcatgaaagtggaatccatcaggatgggatgcttaaatataaaggaacttatgaaataatatcacctgatgatattggtttaactcgtgcaaatgaatttggaattgttcttgggaaactcagtggaaggcatgccgtgagatctaagctagtggagcttggatatgaaatcagtgacaaggaattcgaggacttctttaaacggtacaaagaggttgcagagaaaaaaaagcgtgtaactgatgaagacatagaagcattattgtcagatgagatattccagcctaaggttatttggtcccttgctgctgtacaggcaacatgtggaacacttggtttatctacagcaactgtgaaactgatagcaccagatggagaggagaaaatagcatgttgtgtcggaacaggcccagtcgatgcagcttacaaggctgttgacgaaataatccagattccaactgttctccgagaatatggtatgacttcagtcacagaaggcattgacgcaattgcaacaactcgagtggttatcactggagatgtgagcagcaactccaagcatgccttgacttctttgaatcgctccttcagtgggagtggggcatcaatggacgttgttgtgtccagcgtcagagcttacctgagtgccctgaacaagatgtgcagttttgctggtgctgtaaaagccagcagcgaagtacctgagagcacaagcgtttaaagcaaggagtgagctcggcgttccctttggttctcatatgggctgagcgatgaaagagctctcgaccaactcttcagagcaacatttggtttcagtataggctgggttaatattggggttttcccttcgtcagcgtgaagattgtgccgttcgttttggaggatcggctgcttaggacaggcatgaagattttggcctatgcagtgtacaatttgtatgttatagaccatactttattgaaggaaataatactagggttctatgtctatcgacgatttcacaacccccaaatctgtcgtcttttctggtaattgggattataatggatcggatttacctcctttttccttttatatataccccttttggc

SEQ ID NO: 1155 - DNA, 2001 bp, Avena sativa
ttccctggcggcgccgcggaggccggagtacgtaccgaaccgcatcgacgaccccaactacgtgcgcatcttcgacaccacgctccgcgacggggagcaatccccgggggccaccatgaccagtaccgagaagctcgtcgtcgcgcgccagctcgcccgcctcggcgtcgacatcatagaggcgggcttcccggcctcctcgcccgacgacctcgacgccgtgcgatccatcgccatcgaggtggggaacacgcccgtcggggaagagggccatgtgccggtcatctgcgggctctcgcgatgcaacaagagggacatcgacgccgcctgggaagccgtgcgacacgcgaggaagccgcgcatccacaccttcattgctaccagcgagatccacatgcagcacaagctgcggaagacccccgagcaggtggtggccatcgccaaggagatggtggcttatgcccgcagtcttggatgccccgatgttgagttcagccctgaggacgctggcaggtcaaatcgagagttcctgtatcatattctggaggaagtaatacaagctggagcaacaactctcaacatcccagacactgttggatacacccttcctcacgaattcgggaaattaattgctgacataaaagcgaacactcctggaattgaaaatgcaattatttctactcattgccaaaatgatcttggtcttgcaagtgccaacacactagcgggtgcttatgcaggagcacgacagttagaggtaactatcaatggtatcggtgaaagagccggaaatgcttccttggaggaggttgtcatggcaattaaatgtcgtcgagaactcttagatggcctatatactggaattaatacccaacatattactatgtcgagcaaaatggtacaagagcacagtggacttattgtgcagccgcataaagctattgttggtgccaatgcctttgctcatgaaagtggaattcaccaggatgggatgcttaaattcaaaggaacttacgaaataatatcgcctgatgatattggtttaacacgttcaaatgagtttggaattgttcttgggaagctcagtggaaggcatgccgtcagaactaaactagtggagcttggatatgaaatcaatgacaaggaatttgaggatttctttaaacgctacaaagaggttgcagagaaaaaaaagcgtgtaactgatgaagacattgaagctttattatctgatgagatttttcagcctaaggttatttggtcccttggtgatgtacaggcaacatgtggaacacttggtttgtctacagcaactgttaaactgatagctctagatggagaggagaagataggatgctcagttggaacaggcccagttgatgcagcttacaaggctgttgaccaaataatacagattccaactattcttcgggaatatagcatgacttctgtcacagaaggcattgatgcaattgcaactacccgagtactcatcactagagatgtcagcggtgatgaacatactacgcctggttactccaaccgttccttcagtgggagtggtgcggctatggacgttgtagtgtccagtgtccgagcttacctgagtgccttgaacaagatgtccagttttatcggcgccataaacgccagcaacgaagcaccggagaccataagcgttcagagctcagaatgatcgtcgacatcccttgtcgcatctccagagcatcttgaaaggcctggcgagaagtgttcaaattcctgcattccatgttactagtaaaggtctcagttcgtgttgtagaaactggttattccagttggcgtgcatcttaaggttcttttgttcttggtgggctgaactccaggctgaacaatcagcaatttgagtcgagaacatataatatccagtggatacttcctatttaagaactatactcctaataagtgaataataaatgacttgcttgacagaacatgtctaatgtaatcattttttta

SEQ ID NO: 1156 - DNA, 2468 bp, Panicum virgatum
ctcacccgtccagtgaggatacctgactcatccaccggccggctccgcctcgccttgttggactcctctccctttccacctcacgttccaaagtcgccgccgccgccgccgccgccaccgtcccctaaaccccggtgtcgagtccgccgacgagcgacaccctgagctcaccccgacgaccatggcctcctccaccctctcctcccccgctaaaccctgctactccgccgccaaaacccccgcccccatcggcaaccgcttaccaacccaaaatcccgcgaccacaaccctcccctcccgcgccgccgccccccgcttcgcccatggcctctccgccgccgccgtccgagcgagccccagcgcccgccgcctccgcgcgctggcccgccccgtccgggcgtctcagcagcagccgcagccgccgcctccgcggcggcggcccgagtacgtccccaaccgcatcgacgaccccaactacgtccgcatcttcgacaccacgctccgcgacggggagcagtccccgggcgccaccatgaccagcgccgagaagctcgtcgtcgcccgccagctcgcccgcctcggcgtcgacatcatcgaggccggcttcccggcatcctcccccgacgacctggacgccgtgcgctccatcgccattgaggtcgggaacgcgcccctcggggaggacggccatgtgcccgtcatctgcggcctctcgcggtgcaacaggaaggacatcgacgccgcgtgggaagccgtcaggcacgcgcgccgcccgaggattcacaccttcatcgccaccagcgagatccacatgcagcacaagctcaggaagacgcccgagcaggtggtggcgattgccagcgagatggtggcctacgcccgcagcctgggatgtcctgatgtcgaattcagccctgaggacgccggcaggtcaaatagagagtttctgtatcatatattagaggaagtcataaaagctggagctacaactctgaatatcccggacactgttggatacacccttccatatgaatttgggaacttaattgctgacataaaggcaaacactcctggaattgaaaatgctatcatttccacccattgccaaaatgaccttggtcttgcaaccgccaacacattagcgggtgctcgtgcaggagcacgtcagttagaggtgactattaatggtattggtgaaagagccggaaatgcttctttggaggaggttgtcatggcaattaaatgccgtggggaactcttagatggtctatatactggaatcaattcccaacatattactttgacaagcaaaatggtacaagagcacagtggacttcatgtacaaccacacaaagctattgttggtgccaatgcctttgctcatgaaagtggaattcatcaggatggaatgcttaaatataaaggaacttatgaaataatatcgcctgatgacattggtttaacacgtgcaaatgaatttggtattgttcttgggaaactcagtggaaggcatgctgtgagatctaagctagtggagcttggatatgaaatcagtgacaaggaattcgaggacttctttaaacgctacaaagaggttgcagagaagaaaaaacgtgtaactgatgaggacatagaagcattattgtcagatgagatattccagcctaaagtaatctggtcccttgctgatgtacaggcaacatgtggaacccttggtttgtctacagcaactgtgaaactgataggaccagatggcgaggagaaaatagcatgctctgttgggacaggtccagtcgatgcagcttataaggctgttgaccaaattatccagattccaactgttctccgagaatatggtatgacctcagtcacagaaggcattgacgcgattgcaacaactcgagtggttgtcactggagacgtgaccaacaactccaagcatgccttgactggtcactctttcaatcgctccttcagtgggagcggggcatcaatggacgttgttgtgtccagcgtcagagcttacctgagtgccctgaacaagatgtgcagttttgctggcgctgtaaaagccagcagcgaggtatctgagagcacacgtgtgcaaagcaaagagtgagaccgtcgtcatccgattctcatatgggccgagcaatgtaagagctcttgagcaacttttcagagccacatttcatttcagtaataggctggttaatattggggtttccccttggtcagtgtgaagattgtgcgttctttctggaggatgtccgcttagaacaggcatagagtttttggcccgtccagtgtacaacttgtatgttatagaccatgctttcaataaggaaataatggtagggtctgtgaagccacccattgaatgatttcacaaccccaaatgtgtcggggggggggggggggttcctggtgattgggaatacaatgaaccgttttttgtcgccctgttc

SEQ ID NO: 1157 - DNA, 2323 bp, Panicum virgatum
cccccggagcctcacccccgacgacccatggccctctttcccatcctctcctcctccgctaaaccctgctactccgccacaaaaacccccacccccatcgccaaccgcttgccacccccacccccatccccaaccacaaccctcccctcccgcgccgccgcgtcccgcttcgcccatggcctctacgccgccgccgtcagagcgagccccggcgcgcgccgcctccgcgcgctggcccgccccgtccgggcgtctcagcagcaccaccagcagcagccgcggcggcggcccgagtacgtccccaaccgcatcgacgaccccaactacgtccgcatcttcgacaccacgctccgcgacggcgagcagtcccccggcgccaccatgaccagcgccgagaagctcgtcgtggcccgccagctcgcccgcctcggcgtcgacatcatcgaggccggcttcccggcctcctcccccgacgacctcgacgccgtgcgctccatcgccatcgaggtcgggaacgcgcccgtcggggaggacggccacgtgcccgtcatctgcggcctctcgcgctgcaataagaaggacatcgacgccgcgtgggaggccgtcaggcacgcgcgccggccgaggatacacaccttcatcgccaccagcgagatccacatgcagcacaagctcaggaagacgcccgagcaggtggtggccattgccagggagatggtggcgtacgcccgcagcctgggatgctctgatgtcgaattcagccctgaggatgctggaaggtcaaatagagagtttctgtatcatatattaggggaggtcataaaagctggagctacaactctgaatatcccggacactgttggatacaaccttccatatgaatttgggaacttaattgctgacataaaggcaaacactcctggaattgaaaatgctatcatttccacccattgccagaatgaccttggtcttgcaaccgccaacacattagcgggtgctcgtgcaggagcacgtcagttagaggtgactattaatggtattggtgaaagagccggaaatgcttctttggaggaggttgtcatggcaattaaatgtcgtccggaactcttagatggtctatatactggaatcaattcccaacatattactttgacaagcaaaatggtacaagagcacagtggacttcacgtacaaccacacaaagctattgttggtgccaatgcctttgctcatgaaagtggaattcatcaggatgggatgcttaaatataaaggaacttatgaaataatatcacctgacgatattggtttaacacgtgcaaatgaatttggtattgttctggggaaactcagtggaaggcatgctgtgagatctaagctagtggagcttggatatgaaatcagtgataaggaattcgaggacttctttaaacgctacaaagaggttgcagagaagaaaaagcgtgtaactgatgaggacatagaagcattattgtcagatgagatattccagcctaaagttatttggtcccttgctgatgtacaggcaacatgtggaacacttggtttgtctacagcaactgtgaaactgataggaccagatggcgaggagaaaatagcatgttctgttggaacaggtccggtcgatgcagcttataaagctgttgaccaaattatccagattccaactgttctccgagaatatggtatgacctcagtcacagaaggcattgacgcaatcgcaacaactcgagtggttgtcactggagacgtgagcaacaactccaagcatgccttgactggtcactctttcaatcgctccttcagtgggagtggggcatcaatggacgttgttgtgtccagcgtcagagcttacctgagtgccctgaacaagatgtgcagttttgctggcgcggtaaaagctacagcagtatctgagagcacacgtgttcaaagcaaagagtgagaccatcgtcatctgatcctcatatgggctgagcaatgtaagagctcttgaacaactgttcagagcgacattccgtttcagtaataggctggttaatattggggttcccccttggtcagtgtgaagatcgtgcgctctttctggaggatgtccgcttagaacaggcatgaagtttttggcctgtgcagtgtacaacttgtatgttatagaccatactttcaataaggaaataataagtgtagggtctgtgaagccacccattgaatgatttcacaaccccaaatctgtcctcttttctggtgattgggaataaatggaccggcggattaccctttttttcttttattatccccttttg

SEQ ID NO: 1158 - DNA, 2293 bp, Zea mays
tcactcacatacacatttcgcgcatccactgactttaacacaagatccccgccagcgccgccgcgcgaccaccccttcctaaaccccgacgaccaccaaccatggccttcaacgctaaaccctactgctccaccaccgccaaaccgcccacccccgccgcccaccgctcgccgtccggcccgtccccctgcatctccgtccgcgccgccgccgtatccccccgcgcccggcactcagcctatggcctctccgccgccggcaacgcgtcctccagcaccgtccgcctccgcgcgctggcccagcgcacccgggcgcagccgcagcctccccggcggcggcccgagtacgtgccgaaccgcatcgacgaccccaactacgtgcgcatcttcgacaccacgctccgcgacggggagcagtcgccgggcgccaccatgacgagcgccgagaagctcgtcgtcgcgcgccagctggcccgcctcggcgtcgacgtcatcgaggccgggttcccggcctcctcccccgacgacctcgacgccgtgcgctccatcgccatcgaggtcggcaacccgccgccgggggacgacgggggcgcccacgtgcccgtcatctgcggcctctcgcgctgcaacaggagggacatcgacgccgcgtgggaggccgtcaggcacgcgcggaggcccaggatccacaccttcatcgccaccagcgagatccacatgcagcacaagctcaggaagacgcccgaccaggtcgtcgccgttgccagggagatggtggcgtacgcacgcagccttgggtgcgccgatgtcgagttcagccctgaggatgccggcaggtcaaatcgagaattcctgtaccatatactggaggaagtcataaaagctggggcaaccactcttaatatcccagatactgtcggatacactcttccttatgaatttgggaagttaatttctgacataaaggaaaacactcctggaattgaaaatgccattatttccactcattgccagaatgaccttggccttgcaactgccaacacattagcgggtgctcatgcaggagcacgacagttagaggtgactattaatggtattggtgaaagggctggaaatgcttcattggaagaggttgtcatggcaattaaatgtcgtggggagctcttagatggtctatatacgggaataaattcccaacatattactttgacaagcaaaatggtacaagagcacagtggacttcatgtacaaccacataaagctattgttggtgccaatgcctttgcccatgaaagtggaattcatcaggatgggatgcttaaatataaaggaacatatgaaataatatcgcctgatgatattggtttagcacgtgcaaatgaatttggtattgttcttgggaaactcagtggaaggcatgcagtgagatctaagctggtagagcttggatatgaaatcagtgacaaggaatttgaagatttctttaaacgctacaaagaggtcgcagagaagaaaaagcgtgtaactgatgaggacatagaagctttattgtcagatgagatattccagcctaaggttatttggtcccttgctgatgtacaggcaacatgtggaacacttggcttatctacagcaactgtgaaactgatagggccagatggagaggagagaatagcatgttcagttggaacaggtccagttgatgcagcttacaaggctgttgaccaaataatccagattccaaccgtcctccgagaatacggcatgacttcagtcacagaaggcattgacgctattgcgacgactcgagtggttgtcaccggagacgtggccaacaactccaaacacgccttgactggccactctttcaaccgctccttcagcgggagcggggcggcaatggacatcgtcgtgtccagcgtcagagcttacctgagtgccctgaacaagatgtgcagcttcgctggcgctgcgagagccagcagcaccgaggtgcctgggagcgcaagtgttcaacgcgcagaatgagctcggcggcgttcgcgttcgtgttagttctcgtatgggatgccaggatggactgtgccttgtcaagctgttgaggtgacatttcgtttcagtaacaggctgctcgatattatggggtaccccttgtcagtggggtgacgacaatgctgttctttttctgggaggatagtcccttcagcttagaacatgcaggaaattttggccctatgtagtgtacattttgtatctttaaacatactttcaataatgaaataatattagggtcc

SEQ ID NO: 1159 - DNA, 2219 bp, Zea mays
ccgccccctcctaaaccccggcgaccaaccatggccttctccgctaaaccccactgctcctgctccaccaccaccaaaccccccacccccgtcgcccacctctctccacccccgtccctctccgtccgcgccgccgcctgcgccccgcgctccgcctatggcctctctgccgccggcgtgggcggcggcaaggcgtcccccagtaccgttcgcctccgcgctcgggcccagcgcatccgcgcgtcgcagcagcagccgcggcggcgccctgaatacgtgccgaaccgcatcgacgaccccaactacgtgcgcatcttcgacaccacgctccgcgacggggagcagtccccgggcgccaccatgacgagcgccgagaagctcgtcgtcgcgcgccagctggcccgcctcggcgtcgacatcatcgaggcggggttcccggcctcctcccccgacgacctcgacgccgtgcgctccatcgccatcgaggtcggcaacccgcccaccgccggcgctgggaccgcccacgtgcccgtcatctgcggcctgtcgcggtgcaacaggaaggacatcgacgccgcatgggaggccgtcaggcacgctcggaggccccggatccacactttcatcgccaccagcgagatccatatgcagcataagctcaggaagacgcccgagcaggtcgtcgctattgccagggagatggtggcgtacgcgcgcagcctcgggtgccccgatgttgaattcagccctgaggatgccggcaggtcaaatcgagaattcctgtatcatatactggaggaagtcattaaagctggagcaaccactcttaatatcccagacactgtcggatacactcttccttatgaatttgggaaattaattgctgacataaaggcaaacacttctggaattgaaaatgctatcatttccactcattgccagaatgaccttggtcttgcgactgccaacacattagcgggtgctcgctcaggagcaagacagttagaggtgactattaatggtattggtgaaagagctggaaatgcttcattggaagaggttgtcatggcaattaaatgtcgtggggagctcttagatggtctatatacgggaattaattcccagcatattactttgacaagcaaaatggtacaagagcatagtggacttcatgtgcaaccacataaggctattgttggtgccaatgcctttgctcatgaaagtggaattcatcaggatggcatgcttaaatataaaggaacatatgaaataatatcgcctgatgatattggtttaacacgtgcaaatgaatttggtattgttcttgggaaactcagcggaaggcatgcagtgagatctaagctagtggagcttggatatgaaatcagtgacaaggaatttgaagatttctttaaacgctacaaagaggtcgcagagaagaaaaagcgtgtaactgatgaagacatagaagcgttattgtcagatgagatattccagcctaaggttatttggtcccttgctgatgtacaggcaacatgtggaacacttggcttatctacagcaacagtgaaactgatagcaccagatggagaggagagaatagcatgttcagttggaacaggtccagttgatgcagcttacaaggctattgaccaaataatccagatcccaactgttctccgagaatatggtatgacctcagtcaccgaaggcatcgacgcaatcgcaacaacccgggtggttgtcaccggagatgtgaccaacaactccaaacatgccttgactggccgcgctttcaaccgctccttcagcgggagcggggcagcaatggacatcgtcgtctccagtgtcagagcttacctgagtgccctgaacaagatgtgtagctttgctggtgccgcgaaagccagcggcgaggtacctgagagtgcaagcgtccaaagcgcagagtgagcttggcgacgatttggttctcatgtggactgggcggcgtaagagccagagcaactgttaaagagggtgacatttcgtttctgtattaggctgttcaatgttgggggttttgccttgtcagtgtggtgtgactgtactgttctttttttggaggatagcccagcttggaacgtgcaggcaattttggacctaggtagtgtacaatttgtatcttatatgaacaatacttccaataatcgaaagacttaagatgggttgctggagtc

SEQ ID NO: 1160 - DNA, 2136 bp, Panicum virgatum
cctctccgccgtcgccgtcagagccgagcccccagcgcgcgccgcctccgcgcgctggcctaccccgtccgggcgtctcagcagcagccgccgcggcggcggcccgagtacgtccccaaccgcatcgacgaccccaactacgtccgcatcttcgacaccacgctccgcgacggcgagcagtcccccggcgctaccatgaccagcgccgagaagctcgtcgtggcccgccagctcgcccgcctcggcgtcgacatcatcgaggccggcttcccggcctcctcccccgacgacctcgacgccgtgcgctccatcgccatcgaggtcgggaacgcgcccgtcggggaggacggccacgtgcccgtcatctgcggcctctcgcggtgcaacaagaaggacatcgacgccgcatgggaggccgtcaggcacgcgcgccggccgaggattcacaccttcatcgccaccagcgagatccacatgcagcacaagctcaggaagacgcccgagcaggtggtggccattgccagggagatggtggcgtacgcccgcagcctgggatgctctgatgtcgaattcagccctgaggatgctggaaggtcgaatagagagtttctgtatcatatattaggggaggtcataaaagctggagctacaactctgaatatcccagacactgttggatacaaccttccatatgaatttgggaacttaattgctgacataaaggcaaacactcctggaattgaaaatgctatcatttccacccattgccagaatgaccttggtcttgcaaccgcaaacacattagcgggtgctcgtgcaggagcacgtcagttagaggtgactattaatggtattggtgaaagagccggaaatgcttctttggaggaggttgtcatggcaattaaatgtcgtccggaactcttagatggtctatatactggaatcaattcccaacatattactttgacgagcaaaatggtacaagagcacagtggacttcacgtacaaccacacaaagctattgttggtgccaatgcctttgctcatgaaagtggaattcatcaggatgggatgcttaaatataaaggaacttatgaaataatatcacctgacgatattggtttaacacgtgcaaatgaatttggtattgttctcgggaaactcagtggaaggcatgctgtgagatctaagctagtggagcttggatatgaaatcagtgacaaggaattcgaggacttctttaaacgctacaaagaggttgcagagaagaaaaagcgtgtaactgatgaggacatagaagcattattgtcagatgagatattccagcctaaagttatttggtcccttgctgatgtacaggcaacatgtggaacacttggtttgtctacagcaactgtgaaactgataggaccagatggcgaggagaaaatagcatgttctgttggaacaggtccggtcgatgcagcttataaagctgttgaccaaattatccagattccaactgttcttcgagaatatggtatgacctcagtcacagaaggcattgacgcaatcgcaacaactcgagtggttgtcactggagacgtgagcaacaactccaagcatgccttgactggtcactccttcaatcgctccttcagtgggagtggggcatcaatggacgttgttgtgtccagcgtcagagcttacctgagtgccctgaacaagatgtgcagttttgctggtgcggtaaaagccacagcagtatctgagagcacacgtgttcaaagcaaagagtgagaccgtcgtcatccgattctcatatgggctgagcaatgtaagatctcttgaacaactgttcagagcgacattccgtttcagtaataggctggttaatattggggttcccccttggtcactgtgaagatcgtgcgttctttctggaggatgtccgcttagaacaggcatgaaatttttggcctgtgcagtgtacaacttgtatgttatagaccatactttcaataaggaaataataagtgtagggtctgtgaagccacccattgaatgatttcacaaccccaaatctgtcctcttttctggtgattgagaatacaatggaccggcggattaccttttttttattatccttttttgttc

SEQ ID NO: 1161 - DNA, 2046 bp, Echinochloa colona
agagggagcccgagcatcctccgcctccgcgcgtttgcccggaccatcagggcctcgcagcagcagctgccgcggaaagggcggcccgagtacgtcccccaccgcatcgacgaccccaactacgtccgcatcttcgacaccacgctccgcgacggcgagcagtcccccggcgccaccatgaccagcgccgagaagctcgtcgtcgcgcgccagctcgcccgcctcggcgtcgacatcatcgaggcggggttccccgcgtcctcccccgacgacctcgacgccgtgcgctccatcgccatcgaggtcgggaacacgcccgtcggggaggacggccacgtgcccgtcatctgcggcctctcgcggtgcaacaagagggacattgacgcgcgtgggagccgtgaggcacgcacgccggccgaggatacacacgttcatcgccaccagcgagactccatatgcagcacaagctgaggaagacgcccgagcaggtggtggcgattgccaaggagatggtggcgtacgctcgcagcttgggatgtaccgatgtcgaattcagccctgaggacgccggaaggtcaaatagggagttctgtatcatatactagaggaagtcatcaaggcaggagctacaactctcaatatcccggacactgttggatacactcttccatatgaatttgggaacttaattgctgacataaaggcaaacactcctggaattgaaaatgccatcatttctactcattgccagaatgaccttggtcttgccactgccaacacattagcgggtgctcgtgcaggagcacggcagttagaggtgactattaatggtatcggtgaaagagctggaaatgcttctttggaggaggttgtcatggcaattaaatgccgcggggaactcttacatggtctatatactggaatcaatacccaacatattactttgtcgagcaaaatggtacaagagcacagtggactttatgtacaaccgcataaagctattgttggtgccaatgcctttgctcatgaaagtggaattcatcaggacgggatgcttaaatataaaggaacttatgaaataatatcgcctgacgatattggtttaacacgtgcaaatgaatttggtattgttctcgggaaactcagtggaaggcatgctgtgagatctaagctagtggagcttggatatgaaatcagtgataaggaacttgatgacttctttaaacgctacaaagaggtcgcagagaagaaaaagcgtgtaactgatgaagacatagaagcattattgtcagatgagatatttcagcctaaggttatttggtcccttgctgctgtacaggcaacatgtggaacacttggtttatctacagcaactgtgaaactgatagcaccgggtggagaggagaaaatagcatgttgcatgggaacaggtccagtcgatgcagcttacaaggctgttgacgaaataatccagattccaactgttctccggggaatatggtatgacttcagtcacagaaggcattgatgcaattgcaacaactcgagtggttatcactggagatgtgaccaccaactccaaacatgccttgactggtcgctctttcaatcgctccttcagtgggagtggggctgatatggacgttgtcgtgtctagcgttagagcttacctgagtgccctgaacaagatgtgcagttttgctggcgctgtaaaagccagcagcgaggtaccagagagcgcaagtgttcaaagcaaagagtgagcttggcgttccttttgttctcatatgggctggagcgatgtaagagctcctgaccgacttgtgaaagcgacattttgtttcagtaacaggctggttaattttgggagtttcccttggtcaatttgaagattgtggccttctatttggaggatcgtacctatgtatagcgtaggacaggcatgaaattttgggcatatgtagtgtatgtaccctttgtgaacaagaaatattttcacaacctcaaatgtgccatcttttctggtaactggaaatccaacgggaa

SEQ ID NO: 1162 - DNA, 2636 bp, Zea mays
cactgacgtttcggtgtcatgtaataaagtggatcttatccgatacaaaacgagacagggcagggcaggtagttggttgctgtgcttagtgcctgagtgggtgcgcgcacgcataataaaaagttgttggcgcacgggcacgccgccggtgcacgctcgccgcctgctctcttgtctgctctgctcagctcaggcgacacggcgcgctccgtgccgcccacgaaacctcatcggcgtcatcctcatcaatccctgcctctgccgtccgagataaccatgctccacggtctctgactcacccctgcatcttgccgtgtagccttcttgtacagcttggactggactagactggaggtggagtggagcttttccttctccaaaatccaaatcaccacatccccccattaatttaaggggtttttatgtccaccgccgccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctccgccgcccgctgcctccgcctccgcctccgcgcgtcgtcgcagcatcctccgcctccgcccaccccgcggtcgcggcggccggattacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgccatcgaggtcggcaacccggcgccaggacccgccggggaggaggacgccgtccacgtgccggtcatctgcggcctctcgcggtgcaaccggaaggacatcgacgccgcgtgggaggccgtgcgccacgcgcgccgcccccggatccacaccttcatcgccaccagcgacattcacatgcagcataagctcaggaagacgcccgaccaggtggtcgccattgccagggagatggtggcctacgcccgcagcctcggatgcactgacgtcgagttcagccccgaggacgccggcaggtcaaatagagagttcttgtatcatattctaggggaagtcataaaagctggagctacgactctcaatatcccggacactgtcggatacaatcttccttatgaatttggaaagttgattgctgatataaaggcaaacactcctggaattgaaaaggctatcatttccactcattgtcagaatgaccttggtcttgcgactgccaacacactagcgggcgctcgtgcaggagcacggcagttagaggttactattaatggtattggtgaaagggctggaaatgcttctttggaggaggttgtcatggcaattaaatgccgcagagaactgttagatggtctctatactggaatcgattcccgacatatcactttgacgagcaaaatggtgcaagagcatagtggacttcacgtgcagccacataaagctattgttggtgccaatgcgttcgctcatgaaagtggaattcatcaggatgggatgcttaaatataaaggaacatacgaaattatatcgcctgatgatattggtctaacacgtgcaaatgaatttggtattgttcttgggaaactcagcggaaggcatgctgtgagatctaagctagtagagcttggatatgaaatcggtgacaaggaatttgaggacttctttaaacgctacaaagaggttgcagagaagaaaaagcgcgtaactgatgaagacttagaagcgttattgtcagatgagatattccagcctaaggttatttggtcccttgctgatgtacaggcaacatgtggtacacttgctttatctacggcaacagtgaaattggtagcaccagatggagaggagaaaatagcatgttcagtcggaacaggtccagtcgatgcagcttacaaggctgttgacaaaataatccagattccaacggttctccgagaatacagtatgacatcagtcacagaaggcattgacgcaatcgcgacaactcgggttgttgtcactggagatgtgagcaacaacgccaaacatgccctgactggccagtccttcaaccgctccttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatgagcttccgtttagttcacagtgacatgttcaaaatttctggaaggatcttccattgagcttaggacaggcaggaagtcttggggcctatgtagtgtacaatttatgtgtgtcatatcccgtgctcgttgccagtttgtattgtaccatatataaaccatagaatatgttgccatttagaagtctggccaaggtcagctgtaatgattcacatgcttatagcctggaaacattagacattgaaaacccgagcggtgaataaaggatgcccaaggtagaaactgtg

SEQ ID NO: 1163 - DNA, 2612 bp, Sorghum bicolor
cacagtctcgacacatcgtggctgctgctgacctgagtgcgtgcacaagctcttgcgcacgggcacggactcgccacggtcaccactctcgcatgctcgccgccgccgccgccgcgctgccctcctctgctctcttgtcttgtctgctctgctctgctcagaactaaacgacaccaggcgctccgtggcgcccacgaaacctcatcggcgtcatcctcctcctcctcctcatccccgtcggtccaggataaccatgatccaccaccatctctgactcatccctgcctcctcagtgcctctgccgtgtaggactggagtggagtgccgtctccaaatcatcacatttccccaataatttaatctccaccgccgtcgccgccgtcaactaaacccacgccgacggccgaccaaccatggcgtcctcgctgctctcctcccccgctaaacctttctgctccaccaccaaaacgacccccgcaccaaaagccacccgctttccatccccaagattcctctcctccgcccatgtcctctccgccgcgcgccgcctccgtgcggtctccgcccgagcgtcgcagcagcagcctccgccgccgcgggggcagcagcagcggcggccggagtacgtcccgaaccgcatcgacgacccaaactacgtgcgaatcttcgacaccacgctgcgcgacggggagcagtccccgggcgccacgatgacgagcgcgcagaagctcgtcgtcgcgcgccagctggcccgcctcggcgtcgacatcatcgaggccgggttcccggcttcctcccccgacgacctcgacgccgtgcgctccatcgccatcgaggtcggcaaccccgcacccgccggggacgacggtggcgccgacgccacgcacgtgccggtcatctgtggcctctcgcggtgcaacaggaaggacatcgacgcggcgtgggaggccgtgcgccacgcgcgactgccccggatccacaccttcatcgccaccagcgacatccacatgcagcataagctcaggaagacccccgagcaggtggcggccattgccagggacatggtggcctacgcccgcagcctcggatgcactgacgtcgagttcagccccgaggacgccggcaggtcaaatagagagttcttgtatcatattctaggggaagtcataaaagctggagctacaactctcaatatcccggacactgtcggatacaatcttccttatgaatttgggaagttaattgctgatataaaggcaaacactcctggaattgaaaatgctatcatttcaactcattgccagaatgaccttggtcttgcgactgccaacactttagcgggcgctcgtgcaggggcacgacaattagaggttactattaatggtattggtgaaagagctggaaatgcttctttggaggaggttgtcatggcaattaaatgccgcagagaactgttaaatggtctctatactggaatcgattctcggcatatcactttgacgagcaaaatggtacaagagcatagtggactgatcgtacaaccacataaagctattgttggtgccaatgcatttgctcatgaaagtggaattcatcaggatggcatgcttaaaaacaaaggaacttatgaaattatatcgcctgatgatattggtttgacacgtgcaaacgaatttggtattgttcttgggaaactcagtggaaggcatgctgtgagatctaagctagtggagcttggatatgaaatcggtgacaaggaatttgaggacttctttaaacgctacaaagaggttgcagagaagaaaaagcgcgtaactgatgaagacttagaagcgttattgtcagatgagatattccagcctaagcttatttggtcccttgctgatgtacaggcaacatgcggtacacttagtttatctacggcaacggtgaaattgataggaccagatggagaggagagaatagcatgttcagtcggaacaggtccagtcgatgcagcttacaaggctgttgaccaaataatccagattccaaccgttctacgagaatatagcatgacatcagtcacagaaggcattgacgcaattgcaacaactcgagttgttgtcactggagatgtgagcatcaacgccaaacatgccttgactggccgttctttcaaccgctccttcagtgggagcggggcatccatggacattgtggtgtccagcgtcagagcttacctgagcgccctgaacaagatttgcagttttgctggcgccgtgaaagccagcagcgaggtacctgagatcgcaagcgttccgagcacagaatgagcttggtggcgttccttttgttcaagatttctggaaggatcagcccttcagcttaggacaggcttgtcttgggcctatgtagtgtacaatttctgtatctcatataccatactcgtggccagtttgtatatcatatataaaccatacaatctgtatttggaggtacttgccatttagaactctgtggccaaagaaagatgaggtcatttagaatgattcattcttttagcctgtaaacattatacattgaaaacctgagcagtgaataaaggatgcccaagattgaaactgtgatcc

SEQ ID NO: 1164 - DNA, 1750 bp, Echinochloa colona
gtacgtccccaaccgcatcgacgaccccaactacgtccgcatcttcgacaccacgctccgcgacggcgagcagtcccccggcgccaccatgaccagcgccgagaagctcgtcgtcgcgcgccagctcgcccgcctcggcgtcgacatcatcgaggcggggttccccgcatcctcccccgacgacctcgacgccgtgcgctccatcgccatcgaggtcgggaacacgcccgtcggggaggacggccacgtgcccgtcatctgcggcctctcccgctgcaataagagggacattgacgccgcgtgggaggccgtgaagcacgcccgccggccgaggatacacacgttcattgccaccagcgagatccatatgcagcacaagctgaggaagacgcccgagcaggtggtggcgattgccaaggagatggtggcgtacgctcgcagcctgggatgtcctgatgtcgaattcagccctgaggacgccggaaggtcaaatagggagtttctgtatcatatactagaggaagtcataaaggctggagctacaactctcaatatcccggacactgttggatacactcttccatatgaatttgggaacttaattgctgacataaaggcaaacactcctggaattgaaaatgccatcatttctactcattgccagaatgaccttggtcttgccactgccaacacattagcgggtgctcgtgcaggagcgcggcagttagaggtgactattaatggtatcggtgaaagagctggaaatgcttctttggaggaggttgtcatggcaattaaatgccgcggggaactcttacatggtctatatactggaatcaatacccaacatattactttgtcgagcaaaatggtacaagagcacagtggactttatgtacaaccgcataaagctattgttggtgccaatgcctttgctcatgaaagtggaattcatcaggacgggatgcttaaatataaaggaacttatgaaataatatcgcctgaagatattggtttaacacgtgcaaatgaatttggcattgttctcgggaaactcagtggaaggcatgctgtgagatctaagctagtggagcttggatatgaaatcagtgacaaggaatttgaggacttctttaaacgctacaaagaggtcgcggagaagaaaaagcgtgtaactgatgaagacatagaagcattattgtcagatgagatatttcagcctaaggttatttggtcccttgctgctgtacaggcaacatgtggaacacttggtttatctacagcaactgtgaaactgatagcaccgggtggagaggagaaaatagcatgttgcatgggaacaggtccagtcgatgcagcttacaaggctgttgatgaaataatccagattccaactgttctccgggaatacggtatgacttcagtcacagaaggcattgatgcaattgcaacaactcgagtggttatcactggagatgtgaccaccaactccaaacatgccttgaccggtcgctctttcaatcgctccttcagtgggagtggggctgatatggacgttgtcgtgtccagcgtcagagcttacctgagtgccctgaacaagatgtgcagttttgctggcgctgtaaaaaccagcagcgaggtaccagagagcgcaagtgttcaaagcaaagagtgagcttggcgttccttttgttcccatatgggctggagtgatgtaagagcacctggccgacttgtcaaagcggcattt

SEQ ID NO: 1165 - DNA, 730 bp, Secale cereale
ggcttttaatctcctcctctgcggcggcaaaggcgccaaaccaccccacgccacatcctccaatggctaccaagtcccaaaagaagaagaagctctccgcccccaacccctctatcgacgccaagaagcccaaaccccagaaacccgtcgaggagcgagacacggcggccaagaagccgaatccgaagaagcagaaggagggcaaggtggtctctgcgaagaagccgaaggagcagaaggagggcaaggagggctctgccaagaagccgaagaagcagaaggagagcaacgagatcgacgagatcttcgaggccaccaagaagcgcaagctgcagcaggaggaggaggaggaggagtccgaggggacaagaagcccaagaagggcaaggccgagggggctagtaagagaagagcaagaaggagactgggggcaaaggctgggagcccggccaggatgacgaggtcgaggagaagcggccgcggcggcgcaccgaatgacgggctcaccatatactccgccgacgagctcgggttcggcaaggccgacgccggcggcaccgccctctgccccttcgactgcgactgctgcttctgagcctttcaggggtcctccgtggccgaggtgatgtgatcaggttacgttgcagtggtgtttgttgtaatgctcggttgatttgataactgtgtgcttagacgtgtgatccgatgaaatggaattttggttctctga

SEQ ID NO: 1166 - DNA, 746 bp, Secale cereale
ggcttttaatctcctcctctgggcggcagaggcgtcgaacccccccacgccacatcctccaatggctaccagatcccaaaagaagaagacgctctccgcccccaacccctctatcgacgccaagaagcccaaaccccagaaacccgtcgaggagcgagagacggcggcggcggcggtggcggccaagaagccgaagccgaagaagcagaaggagggctctgccaagaagccgaaggagcagaaggagggctctgccaagaagccgaagaagcagaaggagagcaacgagatcgacgagatcttcgaggccaccaagaagcgcaagctgcagcagcaggaggaggaggagtccgagggggacaagaagcccaagaagggcaaggccgagggggctagtaagaaaaagagcaagaaggagactgggggcaaagcctgggagcccggccacgatgacgaggtcgaggagaagcggccccggcggcgcaccaatgacgggctcaccatatactccgccgacgagctcgggttcggcaaggccgacgccggcggcaccgccctctgccccttcgactgcgactgctgcttctgagcctttcaggggtcctccgtggccgaggtgatgtgatcaggttacgttgcagtggtgtttgttgtaatgctcggttgatttgataactgtgtgcttagacgtgtgatccgatgaaatggaattttggttctctgatattgtcagttttgcaagagct

SEQ ID NO: 1167 - DNA, 787 bp, Triticum aestivum
cccaaaccctcgtccccgcgccgccacccccaagaacctcatcggctccggtcctcctccggccggcagaggcatcgaatcccccacgccacatcctccaatggccaccaagtcccaaaagaagaagctctccgcccccaacccctccatcgacgccaaggccccctcccccaaacaaaagcctacccctcagaaacccgcggaggagccagagacggcggcggcggccgccaagaagccgaagccgaagaagcagaaggtgggcaaggaggtctctgccaagaagccgaaggagggcaagcaggtctctgccaagaagcagaaggaaagcaaggaggtctctgccaagaagcccaagaagcagaaggagagcaacgagatcgacgagatcttcgaggccaccaagaagcgcaagctgcaggaggaagaggaggaagagtccgagggggacaagaagcccaggaagggcaaggccgagggggctagcaagaagaagagcaagaaggagactgggggcaaaggctgggagcccggccacgatgatgaggtcgaggagaagcggccgcggcggcgcaccaatgacgggctcaccatatactccgccgacgagctcgggttcggcaaggccgacgccggcggcaccgccctctgccccttcgactgcgactgctgcttctgagcccttcaggggtcctccgtgcctgaggtgatgtaatcgggttacgtcgcagtggtgtttgttgtaatgcctggttgatttgatgactatgtgcttagacgtgtgatc

SEQ ID NO: 1168 - DNA, 1036 bp, Triticum aestivum
tgcaggtacggtcgcaattcgggtcgaccacgcgtcgaacgagctgactcccgatccatcgatggcgtctagcgacgagaagcctgtcccgacgccggcatcaaccggaggcgacggcgggccgccagggaagccgacgacgacgtcgacgatgctgctggacaagggcgcggcggcgctgcagtcgctgcgcccggtgaagcagatgaagcagcacgtgtgcacgttcgccctgtacgcgcacgacccgcaccggcaggtggagacccaccactacgtctcccgcctcaaccaggacgtcctccagtgccccgtctacgactccgacgacaagcacgcccgcctcatcggcgtggagtacatcgtgtcgaggaagatcttcgagtcgctgccggcggaggagcagaagctgtggcactcgcacgcgcacgagatcaagacggggctgtgggcgaacccgtgggtgcccagcatgctggggaaggcggagctggaccacatggccggcacgtttggcaagttctggtgcacctggcaggtggaccgcggcgaccgcctgccgctcggcgcgcccgcgctcatggtgtcgccgcagggggagcgcgacggcgccgtgcgcccggacctggtgcggaagcgcgaccagaagtacagcttctccacggaggagctcaaggtcgccagggccgacgtggaggtgccgcccgagccgcgcccgggccaggccgactactgggtccgccaccacaagggcttcgccgtcgacgtcgtgccgcacgagatgaagcgccacgcgccgtttccgtgagcgaccccgttcctcggcgcgccggacgtgttggcacaagtgggttattacagcgctttcgtgttgtgtgtgtgtgtgaaactgtgcactttgtttcgtagttgctgtcgagctagcactgtgtaataggggtactggtctgaaaataaaagcatgtagtaattcagttctgctgcctgtgcttgtgctatgtggagcatttgaaaggctggaaatgctcaatttttc

SEQ ID NO: 1169 - DNA, 939 bp, Pseudoroegneria spicata
ggccaacgagccgactctcgatccatcgatggcgtctagcgacgagaagcctgttccgacgccggcctcgataggagacgacggcgggccgccggggaagccgacgaccacgtcgacgatgctgctcgacaagggcgcggcggcgctgcagtcgctgcgcccggtgaagcagatcaagcagcacgtgtgcatgttcgctctgtacgcgcacgacccgcaccggcaggtggagacccaccactacgtctcccgcctcaaccaggacgtcctccagtgccccgtctacgactccgacgacaagcacgctcgcctcatcggtgtggaatacatcgtgtcgaggaagatcttcgagtcgctgccggcggaggagcagaagctgtggcactcgcacgcgcacgagatcaagacggggctgtgggcgaacccgtgggtgcccagcatgctggggaaggcggagctggaccacatggccggcacgttcggcaagttctggtgcacctggcaggtcgaccgcggcgaccgcctgccgctcggcgcgcccgcgctcatggtgtcgccgcagggggagcgcgtcgccgccgtgcgcccggacctcgtgcggaagcgtgaccagaagtacagcttctccacggaggagctcaaggccgccagggtcgacgtggaggtgccggcggagccgcgcccgggccaggccgactactgggtccgccaccacaagggcttcgccgtggacgtcgtgccgcacgagatgaagcgccacgcgccgtttccgtgagcgaccctgttcctcggtgccagacgtgttggcagagctgggttacagcgctttcgtgttgtgtgcgaaactgtgcactttgtttcgttgttgcggtcgagatggcactgtgtaataggtactggcctgctaataaaaatcatttacttctcagttttttttta

SEQ ID NO: 1170 - DNA, 821 bp, Avena sativa
ctgactcccgatccatcgatggcgtctagcgacgagaagcctgtcccgacgccggcatcaaccggaggcgacggcgggccgccagggaagccgacgacgacgtcgacgatgctgctggacaagggcgcggcggcgctgcagtcgctgcgcccggtgaagcagctgaagcagcagtgtgcacgttcgccctgtacgcgcacgacccgcaccggcaggtggagacccaccactacgtctcccgcctcaaccaggacgtcctccagtgccccgtctacgactccgacgacaagcacgccgcctcatcggcgtggagtacatcgtgtcgaggaagatcttcgagtcgctgccggcggagggggcagaagcgtggcactcgcacgcgcacgagatcaagacggggctgtgggcgaacccgtgggtgcccagcatgctggggaaggcggagctggaccacatggccggcacgttcggcaagttctggtgcacctggcaggtggaccgcggcgaccgcctgccgctcggcgcgcccgcgctcatggtgtcgccgcagggggagcgcgacggcgccgtgcgcccggacctggtgcggaagcgcgaccagaagtacagcttctccacggaggagctcaaggtcgccagggccgacgtggaggtgccgcccgagccgcgcccgggccaggccgactactgggtccgccaccacaagggcttcgccgtcgacgtcgtgccgcacgagatgaagcgccacgcgccgttccgtgagcgacccgttcctcggcgcgccggacgtgttggcacaagtgggttattacagcgctttc

SEQ ID NO: 1171 - DNA, 1269 bp, Brachypodium distachyon
ctacgcaaattaacacaacactagaccacccaaagactagctttgacatcgatggcgtccagcgacgagaagcctgtcccgacgccggcctcgaccggaggcgacggcgggcctccggggaagccgacggccacgtcgtcggtccttctggacaagggcgcggcggcgctgcagtcgctccgccccgtgaagcagatgaagcagcacgtgtgcacgttcgccctgtacgcccacgacccgcaccggcagctggagacccaccacttcgtctcccgcctcaaccaggacgtcctccagtgcgccgtctacgactccgacgacaagaacgcccgcctcatcggagtggagtacatcgtgtcgaggaagatgttcgagtcgctgccgggggaggaacaacggctgtggcactcgcacgcgcacgagatcaaggaagggctgtggacgaccccgcgggtgccggggctgctgtccaagacggagatggagacgatggccggcacgttcggcaagttctggtgcacctggcaggtggaccgcggcgaccggctcccgctgggcgcgccggcgctcatggtgtcgccgcagcgggagcgcgagggcgccgtgcgcccggacctcgtgcggaagcgcgacaccaagtacggcttctcgacggaggagctcaaggccgagagggccggcgtggaggcgccggccgacccgcgccccggccaggccgactgctgggtcaggcaccacaaggggttcgccgtcgacgtcgtgccgcacgacatgaagcgccacgcgccgttgccgtgaacgaaaccaattccgttcgtcagggttgttgtgctccacacagcagcgagcaacgcctggggccgcggagctgggtcatgagttatgacagtgcttttgtgtcgtgcggaactgtacatttcctttcgtaatcctagtaggggaaataagaccgccggtgtcaggatgaaccgatgaaagactagaatctttgttggtccagccaatcctgttggtcgttgttgcgtatctgctgtagtcggccgtatacgggtttagtgttgctgacttgctctgtactctgctttccggcacaccccgccggcactcggttgatttctccgcgtgccccgggcgacactcgttggtttgctccagcaccgtgtctgatatgatcgctgagtgagttcaccgctgtattcacaatggtccggccaagatccactactgctttgccgagccgaggagaggacatcctctataagagtcgag

SEQ ID NO: 1172 - DNA, 1235 bp, Brachypodium distachyon
ctacgcaaattaacacaacactagaccacccaaagactagctttgacatcgatggcgtccagcgacgagaagcctgtcccgacgccggcctcgaccggaggcgacggcgggcctccggggaagccgacggccacgtcgtcggtccttctggacaagggcgcggcggcgctgcagtcgctccgccccgtgaagcagatgaagcagcacgtgtgcacgttcgccctgtacgcccacgacccgcaccggcagctggagacccaccacttcgtctcccgcctcaaccaggacgtcctccagtgcgccgtctacgactccgacgacaagaacgcccgcctcatcggagtggagtacatcgtgtcgaggaagatgttcgagtcgctgccgggggaggaacaacggctgtggcactcgcacgcgcacgagatcaaggaagggctgtggacgaccccgcgggtgccggggctgctgtccaagacggagatggagacgatggccggcacgttcggcaagttctggtgcacctggcaggtggaccgcggcgaccggctcccgctgggcgcgccggcgctcatggtgtcgccgcagcgggagcgcgagggcgccgtgcgcccggacctcgtgcggaagcgcgacaccaagtacggcttctcgacggaggagctcaaggccgagagggccggcgtggaggcgccggccgacccgcgccccggccaggccgactgctgggtcaggcaccacaaggggttcgccgtcgacgtcgtgccgcacgacatgaagcgccacgcgccgttgccgtgaacgaaaccaattccgttcgtcagggttgttgtgctccacacagcagcgagcaacgcctggggccgcggagctgggtcatgagttatgacagtgcttttgtgtcgtgcggaactgtacatttcctttcgtaatcctagtaggggaaataagaccgccggtgtcaggatgaaccgatgaaagactagaatctttgttggtccagccaatcctgttggtcgttgttgcgtatctgctgtagtcggccgtatacgggtttagtgttgctgacttgctctgtactctgctttccggcacaccccgccggcactcggttgatttctccgcgtgccccgggcgacactcgttggtttgctccagcaccgtgtctgatatgatcgctgagtgagttcaccgctgtattcacaatggtccggccaagatccactactgctttgccg

SEQ ID NO: 1173 - DNA, 1429 bp, Oryza sativa
attacggaaaacccccaccagcagcagctacgcgaggtcggatcggatggcgtccagcaacgagaagccactgcccacaccgatctctgccgccgccggcggcagcggcggcaacgcgccgccggggaggccgacgacggtggattcgatgctgctggacaagggcgcggcgatgctgcaggcgctgcgcccggtgaagcatatcaagcagcacgtgtgcacgttcgcgctgtacgcgcacgacccgcgccggcaggtggagacccaccacttcgtctcccgcctcaaccaggacgtcctccagtgcgccgtctacgacgccgacgacaagcacgcccgcctcatcggagtggagtatatcgtgtcgcggaagatcttcgactcgctgccggcggaggagcagcggttgtggcactcgcacgcgcacgagatcaaggcggggttgtgggtgagcccgcacgttcccgggatgctggagaaggcggagctggagaagatggccggcacgttcggcaagttctggtgcacctggcaggtggaccgcggcgaccgcctcccgctgggcgcgccggcgctgatggtgtcgccgcaggacgaccccgcggcggacgtgcgccccgacctcgtgcgcaaccgggacgacaagtaccgctactccacgacggagctgcgggcggcgagggccgacgtcgcggtgccggcggagccgcgaccggggcaggccgactactggctccgccaccgcaagggcttcgccgtggacgtcgtgccgcacgagatgaagtgccacgcgccgttcccgtaagctgtgaacagtacgctggcagagctgtggcacacgactcgtgtacgtgaacgtagtagtgtaggaacgaccgtgggtcgttgtatcgtgtgtacggctccgtcgtaaactcgtaacaccaactgctaccacgtcttctgggcaaaaaatggcggcggcggtgagaggggcacacgttgatggtagcgggcgacagcaagtgcagcggctgcagacggcacctctggcgagggggtaggtggcgacgggctaggtcccgcaacggccggcggtgggtgacaaggggatggtgggaggcttgggcttggctcgtggtggatggcagtgggcgacaggtggcttgggcttcctaagggcgggctcgacccacaactactgacggcgggtgcctcggtggccgaatccacctccgccgatctcgtgacggcgcgatccgtcggcgtcggcgctgtgaccgtcagatccgcgtcgccgtcgtcgggattactagggttttgattttttttaagatatctttttttacttttatatatggatgatataagcacccgcgcatgaaaattatcatagaccacttgggacggacggtccgtcttttacatgtgaaaataggttttggtctgc

SEQ ID NO: 1174 - DNA, 1415 bp, Oryza sativa
gtgacggcattacggaaaacccccaccagcagcagctacgcgaggtcggatcggatggcgtccagcaacgagaagccactgcccacaccgatctctgccgccgcaggcggcagcggcggcaacgcgccgccggggaggccgacgacggtggattcgatgctgctggacaagggcgcggcgatgctgcaggcgctgcgcccggtgaagcatatcaagcagcacgtgtgcacgttcgcgctgtacgcgcacgacccgcgccggcaggtggagacccaccacttcgtctcccgcctcaaccaggacgtcctccagtgcgccgtctacgacgccgacgacaagcacgcccgcctcatcggagtggagtatatcgtgtcgcggaagatcttcgactcgctgccggcggaggagcagcggttgtggcactcgcacgcgcacgagatcaaggcggggttgtgggtgagcccgcacgttcccgggatgctggagaaggcggagctggagaagatggccggcacgttcggcaagttctggtgcacctggcaggtggaccgcggcgaccgcctcccgctgggcgcgccggcgctgatggtgtcgccgcaggacgaccccgcggcggacgtgcgccccgacctcgtgcgcaaccgggacgacaagtaccgctactccacgacggagctgcgggcggcgagggccgacgtcgcggtgccggcggagccgcgaccggggcaggccgactactggctccgccaccgcaagggcttcgccgtggacgtcgtgccgcacgagatgaagtgccacgcgccgttcccgtaagctgtgaacagtacgctggcagagctgtggcacacgactcgtgtacgtgaacgtagtagtgtaggaacgaccgtgggtcgttgtatcgtgtgtacggctccgtcgtaaactcgtaacaccaactgctaccacgtcttctgggcaaaaaatggtgcgtgacttgacttgagcactttcatgtcttggatttcacacagtttttcttttagccagttcaacaaaagcttaatcatgagtctaaaaaaatgaagttgagctagaaaaaatgaagtaagctcaactgttaggtttgagggtttattttggaaccagttcatgatttaacagattaaacacgtttacttgtttttaattatctcagttcatgatcaattttgtcatgtgggtcttctaagggtcctctaatggttcgcacgcaaaactaagtctacactcagaacctatttttatatatagacctcttaaggtatttttatagacagacctcttaaataagagggtcgcatgtatagttggtaagagggtcgcatgtatagttgggtctcttaagatgatcgtctatttttatagatagacctcttaaggtaagaggatcgtctctt

SEQ ID NO: 1175 - DNA, 2218 bp, Brachypodium distachyon
cttgcttgcttcccctaccccgctccctgctgccgccgcgcttctctcggagccctgcctcccacctcactgaccacactccctgcttcttccgccagttcacacacacagacacgcacgctctcccctcccccacaccgttccaccgtccacattcgttcgccagcagccagatcagagtagatctccgatggggtgtttccagtccaagccggcggggaagccgctgccgcccgacgccgacgccgccctccccgccgacgaccccgcagatcccgaggcggcgaacggcgtggatgggcccgcgggggtcgcggagggggacgagaaggatggcggcgcggcggcggccaagcgggcggtgccggtcttcagggagttcgggctcgccgagctgcgcgccgccaccaagggcttcagcgccgacctcatcgtctccgagagcggcgagaaggcgcccaacgtcgtctaccggggccgactcgacggcggccgcctcattgccgtcaagcgcttctcccgcctctcctggcccgacccgcagcagttcctcgcggaggcgggcggcgtggggaaggtgcggcacaagcgcctcgtcaacctcatcggctgctgcgcggagggcgacgagaggctgctcgtcgccgagtacatgcccaacgacaccttgtccaagcacctcttccactgggataagcagccattgccatgggaaatgcggttgagggttgcacattacattgcacaagcactcgaccattgcaatgcagagaaccggaaaatctatcatgacttgaatgcttatagggtactttttgatgaggaaggtgatcctcgcttgtcaagttttggactaatgaagaacagtcgtgacgggaaaagttatagcaccaacctggcttacaccccaccagagtttctacgaaccggccgagtcatcgctgagagtgtgatatatagttacggaacggttctcttggatctgttgagtgggaaacacattcctcctagtcatgcgcttgatttgataagaggaaagaatatactgttattgatggattcctccttagaagggcaatatgctaatgaagatgcttcaaaattagtagatcttgcatcaaaatgtttacagtttgaagctagggacagacccaatataaagtatctattgtcttctgttgggcctcttcagaagcaaaaggaggtggcatcacatgtgttgatgggcattacaaaaaccacgtcagtcttaccaactattctttctccacttgggaaggcctgtgctggtatggaccttacagcagtacacgatatattgctcaaaacaggttacaaagacgacgaaggtgcagaaaatgagttgtcctttcaagaatggactcagcaagtgcaagagatgctgaacacaaagaagtttggtgatatttcatttagagataaggatttcaagagtgcaattgactactatacgaagctagttggaatgatgtcagtgccttcagctacagtttttgcaaggcggagtttctcctacctgatgaatgggcagtcggagcttgctctgcgggacgcaatgcaggctcaggtctgcatgcctgaatggcctaccgcattctacctccaagcccttgctctctcaaagctaggcatggaaactgacgcgcaggacatgctcaacgacggagccacttttgaggccaagaagcaaaacagctggcgtggttagggagcaagccacagcttcctccaaactgttgttgcctttcaacagaggaaggtacaatgaagattgttcactgggacgtcggatgcgctgctaggagtgggattgaagtgcactgttttatcgtgcgatctccaccctgaaatgtcgataacgttgctgttgtgacatggaagaagagagcagaggggtaggagttgcgctttgttttcatcagcgattgcggcatgctcttgctagtcattacgccatggtgctcctttgggagagaagattgtaattaaggtgacgctgtcttaacgattctcctttttcgtttttctttccactggatggttggatgattgatagcgaggttaggaagggggctccttccttgtgattagctgggaaaaaaataaattagactgaattccattcgattcaaccatgcatgtttcctcatatgatgttttctatcgaatgaacggttgtgacttgcataaaaaagag

SEQ ID NO: 1176 - DNA, 2242 bp, Brachypodium distachyon
gtgcgcacgcaccggatcccttgcttgcttcccctaccccgctccctgctgccgccgcgcttctctcggagccctgcctcccacctcactgaccacactccctgcttcttccgccagttcacacacacagacacgcacgctctcccctcccccacaccgttccaccgtccacattcgttcgccagcagccagatcagagtagatctccgatggggtgtttccagtccaagccggcggggaagccgctgccgcccgacgccgacgccgccctccccgccgacgaccccgcagatcccgaggcggcgaacggcgtggatgggcccgcgggggtcgcggagggggacgagaaggatggcggcgcggcggcggccaagcgggcggtgccggtcttcagggagttcgggctcgccgagctgcgcgccgccaccaagggcttcagcgccgacctcatcgtctccgagagcggcgagaaggcgcccaacgtcgtctaccggggccgactcgacggcggccgcctcattgccgtcaagcgcttctcccgcctctcctggcccgacccgcagcagttcctcgcggaggcgggcggcgtggggaaggtgcggcacaagcgcctcgtcaacctcatcggctgctgcgcggagggcgacgagaggctgctcgtcgccgagtacatgcccaacgacaccttgtccaagcacctcttccactgggataagcagccattgccatgggaaatgcggttgagggttgcacattacattgcacaagcactcgaccattgcaatgcagagaaccggaaaatctatcatgacttgaatgcttatagggtactttttgatgaggaaggtgatcctcgcttgtcaagttttggactaatgaagaacagtcgtgacgggaaaagttatagcaccaacctggcttacaccccaccagagtttctacgaaccggccgagtcatcgctgagagtgtgatatatagttacggaacggttctcttggatctgttgagtgggaaacacattcctcctagtcatgcgcttgatttgataagaggaaagaatatactgttattgatggattcctccttagaagggcaatatgctaatgaagatgcttcaaaattagtagatcttgcatcaaaatgtttacagtttgaagctagggacagacccaatataaagtatctattgtcttctgttgggcctcttcagaagcaaaaggaggtggcatcacatgtgttgatgggcattacaaaaaccacgtcagtcttaccaactattctttctccacttgggaaggcctgtgctggtatggaccttacagcagtacacgatatattgctcaaaacaggttacaaagacgacgaaggtgcagaaaatgagttgtcctttcaagaatggactcagcaagtgcaagagatgctgaacacaaagaagtttggtgatatttcatttagagataaggatttcaagagtgcaattgactactatacgaagctagttggaatgatgtcagtgccttcagctacagtttttgcaaggcggagtttctcctacctgatgaatgggcagtcggagcttgctctgcgggacgcaatgcaggctcaggtctgcatgcctgaatggcctaccgcattctacctccaagcccttgctctctcaaagctaggcatggaaactgacgcgcaggacatgctcaacgacggagccacttttgaggccaagaagcaaaacagctggcgtggttagggagcaagccacagcttcctccaaactgttgttgcctttcaacagaggaaggtacaatgaagattgttcactgggacgtcggatgcgctgctaggagtgggattgaagtgcactgttttatcgtgcgatctccaccctgaaatgtcgataacgttgctgttgtgacatggaagaagagagcagaggggtaggagttgcgctttgttttcatcagcgattgcggcatgctcttgctagtcattacgccatggtgctcctttgggagagaagattgtaattaaggtgacgctgtcttaacgattctcctttttcgtttttctttccactggatggttggatgattgatagcgaggttaggaagggggctccttccttgtgattagctgggaaaaaaataaattagactgaattccattcgattcaaccatgcatgtttcctcatatgatgttttctatcgaatgaacggttgtgacttgcataaaaaagagagaag

SEQ ID NO: 1177 - DNA, 2260 bp, Oryza sativa
gtgcggccgcttctatcggccctgccccccttcgccttcctcgcctcgcctcgcctccccacttcgcttcactgcttccctactacacactcgccgccattcccaccccccccgcctcaaatattctctcgcattcgcgttcccaccgcctcgccctagatctcaccacctcgcgtcgcgcctccaatggggtgcttcctgtccaagccggcgggggcgggtctcctcccgcccaacgacgccgccgcgctccccgccgacaaccccgcagatcccgaggcggcggccgcgaatggcggcgctgactccgcggcggccgacggcggcggcgacgacaaggacgccgccaagcgcgcggtcccggtgttcagggagttcggcctcgcggagctgcgcgccgccaccaagggcttcagcgccgacctcatcgtctccgagagcggcgagaaggcccccaacgtcgtctaccgcggccgcctcgacggcggccgcctcatcgccgtcaagcgcttctcccgcctctcctggcccgacccgcagcagttcctcgcggaggcggccggggtggggaaggtgcgccacaagcgcctcgtcaacctcatcggatgctgcgccgagggcgacgagaggctgctcgtcgccgagtacatgcccaacgacaccctttccaagcatctcttccactgggataagcagcccttgccatgggaaatgcggttaagggttgcgtattacattgcgcaggcactcgatcactgcaatgccgagaaccgaaaaatctatcatgacttgaatgcttatagagtactttttgatgaggaaggtgatcctcggctgtcaagttttggactaatgaagaacagccgcgatgggaaaagttatagcactaatctggcttacaccccgcctgagtttctacgaactggcagagtcatcgccgagagtgtgatatatagctatggaacagttcttttggatcttttgagtgggaagcacatacctcctagccatgcacttgatttgataagagggaagaatatactgttgctcatggattcctccttagaagggcagtatgctaatgaagatgcttcaaaactagttgaccttgcgtcgaaatgcttgcaatttgaagcgagggacagacccaatataaagtatctcttgtcttctgttgggcctcttcagaagcaaaaggaggtagcatcacatgtgttgatgggtattacaaaagccacggcggtgttgccaactattctttctccccttgggaaggcctgttccggtatggaccttacagcagtacatgatatattgctcaaaacaggttacaaagatgaagaaggtgcagaaaatgagctgtcctttcaagaatggactcagcaagtgcaagagatgctgaataccaagaagtttggtgacattgcatttagagacaaggatttcaagactgcaattgactactactccaagcttgttggaatgatgtcagtgccttcagccacagtttttgcccggagaagtttctcctatttgatgaatgggcagtcagagcttgctctccgggacgcaatgcaggcccaggtctgcatgcccgagtggccaactgccttctacctacaagcccttgctctctcaaagctcggcatggaaactgacgcacaagatatgctaaacgatggagccacttttgaggccaagaagcaaaatagctggcgaggttaggggaacaagtcatggtttcacccccaaatctgttgttgcctttttaacagaaaaaggtaagatgatgatgagtgttcattgggacgactgttgcactactaggagtgggattgaaaatgcactgttttattgtgcaatctccgcccaaatgtcgataaatgagtggcgttgttgtgacctggaaggcaaaaggcagagaggcattgcttatactacgcttttgagtctgagttgcactttgtttctcgggtgatggcagcaaacacctgctgatcattgcgttgcagtgctcctctagagacgagagaattgatgagatgagaagattgtaattaaggggatgcttttctgacaatttcacctttttttttcgttttccattggaatctttgggccccaggtgagatgatagtgtgaagaaaggcgggttccttgtgattagcctaggatggagaataaactagagccatctaaattccattcatttctaccatgttcttgatgtgttacttgctgctttaaccttttgaaggta

SEQ ID NO: 1178 - DNA, 2203 bp, Setaria italica
ccagtgtgctgccgcgcttctctcggagccctgcctccccccccacaccttcacgagctcgctctgctccactccgcactcctccgcactggagtcgagttgagcgcacgctcccgcactcgcattcccaccgaccacaacgcctagatctccactccgcccatggggtgcttccagtccaaggtggcggggcccctgccgcccaacgacgccgccgcgctccccgccgacaacccggcagatcccgaggcggcgaacggcggggcggatggcggcgacgccggcgacgacaaggaggcggcgaagcgcgcggtgccggtattcagggagttcgcgctggccgagctgcgcgccgccaccaaggggttcagcgccgacctcatcgtctccgagagcggggagaaggcgcccaacgtcgtctaccggggccgcctcgacggtggccgtctcatcgccgtcaagcgattctctcgcgtctcgtggcccgacccgcagcagttcgtcgcggaggcggcgggcgtgggcaaggtgcggcacaagcgcctcgtcaacctcattggctgctgcgccgagggtgacgagaggctgctcgtcgccgagtacatgccaaacgacaccctctccaagcacctcttccactgggataagcagccattgccatgggaaatgcggttgagggtagcatatttcatcgcacaagcactcgaccattgcaatgcagagaaccggaaaatctatcatgacttgaatgcttacagagtactttttgatgaggaaggtgatcctcgcttgtctagttttggactgatgaagaatagccgtgatggaaaaagttatagtaccaacctggcttacactccaccagagtttctacgaactggcagagtaattgctgagagtgtgatatatagctatggaactgtcctgttggatcttttgagcgggaagcacattcctccgagtcatgcactggatttgataagggggaagaatatactgttgctgatggattcctccttagaagggcagtatgctaatgaggatgcttcgaaattggttgatcttgcatcaaagtgtttgcaatttgaagctagggatagaccaaacataaagtatctcttgtcttctgttggtcctcttcagaagcaaaaggaggtagcatcccatgtcttaatgggtattacaaaagccacatcagtattgccagctattctttctccacttgggaaggcctgctctgttttggatcttacagcggtgcatgatatattgcttaaaacaggttataaagatgatgagggtgcagaaaacgagttatcctttcaagaatggacccagcaagttcaagagatgctgaacacaaagaaggttggtgacatcgcatttagagacaaggattttaagactgcaattgactactactctaagctagttgcaatgatgtcaacaccttcagccacagtttttgctaggcgcagtttttcctacttgatgaatgagcaagcagaacttgccctccgggacgccatgcaggcccaggtctgcatgcaggaatggcctacagctttctaccttcaagctcttgctctatcaaagcttggcatggaaactgatgcacaagacatgctcaacgatggagccacatttgaggccaagaagcaaaacagctggcgcagttaggggtcaaatttgcgggttccccataccattgccttttgatagaaaaaggtacaatggtgagtgtcctccaaattgttcactgggacatctgttgaactgctaggagtgggattgaaatgcactgttttatcgtgcttcgtgcaatctccacccgaatgttgatagtggcaatgttgtggcctggaagggaagataaaggcaggagcatgcaatgcatattttctctcgagttgcgctttgtatcgcgagtgattgcaagaggatctgctgataattgcaatttcagtgctcctctggagagaagattgttgtaattaaggggatgctttctaacaatttcttctccttttcgtttccattggaatctttgggccccagaggacatgagtggtgtgcaaaaaggcgggtaccttgtgattagctaaggagaataaactagagccatcagaattccattcaattctaccatatttctatgtgctgctttctcttcttgaactgttctgacgtgctgctatttcgc

SEQ ID NO: 1179 - DNA, 2145 bp, Setaria italica
ccctgcctccccccccacaccttcacgagctcgctctgctccactccgcactcctccgcactggagtcgagttgagcgcacgctcccgcactcgcattcccaccgaccacaacgcctagatctccactccgcccatggggtgcttccagtccaaggtggcggggcccctgccgcccaacgacgccgccgcgctccccgccgacaacccggcagatcccgaggcggcgaacggcggggcggatggcggcgacgccggcgacgacaaggaggcggcgaagcgcgcggtgccggtattcagggagttcgcgctggccgagctgcgcgccgccaccaaggggttcagcgccgacctcatcgtctccgagagcggggagaaggcgcccaacgtcgtctaccggggccgcctcgacggtggccgtctcatcgccgtcaagcgattctctcgcgtctcgtggcccgacccgcagcagttcgtcgcggaggcggcgggcgtgggcaaggtgcggcacaagcgcctcgtcaacctcattggctgctgcgccgagggtgacgagaggctgctcgtcgccgagtacatgccaaacgacaccctctccaagcacctcttccactgggataagcagccattgccatgggaaatgcggttgagggtagcatatttcatcgcacaagcactcgaccattgcaatgcagagaaccggaaaatctatcatgacttgaatgcttacagagtactttttgatgaggaaggtgatcctcgcttgtctagttttggactgatgaagaatagccgtgatggaaaaagttatagtaccaacctggcttacactccaccagagtttctacgaactggcagagtaattgctgagagtgtgatatatagctatggaactgtcctgttggatcttttgagcgggaagcacattcctccgagtcatgcactggatttgataagggggaagaatatactgttgctgatggattcctccttagaagggcagtatgctaatgaggatgcttcgaaattggttgatcttgcatcaaagtgtttgcaatttgaagctagggatagaccaaacataaagtatctcttgtcttctgttggtcctcttcagaagcaaaaggaggtagcatcccatgtcttaatgggtattacaaaagccacatcagtattgccagctattctttctccacttgggaaggcctgctctgttttggatcttacagcggtgcatgatatattgcttaaaacaggttataaagatgatgagggtgcagaaaacgagttatcctttcaagaatggacccagcaagttcaagagatgctgaacacaaagaaggttggtgacatcgcatttagagacaaggattttaagactgcaattgactactactctaagctagttgcaatgatgtcaacaccttcagccacagtttttgctaggcgcagtttttcctacttgatgaatgagcaagcagaacttgccctccgggacgccatgcaggcccaggtctgcatgcaggaatggcctacagctttctaccttcaagctcttgctctatcaaagcttggcatggaaactgatgcacaagacatgctcaacgatggagccacatttgaggccaagaagcaaaacagctggcgcagttaggggtcaaatttgcgggttccccataccattgccttttgatagaaaaaggtacaatggtgagtgtcctccaaattgttcactgggacatctgttgaactgctaggagtgggattgaaatgcactgttttatcgtgcttcgtgcaatctccacccgaatgttgatagtggcaatgttgtggcctggaagggaagataaaggcaggagcatgcaatgcatattttctctcgagttgcgctttgtatcgcgagtgattgcaagaggatctgctgataattgcaatttcagtgctcctctggagagaagattgttgtaattaaggggatgctttctaacaatttcttctccttttcgtttccattggaatctttgggccccagaggacatgagtggtgtgcaaaaaggcgggtaccttgtgattagctaaggagaataaactagagccatcagaattccattcaattctaccatatttctatgtgctgctttctcttc

SEQ ID NO: 1180 - DNA, 2213 bp, Sorghum bicolor
cgcacctaccggatccccccaccacccctgtgtgctgccgcgcttctctcggagccctgcctcctgcactgccgcctccccaccttcacgagctcacttctgctgctccattccacgctcccccgcgctggactggagccgagctgagcgcacgctcttgcacaccactcccattcccaccgaccatatcgcccttgcttcgctaagcatcctagatctccattcccgctcatggggtgcttccagtccaaggtggcggggcccctgccgcccaaggacgccgccgcgctccccgccgacaagcctgcagatcccgaggcggcgaacggcggccccgacgggggaggcgacggcgacgacaaggaggcggtgaagcgcgcggtgcccgtgttcagggagttcgcgctcgccgagctgcgcgccgccaccaaggggttcagcgccgacctcatcgtctccgagagcggcgagaaggcgcccaacgccgtctaccgcggccggctcgacggcggccggctcatcgccgtcaagcgcttctcgcgcctctcctggcctgacccgcagcagttcctcgcggaggcggcgggcgtggggaaggtgcggcacaagcgcctcgtcaacctcattggttgctgcgcagagggtgacgagaggctgctcgtcgccgagtacatgcccaacgacaccctgtccaagcatctcttccactgggataagcagccgttaccatgggaaatgaggctgagggttgcatatttcattgcgcaagctctcgaccattgcaatgccgagaacaggaaaatctatcatgatttgaatgcttatagagtactttttgacgaggaaggtgatccccgcttgtcaagttttggattaatgaagaacagccgtgatggaaaaagttatagtactaacctggcttacactccaccagagtttctgcgaactggcagagtaattcccgagagtgtgatatatagctatggaactgtcctgttggatcttttgagcggaaaacacattcctcctagtcatgccctagatttaataaggggaaagaatatactgttgctgatggattcctccttagaaggccagtatgctaatgaagatgcttcgaaattggttgatcttgcatcaaagtgtctgcaatttgaatctagggatagaccaaacataaagtatcttttgtcgtctgttggtcctcttcagaagcaaaaggaggttgcatcacatgtgttcatgggtattacaaaagctacatcagtactgccaaccatttattctccacttgggaaggcctgtgctggtatggatctttcggcggtgcatgatattttgctcaaaacaggttataaagatgatgagggtgcagaaaacgagttatcctttcaagaatggacccagcaagtgcaagagatgctgaacacaaagaagtttggggacattgcgtttagagataaggattttaagactgcaattgactactactccaagctagtggcaatgatgtcaacgccttcagctacagtttttgctaggcgcagtttttcctacttgatgaatgggcaagcagaacttgctctacgggacgctatgcaggctcaggtctgcatgcctgagtggcctacagccttctacctccaagcccttgctctttcaaagctcggcatggaaaccgatgcgcaggacatgctcaacgatggagccacatttgaggccaagaagcaaaacggctggcgtagttaggaaacaaagtctcccaactactccgtgttgttgcccttttagaaaaaggtacaatggcgagtgtcctccaaatcagttcactgggacgtcagttgcactactaggagtgggattgaaatgcactgttttatcgtgcaatctccgcccgaatgtcgataacgagtggcggtgttatgatcaggagtggaagaataggtcaggggctttgaacgcatagcatactcttccatgagttgctctttgttttgcgagtgttggtggcaggatctgctgattatttgcaactgcagttgtaattaaagggatgctttctaacaatttctcctcttggtttacgtggaatctttaggccccagaggacatgagtggtgtgcaaaaaagccgggttcattgtgattagctacggagaataaactagagccatcggaaatccattcgattctaccatatttatatgccgtgtt

SEQ ID NO: 1181 - DNA, 2083 bp, Zea mays
attccacactaccccgcgctggactggagtcgagttgagctcacgctctcgcacactcgcactcccattcccactggccagattgatcttgcttcgctaatcatcctagatctccattcccgcccatgggatgcttccagtcgaaggtggcggggcccctgccgcccaacgacgccgccgctctccccgccgacaagcctgcagatcctgaggcggcgaatggcggcgccgacggggaaggcgacggtgacgacaaggaggctgtgaagcgcgcggtgccggtgttcagggagtttgctctggccgagctgcgcgccgccaccaagggattcagcgccgacctcatcgtctccgagagcggcgagaaggcgcccaacgccgtctaccgcggccgcctcgacggcgggcggctcatcgccgtcaagcgcttctcgcgcctctcctggcctgacccgcagcagttcctcgcggaggcggcgggcgttgggaaggtgcggcacaagcgcctcgtcaacctcattggctgctgcgccgagggtgacgagaggctgcttgtcgccgagtacatgcccaacgacaccctgtccaagcatctcttccactgggataagcagccgttaccatgggaaatgaggctgagggttgcatatttcattgcgcaagctctcgaccattgcaatgctgagaacaggaaaatctatcatgatttgaatgcttatagggtactttttgatgaggaaggtgatccccgcttgtcaagttttggattaatgaagaacagccgtgatgggaaaagttatagcactaacctggcttacactccaccagagtttctacgaactggcagagtaattccggagagtgtgatctatagctatggaactgtcctgttggatcttttgagcggaaaacacattcctcctagtcatgccctagatttaataaggggaaagaatatactgttgctgatggattcctccttagaagggcagtatgctaatgaagatgcttcgaaattggttgatcttgcatcaaagtgtctgcaatttgaatctagggatagaccgaacataaagtatcttctgtcttctgttggtcctcttcagaatcaaaaggaggttgcatcacatgtgttcatgggtattacaaaagccacatcagtactgccaaccatttgttctccactcagaaaggcctgcactggtatggatctttcagcggtgcatgatattttgctcaaaacaggttataaagatgatgagggtgcagaaaacgagctatcctttcaagaatggacccagcaagtgcaagagatgctgaacacaaagaagtttggtgacattgcatttagagacaaggattttaagactgcaattgactactactccaagctagttgcgatgatgtcgacgccttcagctacggtttttgtcaggcgcagtttttcctacttgatgaatgggcaagcagagctcgctctacgggacgcaatgcaagcccaggtctgcatgcccgagtggcctacggccttctacctccaggccctggctctttcaaagctcggcatggaaaccgatgcccaggacatgctcaacgatggcgccacgtttgaggccaagaagcagaacggctggcgcagttaggagccgacgacgaacaaagtctctcttccaacgactccgtgccgttgccctttgagagaagaaggtacaatggcgagtctcctccaaatcagttcactgggacacgcctgttgcactactagtagtgggattgaaacgcactgttttatcgtgcaatctcctctcgaatgtcggtaacgagtgatgatcatgatcaggggtggaaaaataggtcagggcctttgaacgcatagcgtactcttccgtgggttgcgctttgtgttgctggcgatggtggcaggatctgcctgattgttgcaactgcagttgtaattaaagggatgctttctaacaccttctggttttacgtggaatctttgggccccagagcacatgagcggtgtgcaaaaagccgagttcattgtgattagctacgaagaataaactagagccgtcgggat

SEQ ID NO: 1182 - DNA, 2179 bp, Zea mays
ccacactcccccgcgctggactggagtcgagttgagcgcacgctctcgcactcccatattcccaccgaccatatcgctcttgcttcgctaagcatcctagatctccattcgcgcccatggggtgcttccagtccaaggtggcggggcccctgccgcccaacgacgccgccgcgctccccgccgacaagcctgcagatcccgaggcggcgaacggcgccgccgacgggggaggcgacggcgacgacaaggaggccgtgaagcgcgcggtgccggtgttcagggagttcgcgctggccgagctgcgcgccgccaccaagggcttcagcgccgacctcatcgtctcggagagcggcgagaaggcgcccaacgccgtctaccgcggccgcctcgatggcggacggctcatcgccgtcaaacgcttctcgcgcctctcttggcctgacccgcagcagttcctcgcggatgcggtgggcgtggggaaggtgcggcacaagcgcctcgtcaacctcattggctgctgcgccgagggtgacgagaggctgctcgtcgctgagtacatgcccaacgacaccctgtcgaagcatctcttccactgggataagcagcctttaccatgggaaatgaggctgagggttgcatattttattgcacaagctctcgaccattgcaatttggagaacaggaaaatctatcatgatttgaatgcttatagagtactttttgatgaggaaggtgatccccgcctgtcaagttttggattaatgaagaacagccgtgatggaaaaagctatagtactaacctggcttacactccaccagagtttctacgaacaggcagagtaattcccgagagtgtgatatatagctatggaactgtcctgttggatcttttgagcggaaaacacattcctcctagtcatgccctagatttaataaggggaaagaatatactgttgctgatggattcctccttagaagggcagtatgctaatgaagatgcttcaaaattggttgaccttgcatcaaagtgtctgcaatttgaatctagggatagaccaaacataaagtatcttttgtcttcagttggtcctcttcaaaatcaaaaggaggttgcatcacatgtgttcatgggtattacaaaagccacatcagtactgccagccatttattctccacttgggaaggcctgcgctggtatggatctttcagcggtgcatgatattttactcaaaacaggttataaagatgacgagggtgcagaaaacgagttatcctttcaagaatggacccagcaagtgcaagagatgctgaacacaaagaagtttggtgacattgcatttagagacaaggattttaagactgcaattgactactattccaagctagtcgcaatgatgtcgacgccttcggctaccgtttttgctaggcgcagtttttcctacttgatgaatgagcaagcagagcttgctctacgggacgcaatgcaggcccaggtctgcatgcccgagtggcctacagccttctacctccaagcccttgctctttcaaagctcggcatggaaaccgacgcgcaggacatgctcaacgacggagcaacatttgaggccaagaagcaaaacggctggcgcagttaggaaataaaagtctcctaactactccgtgtcgttgcccttcgaggaaaaaaaaggcgcaatcgctagtgtcctccaaatcagttcattgggacgtctgttgcacgaccaaggagtgggattgaaatgcactgttttatcgtgcaatctctgccctaatgccggcaacgagcggtggtgttatgatcaggagtggaagaacaggtcagggggctttgagtgcacaggcatagcttgctctcccgtgagttgcgctttgttttgcgagtggtggtggcaggatctgctgattgttgcaactgcagttgtaattaaagggatgctttctaacaatttctccttttggttcacgtcgaatctttgggctgcagaggacaagagtggtgtgcaaaaagccgggttcattgtgattagctacggagaataaactagaggcatcggaattccattcgattctaccatgtttgtatggagtttgtatgcggtcttattttttccccctttctatgaacaattctgtcttttttgatcgatcgaatcgtttcaga

SEQ ID NO: 1183 - DNA, 1905 bp, Echinochloa colona
acacgacgactcccgcagatcccgaggcggcgaacggcggcgcggatggcagcgacgccgccgacgacaaggaggcggcgaagcgcgcggtgccggtgttcagggagttcgcgctggccgagctgcgcgccgccaccaagggcttcagcgccgacctcatcgtctccgagagcggcgagaaggcgcccaacgtcgtctaccgcggccgcctcgacggcggccgcctcatcgccgtcaagcgcttctcgcgcctctcctggcccgacccgcagcagttcctcgcggaggcggggggcgtggggaaggtgcggcacaagcgcctcgtcaacctcattggatgctgcgccgagggtgacgagaggctgctcgtcgccgagtacatgccaaacgacaccctctccaagcatctcttccactgggataagcagccgttgccatgggaaatgcggttgagggtagcatatttcatcgcgcaagcactcgaccattgcaatgctgagaacaggaaaatctatcatgacttgaatgcttatagagtactttttgatgaggaaggtgatcctcgcttgtcaagttttggactaatgaagaacagccgtgatgggaaaagttatagtaccaacctggcttacactccaccagagtttctacgaaccggcagagtaattcccgagagtgtgatatatagttatggaactgtcctgttggatcttttgagcgggaaacacattcctcctagtcatgcgctagatttgataaggggaaagaatatactgttgctgatggattcctctttagaagggcagtatgccaatgaagatgcttcaaaattggttgatcttgcatcaaagtgtctgcaatttgaagctagggatagaccaaacataaagtatctcttgtcttctgttgggccactacagaagcaaaaggaggtagcatcgcatgtgttaatgggtattacaaaagccacatcagtattgccaactattctttctccgcttgggaaggcctgttctgttatggatcttacggcggtgcatgatatattgctcaaaacagggtataaagatgatgaaggtgcagaaaacgagttatcctttcaagaatggacccagcaagttcaagagatgctgaacacaaagaagttcggtgacattgcatttagagataaggattttaagactgcaattgactactactccaagctagtagcaatgatgtcggcaccttcagctacagtttttgctaggcgcagtttttcctacttgatgaatgagcaagcagaacttgctctccgggacgctatgcaggcccaggtttgcatgcccgagtggcctacagccttctacctccaagcccttgctctgtcaaagctcggaatggaaactgatgcacaggacatgctcaacgatggagccacatttgaggccaagaagcaaaacagctggcgcacttaggaatcaaagtcatggcatctccataccaatgcctttcgaaacaaaaaggtacaatggtggctgtcctgaattgttcactggacgtctggtgcactactaggaatgggattgaaatgcactgttttatcgtgcaatctccgcccgaatgttgatagtgagtggcgttgtgacgcggagtggaagataaaggcaggggcatggaatgtatactcttctgtgagttgcactttgttttgtgagtgatggcagcaggatctgctgatcattgcaattgcagtgctcctctcgagagaagattgttgtaattaaggggatgctttctaacaatttcttctccttttcgtttccattggaatctttggggcccagaggacatgagtggtgtgaaaaaaggcgggtaccttgtgattagctaaggagaataaactagagccatctgaattccatt

SEQ ID NO: 1184 - DNA, 2715 bp, Setaria italica
atgatctggaagcttgcagagactggaatgaatgttgcgcgccttaatatgtcccatggtgaccatcagtcacaccagaaggttattgatttggtcaaggagtacaatgcacagaacactgatggcaatattatcgccatcatgctggacaccaagggtcctgaagttagaagtggggatgttccagaaccaatcatgctcaaggaaggtggtatgatggcacttgctgtgaagtctaaatcagctgatactgtcaagtgtgaagtagttgatggtggagaattgaaatcaaggcgccacctaaatgtccgtggaaagagtgccactttgccatctatcactgaaaaggattgggaagacataaaatttggcgtcgaaaatggtgttgatttctatgcagtttcctttgtgaaagacgccagagttattcatgaattaaaggactatcttaaaggtgcgaatgcggatatacatgtcattccaaaaattgaaagtgcagattcaataccaaatctgcagtccattattgctgcttcagatggggcaatggtggctcgtggagaccttggtgctgaacttccgattgaggatgttcctttgctacaggcagagattgtccaaacatgtcgaagcatggagaaaccagtcattgtcgctacaaatatgttggaaagcatgattaaccatcctactccaactagggcagaagtttctgacatagctattgcagtccgggaaggtgctgatgccatcatgttatctggcgaaactgcacatggaaagtacccactaaaggcagtcaaggtgatgcacactgtggcacttagaacagaatccagcctttataacccaactacctcccctggtcttgttgcacctgcacaggctctacacaatgagtgttccccaagtcagctaagtaaaatgtttggatctcattcaaccatgatggcaaacacccttcgtacacccatcattgtatttacacagacaggctccatggctgtcctcctgagccactatcgtcccgcatctacaatatttgcatttacgaacgaggaacgagtgaagcaacggctggcactctatcagggggtcatccctatccacatgcagttctctgacgacgcagaagaaactttctccagagcaattagcagcttgctgaaagcacaacatgtgaagaagggggactacgtgaccctcgtccagagtggagtggcttcaatctggagagacgaatccactcaccacatccaagtgaggaaagcggcgaacggcggggcggatggcggcgacgccggcgacgacaaggaggcggcgaagcgcgcggtgccggtattcagggagttcgcgctggccgagctgcgcgccgccaccaaggggttcagcgccgacctcatcgtctccgagagcggggagaaggcgcccaacgtcgtctaccggggccgcctcgacggtggccgtctcatcgccgtcaagcgattctctcgcgtctcgtggcccgacccgcagcagttcgtcgcggaggcggcgggcgtgggcaaggtgcggcacaagcgcctcgtcaacctcattggctgctgcgccgagggtgacgagaggctgctcgtcgccgagtacatgccaaacgacaccctctccaagcacctcttccactgggataagcagccattgccatgggaaatgcggttgagggtagcatatttcatcgcacaagcactcgaccattgcaatgcagagaaccggaaaatctatcatgacttgaatgcttacagagtactttttgatgaggaaggtgatcctcgcttgtctagttttggactgatgaagaatagccgtgatggaaaaagttatagtaccaacctggcttacactccaccagagtttctacgaactggcagagtaattgctgagagtgtgatatatagctatggaactgtcctgttggatcttttgagcgggaagcacattcctccgagtcatgcactggatttgataagggggaagaatatactgttgctgatggattcctccttagaagggcagtatgctaatgaggatgcttcgaaattggttgatcttgcatcaaagtgtttgcaatttgaagctagggatagaccaaacataaagtatctcttgtcttctgttggtcctcttcagaagcaaaaggaggtagcatcccatgtcttaatgggtattacaaaagccacatcagtattgccagctattctttctccacttgggaaggcctgctctgttttggatcttacagcggtgcatgatatattgcttaaaacaggttataaagatgatgagggtgcagaaaacgagttatcctttcaagaatggacccagcaagttcaagagatgctgaacacaaagaaggttggtgacatcgcatttagagacaaggattttaagactgcaattgactactactctaagctagttgcaatgatgtcaacaccttcagccacagtttttgctaggcgcagtttttcctacttgatgaatgagcaagcagaacttgccctccgggacgccatgcaggcccaggtctgcatgcaggaatggcctacagctttctaccttcaagctcttgctctatcaaagcttggcatggaaactgatgcacaagacatgctcaacgatggagccacatttgaggccaagaagcaaaacagctggcgcagttaggggtcaaatttgcgg

SEQ ID NO: 1185 - DNA, 1908 bp, Panicum virgatum
agttcgcgctggccgagctgcgcgccgccaccaaggggttcagcgcagacctcatcgtctctgagagcggcgagaaggcgcccaacgtcgtctaccgcgggcgattcgacggcggccgcctcatcgccgtcaagcgcttctcgcgcctctcctggcccgacccgcagcagttcctcgcggaggcggcgggcgtggggaaggtgcgccacaagcgcctcgtcaaccttattggctgctgcgccgagggtgacgagaggctgctcgtcgccgagtacatgccaaacgacaccctctccaagcatctcttccactgggataagcagccattgccatgggaaatgcggttgagggtagcatatttcattgcgcaagcactcgaccattgcaatgcagagaaccggaagatctatcatgacttgaatgcatatagagtactttttgacgaggaaggtgatcctcgcttgtcaagttttggcctgatgaagaacagccgtgatggaaaaagttatagtaccaacttggcttacactccaccagagtttctacgaacaggcagagtaattcccgagagtgtgatatatagctatggaactgtcctgttggatcttttgagcgggaagcacatccctcctagtcatgcactagatttgataaggggaaagaatatactgttgctgatggattcctccttagaagggcagtatgctaatgaagatgcttcgaaattggtcgatcttgcatcaaagtgtctgcaatttgaagctagggatagaccaaacataaagtatctattgtcttctgttggtcctcttcagaagcaaaaggaggtagcatcacatgtcttgatgggtattacaaaagccgcatcagtattgccagctattctctctccacttgggaaggcctgctctgttatggatcttacagcagtgcatgatatattgcttaaaacaggttataaagatgatgagggtgcagaaaacgagttatcctttcaagaatggacccagcaagttcaagagatgctaaacacaaaaaagttcggtgacatagcatttagagacaaggattttaagactgcaattgattactactccaagctagttgcaatgatgtcagcaccttcagccacagtttttgctaggcgcagtttttcctacttgatgaatgagcaggcagaacttgccctccgggacgctatgcaggcccaggtctgcatgcctgagtggcctacagccttctatcttcaatcccttgctctgtcaaagcttggcatggaaactgatgcccaagacatgctcaatgatggagccacatttgaggctaagaagcaaaacagctggcgcagttagggatcaaagtcgctgcttccccataccattgccttccgtaacaaaaaggtacaatgggtgtcctccaaattgttcactgggacatctgttgaactgctaggagtgggattgaaatgcactgttttatcgtgcctcgtgcaatctcccccggagtggcgatgttgtggcctgtaagggaagataaaaggcagaagcatgcaatgcatattctctccctgatgagttagcgctttgtgttactgagtgatggcatgaggatctgctgatcgttgcaattgcagtgctctagagggaagattgctgtaattaaggtggggtgcttgctaacaatttcttcttctcctcgtttccattgaaatctttgggccccaggcgacatgagtggtgtgaaaaaaggcgggtacattgtgattagctaaggagaataaactagagccatctgaattacattcatttcgaccatattttcatgtgctgctttctcttctcgaactgttgtgacgtgctgccattttgcgcaaaaaaaaatgtgctgcttatttgatcaatcgtgtta

SEQ ID NO: 1186 - DNA, 2067 bp, Elaeis guineensis
ctcgctcgctcgctctctctctctctctctctctcttattggacacactcactctttcttattcttctccactgctctttctctctcgtctcctccggcctccttcgccgccgctgccgccgccgggaagcggatgggattctagggttcgggccgcgatgggctgcctccactccaagacctccaacgtccactcccccgacgacgactccgtccctggcgacaagccagatctaccgaatggagacgggggcttgcaggatgaggtgccggcattcaaggagtacgggcttgcggacctccgggcggcgaccaagggcttcagccccgagatgatcgtctcggagagcggtgagaaggcccccaacgtcgtttaccgtggaaagctcgatggcggccgccccgtcgcagtcaagcgcttctccaagcagtcctggcccgatgcccagcagttcgtggcggaggcggccggggttgggaaggtgaggcacaagaggctggtgaacctgattggatgctgtgccgagggagatgagcggcttctcgtggcggagttcatgccaaatgatacactctccaagcatcttttccactgggataagcagccactaccatgggaaatgcgagttagagttgcatactacattgcacaagcacttgatcattgtaatactgaaaatcggaaaatctatcacgatttaaatgcatatagagttctttttgatgaggatggtgaccctcgcttatctagctttggtctcatgaagaatagccgggatgggaaaagttacagcactaacctagcatacactccgccggagttcttgcgaactggcagggtcattccagagagtgtaatatacagttatggaacagttttgctggatctgttgagtgggaaacatatccctccaagtcatgcattagatctaataagagggaagaacatgttattgataatggattcatcgctggaggggcagtatgctaatgaagacgcaacccagcttgttgaactagcttcaaaatgtctacagtttgaggctagggatcgacctaattccaaatttcttctttctgctgcagcaccccttcaaacacagaaagaggtggcatcacatgttctaatgggcctgactaaaacaccggcgatactaccaacaatgctctctccacttggaaaggcttgtgcaaggatggaccttactgctgtccatgatatattgcttaaaacaggttataaagatgaagaaggtgcagaaaacgagctttcctttcaagaatggacgcaacaagtgcaagagatgttgaatacaaagaaatttggtgatattgcattcagagacaaggattttaaaagtgcaatcgagtattattcgaagttggtggtgatgatgtcggttccttcagctactgtttttgctagacgggctctgtcatacctgatgaatggccagccagagcttgcccttcgggatgccatgcaagcacaggtgtgcatgcctgagtggcccacagctttctatttgcaagctcttgcactctccaagctcggaatggaaaccgatgctcaggatatgctgaatgatggagccacatttgaagtgaagaggcaaaacagctggcgcggctagattttctctgcagctgttctggttttccttcatacatgcctgtcttgtgctgctttcagtggtgcctgtttgcgtcgtgggtgatttattgcagcaggagagaaactggatgcttggtttgctgggtattcagtgctgtggcttccaataatggatgttcgaacagccatttgtagaatattcaggagagttaaattgatactgaactttcctgagcaagtgtgcattatggccttccatccatgttggcgtgtaactattggcccttattatattaccaaaggaggatatgtgcactgagggatggaaatcacaaaatgtttcactttgttttgtgcaagattggagactgtaagcatgtctgtcatgaccatcttgatgccaaagggaagtatctacccgagcttttaatcttaaggatacaactttttat

SEQ ID NO: 1187 - DNA, 1891 bp, Vitis vinifera
cagatttactacttctaaccttttgagcctttagcatcctctctctctctctctaaaggctttttccactcactctttctctgctgcagccactcccccgatattccgccccaaacacccgaaactcgtctccccatttcgctgcttctttccctcaatgctgctctagtctagtccttgtccttgtccttgtccatgtggagccactgctgctgatgggttgcttccaatccaaaaccgcccacctccactcccctgacgatccctcctccacccctgaacccaccgccaagcccgattcagctaatggagatcagagtgatcaggagcatcaagttcccgcatttaaggaatacggcctcagcgagcttcgcaaggctaccaacggcttcagcagcgaccacatagtctccgagagcggcgagaaagctcccaatgttgtttacagagggaaactcgacagtaatcgcttggttgctgtcaagcgcttctccaagctgtcttggcctgatgctcaacagtttgtggcggaggcggctggggttgggaaggttaggcacaagagattggtgaatctgattggttgctgtgctgaaggagatgaacggcttttggtagcagaatacatgcccaatgatactctttccaagcatctattccactgggataagcaaccacttccatgggacatgcgtgtgagagttgcatattatattgctcaggcacttgatcattgtaatacagaaaaccggaagatctatcatgatttgaatgcatatagagttctttttgatgaggatggtgaccctcgtttatcaagttttggccttatgaaaaatagtcgagatggtaaaagctacagtacaaacttggcttatactccaccagagtttttgcgaacagggagggtcattccagagagtgtgatatacagttatggaacagttctattggacctgttgagtgggaagcatatccctccaagtcatgcactggacttaataagggggaaaaatgtattgttgttgatggattcatcattggaaggacagtatgccaatgatgatgctactaagttggttgaacttgcttcaaaatgtcttcagtctgaggccagggatcgacctgatactaattttcttcttacagcagtagcaccccttcaaaagcagaaagaggtggcatctcatgttctaatgggcctgactaagactacagttgtgctgccaaccatgctgtctcctcttggaaaggcttgtgcaaggatggatcttactgctgtacatgatatattgcttaaaacaggttataaagatgaagagggtgcggagaatgagctttcatttcaagaatggacacaacaagtgcaagagatgttgaacacaaagaaattcggggatattgcatttagggacaaggatttcaagagtgcaattgattattattcaaagctagtagttatgatgcctgtaccttcggctactgtctttgcaaggagagccctctcatacttgatgattggacaagcagaacttgccttgagggatgccatgcaggctcaggtatgcataccagagtggcccactgcattctatctgcaggctcttgcactctccaagcttggaatggaaacagatgctcaggacatgctcaacgatggggcagcattcgaggccaagaggcacaacagctggcgcaactgaagtataaaccccataactggtagtgtctcttgggtccttcacttgtagaatgaattgctggattaggaaactgaagtgctaggagaaaatgatttgtggtgatagattttttccaggaaatactatcaaatccccttgtagactacacagttacaggcctgatcaatatatgatgtattcataaaaag

SEQ ID NO: 1188 - DNA, 2153 bp, Phalaenopsis aphrodite
caccaagctgctttccagctgccccctgggttctctgtgctctgtcttccgccgtcacagccgacttcgccgtcgccgacgaagacggaattggatggaaatcttgagttaggggggaatgggctgcctgcagtcaaagactagcaacgtacagtcgccggaagaagagtctcccccggcggagaaggaagattcacgtgagaagggagagcaggatcgggttccggtgttccgggagtttaacttagcggagctgcgggcagcgacgaaggggtttagctctgagctcatcgtgtcggagagtggcgagaaagcgccgaacgttgtataccgggggaaacttgaaggcgggaggctggtcgctgtcaaacggttctcacgccaatcgtggccagatgctcaacagtttgtggtggaggctgctggggtgggtaagttgaggcacaagaggctggttaacctgatcggttgctgcgcagaaggggatgagaggctacttatcgccgagttcatgccaaatgacactctttcgaagcatctttttcactgggacaaacagcctttaccatgggaaatgcgagtgagagttgcatactacatcgctcaagcacttgaccattgcaacattgaaaaccggaaaatatatcacgacctgaatgcttatagggttctgtttgacgaggatggtgatccttgtttgtcgagctttggccttatgaaaaatagtagagatggaaaaagctatagcacaaacttggcttataccccgccagagttcttacgaacaggcagggtaattccagagagtgtaatctacagttatggaactgttttattggatcttttgagcgggaagcatatccctccaagtcatgcattagatataataagagggaagaacattttaatgttaatggactcatccttggagggacaatatgcaaatgaggatgctacaaaactagtagaacttgcttcagagtgcctccagtttgaagctaaggatcgaccaaattccaagtttcttctttctgcagttgagccacttctgaaacagaaagaggttgcttcacttgttttgatgggcatatcgaaggccactgtggtattaccaacattgctttctccactaggaaaggcttgtgcaaggatggaccttgttgctgtgcatgatattttacttaaagcaggatacaaagatgatgaaggtgcagaaaatgagctatcatttcaagaatggacccaacaagtacaggagatgttgaacacaaagaaatttggtgatattgctttcagagacaaggatttcaaaagtgcgatcgagtactattcaaagctggtagtgatgatgtcagtgccttctgcaactgtttttgcaaggcgagctctttcgtatctgatgaatgggcaaccagagcttgcacttcgagatgccatgcaagcacaagtttgcttacctgaatggccaactgccttttaccttcaagcactggccctctcaaagttaggcatggaaactgatgcccaggatatgctcaatgatggtgctgccttcgaagctaagaagcaaaataactggcgaggttaagtgtatctctgaaaaaaaaagtctcccatcactcaacatttctccttgttcctgttaatgcttccaaatggatgttgcccaggcagaattacttttcagttggatgagcgaatttaatcccactgtggaagatggagatggatgatgtgagtgatgatgaccaaataaatgtatagtatcttcgggagaaataattttgtatgttattgtgttgctcaggaattcatctacttacatgctaacccatttctttcttagatgtgagaaagctggagatttgagatggaggaatggggattggcgtgaatcctcaacttattttgtatcagttgtcaccatatctatgaacagatgattagcattcaaattgctgaagttatgtgctctgctgtgtgctaacgtgctcatgcattgttttattttttctttttgtgtagattaaaattgataattggttattgttacgttaggaaaacctgaaatttgggtctcgagttgatgatggatggtaaaactgtattcgatttgtaaggagtggaggaaccagtcaatgaatgttggaaac

SEQ ID NO: 1189 - DNA, 1941 bp, Amsonia hubrichtii
atacatacacacacaacacacattaaaagtcacaaagagtcaacaagctcttccactgacctgcaagaacaatttttttcccttcaattcggagaacccatttcagttttctatcccagaaagggagtgagtaagcaagcaagaaggggtaccaacgcacagaaagtgattaactgtgtgtgcagtctatgtgagcataggaaaaaatgggctgttttcagtccaaaactgccaatgttcagtctcctgaccaagaaccttctcagcctgactctaaaccagatcttgctaatggggaccagatagaccaagatcaagcgcctgcatttaaggaatttggcctcgtagaactgcgagctgccacaaatggcttcagcagtgaactgatagtttctgagagtggagagaaagctccaaatgttgtttacagaggaaagcttcgaagcaaccggcttgttgccattaagcggttctcaaagcagtcctggcctgatccccaacaatttgtggcagaagctgctggagttggcaaagttcggcacagaagattggtgaaccttataggatgttgtgctgagggagatgagcgtttgttggtcgcagagtatatgcccaacgatacactgtcaaagcatctttttcactgggataaacagccattgccatgggaaatgcgtgttagagtggcttaccatattgcacaggctcttgaccattgcaattctgagaaccggaaaatttatcatgatttgaatgcttacagggttctttttgacgaggaaggtgacccacggttatctagttttggtcttatgaagaacagcagagacgggaagagttatagcactaatctggcttatactccacctgagtttttacgcacaggcagggttattccagagagcgtgatatacagttatgggactgttctactggaccttttaagtggaaaacatattccaccaagccatgcattggatttgattagaggaaagaatgtactattgcttatggattcgtccttggagggacaatatgccaatgaagatgctactgcattggtggaacttgcttctaagtgtctccagtatgaggctagagaccgccctgatatcaagtttcttctttcagcggtgactcccctgcaaaaacagaaagaagttgcgtcacatgtgttaatggctttgacaaaaagtccagttgtactccccactatgctttctcctcttggaaaggcttgtactaggatggacctcactgcagtgcatgatatcttgcttaaaacaggatacaaagatgaagagggtgcagaaaatgagctctcattccaagaatggacacaacaagtacaagacatgttgaacacaaagaagtttggcgacattgcattcagagacaaggacttcaagagtgcaattgattattactcaaagttggtttccatgatgtcggttccttccggtactgtatttgtgaggcgagctctatcctacttgatgataggccaaccggagcttgctctaagggatgctatgcaggctcaggtttgcttgcctgagtggccaactgcattctacatgcaggccctagcgctatctaagcttggaatggaaactgatgcccaggacatgctcaatgatggtgcttcttttgaagctaagaagcaaaacagttggcgcaactagatgacagccctcacgaggggatcacaaattcgcaagcactttaatctgatttcaagctaaaatttttagagactggatcaggaatcctccggttgattatccaattcagtgaggataactaacagcttaaactacttctctgttgtagcagaaatagttccatgtgaaaaatgtataaaacaattgtgatggcaaaaagctgagtaagctagttactgatcaatgccatttgcattaagctctcttccctgtcctt

SEQ ID NO: 1190 - DNA, 1849 bp, Vinca minor
ctaatcttttttgcttaaattcacagaacccatttcatttttccatcttaggaagagattgagttagagaacaagttgggatttttacacaatgtaaagtgtgttactgtgtgtgtttttgttgtctatgtgagcatagaaaaaaaatgggctgttttcagtccaaaactgccaatgttcagtcccctgaccaagaaccctctcagcctgactctaaaccagatcttgcgaatggggaccaggcggaccaagatcaagcacctgcatttaaggaatttaaacttgtagaactgagagctgccacaaatgggttcagcagtgatctcatagtttctgaaagtggagagaaagctcccaatgttgtttacagaggaaagcttaaaagcaaccggcttgttgccattaagcgtttctcaaggcagtcctggcctgactcccagcagtttgtggcagaagctgctggagttggcaaggttcgtcacaaaagattggttaatcttataggatgctgtgccgagggagacgagcgtttgttagttgcggagtacatgcccaatgatacactgtcaaagcatctttttcactgggataaacaaccgttgccatgggaaatgcgtgttagagtagctaaccatattgcacaggctcttgatcattgcaatactgagaaccggaagatttatcatgatttgaatgcgtatagggttctatttgatgaggaaggtgatccacggttatccagttttggtcttatgaaaaacagcagagatgggaagagttacagcactaatctggcttatactccacccgaatttttaaggacaggaagggttattcccgagagtgtgatatacagttatggaactgttctactggaccttttaagtggaaaacatattccgccaagccatgcgttagatttgattaggggaaagaatgtactattgcttatggattcgtccttagagggtcaatatgccaatgaagacgctactgcactggtggaacttgcttctaagtgtctccaatacgaggctagagaccgtcctgatatcaagtttcttctttcagccgtgactcctcttcaaaaacagaaagatgctgcatcacttgttttaatgggtttgacaaaaactccagtagtgctccctaccatgctttctccgcttggaaaggcttgtactaggatggacctcactgctgtgcacgatatcttgcttaaaacaggttacaaagacgaagagggtgcagaaaatgagctctcgttccaagaatggacacaacaagtgcaagatatgttgaacacaaagaagtttggagacattgcattcagggacaaagacttcaagaacgcaattgattattactcaaagctggtttcgatgatgcctgttccttctggtactgtatttgtgaggcgagctctatcctacttgatgataggccagccggagcttgccctgagggatgctatgcaagctcaggtttgcttgcccgagtggccaattgcattctacatgcaggcgcttgccctatccaagctcggaatggaaaccgatgcccaagacatgctcaacgatggtgcttctttcgaagccaagaagcaaaacagttggcgcaattagattacatccctctccacgggaagccatgaccttgtttgtatgaatcagagaggaaaaaagcattatgatagttgtccgattatcgttaaaacctttttatgtcattgtgcttgagacctgtctatgtcaggattagggcgcaacggacgaattttcagctgccgaatagtgcatggtgttactggtagtataaaagtaagtcgaatagtgcacttaatagtata

SEQ ID NO: 1191 - DNA, 1871 bp, Vinca minor
tttctggtctatgtgagtacagaaaaaaaatgggctgttttcagtccaaaactgctaatgttcaatctcctgaccaagaaccctctcagcccgactctaaaccagatcttgagaatggggaccagacggaccaagatcaagcacctgcatttaaggaatttggacttgtagaactacgagccgccacaaatgggttcagcagtgatctcatagtttctgaaagtggagagaaagctcccaatgttgtttacagaggaaagcttaaaagaaaccggcttgttgccattaagcgcttctcaaggcagtcctggcctgacccccaacagtttgtggcagaagctgctggagttggcaaggttcgtcacaaaagattggtcaatcttataggatgttgtgccgagggagacgagcgcttgttagttgcggagtatatgcccaatgatacattgtcaaagcatctttttcactgggataaacagccattgccatgggaaatgcgtgttagagtggcttaccacattgcacaagctcttgaccattgcaatactgagaaccggaagatttatcatgatttgaatgcttacagggttctatttgatgaggaaggtgatccgcggttgtctagttttggtcttatgaaaaacagcagagatgggaagagttatagcactaatctggcttatactccacccgaatttttacgcacaggcagggtcatccccgagagtgtgatatatagttatggaactgttctattggaccttttaagtggaaaacatattccaccaagtcatgcattggatttgattagggggaagaatgtactattgcttatggattcgtcgttggagggtcaatatgccaatgaagacgctactgcactagtagaacttgcttccaagtgtctccaatacgaggctagagaccgtcctgatatcaagtttcttctttcagctgtgactccccttcaaaagcagaaagatgctgcatcacttgttttaatgggtttgacgaaaactcccgtagttctccctactatgctttctccacttggaaaggcttgtactaggatggacctgactgctgtgcaagatatcttgcttaaaactggttacaaggacgaagagggtgcagaaaatgagctttcattccaagaatggacacaacaagtgcaagacatgttgaacacaaagaaatttgcagacattgctttcagggacaaagacttcaagagtgcaattgattattactcaaagctcgtttctatgatgtctgttccttctggtaccgtatttgtgaggcgagctctatcctacttgatgatagaccaaccggagcttgctctgcgagacgctatgcaggctcaggtttgcttgcctgagtggccaactgcgttctacatgcaggcgcttgccctatccaagctcggaatggaaactgatgcccaagacatgctgaatgatggtgcttctttcgaagctaagaagcaaaacagttggcgcaactagattacaacaccccttttgagggtaatcacaaattcgcgagtatctttaatcttattcggagttaaattcttttcatagtctggatatgggaattcctccggttggttttccaattcagcgaggataactaaatggttaaactacttcctatgttgtagtaaaatagtttcatgtgaaaatgtataaacatttgtgatggcaacaagctgagtagaccagtccttgaatcaaagaggaaaaatgcattatgatagttgtccgattctcggtttgaaacctttttatgtcattgtgatcaagacctgtatatttcaggatttaggccccaacaattgagttttcaaatgttgcggcggattaata

SEQ ID NO: 1192 - DNA, 2563 bp, Eucalyptus grandis
gtcttcccccgcccaagtaatttttctcttcctccttttcccctcaccatcaggtcagatcagatatcccccagaaaaagtccttgaatctcagacttttcgggcagcattttccggggaaagtagatttcgcactcctgcaaggaagacttttttggagtcctatctctctctctcctcggttttctttatagcttttttctgcctttttcttctttctgggtgaatcccacttttgttgctcttgcttgcgagttcttgtacagtgcatggggaaggggataggaacgaacaacccaacccccccaccacttccctcttcacgtgcgcagcttcagcatatcatgtgaccatccgtcttccctcttccgtctgactctctttgacctcccttctccccccttctctctgtctctctcttccccctcactgttcacaccttttagacagtacccgtcactccccctctctccctctctctctctctctctctccctctctatctctctcttactgggacaccttactcttcaaaaccaggaaatactctttctctctctgcaaaaaggaagtgggttgaatctccttctatgtgagagcactcaaccatgggctgtattcagtccaagaccgcccatcttccgtcaccggaccaagaaccctctcaagctgaccccaaaccagatccagcaaatggagagcaagtggaccaggaccaagttcctgcattcaaagagtttccgctcgccgacctccgagccgccacaaatgggtttagcagtgaattgattgtctcagaatgtggagagaaggcccccaacgttgtttacagagggaagctccggaacaactgtttggtcgccattaagcgtttctccaaacaatcttggcctgatcctcaacaatttgtgacagaagcatctggggttggcaaagtccggcataagaggttggtgaatttaattgggtgttgtgctgaaggggatgagcgcctattggtggcagagtacatgccaaatgatactctatccaagcatctgtttcactgggagaagcagccattgccttgggagatgcgggttagagttggttactatattgcacaggcacttgaccattgcaatactgaaaaccggaagatctatcatgatttgaatgcatacagagttctctttgatgaggatggtgaccctcggttatcaagttttggccttatgaagaacagccgggatggaaaaagctacagtacaaatttggcttacactccaccagaatttctacggacaggaagggtcatccctgagagtgtgatttatagttatgggactgtattgctggatcttttgagtggcaagcatatccctccaagccatgcgttggatttgataaggggtaaaaattctttattgttaatggattcatccttggaaggacaatatgtcaatgaagatgcatctgaattggttgagctagcctcaaaatgtctgcagtatgaggccagagataggcctgatgtcaagttcctcctatcatcagttgcgcccctccagaagcagaaagaggtggcttcgcatgttcttatgcgaatcactaaaactcctgtagtgcttccaacaatgctatcaccgcttgggaaggcatgtgttaggatggaccttacagctgtacatgacattctgcttaagacgggttataaggatgaagaaggtgcggaaaatgagctttcgttccaagaatggacacagcaagtacaagacatgttgaacacaaagaagtttggggatattgcttttagggacaaagatttcaagaatgcaattgattactactcaaagttggtatcgatgatgtcggtcccttctggtaccgtttttgtgaggcgggcactctcgtatttgatgattggccaagcagagcttgctctgagagacgcgatgcaggctcaggtgtgcttgcccgagtggcccaccgccttctacatgcaggctcttgccctctcgaagctcgggatggaaaccgatgcacaggacatgctcaatgatggcgcttcctttgaggcgaagaagcagaacagctggcgcggttaattaatcctgatgtgcagagtcattcctctgctccaactcatgctatacagcaaggggggtcgggagacagagattcctccggaaagatgctctaggggtttgtttccgctttgtcgactcaattttccttctctcctggatatagtttcactgagaacgaggtgcctgatgatagtagagagtcgagtagccaagtttctagttagggcaacttaatgctgtatcatgctgagaaatcgggtaggaagagattagctttgtcccatcacgttcgatttgctgtgtgttgagctgaatctctgctggctgcatatcatctgttgtggcttctcggccttcatttcatcgatcgtccaattattatgcaggatgatcttcattacaatttaatgaatgtttcagtcctggtaaatgtcgtgaattttcgcgtaaatgagaagtttgtgacagtgatgttgtgtctgttgcagtttgct

SEQ ID NO: 1193 - DNA, 2387 bp, Cicer arietinum
aggacacaaagagccttaaaagatggaacagaaacctgaaatgagaaatgagtccacgtaaaaactgtgctgatgttcgagttttaggtgaggtaatgcctttgaatgtttgatgtctgttacacaaggtgacgctgtaatattaatttcctaattcttgttaaaaataattataataaaataaaatgccattggaaaatggctcacatcacagccccacctgagtcagcacgtgcttcatcatagaccatatcatgtgaccttctctgctccttgcttccctctctctctctctctcctttttccattgtttcattcacttacttctcagcttttgtattttggtccttttcaatttcacctctctctctctctcttccgtgtttccgccgctgcaacaagcaacatattagtagcagtgacccacacacacagtcacaacattttccgcttcatcattcaacacacttctcgtcttcactcttctaccctttttctttttcttttctatgtagatatatgcaccataatcatattctaaaattcatttcacaatcataatattaataaactctttccatgggttgctttcactccaaaaccgctcatcttcactctcctgaagaccctcctactgatttacccgacccaaacaaacccgatccaggtgatgaagggggtgatggtgatcaagaatctcaagttccagcattcaaagagtatggtctgaatgaactcagaagggctacacatgagttcagcactgattacattgtttctgaaagtggcgagaaagctcctaatgtggtctacagagggaagcttgagaacaatcgtttagttgctgtcaaacgcttctccaaacactcttggcctgatgctcaacagtttctggcagaagcagctggagttgggaaagtgaggcacaaaagaatggtgaatctaattggatgttgtgctgaaggggatgaaagactcttggtagcagagtacatgcctaatgatactttgtccaagcatctttttcattgggacaagcaaccattaccgtgggaaatgcgtgttagagttgcatatcacgttgctcaggcactagatcattgtagcatggaaaaccggaaaatatatcatgatctgaatgcttataggattctttttgatgaggatggtgatccccggttatcaagttttggacttatgaaaaatagtcgagatgggaaaagctacagtactaatttggcgtatactccaccggaatttttgcgaacaggcaggataatcgcagagagtgtgatctacagttacggcactgtccttctggatcttttgagcggcaagcatattcccccaagccatgctttggacttaattagagggaaaaatgcattgttgttgatggactcatccttagaggggcaatatgcaaatgatgatgctaccaagttggttgagcttgcatcaaaatgtcttcagtttgaggccagagatcgtcctgatattaagtttcttctgactgcagttacacctcttcaaaagcagaaagaggtagcatctcatgtgttaatgggccttactaaaaccgcggcagtgctaccactaccaaccatgctttctcctcttggaaaggcttgtgcaaggatggatcttactgctattcatgatatattgttaaaaacaggttataaagatgaagaaggtgcagaaaacgagctttcatttcaagagtggacacaacaagtgcaggacatcttaaacacaaaaaagtttggcgatattgcattcagagacaaggatttcaaaaatgcaattgagtattattccaagctggtggttatgatgtctgttccatctgcaaccgtctttgcaaggagagccttctcttacttgatgaacgatcaggccgaacttgcattacgagacgccatgcaggcacaggtatgcatacccgattggccaactgcattctacctgcaagctcttgctctctcaaagctgggaatggaaactgatgcacaggacatgctgaatgatggtgcagcctttgaagcaaagaggactaacagctggcgtggctaaaattgtaatttgtagttctttgctcattaaattagcagattggcataagaaaatatgctattttgctttaatatgtacttttgctagaatagggttatgtggggtgctagtttagggtgcaagctttggtataaaatgttgtcaaggaatactacagtataatttttgcacacaaatgagtcctatcctgtagtatgaattttctccatatgaaaataagttcatttatgctattatgccttttgggtttggtgatcatctatttggtaaataaatagtagtgttacgaagttcaagttacatttatgata

SEQ ID NO: 1194 - DNA, 1795 bp, Musa acuminata
cttcatcccactctccactggtctgttcttccctccctcttcttccacgactctctctctctctctctctctgctcttcgccttccgccggacccaagtcgaatgggattctagggtttcgcccttccgcgagatgggctgcttccactccaagacaactaacctccactcccccgaagacgatcccgaccacgccgacaagccagatcacgaaacgaatggggaggcgggggaccaggatcaggtgccggccttcaaggaatacgggctggcggagctgagggcggcgacgaagggcttcagcccggacctgattgtttccgagagcggcgagaaggcgcccaatgtcgtgtaccggggaaagcttgatggaggacggctggtggctgtcaagaggttctctaagcagtcgtggcccgacgcccagcagtttgtggcggaagctgcgggggtgggaaaggtgcggcataagaggctggtgaacctcatcggatgctgtgcggaggatgacgagagacttctcgtcgcagagttcatgcccaatgacacattgtctaagcatcttttccattgggataagcagcctctaccatgggcaatgcgagttagggtggcatactacattgcacaagcacttgatcattataatactgaaaaccggagaatatatcatgatctgaattcttatagagttctttttgatgaggatggagatcctcgtttgtctagttttggtctcatgaaaaatagccgagatggaaaaagttatagcactaacctagcttacactccaccagaattcttgcgaactggaagggtaattccagagagtgtaatctacagttatggaactgtacttttagatcttttgagtgggaagcatatccccccaagtcatgcactagacctaataagaggaaagaacatgttaatgattatggattcttccctggaggggcaatatgctaatgatgatgctactaatttcgttgaactagcttcaaaatgtctacagtttgaggctagagatcgacccaactctaaatttcttctttctgccctagcaccacttcaaactcagaaagagattccatcacatgctctcatgggtataacaaagacagaacaggtgctgccggtgatgctctcaccacttggaaaggcttgtgcaaggatggatctaacagctgtgcatgatatattgcttaagacaggttataaagatgaagaaggtgcagaaaatgagctttcctttcaagaatggacacaacaagtgcaagagatgttgaatacaaagaaatttggtgacattgcattcagagataaagatttcaagagtgctattgactattattccaagttggtgatgatgatgtcagttccttcagccacggtctttgccaggcggagcctttcctacttgatgaatggacaaccggagctggccctacgcgacgccatgcaagctcaggtgtgcatgccggagtggccgacggccttctacttgcaagcccttgccctctcaaagctcgggatggaaaaagatgcccaggatatgctcaacgatggagctgccttggaggtgaagaagcagagcagctggcgtggctagtgactcgtacgcagtcgctatggatttcacgtctgcaactccgatatctgtcattcctgtacgcaagtttcgtcttgggttctaaatgcagcaggaacgttgtgacagcacacatgctgagaaggtaagcagacacaataatgtatagaaatttcacgagattaattagcatctttacacttg

SEQ ID NO: 1195 - DNA, 1844 bp, Musa acuminata
cttcatcccactctccactgctctgttcttccctccctcttcttccacgactctctctctctctctctctctgctcttcgccttccgccggacccaagtcgaatgggattctagggtttcgccttccgcgagatgggctgcttccactccaagacaactaacctccactcccccgaagacgatcccgaccacgccgacaagccagatcacgaaacgaatggggaggcgggggaccaggatcaggtgccggccttcaaggaatacggtctggcggagctgagggcggcgacgaagggcttcagcccggacctgattgtttccgagagcggcgagaaggcgcccaatgtcgtgtaccggggaaagcttgatggaggacggctggtggctgtcaagaggttctctaagcagtcgtggcccgacgcccagcagtttgtggcggaagctgcgggggtgggaaaggtgcggcataagaggctggtgaacctcatcggatgctgtgcggaggatgacgagagacttctcgtcgcagagttcatgcccaatgacacattgtctaagcatcttttccattgggataagcagcctctaccatgggcaatgcgagttagggtggcatactacattgcacaagcacttgatcattataatactgaaaaccggagaatatatcatgatctgaattcttatagagttctttttgatgaggatggagatcctcgtttgtctagttttggtctcatgaaaaatagccgagatgggaaaagttatagcactaacctagcttacactccaccagaattcttgcgaactggaagggtaattccagagagtgtaatctacagttatggaactgtacttttagatcttttgagtgggaagcatatccccccaagtcatgcactagacctaataagaggaaagaacatgttaatgattatggattcttccctggaggggcaatatgctaatgatgatgctactaatttcgttgaactagcttcaaaatgtctacagtttgaggctagagatcgacccaactctaaatttcttctttctgccctagcaccacttcaaactcagaaagagattccatcacatgctctcatgggtataacaaagacagaacaggtgctgccggtgatgctctcaccacttggaaaggcttgtgcaaggatggatctaacagctgtgcatgatatattgcttaagacaggttataaagatgaagaaggtgcagaaaatgagctttcctttcaagaatggacacaacaagtgcaagagatgttgaatacaaagaaatttggtgacattgcattcagagataaagatttcaagagtgctattgactattattccaagttggtgatgatgatgtcagttccttcagccacggtctttgccaggcggagcctttcctacttgatgaatggacaaccggagctggccctacgcgacgccatgcaagctcaggtgtgcatgccggagtggccgacggccttctacttgcaagcccttgccctctcaaagctcgggatggaaaaagatgcccaggatatgctcaacgatggagctgccttggaggttaagaagcagagcagctggcgtggctagtgactcgtacgcagtcgctatggatttcacgtctgcaactccgatatctgtcattcctgtacgcaagtttcgtcttgggttctaaatgcagcaggaatgttgtgacagcacatgctgagaaggtaaccagacacaataatgtatagaaatttcacgagattaattagcatctttacacttgagggtttcgtaattgcacaatatttcatttatatgagtaagcctaattgcac

SEQ ID NO: 1196 - DNA, 1882 bp, Lippia dulcis
gtactacttttttttttaattcggtggaatattatactgtgttgaacacactgagtgcgtgtgaagtgggtgaatgtgagcacactcaagatgggctgtttgcagtccaaaactgctaatgtccagtctcctgatcaagaaccttcacagcccgactcgaaaccagatctggcaaatggggagcaagtggatcaagatcaagtgcctgcattcaaggaatttggactttctgaacttcgtgctgcaacaaacggttttagcagtgaactaatagtgtcagagagtggagaaaaagctcctaatgttgtctatagaggcaagcttcgaagtaaccggctcgttgcaattaagcgcttttcaaagcagtcatggcctgatcctcaacagtttgtggctgaagctgctggagttggtaaggttagacataagagagtggtgaatttaattggatgttgtgccgaaggagacgaacgcctattagttgctgaatatatgcccaacgatacactctcaaagcacctctttcattgggataaacagcctctgccatgggaaatgcgtgtgagagtggcacacaacatagcacaagctcttgaacactgtaatgctgaaaaccgcaaaatctatcatgatttgaatgcttatagagttctttttgatgaggatggtgacccaaggttatctagttttggcttgatgaagaacagtagggatggaaagagttatagcaccaatttagcatacactcctccagagtttttgcgaaccggcagggtaattccagagagtgtggtgtacagttacggaactgttcttctggaccttctgagtggaaaacatatccctccgagtcatgctttggatttgataagaggaaaaaatgttctcttgctgatggactcgtctttggaaggtcaatatgccaacgaagatgctactgcgttagttgaacttgcttcaaaatgccttcagtacgaggccagggatcgacctgttatcaagtttcttattactgcagtagaaccacttcaaaagcagaaagaggttgcatcacatgtgctgatgggtctgactaaaacccctgtaattctaccaactatgctttctcctctcggaaaggcgtgtgcgaggatggatcttactgctgtacatgacatcatgctcaaaacaggctataaagatgaagagggtgcagaaaacgagctttcattccaagaatggacacagcaagttcaagatatgctaaatactaagaaatttggagatattgcatttagagacaaggatttcaagggtgcaattgactactattcaaagctggtatcgatgatgtctgtgccatctggcacagtatttgtgagacgggctctctcatatttgatgatagggcaaccggagctagcactaagggacgccatgcaggcacaggtttgcttgcccgagtggccattggcattctacatgcaggcacttgcactttccaagcttggaatggagaccgatgctcaagatatgctcaatgatggcgcctcatttgaagcgaagaagcaaaacagttggcgcaactaaaacgttcgtgtttgaaaaatcccggttgtgacaaattagatatattccagagtgatgttggatgatggaaattctgtgaaatttgggggaggtgagagtgaactatgggtttgtatctttgatctatgttgtaggttactatagagcttcatacacaaatgagaaatgtataaagatagccttcttaggccaatttgggagtgggcatgtcatttgtctagtagggatatgtgtgattggtgtccatcccatcccacattggttggtgatcttgttcgaccaacttataagatcggggtatcatcccaaaaag

SEQ ID NO: 1197 - DNA, 2064 bp, Cajanus cajan
atctctctcttctttttcacattcattcatttttttcttccttacttaccttttgggttttggtctttttatctctctctctcctctgtgtttccgccgctgaaacaagcaagagtggcagtgactcagtcgcttgcaacattttcggcgtatcatatcaaaccattgaaccttcactctttttgcttctgctcgggtattcatcatgccccctatgccaacctagtgctgcaatcttcaacctttgtttctatgtagacaccccacttgtattatagccacaatcatattaatcatttcacaatcataaccacaaccatgggttgttttcactccaaaactgctcatattcactctcctgaagaccctcctgctgccttgccagactccaaacatcccgatccagggcatggtggggatgatgctgatcaagagtgtctggttccagcattcaaggagtatggtctgagtgaactacgaagggccacaaatgagttcagcacagattacattgtttctgagagtggtgagaaagctccaaatgtggtctacagagggaagcttgagaacaatcggttggttgctgtgaagcgcttctccaaactgtcttggcctgatgctcaacagttcatggcagaggcagctggagttgggaaagtgaggcacaagaggctggtgaatctaattggctgttgtgctgaaggagatgaaaggctcttggtagctgagtacatgccaaatgatactttgtccaaacatctctttcattgggacaaacaaccattaccatgggaaatgcgtgtcagagttgcataccatgttgcccaggcactagatcattgtagcatggagaaccggaaaatatatcatgatctgaatgcatataggattctttttgatgaggatggtgatccccgcttatctagttttgggcttatgaaaaatagtcgagacgggaaaagctacagtaccaatttagcttatactccacctgaatttttgcgaacaggcaggataatccctgagagtgttatctacagttatggaactgttcttctggatcttttaagtggaaagcatattcctccgagccatgctttggacctaattagagggaaaaatgttctgttgttgatggactcttctctagaagggcaatatgcaaacgatgatgctacaaagttggttgagcttgcttcaaaatgtcttcagtttgaggccagagaacggcctgatattaagtttcttcttactgccgttgcacctcttcaaaagcagaaagaggtagcatctcatgtgttaatgggcctaactaaaaacacaacagtgctacctaccatgctttctcctcttggaaaggcttgtgcaaggatggatcttactgcagtgcatgatatattgttaaaaacaggttataaagatgaagaaggtgcagaaaatgagctttcattccaagaatggacacaacaagtgcaagatatcttgaacacaaagaagtttggtgatatagcattcagagacaaggatttcaaaaatgcaattgagtattattcgaagttggtggttatgatgtctgttccttctgctactgtgtttgcaaggagagccttctcctacttgatgaatgatcaagcagaacttgcattaagggatgccatgcaggcacaggtatgcatacctgaatggccaactgcattctacctgcaggctcttgctctctctaagctgggaatggaaactgatgcgcatgacatgcttaatgatggagctgcttttgaagctaagaggtctaacagctggcgtggctaaaattccaatttgaagttctttgctcactgaactagctgagtggcataaaagaatatgctattttttgccataatttgtactttgctagtgtaggaatatgtagggtgctagtttaaggggcaagaaaaagaactttggtataagatgttctcaatgaatattttacagtatagattttcccatacaaatgaatcttgtagaatgaactttctccatatgaaaataacaatgtatttggatggggaattttgatgg

SEQ ID NO: 1198 - DNA, 2143 bp, Solanum lycopersicum
acgttgttgttggagtgtctctctcttcacgtgctgatcatcaacttatcatgtgactaaacccctctattctcggtgtctccttctttggcggcctctctttcctttttgtgttctcactttcttccattacattcactaataattactatctagctcatatttgttatcccttttacttatctaaaaaaaagatttgattttttcaaacacccattcttgattcttgtgtgtttgagttaaagagtttactgagtgtctatttttgtctatgtgagctgatgaaaaatgggctgtttacagtccaaaactgtaaatgttcagtcccctgataaagaaccttctcaagatgactcaaaaacagatcttgctaatggggatcaagtagaccaagatcaagtgcctgtattcaaggaatttagtcttgcggaactccgggcagcaacaaatggctttagcagtgaattaatagtttctgaaagtggtgagaaagctcccaatgttgtctacagagggaagcttcgtagcaacaggctagctgccatcaagcgcttctccagacaatcgtggcctgacgcccaacagtttgtggcagaggcagctggagttggcaaggttcggcataagagattggtgaatctaattggctgttgtgcagagggagatgagcgcctattggttgctgaatacatgcctaatgatactctctcgaagcatctcttccactgggagaaacaaccgttgccgtgggagatgcgagtaagagttgcatactatattgctcaggctctggatcattgcaatactgaaaacagaaaaatatatcatgatttgaatgcttacagaattctttttgatgaggaaggtgaccctcgattgtctagttttggtctaatgaaaaatagcagagatggaaagagctatagcaccaatcttgcttatacacctcctgagtttttgcgcacaggccgagtaatcgcagaaagtgtgatgtacagctatgggactgttctgctggacctgttgagtggaaaacatatcccaccaagccatgcactagacttaattaggggtaaaaatgtattgttattaatggattcatccttggaaggacaatatgccaatgaagatgcaacagcattggttgaacttgcttcaaagtgtctccaatatgaggcaagggatcgacctgaaattaagttcattctaaatgcagtggagccccttcaaaagcagaaggaggccgcgtcacatgtcctgatgggtctaacaaaaactccagtggtgcttccaaccatgctctcacctctaggaaaggcttgtgcgaggatggacctcactgctgtccatgatatcttgctcaaaacaggttataaagatgaggagggtgctgaaaatgagctctcattccaagaatggacacaacaagttcaagatatgttgaataccaagaaatttggggatattgcttttcgggacaaggattttaagaatgcagttgactattactctaagttagtatcaatgatgtctgttccttctggcactgttttcgtgaggcgagccctttcctacatgatgaatggccaaccagaactcgcactaagggacgctatgcaagcccaggtgtgcttgcccgagtggcctactgcattttatatgcaggctcttgccctatccaagcttggcatggaaactgatgcacaagacatgctcaatgatggtgcctcctttgaagcaaagaagttaaacagttggcgtaactgattctggcacgtttcatgtgtcaagaacctcacagcctataatgcagctagaggtagctatagtaaggatgagataggaggaggaaccaaaggtaatgtggtgtttggggattatatttatctcgtcccttgctcttctgtagccaatacagttccatacagaaaatgtataaatcactctagtgaaaaccctcgtagtttattctgcgatgaatgccaatttttagttttgaaactcatcaagagttctttcattggtcatgtttaagggtaaacattactgccaaggcttgggttgttatttacagttattttaccagttaatcaatcgtattatgcaggcgatggtgatctcagagttgttaatcatttaagat

SEQ ID NO: 1199 - DNA, 1950 bp, Trifolium pratense
gttccgtgtttccgccgctgcaacaaaagcaacaatatcagcagtgactcagtgacttgcaatatggagaaccattcatgaatcaatgattcaaaccattcttcattttactcttcttcaaccctttttctttttctatgtagtagttttagtagtaacacaccaaaccctttaatcatttcacaatcattcataacaacaactctttctatgggttgctttcactccaaaaccgctcatcttcactcccctgaagaccctcctactgctttaccagactcaaagaaacccgatccaggtgatgatgggggtgatggtgatcaagaaattcaggttccagcatttaaagagtatggtttgaatgaacttagaagggctacacatgagttcagcactgattacattgtttctgagagtggtgaaaaagctcctaatgtagtttacaaagggaagcttgaaaataatcgattagttgctgttaaacgcttctccaaacagtcctggcctgatgctcaacagtttctggcagaggcagctggagttgggaaagtgaggcacaaaagaatggttaatctaattggttgttgtgctgaaggagatgaaaggcttttggtagctgaatacatgccaaatgatactttgtccaaacatctctttcattgggacaagcaaccattaccatgggaaatgcgtgttagagttgcatatcatgtcgcccaggcactagatcattgtagcatggaaaatcggaaaatatatcacgatctgaatgcttataggattctttttgacgaggatggtgatccccggttatcaagtttcgggcttatgaaaaatagccgagatgggaaaagctacagtactaatttggcttatactccacccgaattcttgcgaacaggcaggataattgcagagagcgtgatctacagttacggcactgtccttctggatcttttaagcggcaagcatattcccccaagccatgctttggacctaattagagggaaaaatgcattgttgttgatggactcatccctagaagggcaatatgcaaatgatgacgctacaaagttggttgagcttgcatcaaaatgtcttcagtttgaggccagagaacgacctgatattaagtttcttctcactgcagttacacctcttcaaaagcagaaagaggtagcatctcatgtgttaatgggccttactaaaaccgcggcagtgctaccactaccaaccatgctttcccctctaggaaaggcttgtgcaagaatggatcttactgctattcatgatatattgttaaaaactggttataaagatgaagaaggtgcagaaaatgagctttcatttcaagagtggacacaacaagtgcaggacatcttgaacacaaaaaagtttggcgatattgcatttagagacaaggatttcaaaaatgcaattgagtattattcgaagttggtggttatgatgtctgttccatccgcaaccgtctttgcaaggagagccttctcctacttgatgaacgatcaggcagaacttgcattaagagacgcaatgcaggcacaggtatgcatacctgattggccaactgcattctacctacaagctcttgctctctcaaagctaggaatggaaaccgatgcacaggacatgcttaacgatggagcagctttcgaagcaaagaggtctaacagctggcgcggctaaaactataatttgcagttcattgctctccaaactagcacattggcatcagaaaatatatgctatttttgctataagctgtacttgctagaatagggatatctaatggtgtgctagtttagggttgaagaaaaagaattatcatggtataaaatgttctcgaggaatattacagcataaattttgccacacaaattagtcctctctagttgaatgaattttctccctatgaaaataagttcattt

SEQ ID NO: 1200 - DNA, 1892 bp, Catharanthus roseus
atctttttgcttcaactcagaaaacccatttcggtttcccatctcagaaactgaataagcaagaagggccacctcctcacagtaaagtctgtaactttgtgtctggtggtctatgtgagcatagaaaaaatgggctgttttcagtccaaaacggccaatgttcaatcccctgaccaagaaccctctcagcctgactctaaaccagatcttgcaaatggggaccagatggatcaagatcaagtacctgcattcaaggattcggacttgtagaattgcgagctgccacaaatgggttcagcagtgaactgatagtttctgaaagtggagagaaggctcccaatgttgtttacagaggaaagctccgaagcaaccggcttgttgccattaagcgcttctcaaagcagtcctggcctgatccccaccaatttgtggcagaagctgctggagttggcaaggttcggcacaaaagattggttaatcttataggatgttgtgccgagggagacgagcgtttgttagttgcagaatacatgccgaatgatacactgtcaaagcatctattccactgggataagcagccgttgccgtgggaaatgcgtgttagagtggcttaccatattgcacaggctcttgaccattgcaattctgagaaccggaagatttatcatgatttaaatgcttacagggttatatttgatgaggaaggtgatccacggttatctagtttcggtctcatgaaaaacagcagagatgggaagagttatagcactaatctggcttatactcctcctgagtttctacgcacaggcagggtcattcctgagagtgtgatatacagttacggaactgttctattggaccttttaagtggaaaacatatcccaccaagccatgcattggatctaattaggggaaagaatgtactattgcttatggattcgtcgttggagggccaatataccaatgaagacgctactgcattggtggaacttgcttctaagtgtctccaatacgaggccagagaccgtcctgatatcaagtttcttctctcagcagtggctccacttcaaaagcagaaggacgttgcatcacatgtgttaatgggtttgacaaaaactcccgttgtgctccctactatgctttctccactaggaaaggcttgtactagaatggacctcactgctgtacatgacatattgcttaaaacaggttacaaagacgaagagggtgccgaaaatgagctatcattccaagaatggacacaacaagtgcaagacatgttgaacacaaagaagtttggcgacattgcattcagggacaaagacttcaagaatgcaattgattattactcaaagctggtttcgatgatgtctgttccttctggtactgtatttgtaagacgagctctatcctacttgatgataggccaaccggagcttgctctaagggatgcaatgcaggctcaggtttgcttacctgagtggcctactgcattctatatgcaggctctcgctctttctaagctcggaatggaaactgacgcacaagacatgctcaatgatggtgcttctttcgaagctaagaagcagaacagttggcgcaactagattacaggcagccctcacgaggccaatcacaaatcttgagatatccatccaagttgaatatttttatatagtctgaatcaggaattcctccgtttggttttgtcccaattcagtgaggatatctaactctttcttgcttaaaactacttaaaaaaatagttgtagtagtaaaaatagttgtcaatgtgaaaaatgtataaaacaaaatttgttacttattattattatcattgccatttgcattaagtttctacaaaaaaaaaactaaagaggcgtggtcggcgt

SEQ ID NO: 1201 - DNA, 2087 bp, Solanum phureja
ctctctcttcacgtgctcatcatcgagttatcatgtgactaaacccctctattctcggtgtctccttctttggcggcctctctttcctttttgtgttctcactttcttcctatactttcactaatcattactatctagctcatatttgttatcccttttttccctaacaaaagatttgatttttgaaacacccattcttgattcttgtgtgtttgagttaaagagtttagtgagtgtccattattgtctatgtgagctgatgaaaaatgggctgtttacagtccaaaactgtaaatgttcagtcccctgataaagaaccttctcaagatgactcaaaaacagatcttgctaatggggatcaagtagaccaagatcaagtgcctgcattcaaggaatttagtcttgcggaactccgggcagcaacaaatggctttagcagtgaattaatagtttctgaaagtggtgagaaagctcccaatgttgtctacagagggaagcttcgtagcaacaggctggctgccatcaagcgcttctccagacagtcgtggcctgacgctcaacagtttgtggcagaggcagctggagttggcaaggttcggcataagagattggtgaatctaattggctgttgtgcagagggagatgagcgcctattggttgcagaatacatgcctaatgatactctctcgaagcatctcttccactgggagaaacaaccgttgccctgggagatgcgagtaagagttgcatactatattgcacaggctctggatcattgcaatgcggaaaacagaaagatatatcatgatttgaatgcttacagaattctttttgatgaggagggcgaccctcgattatctagtttcggtctgatgaaaaatagcagagatggaaagagctatagcaccaatcttgcttatactcctcctgagtttttgcgcacaggccgagtaatcgcagaaagtgtggtgtacagctatgggactgttctgctggacctgttgagtggaaaacatatcccaccaagccatgcactagacttaattaggggtaaaaatgtgttgttattaatggattcatccttggaaggacaatatgccaatgaagatgcaacagcattggttgagcttgcttcaaagtgtctccaatatgaggcaagggatcgacctgaaatcaagttcattcttaatgcagtggagccccttcagaagcagaaggaggccgtgtcacatgttctgatgggtctaacaaaaactccagtggtgcttccaaccatgctctctcctctcggaaaggcttgtgcgaggatggacctcactgctgtccatgatatcttgcttaaaacaggttataaagatgaggagggtgctgaaaatgagctctcattccaagaatggacgcaacaagttcaagatatgttaaataccaagaaatttggggatattgcttttcgggacaaggatttcaagaatgcagttgactattactctaagttagtatcaatgatgtctgttccttctggcactgttttcgtgaggcgagccctttcctacatgatgaatggccaaccagaactcgcactaagggacgctatgcaagcccaggtgtgcttgcccgagtggccaactgcattctatatgcaggctcttgccctatccaagcttggtatggaaactgatgcacaagacatgctcaatgatggtgcctcctttgaagcaaagaagttaaacagttggcgtaactgattctggcacgtttgatgtatcaagaaacctcacatcctttaatgcaactagaggtagctatagtaaggatgagacaggagaggaaccaaaggtaatgtggtgtttggggattatattaatcttgtccctcgctcttttgtagccaatacagttccatacagaaaatgtataaatcactctagtgaaaatcctcgtagttattctgcgatgaatgccaatttttagttttgaaactcatcaagagttctttcattggtcatgtttgggtaaaacattactgccaaggcttgggttgatatttacagttattttaccagttgatcgatcgtattacgcaggcga

SEQ ID NO: 1202 - DNA, 1849 bp, Vinca minor
cccatttcatttttccatctcaggaagtgtttgagttagtaaacaagttgggtttttttacacacagtaaagtgtgtaactctgtgtgttttgtgttggtctatgtgagcatagaaaaaaaatgggctgttttcagtccaaaactgctaatgttcagtctcctgatcaagaaccctctcagcctgactctaaaccagatcttgcggatggggaacagacggaccaagatcaagcacctgcatttatggaatttggacttgtagaattaagagctgccacacatggtttcagtagtgatctcatagtttctgaaagtggagagaaagctcccaatgttgtttacagaggaaagcttaaaagcaaccggcttgttgccattaagcgcttctctaggcagtcctggcctgacccccaacagtttgtggcagaagctgctggagttggcaaggttcgtcacaaaagattggttaatcttataggatgttgtgccgagggagatgagcgtttgttagttgcggagtatatgcccaacgatacactgtcaaagcatctttttcactgggataaacagccgttgccatgggaaatgcgtcttagagtgacttaccatattgcacaggctcttgaccattgcaatactgagaaccggaagatttatcatgatttgaatgcttacagggttctatttgacgaggaaggtgatccacgattgtctagttttggccttataaaaaacagcagagatgggaagagttatagcaccaatctggcttatactccacccgagtttttacgtacaggaagggtcattcccgagagtgtgatatacagttatggaactgttctgttggaccttttaagtggaaaacatattccaccaagccatgcattggatttgattaggggaaagaatgtactattgcttatggattcatccttggaggggcaatatgccaatgaagacgctactgcactggtggaacttgcttctaagtgtctccagtacgaggctagagaccgtcctgatatcaagtttctcctttcagcggtgactccacttcaaaaacagaaagacgctgcatcacttgttttaatgggtttgacaaaaactccagtagtgctccctactatgctttctccacttggaaaggcttgtactaggatggacctcactgctgtgcacgatatcttgcttaaaacaggttacaaagacgaagagggtgcagaaaatgagctctcattccaagaatggacacaacaagtgcaagacatgttgaacacaaagaagttcggagacattgcattcagggacaaagacttcaatagtgcaattgattattactcaaagctggtttcaatgatgcctgttccttctggtactgtatttgtgaggcgagctctagcctacttgatgatagaccaaccggagcttgctctaagggatgctatgcaagctcaagtttgcttgcccgagtggccaacagcattctacatgcaggcgcttgccctatctaagctcggaatggaaactgatgctcaagacatgctcaatgatggcgcttctttcgaagacaagaagcaaaacagttggcgcaactaagattacaacacccctctccacgggaatcacaaagtcgcaagtatctttaatcttatctatctcaaattacatttttctttttatatagtccggatcaggaaattcctccggttggttttccaattcagtgaggataaccaactgggatgtataaaacatttgtgatgggaacaagctgtgtagactagtttactgatcatcaatatgccatttgcattaagctgtcttctctgtcattgtttgtattaa

SEQ ID NO: 1203 - DNA, 1830 bp, Trifolium pratense
caaccctttttctttttctatgtagtagttttactagtaacacataaaaccctttaatcatttcacaatcattcataaaaaacaactctttctatatgggttgctttcactccaaaaccgctcatcttcactcccctgaagaccctcctactgctttaccagactcaaagaaacccgatccaggtgatgatggaggtgatggtgatcaagaaattcaggttccagcatttaaagagtatggtttgaatgaacttagaagagctacacatgagttcagaactgattacattgtttctgagagtggtgagaaagctcctaatgtggtttacaaaggaaaacttgagaataatcgattagtcgctgttaaacgcttctccaaacagtcctggcctgatgctcaacagtttctggcagaggcagctggagttgggaaagtgaggcacaaaagaatggtgaatctaattggttgttgtgccgaaggagatgaaaggcttttggtagctgaatacatgccaaatgatactttgtccaaacatctctttcattgggacaagcaaccgttaccatgggaaatgcgtgttagagttgcatatcatgtcgcccaggcactagatcattgtagcatggaaaaccgaaaaatatatcacgatctgaatgcttataggattctttttgatgaggatggtgatccccggttatcaagtttcgggcttatgaaaaatagtcgagatgggaaaagctacagtactaatttggcctatactccacccgaattcttgcgaacaggcaggataatcgcagagagtgtgatctacagttacggtactgtccttctggatcttttaagcggcaagcatattcccccaagccatgctttggacctaattagagggaaaaatgcattgttgttgatggactcatccctagaagggcaatatgcaaatgatgacgctacaaagttggttgagcttgcatcaaaatgtcttcagtttgaggccagagaacgacctgatattaagtttcttctcactgcagttacacctcttcaaaagcagaaagaggtagcatctcatgtgttaatgggccttactaaaaccgcggcagtgctaccactaccaaccatgctttctcctctaggaaaggcttgtgcaaggatggatcttactgctattcatgatatattgttaaaaactggttataaagatgaagaaggtgcagaaaatgagctttcatttcaagagtggacacaacaagtgcaagacatcttgaacacaaaaaagtttggcgatattgcatttagagacaaggatttcaaaaatgcaattgagtattattccaagttggtggttatgatgtctgttccatctgcaaccgtctttgcaaggagagccttctcctacttgatgaacgatcaggcagaacttgcattaagagacgcaatgcaggcgcaggtatgcatacctgattggccaactgcattctacctacaagctcttgctctctcaaagctgggaatggaaactgatgcacaggacatgcttaacgatggagcagcctttgaagcaaagaggtctaacagctggcgcggctaaaattgttatttgcagttcattgctcaccaaactagcacattggcatcggaaaatatatgctatttttgcgttaagctgtacttgctagaatagggatatgtaagggtgctagtttagggttgaagaaaaagaattatcatggtgtaaaatgttctcaaggaatattacagtataaattttgcctcacaaattagtcctctccagaatgaattttctccatatgaaaataagttcattt

SEQ ID NO: 1204 - DNA, 2022 bp, Mimulus guttatus
ctaaattcacgtgccaatcatagacttatcatgtgacgcctccgtcccactctctgcctggtgctgtctctctgtaatcatccccctcccccttcacacacacacacacacacacacagtcgtttcaactctcttcttccatcgactaatcattttttagttcagagaaagcacctatatagaaaaaaccgagctttctttttttaacccataaacatgactcagtgagttagtgagtgaatgtgagatgggctgttttcagtccaaaactgccaatgtccagtcccccgaccaggacccttcgctgcccgactccaaaccagatctggcaaatggggagcaagtagatccagatcaagtacccgcattcagagaattcggactcgcggaactacgcggcgcaacaaacggtttcagcagcgagcttatagtttccgagagtggagagaaagcgcccaatgttgtctacaaaggtaagcttcggagtaatcgcctcgtcgccattaaacgcttctcaaagcaatcgtggcccgaccctcagcagtttgcggcagaagctgctggagtaggtaaggttaggcataagagattggtgaacttaatcggatgttgtgccgaaggagacgagcgcttattagttgctgaatacatgccaaatgatactctgtcaaagcatctctttcactgggagaaacagcctctgccatgggaaatgcgtgtgagagttgcgtaccacatggcgcaagctcttgaacactgcactgctgaaaatcggaaaatttatcacgacttaaatgcttacagagttcttttcgacgaggaaggtgaccctagattatcgagttttggtttgatgaagaacagtagggatgggaagagttatagcaccaatttagcttacactcctcccgagtttttgcgtacaggcagggttattccagaaagtgtgatatacagttacggaacagttcttctggaccttttgagcggaaagcatatcccgcctagccatgcgttggatttgataagaggaaagaacgttctattgctaatggattcttccttggaaggacaatatgccaacgaagatgctactgctttagtcgaacttgcgtcaaagtgtctccagtacgaggccagagataggcccgatgttaagtttcttgttacttctgtcgcacccctcgaaaagcaaaaggaggttgcatcacttgtgctgatggggctgacgaaaacaccagtggtatcattgcccaccatgctttctccactcggaaaggcgtgcgcgagaatggatcttacagccatacacgatattcttctcaaaactggatataaagacgaagagggtgctgagaatgagctgtccttccaagaatggacacaacaagttcaagatatgttgaatacgaaaaagtttggagatattgcattcagggacaaggacttcaaaagtgctatcgaatactactctaagctggtgttgatgatgccggttccatctggaacagtgtttgtgaggcgggccctctcgtatttaatgatagggcaaccggagctagcgctaagagatgctatgcaggctcaagtttgcctgtcggagtggcccacggcattctacatgcaggctcttgccttgtccaaactcggaatggagactgatgctcaagacatgctcaacgacggagcctctttcgaagctaagaagcaaaacagctggcgccactaagtttatatgtattattacagagagaagctacttaggaatgctgtgggttgtcttgctaaaactgtgtccaatttaattttttttttcactacatgaaatgtgacatgacaatggatttttgatccgggtgcagagtttctcgaaaagtatgcagagagaaatgtataaaaatcgttgtttaggcttgttattttctcgataagtatgcagagagaaattacgttcgatacgcgaaccagttcattgtgtttttagagattctgctgctactgtattttatcatgactcgacga

SEQ ID NO: 1205 - DNA, 2140 bp, Trigonella foenum-graecum
gggttctaacataacatcattcacagccccacctgggtcagcacgtgctccatgatagactttgttcatgtgaccttctctctgtgctttctctctaccattgcttctctgcttttgttgttttgtttttctaactctctctctctctctctctctctatctctcttccgtgtttccgccgctgcaacaagcaacaatagtagcagtgactcagtagtcacttgttgcagcaatatggaaaaccattaactatgattcaactattcatttactcttcaaccctttttctttttctatgtataaaccaaaccctttaatcatttcacaatcataatcacttttttttctattctattctatatgggttgctttcactccaaaactgctcatcttcactcccctgaagaccctcctactgctttacccgactcaaagaaacccgatccaggtgatgatgggggtgatggtgatcaagaaagtcaggttccggtattcaaagagtatggtttgaatgaactcagaagggctacacatgagttcagcactgattacattgtatctgagagtggtgaaaaagctcctaatgtggtttacaaagggaagcttgagaataatcgattagttgctgttaaacgcttctccaaacagtcctggcctgatgctcaacagtttctggcagaggcagctggagttgggaaagtgagacacaaaagaatggtgaatctaattggttgttgtgctgaaggagatgaaaggctcttggtagctgagtacatgccaaatgatactttatccaaacatctctttcactgggacaaacaaccattaccatgggaaatgcgtgttagagttgcatatcacgttgcccaggcactagatcattgtagcatggaaaaccggaaaatatatcatgatctaaatgcttacaggattctttttgatgaggatggtgatccccggttatcaagttttgggcttatgaaaaatagtcgagatgggaaaagctacagtactaatttggcgtatactccacctgaatttttgcgaacaggcaggataattgcagagagtgtaatctacagttacggcactgtccttctggatcttttgagcggcaagcatattcccccaagccatgctttggacctaattagagggaaaaatgcattgttgttgatggactcatccctagaagggcaatatgcaaatgatgacgctacaaagttggttgagcttgcatccaaatgtcttcagtttgaggccagagaacgacctgatatcaagtttcttctcactgccgttacacctcttcaaaagcagaaagaggtagcatctcatgtcttgatgggtcttactaagacaccggcagttctaccattaccaaccatgctttctcctcttggaaaggcttgtgcaaggatggatcttactgctattcatgatatattgttaaaaacaggttataaagatgaagaaggtgcagaaaatgagctttcatttcaagagtggacacaacaagtgcaggacatcttaaacacaaaaaagtttggcgatattgcatttagagacaaggatttcaaaaatgcaattgagtattattccaagttggtggttatgatgtctgttccatccgcgaccgtgtttgcaaggagagctttcgcctacttgatgaacgatcaggctgaacttgcactaagagacgcaatgcaggcgcaagtatgcatacctgattggccaactgcattctacctgcaagcacttgctctttcaaagctgggaatggaaaccgatgcacaagacatgcttaatgatggagcagccttcgaagcaaagaggtccaacagctggcgcggctaaaattgtaattcgcagttctttgctcactaaactagcagattggcatcagaaaatatatgctatttttgctataatttgtacctgctagaatagagaggtatctgtctgtgagggtgctagtttagggtgcaagaagaattatcatggtataaaatgttttcaaggaatgaatattacaatataaattttgccatacacatgagtcctatcaagtagaatgagttttctcagcatgaaaataagtcatttatgccattattatgccttttgggtttggtggtca

SEQ ID NO: 1206 - DNA, 2230 bp, Phaseolus vulgaris
tttccattgaaaaatggttctcacttcttacttcttactacttctcagtcccacctgggacagcacgtgctgcatcatagacactgtcatgtgaccttccctgttcctttttcatcctttctcccctctctcttctttttcatactgattcattttacttacttaccttttgggttttggccttttcatctctttctttctttctctctctttgctgtgtttccgccgctgcagcaacaaagagtagcagtgactcagtcacttgctgcattttccgcttatcatatcaaacccataccattgaaccgtcactctttctgcttctgctaacctatattcatcatgccccctatgtcaatctagagttgttgtaatctttttgcaaccttttttctatgttgacaccccacttattattccattgcaacattagttaatcatttcacaatcataatcatgggttgtctccactccaaaaccgctcatcttcactctcctgaagacccccccactgccttgccagacgcaaagaaacccgatccagggaatggtggggatgatgttgatcaagaggttcaggttccagcattcaaagagtacggtctgagtgaacttcgaagggcgacaaatgagttcaacacagattacattgtttctgagagtggggagaaagcccccaatgtggtctacagagggaagcttgagaacaatcggttagttgctgtgaaacggttctcaaaactgtcttggcctgatgctcaacagttcatggcagaggcagctggagttgggaaagtgaggcacaagagactggtgaatctaattggttgttgtgctgaaggagatgaaaggctcttggtagctgagtacatgccaaatgatactttgtccaaacatctctttcattgggacaagcaaccattaccatgggaaatgcgtgtaagagttgcgtaccatgttgcgcaggcactagatcattgcagcatggaaaaccggaaaatatatcatgatctgaatgcatataggattctttttgatgaggatggtgatccccgcttgtcgagttttgggcttatgaaaaatagtcgagatgggaaaagctacagtactaatttagcttacactccacctgaatttttgcgaacaggcaggataatcccggagagtgtgatctacagttatggaactgttcttctggatcttttaagtggcaagcatattccccctagccatgctttggacctgattagagggaagaatgttttgttgttgatggactcttccctagaagggcaatatgcgaacgatgatgctacaaagttggttgagcttgcttcaaaatgtcttcagtttgaggccagagaacgacctgaaattaagtttcttcttacttccgttacacctcttcagaagcagaaagaggtagcatctcatgtgttgatgggcctaactaaaaacacagcagtgctaccaaccatgctttctccccttggaaaggcttgtgcaaggatggatcttactgctgtgcatgatatattgttaaaaacaggttataaagatgaagaaggtgcagaaaatgagctttcattccaagaatggacacaacaagtgcaagatatcttgaacactaaaaagtttggggatattgcattcagggacaaggatttcaaaaatgctattgagtattattctaagttggtggttatgatgtctgttccttctgctactgtgtttgcaaggagagcgttctcctacttgatgaatgatcaagcagaacttgcattaagagatgccatgcaggcacaggtatgcatacctgattggccaactgcattctacctgcaggctttggctctctcaaagctaggaatggaaactgatgcacatgacatgctcaatgatggggctgcctttgaagcaaagaggtctaacagctggcgtggttaattttcttatttgcagttctttgctcactaaactagcagagtggcataaaaaatatgctattttgccataatttgtacttgctagaataggaacatgtaggatgctagtttaaggggcaagcaaaagaactctggcataagatgttctcgaggaatgttacagtatagattttcccatacatatgaattctgtagaattaattttctccatatgaaaataacaatgtgtttggatggggagttttgagggaggaattcagtttttaagtggattttttaaatat

SEQ ID NO: 1207 - DNA, 2555 bp, Theobroma cacao
tagtcagtcagtccccacgccctcttctcgtctgttcatgctttccactaatttatacttttattattactattattattacgtaatgttaacaaaaatccttccttggagttattatttatacaaaaaaccctattttatattatcacatcaaaaactcacacttggagttagtattattctttcaattcacaacaaacaaaaagggcaaaagtattcacttggaaccccccattcaactcctcattttagtcaactttctttcttcccactcctcagtcctgcctccccaaactctgaagtcttgttccaagttcctactatactataccacacttactctatactctacactggagtcctcctgctcctgctgctcttgcttatactattatatgtgaacaaaggcagaccaacagtgatgggctgctttcagtccaaaaccacccatcttccatcccctgatcaagatcctcctcctcaaaccaagccagatctagatggggacggggagcagtcgtcattgcccgcattcaaggagttcggtctggtggagctgcgggcggcgaccaacggattcagcagtgagctgatagtttcagagagcggagagaaggctccgaatgtggtgtacagagggaagctgaagaacaatcgagtggtggccattaagcgattctcgaggcagtcatggcctgatcctcaccagttcgttaacgaagctgctggggttggaaaagtccgccacaaaagattggtcaatttgattggctgttgcgccgagggagacgagcgcttgttggtcgctgagtatatgcctaatgataccctctctaagcatcttttccactgggaaaaacagcctttgccatgggaaatgcgcctcagagttgcgtaccatattgcacaagcccttgatcactgcaacgctgaaaaccgtaaaatttatcacgatttaaatgcttacagagttcttttcgatgaggatggtgatcctcgattatctagttttggattgatgaaaaatagccgagatggaaaaagttacagtactaatttggcttatactcctccggagtttttgaggacaggcagggtcatccctgagagtgttatttacagttatggaactgttctcttggatctcttaagtggaaagcatattcctcccagccatgcattggacttgataagaggaaagaatttattgttgttaatggattcttctctggaaggtcaatatgctaatgaagatgccagcgaattggttgaattggcttcaaaatgtcttcagtacgaggctagagatcgacctgatattgaattcctcctttcagcagtggtacctcttcaaaagcagaaagaggttgcatcacatgttctaatgggtctatcaagaaccccatcactgttgccaactatgctttctgcacttggaaaggcatgtgccaggatggatcttactgcagtgcatgatatcttgcttaaaactggttatagagatgaagaaggtgcagaaaatgagctgtcattccaagagtggacgcaacaggttcaagatatgctgaatacaaagaaatttggggatattgcatttagagacaaagattttaaaaatgctattgattactactcgaagttggtatcgatgatgtctgttccttctggtactgtatttgtgagaagagccctctcattcttgatgattggtcaaccagaatttgccttgagagatgccatgcaggctcaggtgtgcttgcccgaatggcccactgccttctacatgcaagctcttgccctctccaagcttggaatggaaactgatgcgcaagacatgcttaatgatggagcctcatttgaggcaaagaagcagaatggctggcgtgtctaagcagcaatgttttaagcttttaggtggtaattctttctggattcttttccccatgcatatcgtcgagctgctgagagcttggaagaagatggtagcagaaaggaagtctgtgtgtgaggactattttgagtcaagagttgttttattatgttaaaagaatagtttgacgtagagaaatgtataaaggatactagacatgaagaaacaattagagtagtaactgaccaatgaatttgatactggtggtgctggttttttggtacaacttttcgtatgagctattgtcattatgaatcgaagggtgggtacggtgtatgaagagggaggacatgagagtgaggttgggcggttgagatttaacatcagatggtgcacaacgttattgggagattaaaagagaaaattgaatggacgtgtcaaattaggatgatgttatgattatttcatttatcatggtggtttaacagagccagccagcatatataaaaaagagaagcaactttattttaattcatggggttggcattagcgaagaaagcgttgctatgttaaacccaaaaaagagaaagaaagcattgggtctatagtttatacttcatacattcttgcattgcaaatcggaggaaaagaccagtattttttgttaggacagaaagatgattga

SEQ ID NO: 1208 - DNA, 1936 bp, Panax ginseng
cctatttctcccaagtcaatcagctcactcccattgaccccaaaatctatcaaatcccttccgattcaaaatacccacttaaaatcagcaaaagtaaaaaaatacccacatagggttttacttgtatatatagagtgagagatttgtgtgtgggtttgttcttgtctatgtagaattcaaacatgggctgttttcagtccaaaaccgccaatgttcagtctccagaccaagagcccgaacccaaaccagatctggaaaatggagaccaactggatcaagatcaagtacctgcatttaaagaatttgctcttacagagctccggaccgcaacaaatgggttcagtagtgatttgatagtgtcagaaagtggggagaaagctcccaatgttgtatatagaggcaggcttcgaagcaatcgggttgtcgccattaagcgcttttcaaagcagtcctggcctgatcctcaacagtttgtgacggaagcttctggagttggcaaggttcgacatagtagattggttaatctgattggatgttgcgccgagggagatgagcgtctattggtggcagaatacatgcccaatgatacactctcaaagcatctttttcactgggataaacagcctctgccctgggaaatgcgtgtgagagttgcacaccatattgcacaagcccttgatcattgcaatgctgagaatcgaaaaatctatcatgatttgaatgcgtacagagttttgtttgatgaggaaggtgacccccggttatccagttttggacttataaaaaatagtcgagatgggaagagttatagcactaatctggcttatactccgcctgagtttttgcgtacaggtagggttgttgcagagagtgtgatctatagttatggaactgtacttctggatcttttgagcggaaagcatatccctccaagccatgcattggacttgatcaggggaaaaaatgttttgttgctgatggattcatcattagaaggacaatatgcaaatgaagacgcaactgcattggttgaacttgcttcaaagtgtctccagtatgaggctagagatcggcctgatattaagtttcttcttacagcagtggcaccccttcaaaagcagaaagaggttgcgtcacatgttctgatgtgtctgacaaaaactacggtggttctgccaacaatgctttctcctcttggaaaggcttgtgctaggatggatcttactgcagtgcatgatatattgcttaaaactggttatagagatgaagagggagcagagaatgagctatcattccaagaatggacacagcaagtgcaagatatgctaaatacaaagaagtttggagatattgcatttagggacaaggatttcacgagcgcagtggactactattcaaagttggtatctatgatgtcagttccttctggtacaatttttgtgaggcgagctatctcctacttgatgattggccaaccagaactcgcactgagggacgcgatgcaggctcaggtgtgcttgcctgagtggcctactgccttttacatgcaggctcttgccctttccaagcttggaatggaaactgatgctcaagacatgcttaacgatggagccgcctttgaagcaaagaagcaaaacagttggcgcaactaaattatgagcagatgctggaaatcccatagatcgggttcattctgcaaaatttcagttatcacaccactaaaagggtcaacaagtagattccagccagtgaatatttaagattgtactcacccacccctgttgtagactatagtttccatacaaaaatgtataaatcactcctgatagggaaaaaaaattaatagttgatttatacaatttgattatgtattattatattcagtagttttttctgttaaaaattgtttacaaatctattccattaggtatttttg

SEQ ID NO: 1209 - DNA, 1902 bp, Solanum tuberosum
tttccctaacaaaagatttgatttttgaaacacccattcttgattcttgtgtgtttgagttaaagagtttagtgagtgtccattattgtctatgtgagctgatgaaaaatgggctgtttacagtccaaaactgtaaatgttcagtcccctgataaagaaccttctcaagatgactcaaaaacagatcttgctaatggggatcaagtagaccaagatcaagtgcctgcattcaaggaatttagtcttgcggaactccgggcagcaacaaatggctttagcagtgaattaatagtttctgaaagtggtgagaaagctcccaatgttgtctacagagggaagcttcgtagcaacaggctggctgccatcaagcgcttctccagacagtcgtggcctgacgctcaacagtttgtggcagaggcagctggagttggcaaggttcggcataagagattggtgaatctaattggctgttgtgcagagggagatgagcgcctattggttgcagaatacatgcctaatgatactctctcgaagcatctcttccactgggagaaacaaccgttgccctgggagatgcgagtaagagttgcatactatattgcacaggctctggatcattgcaatgccgaaaacagaaagatatatcatgatttgaatgcttacagaattctttttgatgaggagggcgaccctcgattatctagtttcggtctgatgaaaaatagcagagatggaaagagctatagcagcaatcttgcttatactcctcctgagtttttgcgcacaggccgagtaatcgcagaaagtgtggtgtacagctatgggactgttctgctggacctgttgagtggaaaacatatcccaccaagccatgcactagacttaattaggggtaaaaatgtgttgttattaatggattcatccttggaaggacaatatgccaatgaagatgcaacagcattggttgagcttgcttcaaagtgtctccaatatgaggcaagggatcgacctgaaatcaagttcattcttaatgcagtggagccccttcagaagcagaaggaggccgtgtcacatgttctgatgggtctaacaaaaactccagtggtgcttccaaccatgctctctcctctcggaaaggcttgtgcgaggatggacctcactgctgtccatgatatcttgcttaaaacaggttataaagatgaggagggtgctgaaaatgagctctcattccaagaatggacgcaacaagttcaagatatgttaaataccaagaaatttggggatattgcttttcgggacaaggatttcaagaatgcagttgactattactctaagttagtatcaatgatgtctgttccttctggcactgttttcgtgaggcgagccctttcctacatgatgaatggccaaccagaactcgcactaagggacgctatgcaagcccaggtgtgcttgcccgagtggccaactgcattctatatgcaggctcttgccctatccaagcttggtatggaaactgatgcacaagacatgctcaatgatggtgcctcctttgaagcaaagaagttaaacagttggcgtaactgattctggcacgtttgatgtatcaagaaacctcacatcctttaatgcaactagaggtagctatagtaaggatgagacaggagaggaaccaaaggtaatgtggtgtttggggattatattaatctcgcccctcgctcttttgtagccaatacagttccatacagaaaatgtataaatcactctagtgaaaaccctcgtagttattctgcgatgaatgccaatttttagttttgaaactcatcaagagttctttcattggtcatgtttgggtaaaacattactgccaaggcttgggttgatatttacagttattttacc

SEQ ID NO: 1210 - DNA, 1914 bp, Trifolium pratense
gttccgtgtttccgccgctgcaacaaaagcaacaatatcagcagtgactcagtgacttgcaatatggagaaccattcatgaatcaatgattcaaaccattcttcattttactcttcttcaaccctttttctttttctatgtagtagttttagtagtaacacaccaaaccctttaatcatttcacaatcattcataacaacaactctttctatgggttgctttcactccaaaaccgctcatcttcactcccctgaagaccctcctactgctttaccagactcaaagaaacccgatccaggtgatgatgggggtgatggtgatcaagaaattcaggttccagcatttaaagagtatggtttgaatgaacttagaagggctacacatgagttcagcactgattacattgtttctgagagtggtgaaaaagctcctaatgtagtttacaaagggaagcttgaaaataatcgattagttgctgttaaacgcttctccaaacagtcctggcctgatgctcaacagtttctggcagaggcagctggagttgggaaagtgaggcacaaaagaatggttaatctaattggttgttgtgctgaaggagatgaaaggcttttggtagctgaatacatgccaaatgatactttgtccaaacatctctttcattgggacaagcaaccattaccatgggaaatgcgtgttagagttgcatatcatgtcgcccaggcactagatcattgtagcatggaaaatcggaaaatatatcacgatctgaatgcttataggattctttttgatgaggatggtgatccccggttatcaagtttcgggcttatgaaaaatagtcgagatgggaaaagctacagcactaatttggcctatactccacccgaattcttgcgaacaggcaggatagtcgcagagagtgtgatctacagttacggcactgtccttctggatcttttaagcggcaagcatattcccccaagccatgctttggacctaattagagggaaaaatgcattgttgttgatggactcatccctagaagggcaatatgcaaatgatgacgctacaaagttggttgagcttgcatcaaaatgtcttcagtttgaggccagagaacgacctgatattaagtttcttctcactgcagttacacctcttcaaaagcagaaagaggtcgcatctcatgtgttgatgggccttactaaagccgcggcagtgctaccactaccgaccatgctttctcctctaggaaaggcttgtgcaaggatggatcttactgctattcatgatatattgttaaaaactggttataaagatgaagaaggtgcagaaaatgagctttcatttcaagagtggacacaacaagtgcaggacatcttgaacacaaaaaagtttggcgatattgcatttagagacaaggatttcaaaaatgcaattgagtattattcgaagttggtggttatgatgtctgttccatccgcaaccgtctttgcaaggagagccttctcctacttgatgaacgatcaggcagaacttgcattaagagacgcaatgcaggcgcaggtatgcatacctgattggccaactgcattctacctacaagctcttgctctctcaaagctgggaatggaaactgatgcacaggacatgcttaacgatggagcagcctttgaagcaaagaggtctaacagctggcgcggctaaaattgttatttgcagttcattgctcaccaaactagcacattggcatcggaaaatatatgctatttttgcgttaagctgtacttgctagaatagggatatgtaagggtgctagtttagggttgaagaaaaagaattatcatggtgtaaaatgttctcaaggaatattacagtataaattttgcctcacaaattagtcctctccagaat

SEQ ID NO: 1211 - DNA, 2020 bp, Medicago truncatula
cttggtcagcacgtgctccatgatagactttgtcatgtgaccttctctgtgctccttgtttctctctagtctctaccattgcttctcagctttttcttgtgttttgttttcaactctctctctctctctctcttccgtgtttccgccgctgcaacaagcaacaataacagcagtgactcagtatagtatagtcatttgcaacatgaaaaaccattaaccatgattcaactattcatttactcttcaaccctttttctttttctatgtatacaccaaaccctttaatcatttcacaatcataatcactttatgggttgctttcactccaaaactgctcatcttcactcccctgaagaccctcctactgctttacctgactcaaagaaaaccgatccaggtgatgatggaggtgatggtgatcaagaaagtcaagttccagtattcaaagagtatggtttgaatgaacttagaagggctacacatgagttcagcactgaatacattgtttctgagagtggtgagaaagctcctaacgtggtttacaaagggaagcttgagaataatcgattagttgctgttaaacgcttctccaaacagtcttggcctgatgctcaacagtttctggcagaggcagctggagttgggaaagtgaggcacaaaagaatggtgaatctaattggttgttgtgctgaaggggatgaaaggctcttggtagctgagtacatgccaaatgatactttatccaaacatctctttcactgggacaaacaaccattaccatgggaaatgcgcgttagagttgcatatcatgttgcccaggccctagatcactgtagcatggaaaaccggaaaatatatcacgatcttaatgcttacaggattctttttgacgaggatggtgatcctcggttatcaagttttgggcttatgaaaaatagtcgagatgggaaaagctatagtactaatttggcctatactccacctgaatttttgcgaacaggccggataatagcagagagtgtgatctacagttacggcactgtccttcttgatcttttgagcggcaagcatattcccccaagccatgctttggacctaattagagggaaaaatgcgttgttgttgatggactcatccttagaagggcaatatgcaaatgatgatgctacaaagttggttgagcttgcatccaaatgtcttcagtttgaggccagagaacgacctgatatcaagtttcttctcactgccgttacacctcttcaaaagcagaaagaggtagcatctcatgtgttaatgggccttactaaaacaccggcagtgctaccattaccaaccatgctttctcctcttggaaaggcttgtgcaaggatggatcttactgctattcatgatatattgttaaaaaccggttataaagatgaggaaggtgcagaaaatgagctttcatttcaagagtggacacaacaagtgcaggacatcttaaacacaaaaaagtttggcgatattgcatttagagataaggatttcaaaaatgcaattgagtattattccaagttggtggttatgatgtctgttccatccgcaaccgtgtttgcaaggagagccttcgcctacttgatgaatgatcaggctgaacttgcattaagagacgcaatgcaggcgcaagtatgcatacctgattggccaactgcattctacctgcaagcacttgctctctcaaagctggggatggaaactgatgcacaagacatgcttaatgatggagcagccttcgaagcaaagaggtctaacagctggcgcggataaaattgtaatttgcagttctctgttctctaaactagcatatatgtgctatttttgctataatttgtacttgctagaatagggatatgtgagagtgctagtttagggtgcaagaaaaagatttattatggtataaagttttctcaaggaatattggtctaaattttgtcacacaaatgagtcctatccagtagaatgaattttctcagtatgaaaa

SEQ ID NO: 1212 - DNA, 1824 bp, Panax ginseng
tctctctctagcacatcttttgcatagaaaccacttgcattcaggccgataaacctttctcaatccgtcattccttttctttctctctctctctaaaacttcagaccccatctaccctttcttcaatgtcgacgctcctttttcactaaaaccccaactcataatgggctgcttccactccaaaaccacgcacctcccttatccagatgacccctccaaactcgattcagttaatggagataattgtggaggtgaggaagaccaagataataaccaagttcccgtatttaaagagtacgtactaaacgagcttaaaaaggccactaatggattcagcagtgactgcctcgtctccgagagcggagaaagagcccctaatgttgtttacagagcaaagctcgataataatcgatttgtcgccgttaagcgtttctccaaactgtcctggcctgaccctcaacaattcttggcggaagcagctggagtagggaaggttaggcataagagattggtgaatcttattgggggttgcgccgagggagatgagaggctattggtggcagagtatatgccaaatgatactctgtctaaacacctcttccactgggataagcagccattaccatgggaaatgcgcgtacgagttggatgtcatgttgcacaggcacttgatcattgcaatagtgaaaaccggaagatatatcatgatttgaatgcatatagagttctttttgatgaggatggtgatcctcgtttgtctagttttggcctcatgaaaaatagccgggatgggaagagctatagcacaaacttggcttatacaccacctgaatttttgcgaacaggcagggttatcccagagagcgtcatctacagttatggaacagtactgttggatcttctgagtgggaagcatatccctccaagccatgcactggacctaataagggggaagaatgtattgttgttaatggactcatcattggaagggcagtatgccaatgatgacgctactaaattcgttgaacttgcttcaaaatgtcttcaggctgaggctagggatagacctgataccaagtttcttattacagctgtatctcctcttcaaaagcaaaaggaggtggcatctcatgttttaatggggctaactaaaactgcgacagtggtaccaaccattctatctcctcttggaaaggcttgtgcaaggatggatcttactgctgtgcatgatatactgcttaaaacaggctataaggatgaagaaggtgctgaaaatgagctatcgtttcaagaatggacgcagcaagtgcaagatatgttaaacacaaagaagtttggtgatattgcatttagggacaaggatttcaagagtgcaattgaatactatacaaagttggtagttatgatgtctgttccatcggccactgtctttgcacgaagagccctctcctatttgatgaacgaccaagcagaacttgccttgagagacgccatgcaggctcaggtttgtataccggagtggccaactgcattctatttgcaagcgcttgcactctccaaacttggaatggaaactgatgctcaggacatgcttaacgacggggcagcatttgacacaaagaagcagaacagctggcggaactagtacacaaactcgtggcaaaaattatagcactccctttctaacttggctctatgttccaattctacagtagaaattttagttaaatgaggtcagtgttagtggtagggggaaatatattatgagaatcgcgatttcaggaaatgtcaccaaatcccctgttaactatacatctacaggtt

SEQ ID NO: 1213 - DNA, 1789 bp, Quercus alba
gtttatatatatgtaaagctatcatcagtcatgggctgttttcagtccaaaactgcccacctagcttctcccgaccaagaccctcctcttcctcaccccagtccagatccagctaatggtggaggaggagaggaggaattagagcaaaacgatggcgtgccggcattcaaggagttcgagctggcagagctgagagcagcaacaaatgggttcagtagtgaattgatagtctctgagagtggagagaaagctcccaatgtggtttacaaagggaagcttcgaaacaatggccttgttgccattaagcgcttctccaagctttcctggcctgacccacatcagtttgtgacagaggcttgtggagtagggaaggttcggcataagagaatggtgaatttaataggatgttgtgctgagggagatgagcggcttttggtggcagagttcatgcctaatgatactctctccaagcatctctttcactgggataaacaaccattgccttgggaaatgcgtgtgagagttgcctactatattgcacaagcacttggtcattgcaacacagaaaaccgaaaaatctatcatgatttaaatgcatatagagttctatttgatgaggatggtgacccacgattatctagttttggtcttatgaagaatagccgagatggaaaaagttatagcactaacttggcttatactccaccagagttcttgcggacaggcagggtcatcccagagagtgtggtctacagttatggaactgttcttctggaccttttgagtggaaagcatatccctccaagccatgcattggatttgataagaggaaaaaatttgttgttactgctggattcgtccttggaaggacaatatgccgaagaagatgcaactgagttggttgaactggcctcaaaatgcttgcaatatgaggctaaagatcgacctgaaatcaaatttcttctttcatcagtaactccgctccaaaagcagaaagaggttgcatcacatgtcctattgggtttaacaaaaacaccagtggtgctgccaaccatgctttccccccttggaaaggcttgtgtgagaatggatcttactgcagtgcacgatatattgcttaaaacaggttataaagatgaagagggtgcagaaaatgaactgtcattccaagagtggacgcaacaagtgcaagatatgttgaacaccaagaagtttggggatattgcatttagagacaaggatttcaaaaatgctatcgaatattattcaaagttagtatcgatgatgcctgttccctcggctactatctttgtgaggcgagccctctcatacttgatgactggccaagcagaacttgccttgagagatgcaatgcaatctcaggtgtgcttgcccgagtggcctactgcattctacatgcaagctcttgccctctcaaagcttggaatggaaacagatgctcaggacatgcttaatgatggagcctcctttgaagcaaagaaacaaaacagctggcggatataggttctcggcttttagctaatggtggtggcaatcccatatctcttaattttttctgctcatttttaccattatgttgctaggggcatttgcaagaagatccatgtgagaacaagtttgatatatatggtattgattggggttatttttaagttttgcacccacttcacttgattagtttcacacaaagaaatgtataaagcatttgtaataaacaataatctaagtcagtttttttagatttatatattgaattgcaaaaaattag

SEQ ID NO: 1214 - DNA, 2088 bp, Capsicum annuum
gttctctctcttcacgtgctgatcatgtgactaaacccctctattctcggcgtccccttctttggcggcctctctttcctttttctgttctcacctttactttcactaatcattactactaactatcttcttgttatccattttccactactcattagctacaaaaggttcaaactttcttgattcttgaaggtttgagttaaagaaactgtttgtaagtgtgcatttttgtctatgtgagctgatgaaatatgggctgtttacagtccaaaactgcaaatgttcagtcccctgataaagaaccttctcaagatgactcaaaaacagatcttgctaatggggatcaagtagaccaagatcaagtgcctgcattcaaggaatttaatcttgccgaacttcgggcagctacaaatggctttagtagcgaattaatagtttctgaaagtggtgagaaagctcccaacgttgtctacagagggaagcttcgtagcaacaggctagttgccatcaagcgattctctagacagtcgtggcctgacgctcaacagtttgtggcagaggcagctggagttggcaaggttcggcataagagattggtgaatctaattggttgttgtgcagagggagatgaacgcctattggttgcagaatacatgcctaatgatactctctcaaagcatctcttccactgggagaaacaaccagtgccctgggagatgcgagtaagagttgcatactatattgcacaggctctggatcattgcagtgctgaaaacagaaagatatatcatgatttgaatgcttacagagttctttttgatgaggaaggcgatcctcgattatctagttttggtctaatgaaaaacagcagagatggaaagagctatagcaccaatcttgcttatacacctcctgagtttttgcgcacaggccgggtaatcgcagaaagtgtgatgtacagctatggaaccgttctgctggaccttttgagtggaaaacatatcccaccaagccatgcactagacttaattaggggtaaaaatgtgttgttattaatggattcatccttggaaggacaatatgctgatgaagatgcaacagcattggttgaacttgcttcaaaatgtcttcagtatgaggctagggatcggcctgaaatcaaattcattcttaatgcagtggagcctcttcagaagcagaaggaggttgcatcacatgttctgatgggtctaacaaaaactccagtggtgcttccaaccatgctctctcctcttggaaaggcttgtgcaaggatggacctcactgccgtccatgatatcttgctaaaaactgggtataaagatgaggagggtgctgaaaatgagctctcattccaagaatggacgcaacaagtacaagatatgttaaataccaagaaatttggggatattgcttttcgggacaaggacttcaagagtgcagttgactattactctaagttggtatcaatgatgcctgccccttccggcactgtttttgtgaggcgagccctttcctacatgatgaatgggcaagcagaacttgcactaagggatgctatgcaagcccaggtttgcttgcctgagtggcctactgcattctatatgcaggctctttccctatccaaacttggcatggaaactgatgctcaagacatgctcaacgacggagcttcctttgaagcaaaaaagttaaacagttggcgtaattgattctggcacgtttggtggatcaagaacctcaccaccctttaccaaagctagagatagctatagtaaggatgagacggaatactaaaggggaaccaaaggtaatgtggtgtttaggggttatatttatctcggccctcgctcttttgtagccaatacagttccatacagaaaatgtataaatcactctagtgtaatcccttatagcttattccgttccgcgatgaatgccaattcttagttttgaaactcttcaagagttctttctttgtcatgtttgggtaaacattactgccattgtctatgttgctatttatggttattttacctgaaccatgtactatataacactggaggcgac

SEQ ID NO: 1215 - DNA, 2183 bp, Glycine max
atgatagacactgtcatgtgaccttctctgctcctttcgtcccttcatctctttctcttttctttttcacacttattcagtttacttacttaccttttgggttttggccttttcatctctctctttctctctcttctgtgtttccgccgctgcataagcaaagtagcagtgactcagtcacttgcaacattttcggcttaacatatcagacccattgaaccatcactcttttctgttcctgctcatgtatctcatcatgccccctattccaatctagagttttaatcttttcaagtttcaacctttgttcctatgtagacaccccacttagtatatcatagccataataattatatcatatcttaatcatattaatcatttcacaatcataaccaaaccatgggttgcttacactccaaaaccgcacatcttcactcccctgaagaccctcctactgccttaccagactccaaaaaacccgatccagggaatggtggtgatgatgttgatcaagagtgtcaggttccagcattcaaagagtatggcctgattgagcttagaagggccacaaatgagttcagcacagattacattgtttctgagagtggtgagaaagctcccaatgtggtctacagagggaagcttgagaacaatcgattagttgctgtgaaacgcttctccaaactctcttggcctgatgctcaacagttcatggcagaggcagctggagttgggaaagtgaggcacaagagactggtgaatctaattggttgttgtgctgaaggagatgaaaggctcttggtagctgagtacatgccaaatgatactttgtccaaacatctctttcactgggacaagcaaccattaccatgggaaatgcgtgtcagagttgcataccatgttgcccaggcactagatcattgtagcttggaaaaccgtaaaatatatcatgatctgaatgcatataggattctttttgatgaggatggtgatccacgcttatctagttttgggcttatgaaaaatagtcgagatgggaaaagctacagtactaatttagcttatactccacctgaatttttgcgaacaggcaggataatcccagagagtgtgatctacagttatggaactgttcttctggatcttctaagtggcaagcatattcctccaagccatgctttggacctaattagagggaaaaatgttttgttgttgatggactcttctctagaagggcaatatgcaaatgatgatgctacaaagttggttgagcttgcttcaaaatgtcttcagtttgaggccagagaacggcctgaaattaaatttcttcttactgctgttgcgcctcttcaaaagcagaaagaggtaacttctcatgtgttaatgggcttaactaaaaacacagcagtactaccaaccatgctttctcctcttggaaaggcttgtgcaaggatggatctcactgctgtgcatgatatattgttaaaaacaggttataaagatgaagaaggtgcagaaaatgagctttcattccaagaatggacacaacaagtgcaagatatcttgaacacaaaaaagtttggggatattgcattcagagacaaggatttcaaaaatgcaattgagtattactctaagttggtggttatgatgtctgttccttctgctactgtgtttgcaaggagagccttctcctacttgatgaacgatcaagcagaactggcattaagggatgccatgcaagcacaggtatgcataccggattggccaactgcattctacctgcaggctcttgctctctcaaagctgggaatggaaactgatgcacatgacatgcttaatgatggggctgcctttgaagctaagaggtctaacagctggcgcggttaaaattcctaatttgcagttctttgctcactaaactagcagagtggcataaaagaatatgctatttttttgccataatttgtacttgctagaataggaatatgtagagtgctagtttaaggggcaagaaaaagaactctgctataagatggttctcaaggaatattacagtatagattttcctatacaattgaatcctgtagaatgaattttctccatatgaaaataacaatgtgtttggatggggagttttgagggaaaaattcaatttttaagtagatttaaaatatcacatg

SEQ ID NO: 1216 - DNA, 1670 bp, Musa acuminata
cactctctcggacacacgcatcaccacttcgcttctccttcttctactctctttctccgccttccgccgcccccgggcagcgaatgagattctagggttcggaccaccgccggagatgggctgcttccactccaagaccaccaatgtccagtcccccgacgaggagtcccttccggccgacaagccagatctaccgaatggggacgcgggggagcaggaccaggtgccagcgttcaaggaatacggactcgctgagctgagggccgccaccaaagggttcagccccgagatgatcgtttccgagagcggggagaaggcgccgaacgtcgtctaccgggggaacctcgacggggggcggctggtggccgtgaagaggttctcgaagcagtcgtggcccgacgctcaacagtttgtgacggaggcggcgggcgtgggcaagttgcggcacacgaggttggtgaacttgatcggctgctgcgcggaaggtgacgagagacttctcgtggcggagttcatgcctaatgatacattgtccaagcatctcttccactgggataagcacccattaccatggcaaatgagagtgagggtggcattctacattgcccaagcgcttgaccactgtaatactgaaaatcggagaatttatcatgacctaaatgcttatagagtcctatttgatgagaattatataattagggatcttcatcaagatggggatcctcgcttgtctagctttggtctaattaagaacagccgagatggaaaaagttacagcactaatcttgcttacactccaccagaattcatgcgcactggcagggtgattccagaaagtgtaatctacagttatggaacaattcttttggatcttttgagtgggaaacatattcctcctagtcatgcactggatcttataagagggaaaaacatgttgcttataatggattcatccctggaggggcaatatgctaatgaagatgctaccaagctcgttgaactagcttcaaaatgtctacagtttgaggctagagatcggccgaattctaagtttcttctatcttctgtggaacctctgcaaactcagaaggaggtgccatcacatgtattaatgggcataacaaaagcgccacaagtgttgccaacaatgctttccccacttggaaaagcttgtgcaaagatggacctaactgctgtgcatgatatactgctcaagacaggctataaagatgaagaaggtgcagaaaatgagctttcttttcaagaatggacacaacaagtgcaagagatgttgaatacaaagaagtttggagacattgcattcagggacaaagatttcaaaagtgctattgagtattattccaagttagtggcaatgatgtcggttccatcggccacagtttttgcgaggcgtggcctatcatacttgatgagtggtcaaccggagctcgcgctacgggatgccatgcaagcccaggtgtgtatgcctgaatggccaacagccttctacttgcaagctcttgccctctccaagcttggaatggaaactgatgcccaggatatgctcaacgatggtgctgccttcgaggccaagaggcagaacggctggcatggctagatgatctcagtgctctctcttcgttgtgcttctcctagcaactcaacagagg

SEQ ID NO: 1217 - DNA, 1748 bp, Allium cepa
agtgggccattacggcctagttacgggactcacatcagtaatctccttcactcaactccactattttttctcacattttaaatattcgaaaatacaacaataattaaatgcaaatctaaaatatcgatcaaaatgggatgtttacaatccaaaacagccaacatccattcccctgaaaacgaacccataacccaagaatctaaaccagatctacagaatggagaagcagtagatcaagaacaagtgcctgcttttaaagagtttggtttatcggagctccgaatagcaacaaaagggttcagttcggatcttatagtttcggaaagtggtgagaaagctccgaatatagtatttaaaggcaagcttgataatggtaaaattgttgctgtcaaaagattttctaggcagtcttggcctgatgcacaacagtttgtgtcagaagcagctggtgtaggaaagttacgccacaggagaattgtgaatttaattggttgctgcactgagggtgatgaaagacttcttgttgctgaattcatgccaaatgacacgttatcgaaacatcttttccattgggacaagcaaccattaccatgggaaatgagagcaaggattgcatattacatagcacaagcacttgatcactgtaataccgaaaaccgcaaaatatatcatgacttgaatgcttacagagttctttttgatgaggatggcgatcctcgtctatctagctttggactgatgaaaaatagcagggatgggaaaagttatagtactaatttagcttacaccccaccagagtttttgcgaacaggcagagtcattccagagagcgttatatacagttatggaacagtgctattggatttattgagcgggaaacatattccaccaagtcatgcattagacatgataagggggaaaaacatattacttctgatggattcttctttagagggacaatatacagatgaagatgcttcaaagttgattgatcttgcttcaaaatgcttgcaatttgaagcaagagatcgccccaattctaaatttctcttatctgctgtggcttctcttcaaaagcagaaagaggtggcatcacatgtactaatgggtttatctaaagctcccgttgcactgccaacaacactctctccacttggaaaagcatgcgcacgaatggatctcactgctgtacatgacatattactcaaaacaggttacaaggacgaggaaggtgcagaaaatgagctctcatttcaagaatggacacaacaagtgcaagagatgttgaacaccaagaagttcggcgatattgcattcagagataaggatttcaaaaatgcaattgattactacaccaagttggtgggcctgatgtctgtaccatcggcaactgtatttgcaagaagaggtctatcatatttgatgaacgggcaacctgagcttgcacttcgagatgcaatgcaagcgcaagtgtgcatgcctgaatggcccactgctttttatttacaagctcttgctctttcaaagcttggaatggaaaccgatgcacaagatatgcttaacgatggagcggcctttgaagccaaaaaacaaaatggatggcgcagctaatttgatttcactgccaatacagcagcatccatgactgaattacatggatcaagtccatgatattgatgcattcagagtagaaagttaggggagagcaatgtatataggaagagaatgagttactaggcacacattgc

SEQ ID NO: 1218 - DNA, 1892 bp, Musa acuminata
ctcggacacacgcatcaccacttcacttctgcttcttctactctctttctccgccttccgccgcccccgggcagcgaatgagattctagggttcggaccactgccggagatgggctgcttccactccaagaccaccaatgtccagtcccccgacgaggagtcacttccggccgacaagccagatctaccgaatggggacgcgggggagcaggaccaggtgccagcgttcaaggaatacggactcgctgagctgagggccgccaccaaagggttcagccccgagatgatcgtttccgagagcggggagaaggcgccgaacgtcgtctaccgggggaacctcgacggggggcggctggtggccgtgaagaggttctcgaagcagtcgtggcccgacgctcaacagtttgtgacggaggcggcgggcgtgggcaagttgcggcacacgaggttggtgaacttgatcggctgctgcgcggaaggtgacgagagacttctcgtggcggagttcatgcctaatgatacattgtccaagcatctcttccactgggataagcacccattaccatggcaaatgagagtgagggtggcattctacattgcccaagcgcttgaccactgtaatactgaaaatcggagaatttatcatgacctaaatgcttatagagtcctatttgatgagaattatataattagggatcttcatcaagatggggatcctcgcttgtctagctttggtctaattaagaacagccgagatggaaaaagttacagcactaatcttgcttacactccaccagaattcatgcgcactggcagggtgattccagaaagtgtaatctacagttatggaacaattcttttggatcttttgagtgggaaacatattcctcctagtcatgcactggatcttataagagggaaaaacatgttgcttataatggattcatccctggaggggcaatatgctaatgaagatgctaccaagctcgttgaactagcgtcaaaatgtctacagtttgaggctagagatcggccgaattctaagtttcttctatcttctgtggaacctctgcaaactcagaaggaggtgccatcacatgtattaatgggcataacaaaagcgccacaagtgttgccaacaatgctttccccacttggaaaagcttgtgcaaagatggacctaactgctgtgcatgatatactgctcaagacaggctataaagatgaagaaggtgcagaaaatgagctttcttttcaagaatggacacaacaagtgcaagagatgttgaatacaaagaagtttggagacattgcattcagggacaaagatttcaaaagtgctattgagtattattccaagttagtggcaatgatgtcggttccatcggccacagtttttgcgaggcgtggcctatcatacttgatgagtggtcaaccggagctcgcgctacgggatgccatgcaagcccaggtgtgtatgcctgaatggccaacagccttctacttgcaagctcttgccctctccaagcttggaatggaaactgatgcccaggatatgctcaacgatggtgctgccttcgaggccaagaggcagaacggctggcatggctagatgatctcagtgctctctcttcgttgtgcttctcctagcaactcaacagtggttcgtcttgggttgtcaaatgttggctcttcttcttgggaaaccagagctgtgacccccaacagtggatgttgagaagggaatcagccagtgttttgtacaaaatcttcagaaaaagaatgattcagttagtgaagtttccatggacattgtattaggatcatcatttatgatggcatatcgatgttcttgtaatcacatgacaggtggggatatttacattgacgag

SEQ ID NO: 1219 - DNA, 1505 bp, Manihot esculenta
tgatgggctgctttcagtcgaaaaccacccatatagcttctccagaccaagagcctcttccacctcaagaacccaaagcagatctcgctaatggagccactgaccttgaccatcaccaagacctagaccaagttccaaccttcagagagttctctttggcggaacttcgaaccgccaccaacggatttagcagcgatttgatagtctctgaaagtggagaaaaagctcccaatgtggtttacagagggaagctaaacgccaatcgccttgtcgctatcaagcgcttctccaggctttcttggcctgaccctcaccagtttgtgacggaggcttctggagttggcaaagttcggcataagagattagtcaacttaattgggtgttgcgccgagggagatgagcgcttattggtggcggagttcatgcctaatgataccctttctaagcatctctttcactgggaaaaacaaccattgccatgggaaatgcgcgtcagagttgcttactatattgcacaagcacttgggcattgcaatgcccaaaaccgtaaactttatcatgatttgaatgcctacagagtcctcttcgatgaggatggtgatcctcgattatctagttttggtctaatgaagaatagccgggatgggaaaagctacagcacaaacttggcttatactcctccagaatttttgcggacaggcagggtcatccccgagagtgtgatttacagttatggaactgttctgctggacctcttgagtgggaagcatatccctccaagccatgcgttggacttgattagggggaagaatttgttgttattaatggattcttccttggaaggacaatatgctaatgaagatgcaactgaattggtggaactagcctccaaatgtctacaatatgaggctaaagatcgacctgatattcagtttcttctcacagcagtgacaccccttcagaagcagaaagaggttgcatcacttgtgctaatgggtctatcgaaaacacctgtggtgctgccaaccatgctttccccacttggaaaggcttgtgtgagaatggatcttactgcagtgcatgatatcttgcttaaaacaggctataaagatgaagaaggtgcagaaaatgagctgtcatttcaagagtggactcaacaagtgcaagatatgctgaacacaaaaaaatttggggacattgctttcagagacaaggatttcaaaaatgctgttgattattattcgaagctggtagcgatgatgtctgttccctctggtactgtttttgtgagacgagccctatcatatttgatgattggccaagcagaacttgccttgagagatgccatgcaggctcaggtgtgcttgcctgagtggccgactgcattctatatgcaagctcttgcactgtccaagcttggaatggaatctgatgctcaggacatgctcaacgatggagcctcctttgaggcgaagaagcagagcagctggcgcatttgaattagc

SEQ ID NO: 1220 - DNA, 2102 bp, Quercus alba
ctagtctcacagaaagactgagagaaactccgacaattcgggccaaaatagagaaacaaacaagtacccgaaattcaacctcgtccaaactccaattcatatgcaaaccgtgtcttgtcgtttcgtgtcgtttatagactccgactgtgagcttttctttctttttaataattaatatataaaaaagaaagactgagagaacttggaagttcctgtgttctgttctgttctgtacttgtgtgtatgtaactgtaagaaagaactaaagaagaagaagaagaagaagagtgaacagtgaatagtgatgggttgcttacactccaaaaccacacaccttcactccccagatgacccttcttccctacccgactccaataaacccgaccctacaggtaatggggatgaagttaatgaagagctccaagtcccagcattcaaagagtacggactcaatgagctccgcaaggccaccaatgggttcagcactgattacattgtctccgagagtggagagaaagctcccaatgtggtttacagaggcaagctcgacagcaaccgcttagtcgctgtcaaacgcttctccaaacagtcttggcctgatgctcaacagtttgtggaagaggcggcaggattgggaaagatgaggcataagagattggtgaatctgattggttgctgtgctgaaggagatgaacgacttttggtagctgagtacatgcccaatgatactctgtccaagcatctcttccattgggataagaagccactgccatgggaaatgcgtgttagagttgcatattttattgcacaggcacttgatcattgtaatactgaaaatcggaaaatttatcatgatttgaatgcatacagagttctttttgatgaggatggtgaccctcatttgtctagttttggtcttatgaaaaatagtcgagatggaaaaagctacagtactaatttagcttacactccgcctgagtttttacggacaggaagggtcatcccagagagtgtgatctacagttatggaacagttctgttggacctcttaagtgggaagcatattcctccaagtcatgcgttggacctgataagagggaaaaatgtgttactgttgatggattcatcattggaaggacagtatgccaatgatgatgctactaaattggttgaacttgcttcaaagtgtcttcagtctgagcctagggatcggcctgatacaaagtttcttctagcagcagttacaccacttcaaaagcagaaagaggtggcatcgcatgttctaatgggcctatctaaaaatacagtggtgatgccaactatgctctccccccttgggaaggcttgtacaaggatggatcttactgctgtgcatgatattttgctaaaaacagggtataaagatgaagagggtgcagaaaatgagctgtcatttcaagaatggacgcaacaagtgcaggaaatgttgaacacaaagaaatttggggatattgcatttagggacaaggatttcaagagtgcaattgagtattattcgaagttagtagtaatgatgtcggttccctcggctactgtctttgcaaggagagccttctcatatttgatgaatggccaagcagaacttgccttgagagatgccatgcaggctcaagtgtgcataccagagtggccaactgcattctacttgcaagctcttgcactctcaaagctgggaatggaaactgatgcacaggacatgctcaatgatggggcaacctttgaaacaaagagacaaaatagctggcgcggctaaattctgagattgttaatatacttaaatttcaatcagtccttagtcatcatagtgctgtgagaagattgtctagaatagaaagattaatgtggtagggaaaaatgaatagtggtagtagtagatgttttcaggaaattctaacagatattgtgttgccaacatagttgaaagtttgagcaatgtatgaatgtaatttctcaaaagataaaaaataagtttttgatttatcagttacagatttactgcgtgaaatatattttttttgcggcatcttgttgcctggcagaatgatgctagtgacagaaataca

SEQ ID NO: 1221 - DNA, 1925 bp, Olea europaea
gttcatcacaagcatacaaacaaagctcagtcctccccaagtcttccattaaactttccaacatcaaactttcttacaaacccattaaggttttcgattcacactcacaaatatttatacaggaagacagagttacttataccttaaaaactgtgggagtgagtgagtgaatgtgagcacaaaaagtatgggctgtttccagtccaaaaccgccaatgttcagtcgcctgaccaagaacctccacagcctgagtccaaaccagatctggcaaatggggaccaaggagatcaagatctggtgcctgcattccaagaatttggcctcgcggatctgcgatctgcaacaaatgagttcagcagtgatttgattgtttcagagagtggagagaaggctccaaatgttgtctatagagggaagcttcgaaataatcgacttgttgcaattaagcgcttctcaaagcagtcatggcccgaccgccaacaatttgtcgcagaagccgctggagttggtaaggttagacacaagagactggtgaacttaattggatgttgtgctgagggggatgaacgtctattagttgctgaatttatgcctaatgatacgctatcgaagcacctctttcactgggataaacaacctttgccatgggaaatgcgtgtgagagttgcatatcatatggcacaggctcttgaccattgcaatgctgaaaaccgaaaaatctatcatgatttaaatgcttacagagttctttttgatgaggatggtgatcctcgtttatctagttttggcctgatgaaaaacagcagagatggaaagagttatagcaccaatctagcttatacgccccctgagtttttgcgcactggcagggtcattccagaaagtgtgatttacagttatggaactgttctgctggaccttttgagtggaaagcatattcctcctagccatgcattggatttgataagagaaaagaatgttttattgctgttggactcatccttggaaggacaatatgctaatgaagatgctactgcattagttgaacttgcatctaagtgcctccaatatgaagctagagaccggcctgatatgaagtttcttctaacttccgtggcccctcttcaaaagcaggaggttgcttctcatgtattgatgggtcttacgaaaactcccgtggttatacctaccctgctttctcctcttggaaatgcttgtgcgagaatggatcttactgctgtgcatgacatcttgcttaaaacaggatataaagacgaagagggtgcagaaaatgagctttcattccaagaatggacccagcaagttcaagatatgttgaatacaaagaaatttggggatattggattcagggacaaagacttcaagagtgccattgataattattcaaagctggtatcaatgatgtctgttccgtctggtacagtatttgtgagacgagccctctcatacttgatgattggccaacctgaacatgctctgagagatgcaatgcaggctcaagtttgcttgcccgaatggccaactgctttttatatgcaggctctcgccctctccaagcttggaatggaaactgatgctcaagacatgctcaatgacggagctgcctttgaagctaagaagcaaaatagtcgacgcatttaaataacggcatggtgatggatattaggtttgtcgcggaggctgattcagtggtgtgaggattacacgtagtgatatcttactgctgtttttgacagtatagccccttatcaagaaatgtgtaaatcacttatcgtgccaaattttaagtagatagtcactgttaatgcaggttgaatcgactcttttctagcccttaattttcatgaatcattgtataacttatatatatcctcgagtatattgcagaaaaccctgtttgtga

SEQ ID NO: 1222 - DNA, 1873 bp, Tripterygium wilfordii
aaactcagttttaacctcattaaagcactaaagtcttcacctttttgatgtgaggaggagtaatcaataatgggttgttttcattccaagaccagacatctttcatctcctgaccaggagcctcctccaccagaagcaaagccagatctagctaatgtagaaactgatgaagaaggccaagtgcctccatttaaagagtactccttatcggagcttcgagctgctacaaatgggtttagtagcgatctcatagtgtctgagagtggagaaaaggctcccaatgtggtttacagaggcaagctcaagaacagccgattagtggctattaagcggttttcgaggctttcttggcccgaccctcaacagtttgtgactgaagctgctggtcttggcaaggtcaggcacaagagagttgttaacttgattggctgctgtgctgaaggcgatgagcgtttgttggtggcagagtacatgcctaatgatactctatctaagcatctgttccactgggagaaacagcctttaccgtgggaaatgcgagtcagagttgcatactatattgcacaagcacttgatcattgcagcgctcaggaccgtaaaatctatcatgatctaaatgcttaccgggtactttttgatgaggatggcgaccctcgattatctagctttggcatgatgaaaaatagtcgagatggaaaaagctacagcacaaacttggcttacactcctccagagtttttgcggacaggtagggtcattccagagagtgtgatctacagttatggaactgtgctgctggaccttttgagtggaaaacacatccctccaagccatgcattagatttgataaggggaaagaatgtattgttattaatggattcatccctggaaggacaatacgcaaatgaagatgcaaccgaattagttgagctggcctctaagtgtcttcagtacgaggctagggatcgacctgatattaaatttctcctttcagctgtggcaccccttcaaaagcagacagaggttgcatctcatgttcttctgggtctaccgaaaactccagtagtgccacaaaccattctttctccacttggaaaggcttgtgcaaggatggatcttacggcagtgcatgatattttgctcaaaacaggttataaggatgaagaaggtgcagaaaatgagctatcatttcaagagtggacacagcaagtgcaagatatgttgaatacgaagaaatttggggatattgcttttagggacaaggattttaagaatgctattgagtattactctaagttggtatcgatgatgtctgttccttctggtaccgtctttgttaggcgagctctctcatacttgatgattggccaaccagaacttgccctgagagacgccatgcaagctcaggtgtgcttgcctgagtggcccactgccttctacatgcaagctcttgccttgtccaagctcggaatggacagtgatgctcaggacatgcttaacgatggagcctcgttcgaagcaaagaaacagaacagctggcgcatttaaaacagtgaactatagccaatcttacattatccgggtgcggctctctatccatttccaccatggaaacgccattggaggtgaagatgaatgcggaattagactagatttcatgtgtagtgagggttgttttcagttgatgcccccttccatcattggcagaatatattcatacagagtgaaatgtataaatgattggtgatagcaaaaataagtagagaataacccactaaccattatgagttcttaatgtgcttgtgtgcttccattgttgtattgtgctgaagcctgaaagagtgattgtaacaacgaagtacatttatgtatg

SEQ ID NO: 1223 - DNA, 2273 bp, Prunus mume
gttgtatggatcctcctcggtctcgctacgcgtgctgttgtcagctgaccatgtgcgtcttcgtctccctctgaatcctgagtttgatgtcagcttcccattttgaacttgaacggctcaaccccacaaccccaccaaaacataactctctcactttctctctctcactctcagtccccacttctctttgttgactttttcctccattttcacacacacaaaaacacccacttcacttcagctggtccaagttccatagactttgacaaagaaacaaaaagaaagcaagcagtggtggcatgtagcactcagcaatgggctgcttccagtccaaaacagcacacctcccttccccagaccaagaccctcctgtcacagatccagctaatggagaggaattagaagatgaacaagcagttcctgctttcaaagagttcagtctagcagagctaagagcagccaccaatgggttcaactcagaacttatagtctccgagagtggtgagaaggcgcccaatgttgtttacagaggcaagcttcgcaataatcgattggtggccattaaacgcttttctaagcaatcttggcccgacccacatcaatttttggcggaggctgccgggtttggcaaggttaggcacaaacgtttggtgaatttgatcgggtgttgtgctgagggagatgagaggctgttggtggcagagtacatgcctaatgatactctctcaaagcacctctttcactgggagaaacagccattgccatgggatatgcgtgtgagagttgcatactatattgcacaagcccttgatcattgcaatacagaaaaccgaaaactgtatcatgacttaaatgcatacagagttctctttgatgaggatggtgacccgcggttgtctagctttggtctgataaaaaatagccgagatggaaaaagctatagcactaacttggcttatactccacctgaatttttgcggacaggtagggtcattccagagagtgtgatctacagttatggaactgttcttcttgaccttttgagtggaaaacatatccctcctagccatgcactggacttgataaggggaaaaaatttgttattattaatggattcatccttagaaggacaatatgccaatgaagatgcaactgagttggttgaactggcctcaaaatgtcttcaatatgaggctaaagatcgaccagagattacatttcttctttcagctgtagcccccctccaaaagcagacagaggttgcttcacttgttctaatgggtttaactaaaactccagtggtgctgccaaccatgctttctccccttggaaaggcttgtgtacggatggacctttctgcagttcatgagattttgctaaaaactggttatagagatgaagagggtgcagaaaatgaactgtcatttcaagagtggacacaacaagtgcaagatatgttgaataccaagaaatttggggatattgcgtttagagacaaggattttaaaaatgctgtggagtattattcaaagttggtttccatgatgtctgttccttcgggtaccgtatttgtgaggcgagccctcgcctacttaatgaatggacagccagaattagctttgagagatgccatgcaagctcaggtgtgcttgcccgagtggccaactgccttctacatgcaggctctcgccctctccaaactaggaatggaaactgatgctcaggacatgctaaacgacggagcttcctttgaagcgaagaagcaaaacagctggcgcaattagattgtgaagctgaggagatggtggtgccagggtcttcgaattttcagccacttttcaccctgatgctgtggctgcttagggtccatgatcaaatgtaagcaggttagattgagggttattttacgttgacaccctcatcttctagttggaaaagtagttctacacaaatgtataaccaaaatttcagatgagaaataagtaactagatttgtaatcactcaaatttacgaagttcagttttctaacttggatttttgtgtacctgtacacccagaaaccctcaagaaacatgtccatgaatctccctttctgggagtgtcagctacttggtaaaatgtatatttttttaatgtgcataaaattcagtgagctactctttttaaataccaaggtattagtgaaaaatttcacattgaaatttaggacttcctgctcggctgccagacgtcgagacgtacattttatgcaacaatttcaatctcaccccca

SEQ ID NO: 1224 - DNA, 1635 bp, Prunus persica
cacacacaaaaacacccacttcacttcagcttgtccaagttccatagactttgtcactttgacaaagaaacaaaaagaaagcaagcagtggtggcatgtagcactcagcaatgggctgcttccagtccaaaacagcacacctcccttccccagaccaagaccctcctgtcacagatccagctaatggagaggaattagaagatgaacaagcagttcctgctttcaaagagttcagtctagcagagctaagagcagccaccaatgggttcaactcagaacttatagtctccgagagcggggagaaggcgcccaatgttgtttacagaggcaagcttcgcaataatcgattggtggccattaaacgcttttctaagcaatcttggcccgacccacatcaatttttggcggaggctgccggggttggcaaggttaggcacaaacgtttggtgaatttgatcgggtgttgtgctgagggagatgagaggctgttggtggcagagtacatgcctaatgatactctctcaaagcacctctttcactgggagaaacagccattgccatgggatatgcgtgtgagagttgcatactatattgcacaagcccttgatcattgcaatacagaaaaccgaaaactgtatcatgacttaaatgcatacagagttctctttgatgaggatggtgacccgcgactgtctagctttggtctgataaaaaatagccgagatggaaaaagctatagcactaacttggcttatactccacctgaatttttgcggacaggtagggtcattccagagagtgtgatctacagttatggaactgttcttcttgaccttttgagtggaaaacatatccctcctagccatgcactggacttgataaggggaaaaaatttgttattattaatggattcatccttagaaggacaatatgccaatgaagatgcaactgagttggttgaactggcctcaaaatgtcttcaatatgaggctaaagatcgaccagagatcacatttcttctttcagctgtagcccccctccaaaagcagacagaggttgcctcacttgttctaatgggtttaactaaaactccagtggtgctgccaaccatgctttctccccttggaaaggcttgtgtacggatggacctttctgcagttcatgagattttgctaaaaactggttatagagatgaagagggtgcagaaaatgaactgtcatttcaagagtggacacaacaagtgcaagatatgttgaataccaagaaatttggggatattgcgtttagagacaaggattttaaaaatgctgtggagtattattcaaagttggtttccatgatgtctcttccttcgggtaccgtatttgtaaggcgagccctcgcctacttaatgaatggacagccagaattagctttgagagatgccatgcaagctcaggtgtgcttgcccgagtggccaactgccttctacatgcaggctctcgccctctccaaactgggaatggaaactgatgctcaggacatgctaaacgacggagcttcctttgaagcgaagaagcaaaacagctggcgcaattagattatgaagctgaggagatggtggtgccaaggtctatgaattttcagccactttt

SEQ ID NO: 1225 - DNA, 2204 bp, Glycine max
atgtgaccttctctgctcctttcatcccttcatctctctcttctttttcacacttacttacttaccttttgagttttggccttttcatctctctctctcttctgtgtttccgccgctgcaacaagcaaagtagcagtgactcagtgacttgcaacattttcggtttaacatatcatatcaaacccattgaaccatcactcttgtctgctactgctcacgtatctcatcatgcccccctataccaatctagtcttatagtaatcttttcaagtttcaccttttgtttctatgtagaccacccccacttatatattactcacagccataataatcataatcatattaatcatttcacaatcataaccaaaaccatgggttgcttacactcaaaaaccgcacatcttcactcccctgaagaccctcctactgccttgccagactccaaaaaacccgatccagggaatggtggtgatgatgttgatcaagagtgtcaggttcaagcattcaaagagtatggtctgattgagcttagaagggccacaaatgagttcagcacagattacattgtttctgagagtggtgagaaagctcccaatgtggtctacagagggaagcttgagaacaatcggttagttgctgtgaaacgcttctccaaactgtcttggcctgatgctcaacagttcatggcagaggcagctggagttgggaaagtgaggcacaagagaatggtgaatctaattggttgttgtgctgaaggagatgaaaggctcttggttgctgagtacatgccaaatgatactttgtccaaacatctctttcactgggacaagcaaccattaccatgggaaatgcgtgtcagagttgcataccatgttgcccaggcactagatcattgtagcttggaaaaccataaaatatatcatgatctgaatgcatataggattctttttgatgaggatggtgatccccgcttatctagttttgggcttatgaaaaatagtcgagatgggaaaagctacagtactaatttagcttatactccacctgaatttttgcgaacaggcaggataatcccagagagtgtgatctacagttatggaactgttcttctggatcttttaagtggcaagcacattcctccaagccatgctttggacctaatcagagggaaaaatgttttgttgttgatggactcttctctagaagggcaatatgcaaacgacgatgctacaaagttggttgagcttgcttcaaaatgtcttcagtttgaggccagagaacgacctgaaattaagttccttcttactgccgttgcgcctcttcaaaggcagaaagaggtagcatctcttgtgttaatgggcctaactaaaaacaccgcagtggcagtgctaccaaccatgctttctcctcttggaaaggcttgtgctaggatggatcttactgctgtgcatgatatattgttaaaaacaggttataaagatgaagaaggtgcagaaaatgagctttcattccaagaatggacacaacaagtacaagatatcttgaacacaaaaaagtttggggatattgcattcagagacaaggatttcaaaaatgcaatcgagtattattctaagttggtggttatgatgtctgttccttctgctactgtgtttgcaaggagagccttctcctacttgatgaatgatcaagcagaacttgcattaagagatgccatgcaagcacaggtatgcataccggattggccaactgcattctacttgcaggctcttgccctctcaaagctgggaatggaaactgatgcacatgacatgcttaatgatggagctgcctttgaagcaaagaggtctaacagctggcgcggataaaatttctaatttgcagttctttgctcactaagctagcagagtggcataaaagaatatgctaatttttgccataatttgtacttcctagaataggaatatgtagggtgctagtttaaggggtaagaacaagggtataagatgtgttattacagtatagattttcccatacaaatgaatcctgtagaatgaattttctccatatgaaaataacaatgtgtatggatggggagttttgagggaggaattcaatttttaagtagatttaaaatatcacataaaatctagttgtttttatatattgaatatgaagaattttcaaaatgatagaaagtttag

SEQ ID NO: 1226 - DNA, 1729 bp, Chrysanthemum coronarium
tttaggagcacgctcttttggcctctgctcttcagtttttctataaaaaatgggctgttttcagtccaaaactgctaatgttcaatcccctgatcaagttcctgaatctaaaccagatccaggtgatggagaacaagtagcaggtcaacaggatcaagagcaagcagtgcccgtgtttaaagaatttgagttaacggaacttcgagcggctacaaatgggtttagtagtgaattaatcgtttcggaaagtggtgaaaaggctcctaatgtggtgtatagaggaaaactaaagaataataaagttgttgctattaagagattttcgaagctatcttggcctgacccgcaacaatttgtggcagaagctgctggagttggcaaggttcggcataatagattggtgaatctaattggctgttgcgcagagggagatgagcgtcttttagttgctgaatacatgcccaatgatacactatcaaagcatctatttcactgggataaacagcctttgccatgggaaatgcgtgttagagttgcttaccatattgcacaagcactcgagcattgcaatgcggagaatcggaaaatataccacgatttgaatgcatatagggttctctttgacgaggagggagaccctcgtttatctagttttggtttaatgaagaatagtcgtgatgggaagagctatagcactaatcttgcttacactcctcccgagtttctgaggacaggcagggtaattcctgagagtgttatttatagttatggaactgttctcctggaccttttaagcgggaaacatatccctccaagccatgcactggatttaatacgcgggaaaaacgttttgttgctgatggattcatccttggaaggacaatatgcagatgaagatgcaaccgtgttggttgaacttgcttccaagtgtcttcagtacgagggtagagatcgtcctgatgtcaaatttcttcttacagcagtggcaccacttcaaaagcagaaagaggttgcatcccatgtcttaatgggtctgacaaagactccggtggtggttccaactttactttctcctcttggcaaagcgtgtgcacggatggatcttactgcagtgcatgacattttgctaaaaacgggatatagagacgaagagggtgctgagaatgagctatcatttcaagaatggacccagcaagtgcaagatatgttaaatacaaagaagttcggggatatcgcgtttagggacaaggatttcaatgggtcagttgaatactattcgaagttggtaacgatgatgtctgttccgtctggtactatctttgtgaggcgggcactctcatacttgatgattggacaaccagaactcgcgttgagggatgcaatgcaagctcaggtatgcctgcctgagtggccgactgctttttacatgcaagctttagctttgtctaagcttggaatggaaactgatgctcaagacatgcttaacgatgggtcatccttcgaggcaaagaggcaaaacagttggcgtaattagaattcgaccagaggcaatgtttatttgaatcactactcgcctttctgtcgcagactacatttttcgatattagcattgtataaatcactttctaaatgccgaagaaactagtatttgagttgtgtcatttccgtgccttttacttaaacctttcgctggaagttcattttacttgcaataaattgaaggaaatgc

SEQ ID NO: 1227 - DNA, 2614 bp, Citrus sinensis
aaagaagagaaaaaattaaaaaagaaaagtaagaaagaggtgattcgattgatttcttgcatctttaatgatctgcgagcgcaggtagaggacgctccagtttagtttgtaaacttgactattttaacttcttgttgagtcctcgctcaccacttgctttgcttaccgtttctcctggcgtctctgttgttagaacttggaaaccgaaatgcaaatacaagtcagtcaacccccacaacaacgcctaccggccctaccccctatagctctctctctagccgtatataaataagtataccccatcccgtttgctttccacagccacagccactctttttatgaactctatgtattctctagattccaaacctaattactattactcctaccgcctgctggtatggtatgagtggatgattagtgggtgagtgaaatagttcttaattaattaaagcccaggagaaaaaaaaaagaaaaaagaaaaaagaagattcaaaattcaaaaaaataaaaataaaaagaaaaaggaaaagaaaatcctcctccacctcctcggaggcgagaagaagtggatgatgggttgttttcagtcgaagactgcacatttagcatcacctgataaagaagctcccgaagcaaagccagatctaggggaaggggaaggggaaggggaaggggaagaaggagaagaggaacaagtcccagcattcaaagagtttgttctagctgacctccgagccgccaccaacggcttcagcagcgagcttattgtgtcggagagcggagacaaagctcccaatgtggtctacagaggcaggctcaagaacaatcgcttggttgctatcaagcgcttctccaggcagtcttggcctgacccccaccagttcgtcaccgaagctgctggcctcggcaatgttcgccataagagattggttaatttgattggctgttgtgcggagggagatgagcgcttattggtcgctcagtacatgcctaatgataccctctccaagcacctttttcattgggataaacagcctttgccgtgggaaatgcgcgtcagagttgcttactacattgctcaggcacttgatcattgcaactctcaaaaccgcaaattataccatgatttaaatgcttacagggttctttttgatgaggatggtgacccgcggttatccagttttggtcttatgaaaaacagcagagatggaaaaagctacagcacaaacttagcttatactccaccagagtttttgcggacaggtagggtcatcccagagagtgtgatctacagttatggaactgtgctattggaccttttgagcggaaagcatatccctccaagccatgcattggatgtaataagggggaaaaatttactgctgttgatggattcatctttggaagggcaatatgctaatgaagatgcgactcaattggttgagctagcctcaaaatgtcttcaatatgaggctaaagatcgaccagatgttaaatttcttctttcggcggtggcacccctccaaaagcagacagaggttgcatcacatgttctgatgggtttatcaaaagctccagtagtactgccgactatgctatcctcacttggaaaggcttgtgcgaggatggatcttacagctgtgcatgatatcttgttaaaaactggttataaggatgaagagggtgcagaaaatgagctttcattccaagaatggacacaacaagttcaagatatgttgaatacaaaaaaatttggggatattgcattcagagacaaggatttcaaaaatgctatcgagtattactcaaagctggtatcaatgatgtctgttccttcgggtaccgtttttgtgagacgagcactgtcgtacctgatgattgaacaagcagagcttgccttgagagatgccatgcaggctcaggtttgcttaccagagtggcccactgccttctacatgcaagctcttgcacttaacaagcttggaatggaaactgatgctcaggacatgcttaatgatggagcctcctttgaagcaaagaagcagaatagctggcgcatttagacggatgtaagcaatttttttttttagatatttaaagagggttattttttcggttgacgtccccttctgtcctgacctgttctgttggcaaaatagtttctctctatcatatataaaagaaatgtgtaaaaagatcattaataggagaacaataagaagataagtgacaaacttgtagaattgttagtttattataatatccagcaaggagactaattagcttaagcttacagtattgtcatatccttctgtatggggtttgatatcaattgtgacatcaaagatactggcattagcattaacctcctcattattagcttttgtttggctttttggatgattacttattttacatgggtggagtaatttcacacatccagcttaaaagggtatgtaagccaccgtctgtcttgccaaaccccattctcaattttatttttaattttaaatacaaaatctatctttagtcaatactactacaatggacaaaaattacgtccaataacacagcagcacaaatctgattccttgtacgtactgattatgac

SEQ ID NO: 1228 - DNA, 1674 bp, Ocimum basilicum
actcctcgccatcatcattccacctctcttccttcactcccatctcctgcttctatctcatttactctcctcattaatcaaactctgattcacctcttgaatgagagctcgcttgtcatgggctgtttgcagtccaaaactgccaatgtccagtcccctgatcaagaaccctcacactccgactctaaaccagatctagcgaatggagagcaagtagatccagagcaagtgccagcattcaaggaatttgagcttgctgaactccgtgctgctacgaatggttttagcagtgagttgatagtttctgagagtggagagaaagctcctaatgttgtctataggggtaagctccgaagtaaccgcctagttgccatcaaacgcttctcaaagcaatcatggcctgatgcacagcagttcacgaccgaagctgctggagttggtaaagttagacacaaacgactggtgaatttaataggatgttgcgctgaaggagatgaacggctattagtagctgaatacatgcccaacgacacactctcaaagcatctttttcactgggataaacaacctctgccatgggaaatgcgtgtgagagttgcataccatatggcacaagctcttgaccactgcaatgctgaaaaccgaaaaatttatcatgatttaaatgcttacagaattctttttgatgaggaaggtgacccaaggttatctagttttggtttaatgaagaacagcagggatgggaagagttatagtaccaatctagcatatacacccccagagtttttgcgaacaggcagagttattcctgagagtgtgatatacagttacggaactgttcttctggacctattgagtggaaaacatattccgcctagccatgccttagatttaataaggggaaaaaatgttctattgctgatggactcatccttggaaggacaatatgctaacgaggatgcaacaacattagtcgaacttgcatctaagtgtctccagtatgaggcgaaagatagaccggatgtgaagttcttactcactgctgcgactccccttcaaaagcaggaggttgcatcacatgtactaatgggtctgacgaaaagcaaccccgttgttgctcctactttgctttctcctcttggaaaggcttgcgcaagattggatctcactgccgtacatgatattttgctcaaaaccggctataaagatgaagagggagccgaaaatgagctttcgttccaagaatggacgcagcaagttcaagatatgctaaatacaaagaaattcggcgatatagctttcagagacaaagatttcaagggcgcaatcgactactactccaagttggtatcaatgatgtctgttccatctggaacggtgtttgtgaggcgtgccatttcatatctgatgatcgggcagccggaattggctttgagggatgcaatgcaagctcaggtttgcttgccggagtggccgactgcattctacatgcaggctctggctctttccaagctgggaatggaaaccgacgctcaagacatgctgaacgacggtgccgccttcgaagccaagaagctaaacagttggcgcaactaagtttgctaatttctattaacccacttcatattacatatcttggagaatggtcacgtcacgtcataaagagagggaaga

SEQ ID NO: 1229 - DNA, 1795 bp, Cirsium arvense
taacaaaaattaaaaaaaaaggttaacagttcatcacactctccatcaacctcattcaaaatttctagggttttcatttccatcaccaccaccatcaccaccatatcacatcactctttttccttagaaattttatgtgattgaatcatcacaatgggctgttttcagtccaaaactgccaatgttcaatctcctgaccaggttcctcaatccaaaccagatccaggtgatggaggagagcaaggattaggattaggtcaacaggatcaagagcaagcagtccctgtgttcaaggagtttgagcttacggagcttcgagctgctaccaatggcttcagtagtgaccttatagtatcggaaagcggagagaaagctcccaatgtggtttatagagggaagcttcgtagcaatagagtcgttgcgattaagcggttctccaagctctcttggcccgatccacaacaatttgtggcagaagctgctggagttggcaaggttcggcatgatagattagtgaatctaattggatgttgtgcagaaggagacgagcgtcttttagtggctgaatacatgcccaacgatacactctcgaagcatctatttcactgggataaacagcctttgccatgggaaatgcgtgttagagttgcataccatattgcacaagcacttgagcattgcaatgcagaaaatcggaaaatctatcatgatctgaatgcctatagggtcctctttgatgaggacggtgatccccgcttatctagttttggattgatgaagaacagtcgagatgggaagagctatagcactaatcttgcatacactcctcctgaatttttgcgcacaggcagggtaattccagagagtgtgatttacagttacggaactgttctgctggatcttttgagcggaaagcatatccctccaagccatgcattggatttaatacgggggaaaaatgttttgctgctgatggattcatccttggaaggacaatatgctgatgaagatgcaaccgcaatggtggaacttgcttcgaaatgtcttcagtatgagggtagagatcgtccagatgtcaaatttcttcttacagcagtggcaccccttcaaaagcagaaagaggttgcatcacatgtgttgatgggtttgacaaagactccggtggttgttccaaccttactttctcctcttggcaaggcatgtgctcgaatggatcttactgcagtgcatgacattttgctaaaaacgggatatagagatgaagagggggctgaaaatgagctatcgtttcaagaatggacccagcaagtgcaagatatgctaaatacgaagaagtttggagatattgcatttagggacaaagatttcagtggtgcggttgaatactattcaaagttggttacaatgatgtcagtcccttcgggcaccatattcgtgcggcgggccctcgcatacttgatgctcggacaaccagagcttgcattgcgtgacgctatgcaagctcaagtatgcttgcccgaatggccaaccgccttttacatgcaggccctcgctctctcaaaacttggaatggaaaccgacgctcaagatatgctcaatgacgggtcctccttcgaggcaaagaggacaaaacagctggcgcaaactaaaaactacgtaatatgtgattaggtcgatgctatgttagcctccgcaaacactcgcttgtatttgaggcaattgttttatttaaatttaaaaaaacttgccattctcttggtagactacagttttcgatgttaattagcattgtata

SEQ ID NO: 1230 - DNA, 1752 bp, Panax ginseng
ttttcactctctccctaaagcttaagaccccagctaccctttcttcaatgtcgacacttctttttcactaaaaccccaactcataatgggctgcttccactccaaaaccacgcacctcccttatccagatgacccctccaaactcgattcagttaatggagataattgtggaggtgaggaagaccaagataataaccaagttcccgtatttaaagagtacgtactaaatgagcttaaaaaggccactaatggattcagcagtgactgcctcgtctccgagagcggagaaagagcccctaatgttgtttacagagcaaagctcgataataatcgatttgtcgccgttaagcgtttctccaaactgtcctggcctgaccctcaacaattcttggcggaagcagctggagtggggaagttaaggcataagagattggtgaatcttattgggggttgcgccgagggagatgagaggctattggtggcagagtatatgccaaatgatactctgtctaaacacctcttccactgggataagcagccattaccatgggaaatgcgcgtacgagttggatgtcatgttgcacaggcacttgatcattgcaatagtgaaaaccggaagatatatcatgatttgaatgcatatagagttctttttgtatgaggatggtgatcctcgtttgtctagttttggcctcgtgaaaaatagccgggatgggaagagctatagcacaaacttggcttatacaccacctgaatttttgcgaacaggcagggttatcccagagagcatcatctacagttatggaacagtactgttagatcttctgagtgggaagcatatccctccaagccatgcactggacctgataagggagaagaatgtattgttgttaatggactcatcattggaagggcagtatgccaatgatgacgctactaaattcgttgaacttgcttcaaaatgtcttcaggctgaggctagggatagacctgttaccaagtttcttattacagctgtatctcctcttcaaaagcaaaaggaggtggcatctcatgttttaatggggctaactaaaactgcgacagtggtaccaaccattctatctcctcttggaaaggcttgtgcaaggatggatcttactgctgtgcatgatatactgcttaaaacaggctataaggatgaagaaggtgctgaaaatgagctatcgtttcaagaatggacgcagcaggtgcaagatatgttaaacacaaagaagtttggtgatattgcatttagggacaaggatttcaagagtgcaattgaatactatacaaagttggtagttatgatgtctgttccatcggccactgtctttgcacgaagagccctctcctatttgatgaacgaccaagcagaacttgccttgagagacgccatgcaggctcaggtttgtataccggagtggccaactgcattctatttgcaagcgcttgcactctccaaacttggaatggaaactgatgctcaggacatgcttaacgacggggcagcatttgacgcaaagaagcagaacagctggcggaactagtacacaaactcttgtggcaaaaattatagcgctccctttctaactgagctatttgttccaattctacagtataaattttagctaaatgaggtcatgttagtggtagtgggaaatatattatgataatcgcgatttcaggaaatgtcaccaaatcccctgttaactatacacctacaggttgagc

SEQ ID NO: 1231 - DNA, 1910 bp, Petroselinum crispum
tgcatactctctcttctttcgcaggaaaaccagttccattcttgcccaaacaataaaagctctattttttcagtatttatttaataataaaaactcagctactacactttgtccttcaaatgtcaatgcttatttaactaaactcaaacagttaactccataatatgggttgtttcagctccaaaactgctcaccttccttctccagataacccctctaaacctgaatcagtgaatggagatgattccggagttgaagaagttgaagttaatcaagttcaggttttcaaagaatacgaactaaatgagcttagaaaagctacaaatggatttagcagcgattgtattgtctctgagagtggtgaaagagctccaaatgttgtttacagagccaagcttgagaacaatcactttgttgctgttaagcgcttttccagacaatcttggcctgatccccaacagttcttggcggaagcagctggagtagggaagctaaggcataaaagattggtgaatctgattggggcttgtgccgaaggcgatgagagactgttagtggctgagtatatgccaaatgatactctgtctaaacacctcttccattgggataaacagccactgccatgggaaatgcgtgtacgagtagcatatcatattgcacaagcacttgatcattgcaatatggaagaccggaagatctatcatgatttgaatgcatatagagttctttttgatgaggatggtgagccttgtttgtcaagtttcggtctcatgaaaaatagtcgtgacgggaagagctacagcactaacttggcttatacaccacctgaatttttgcggactggcagggttattcctgagagcgttatctacagctatggaacagttctgctagatcttctgagtgggaaacatatccctccaagccatgctttggacttgatacggggaaaaaatgtcttgctgttgatggactcatcaatggaagggcagtatgccaatgatgatgccaccaaatttgttgaacttgcttcaaaatgtctccaggccgaggctagggaccgacctgatagcaaatttcttctttcggcagtttcaccattgcaaaagcagaaagaggtggcatctcatgttttaatggggcttacaaaatctgcaccagtggtcccaaccattttctctcctcttggaaaggcttgtgtgaggatggatcttactgctgtgcatgatatactgcttaaaactggttacaaggatgaagagggtgctgaaaatgagctgtcatttcaagaatggacgcagcaggtgcaggaaatgttaaacacaaaaaagtttggagatatagcattcagggacaaggattttaagagtgcaatcgattactattcaaagctggtagtgatgatgcctgctccctcggctactatctttgcacgaagagctctttcctatttgatgaacgaccaagcggaacttgcattacgagatgcaatgcaggctcaggtttgcatacaagagtggccaactgcattttatctgcaagcgcttgcgctctccaaacttggcatggaaactgatgctcaggatatgcttaatgatggagcagcattcgactcaaagaagcaaaacagttggagaaattaagaagtgatttccacttcaaactgataaatcttcatttcgtcttgttggatttattagtttaatctcgagctgaatcaggtcagtgctagtggtaggtgtaaaatatattatgacacttatctttacaagaaatgtcatcctgtcccctggcggggttttgaccaatatacaggtaataagttgtcaagcctttattggaattgtgatggcgataagtaggctttgaacgcacttgtatgacatgatatcaatggaaaagaattaatg

SEQ ID NO: 1232 - DNA, 1848 bp, Centaurea maculosa
aaaaaaaaaggttcagttcatcacactctccaatcaacctcattcaaaattctagggtttcatttccatcatcaccaccaccaccaccacatcacatcactctttttcctagaatttttatgtgattgaatcatcacaatgggctgttttcagtccaaaactgccaatgttcaatcccctgaccaggttcctcaatccaaaccagatccaggtgatggagagcaacaaggattaggtcaacaagaacaagagcaagcagtccctgcattcaaggagtttgagcttacggagcttcgagctgctaccaatggcttcagtagtgaccttatagtatcggaaagcggagagaaagctcccaatgtggtttatagagggaagcttcgtagcaatagagtcgttgcgattaagcggttctccaagctctcttggcccgatccacaacaatttgtggcagaagctgctggagttggcaaggttcggcatgatagattagtgaatctaattggatgttgtgcagaaggagacgagcgtcttttagtggctgaatacatgcccaacgatacactctcgaagcatctatttcactgggataaacagcctttgccatgggaaatgcgtgttagagttgcataccatattgcacaagcacttgagcattgcaatgcagaaaatcggaaaatctatcatgatctgaatgcctatagggtcctctttgatgaggacggtgatccccgcttatctagttttggattgatgaagaacagtcgagatgggaagagctatagcactaatcttgcatacactcctcctgaatttttgcgcacaggcagggtaattccagagagtgtgatttacagttacggaactgttctgctggatcttttgagcggaaagcatatccctccaagccatgcattggatttaatacgggggaaaaatgttttgctgctgatggattcatccttggaaggacaatatgctgatgaagatgcaaccgcaatggtggaacttgcttcgaaatgtcttcagtatgagggtagagatcgtccagatgtcaaatttcttcttacagcagtggcaccccttcaaaagcagaaagaggttgcatcacatgtgttgatgggtttgacaaagactccggtggttgttccaaccttactttctcctcttggcaaggcatgtgctcgaatggatcttactgcagtgcatgacattttgctaaaaacgggatatagagatgaagagggggctgaaaatgagctatcgtttcaagaatggacccagcaagtgcaagatatgctaaatacgaagaagtttggagatattgcatttagggacaaagatttcaatggtgcggttgaatactattcaaagttggttacaatgatgtcagtcccttcgggcaccatattcgtgcggcgggccctcgcatacttgatgctcggacaaccagagcttgcattgcgtgacgctatgcaagctcaagtatgcttgcccgaatggccaaccgccttttacatgcaggccctcgctctctcaaaacttggaatggaaaccgacgctcaagatatgctcaatgacgggtcctccttcgaggcaaagaggcaaaacagctggcgcaactaaaaactacgtaatatgtgattaggtcgatgctatgttagcctccgcaaacactcgcttgatttgaggcaatgttttatttaaattttaaaaaacttgccattctcttggtagactacagttttcgatgttaattagcattgtataaatcgcttctaaaatgctgaaaaaaatttagcattcgagttgaaaaaagaaaaaagtaccgactgcgtggccgctcgt

SEQ ID NO: 1233 - DNA, 2073 bp, Nicotiana benthamiana
ctcactttctcttctttgctttcactaatcattagctcctcctaacttccctatctattgtccactaagtttaaaaaaagatacaatcttttatcgatttttcagcaccccattttgattcttcgagttatatagactgtgcttgtcatatttgtctatgtgagctgatgaaaaatgggctgtttacagtccaaattcaaaactgcaaatgttcagtcccctgataaagaaccttctcagcctgactctaaaacagatcttgctaatggggatcaagtagacctagatcaagtgcctgcattcaaggaatttagtcttgccgaactccgatcagcaacgaatggctttagcagtgaattaatagtttctgaaagcggcgagaaagctcccaacgttgtctacagagggaagcttcggtgcaacaggatagttgccatcaaacgcttctccaggcagtcatggcccgacgctcaacagttcgcggcagaggcagctggagtgggcaaggttcggcataagagattagtgaatctaattggatgttgtgctgagggagatgagcgtctattggttgcagaatacatgcctaatgatactctctcaaagcatctcttccactgggagaaacaacctttgccttgggagatgcgagtgagagttgcatactatattgcacaggctctggatcattgcaatgatgaaaacagaaatatatatcatgatttgaatgcttacagagttctttttgataaggaaggtgaccctcgattatctagtttcggtcttatgaaaaacagcagagatggaaagagctatagcaccaatcttgcttatacgcctcctgagtttttgcgcacaggccgggtaatcgcagaaagtgtgatgtacagctatgggactgttctgctggacctgttaagtggaaagcatatccctccaagccatgcactagacttaattaggggtaaaaatgcgttgttattaatggattcatccttggaaggacaatatgtcgatgaagatgcaactgcattggttgaacttgcctcaaaatgtctccagtacgaggcaagggatcgacctgatatcaagttcattcttaatgcagtggagccccttcagaagcaggaggtggtcgcatcacatgttctgatgggtctaacaaaaactccagtggtgcttccaaccatgctctctcctcttggaaaggcttgtgcgaggatggacctcactgctgttcatgatatcttacttaaaacaggttataaagatgaggagggtgctgaaaatgagctctcattccaagaatggacccaacaagttcaagatatgttaaataccaaaaaatttggggatatagctttccgggacaaggacttcaagagtgcagttgattattattctaagttggtatcaatgatgtctgttccttccggcactgtttttgtgaggagggcactttcctacatgatgataggccaaccagaactcgctctaagggatgctatgcaagcgcaggtttgcttgcccgagtggcctactgcattctatatgcaggctcttgccctatccaaacttgggatggaaactgatgcacaagacatgctcaatgatggagcctcctttgaagcaaagaagctaaacagttggcgcaactgattctggcacgctaggtgaatctagaatgtctcatcttttatcgaagctggaggtagctatagtaaagatgacagaggatactaaagaaccaaaggtgatgtggtgcttttggggttatatttatctcagcccccactcttttgtagctaatacagttccatacagacaatgtataaagtaagtactctggtgaaaaccctcagtagtttagtttgcgatgaatgccaattcttagctttggaacttatcaagaattctttcattgtcatgtttgggtaaaaattactgccaaggtctggtttgctatttacacttactttgccagttgatcgtattatgcagattatagtgattgtataattgagtctaaaatttagacattgttgaattgagtagaaattttgacgagtacct

SEQ ID NO: 1234 - DNA, 1605 bp, Plantago ovata
tattcaccatcaagatcaaacccatcaaccttttttagctcaagataataaaagtacaagtgagagtttacaagtgtgtgaatgtgagcaaactcaaatgggctgtctccagtccaaaactgccaatgtccagtcccctgaccaagaacccccacaacccgacccgaaatcagatctggcaaatggggaacaagtagatacagaacaagtgcctgcattcaaggaattcggacttgcagaacttcgtgccgctacgaatggttttagcggtgaacttattgtttcagagagtggagagaaagctcctaacgttgtctatagaggtaaactcaggagtaaccggcttgttgctattaagcgcttctcaaagcagtcgtggcctgattctcagcaatttgtggcagaggcttctggagttggtaaacttagacataagagattggcaaacttaattggatgctgtgctgaaggagatgagcgtctattagttgcggagtatatgccaaatgatacattgtcgaaacatctctttcactgggataaacaacctctgccatgggaaatgcgtgtgagaattgcatatcacgtggctcaagcacttgatcactgcaatactgaaaaccggaagatctatcatgacctgaatgcttaccggattctttttgatgaggaaggagaccccaggttatctacatttggtttgatgaaaaacagtagggatgggaagagttacagcaccaatttggcttacacaccccctgagtttttacgcacaggcagagtcatcccagaaagtgtggtgtacagttatggtactgttcttcttgacctcttgagcggaaaacatattccacctagccatgctctggatttaataagagggaagaatgttctaatgttaatggactcatctttggaaggacaatatgctaacgaagatgctacagcgttggttgaactcgcctcaaagtgcctacagtatgaagccagagataggcctgacatcaaatttcttcttacttcagtcacaccgcttcaaaagcagcaggaggttgcgtctcttgtgctgatgggtctgacgaaaactcctgtcgtcctgcccaccatgctttctcctctgggaaaggcttgtgcgagaatggatctcactgctgtacatgaaattttgctcaaaactggatataaagacgaagagggtgcagaaaatgagctctcattccaagagtggacgcaacaagttcaagatatgctaaacacaaagaaatctggagatatttcattcagggacaaggattttaagaatgcaatcgaatcctactccaagctggtttcgatgatgtctgttccatctggcacggtatttgtgagacgggccctctcgtatctaatgataggccaaccagaactagcactgagagacgccatgcaagcccaggtctgcttaccagagtggcctacggcattctacatgcaggctctggccctatccaagctcggaatggagaccgatgctcaagacatgctgaacgatggagcctcgttcgaagccaagaagcaaaacagctggcgcaactaagttattctctaatgtacgtatggttcttc

SEQ ID NO: 1235 - DNA, 1957 bp, Arachis hypogaea
tctctatgcgaagcagtggtatcaacgcagagtacgggggggttttggccttttccctcctctctctctctctcttacaagaactctttccctcttttgtgtgtttccgccgctgcaacaaccaacaccaacagcagcagcagtagtaagactgagtcactcacttgcaacatcatcatcatcatcatcatcaagaatctttcactcttcttcttcttcatcatcagaatcaagtgctgtgtgtgtgctacttcaaccaaaagcactttctaacttgtttctatgtagacaccgacagcaccaccacattctcatattgatcataataataataacagaatggggtgtttacattcaaaaaccgctcatcttcaatctcctgaagaccctcccactgacttaccagaccccaacaagcccgatccaggtgatggggttggtggtgatgatggtgaagagagtgaggttccggcattcaaagagtatagtttaagtgaactgagaagggcgacaaatgagttcaacgcaaagaacatagtttcagagagtggagagaaagctccgaacgttgtgtacaaagggaagcttgagaacaatcgcttcgttgctgttaagcgtttctccaaactttcttggcctgatgctcagcagttcatggtagaggctgctggagttgggaaagtgaggcacaagagactggtgaatctaattggctgttgcgccgaaggagatgagcggctcttggtagccgagtttatgccaaatgatactttgtcaaagcatctctttcattgggataagcaaccgttaccatgggaaatgcgtgttagagttgcataccatgttgctcaggcattggatcattgtagcaacgaaaaccggaaaatatatcatgatctgaatgcctataggattctcttcgatgaggatggtgatccccgtttatctagttttgggcttatgaaaaatagtcgagatggaaaaagctacagtactaacttagcatataccccacctgaatttttgcgaacaggtaggataatccctgagagtgtgatttacagttatggaactgttcttctggatctattgagcggcaagcatattcctccgagccatgcactagacctaattagagggaaaaatgtattgatgttgatggactcgtccctcgaagggcaatatgcaaatgatgatgctacaaagttggttgagcttgcttcaaagtgtcttcagtttgaggctagagaacgacccgatatcaattttcttcttactgcagttacaccccttcagaagcagaaagaggtagcatcacatgtgttaatgggccttacagtgaataatacaccggtgcttccgaccatactttctccccttggaaaggcatgtgcgagaatggatcttactgcggtgcatgatatattgttaaaaactggttataaagacgaagaaggtgcagaaaatgagctttctttccaagagtggacacaacaagtgcaagatatattgaacacaaaaaagtttggggatattgcatttagagacaaggacttcaaaaatgcaattgagtattattctaagttggtggttatgatgtcggttccttctgcaaccgtctttgcaaggagatccttctcctacttaatgaacgatcaggcggaacttgcgttacgcgacgccatgcaggcgcaggtgtgcatatgtgattggccaactgcgttctacctgcaggctctcgcgctctcaaagctgggaatggacacagatgctcaggacatgcttaatgatggagcagcctttgaagccaagaggtctaacagttggcgtggctagtaaaatgctaattttgctgttctttgctcattaaactagaagagtggcatcaccagaaagacagacaaaagtgatgttttgatgtaatttgtactttggtagaatagagaatatgtagggt

SEQ ID NO: 1236 - DNA, 1799 bp, Chrysanthemum coronarium
ttcacacaaacactaaaaccacaaacacttcttttcacacacccaaatcagcaaacaccatatttttaggggtttttctataaaacactagtcataagttttttataaaattttatgtgattaagttttctataaaaaaatgggctgttttcagtccaaaactgctaatgttcaatcccctgatcaagttcctgaatctaaaccagatccaggtgatggagaacaagtagcaggtcaacaggatcaagagcaagcagtgcctgtgtttaaggaatttgagctaacggaacttcgagcggctacaaatgggtttagtagcgaattaatcgtttcggaaagtggtgaaaaggctcctaatgtggtgtatagaggaaaactaaagaataataaagttgttgctattaagcggttttcgaagctatcttggcctgacccgcaacaatttgtggcagaagctgctggagttggcaaggttcggcataatagattggtgaatctaattggctgttgtgcagagggagatgagcgtcttttagttgctgaatacatgcccaatgatacactctcaaagcatctatttcactgggataaacagcctttgccatgggaaatgcgtgttagagttgcttaccatattgcacaagcactcgagcattgcaatgcggagaatcggaaaatatatcacgatttgaatgcatatagggttctctttgatgaggatggagaccctcgcttatctagttttggtttgatgaagaatagtcgtgatgggaagagctatagcactaatcttgcttacactcctcccgagtttctgaggacaggcagggtaattcctgagagtgttatttatagttatggaactgtcctgctggaccttttgagcgggaaacatatccctccaagccatgcattggatttaatacgcgggaaaaatgttttgttgctgatggattcatccttggaaggacaatatgcagatgaagatgcaactgtgatggttgaacttgcttccaagtgtcttcagtacgagggtagagatcgtcctgatgtcaagtttcttcttacagcagtggcaccacttcaaaagcagaaagaggttgcatcccatgtcttaatgggtctgacaaagactccggtggtggttccaaccttactttctcctcttggcaaggcgtgtgcacgaatggatcttactgcagtacatgacattttgctaaaaacgggatatagagacgaagagggtgctgagaatgagctatcatttcaagaatggacccagcaagtgcaagatatgttaaatacaaagaagttcggggatatcgcgtttagggacaaggatttcaatgggtcagttgaatactattcgaagttggtaacgatgatgtctgtcccgtccggtactatctttgtgaggcgggccctctcgtacttgatgattggacaaccagaactcgcgttgagggatgcaatgcaagctcaggtatgcctgcctgagtggccgactgctttttacatgcaagctttagctttgtctaagcttggaatggaaactgatgctcaagacatgcttaacgatgggtcatccttcgaggcaaagaggcaaaacagttggcgtaattaaaattcgaccagaagcaatgtttatttgaatcactactcaccttctgtcgtagactacatttttcgatattagcattgtataaatcactttttaaatgccgaataaactagtatttgagttatgtcatttccgtgccttttataacatttcgttggaagttctttgcatgcaataa

SEQ ID NO: 1237 - DNA, 2606 bp, Citrus clementina
aaagaagagaaaaaattaaaaaagaaaagtaagaaagaggtgattcgattgatttcttgcatctttaatgatctgcgagcgcaggtagaggacgctccagtttagtttgtaaacttgactattttaacttcttgttgagtcctcgctcaccactactttgcttaccgtttctcctggcgtctctgttgttagaacttggaaaccgaaatgcaaatacaagtcagtcaacccccacaacaacgcctaccccctgtacctctctctctagcagtatataaataagtatacccccatcccgtttgctttccacagccacagccactctttttatgaactctatgtattctctagattccaaacctaattactattactcctactgcctgctggtatggtatgagtggatgattagtgggtgagtgaaatagttcttaattaattaaagcccaggagaaaaaaaaaaagaaaaaagaaaaaagaagattcaaaattcaaaaaaataaaaataaaaagaaaaaggaaaaggaaatcctcctccacctcctcggaggcgagaagaagtggatgatgggttgttttcagtcgaagactgcacatttagcatcacctgataaagaagctcccgaagcaaagccagatctaggggaagtggaaggggaaggggaaggggaagaaggagaagaggaacaagtcccagcattcaaagagtttgttctagctgacctccgagccgccaccaacggcttcagcagcgagcttattgtgtcggagagcggagacaaagctcccaatgtggtctacagaggcaggctcaagaacaatcgcttggttgctatcaagcgcttctccaggcagtcttggcctgacccccaccagttcgtcaccgaagctgctggcctcggcaatgttcgccataagagattggttaatttgattggctgttgtgcggagggagatgagcgcttattggtcgctcagtacatgcctaatgataccctctccaagcacctttttcattgggataaacagcctttgccgtgggaaatgcgcgtcagagtttcttactacattgctcaggcacttgatcattgcaactctcaaaaccgcaaattataccatgatttaaatgcttacagggttctttttgatgaggatggtgacccgcggttatccagttttggtcttatgaaaaacagcagagatggaaaaagctacagcacaaacttagcttatactccaccagagtttttgcggacaggtagggtcatcccagagagtgtgatctacagttatggaactgtgctattggaccttttgagcggaaagcatatccctccaagccatgcattggatgtaataagggggaaaaatttactgctgttgatggattcatctttggaagggcaatatgctaatgaagatgcgactcaattggttgagctagcctcaaaatgtcttcaatatgaggctaaagatcgaccagatgttaaatttcttctttcggcggtggcacccctccaaaagcagacagaggttgcatcacatgttctgatgggtttatcaaaagctccagtagtactgccgactatgctatcctcacttggaaaggcttgtgcgaggatggatcttacagctgtgcatgatatcttgttaaaaactggttataaggatgaagagggtgcagaaaatgagctttcattccaagaatggacacaacaagttcaagatatgttgaatacaaaaaaatttggggatattgcattcagagacaaggatttcaaaaatgctatcgagtattactcaaagctggtatcaatgatgtctgttccttcgggtaccgtttttgtgagacgagcactgtcgtacctgatgattgaacaagcagagcttgccttgagagatgccatgcaggctcaggtttgcttaccagagtggcccactgccttctacatgcaagctcttgcacttaacaagcttggaatggaaactgatgctcaggacatgcttaatgatggagcctcctttgaagcaaagaagcagaatagctggcgcatttagacggatgtaagcaatttttttttttagatatttaaagagggttattttttcggttgacgtccccttctgtcctgacctgttctgttggcaaaatagtttctctctatcatatataaaagaaatgtgtaaaaagatcattaataggagaacaataagaagataagtgacaaacttgtagaattgttagtttattataatatccagcgaggagactaattagcttaagcttacagtattgtcatatccttctgtatggggtttgatatcaattgtgacatcaaagatactggcattagcattaacctcctcattattagcttttgtttggctttttggatgattacttattttacatgggtggagtaatttcacacatccagcttaaaagggtatgtaagccaccgtctgtcttgccaaaccccattctcaattttatttttaattttaaatacaaaatctatctttagtcaatactactacaatggacaaaaattacgtccaataacacagcagcacaaatctgattccttgtacgtactgattatgac

SEQ ID NO: 1238 - DNA, 2784 bp, Populus trichocarpa
gacaatctccttctctttcctcaactttttttttccttgttttggaactgccttctcctcctcaacttcttcatgtctgccttcatccttgtttcagagcaatataagcatacgatgacgatgacgatgacgaaataacagtttccaacaacaattatttaataaaaaatgaaatcagtttgctccaccatacactcactgtctgaaaaacttgagccagaaaaaagaaaaaagaaaaaagaaaaaagaaaaaactaatatatatgttctctctctcttcacgtgctggcgatgaactagtcatgtgacctccctcgtctctagtgttttgagcatgcagacaagagagagaagaaggcctgatcacctccctccttcaagtctttttgacttttgagttccatcttcactactaccttgccattctcagtgggattggagtggagatggtatcattataaagcagtagcagtgtctggtggtagcgatcaaagaaagaagaccccaactccaagtcagtcaacctccattaaatttacataatcttcaacctttccttcccaaccacttcatttacgccccgctaaaataaatgaataaatgttgatttcatactactgctactaggctagttcttctgctactgtgtatttctcttataggaaaaaagggatagtatagtctgtcctcttcctgtaataatgggctgtttccagtccaaaaccacccatctagcttctcctgatctagaccctcctctccctgaagaagccaagccagatctacccgctaatgaccaacctgactcccaagaaaatcacgatcaagaccaactcgtcccccccttcagggagttctccttggccgagcttcgaggcgccaccaatggattcagcagcgatttgattgtatccgagagtggagagaaggctcccaatgtggtttacagaggaaagctcaagagtaataataacaatagtcacaggcttgttgctgtcaagcgtttctccaggctctcttggcctgacccgaaccagtttctcactgaggcttctggggttggaaaagttcgccataacagattggtcaatttgattgggtgctgtgcggagggtgatgagcgcttgttggtggctgaatacatgcctaatgacactctctctaagcatctttttcactgggaaaaacagcctttgccatgggaaatgcgtgtcagagttgcttattacattgcccaagtgcttgatcattgcaatgcccagaaccgcaagatttaccatgatttgaatgcctacagagttctttttgatgaggatggtgacccccgattatctagttttggcttgatgaaaaatagccgggatgggaaaagctacagcacaaatttggcttacacaccgccagaatttttgcgaacaggtagggtcatccctgagagtgtggtatacagttatggaactgttctactggatcttctgagtgggaaacatatccctccaagccatgcattggatttgataagagggaagaatttattattgctgatggactcatccttggaaggacaatatgcgaatgaagacggaactgctttggttgaactagcctcaaaatgtctacagtatgagtccaaagatcgacctgacattaagtttctccttacagcagtggcccctctccagaaacaaaaagaggttgcgtctcatgtgctaatgggtctatctaaaactccagcagcgctgccaaccatgctttccccacttggaaaggcttgtgcaaggatggatcttactgcagtgcacgaaattttgcttaaaacaggctataaagatgaagaaggtgcagaaaatgagttgtcatttcaagagtggacacagcaagtacaagatatgctgaatacaaagaaatttggggatattgctttcagagacaaagattttaaaaatgccattgaatattatacaaagttggtatcgatgatgtctgttccttctggtactatttttgtgaggcgagccctgtcgtacttgatgattggccaggaagagcatgcattgagagatgcaatgcaggctcaggtgtgtttgccggagtggcccaccgcattctacatgcaagctctggcgctgtccaagctgggaatggaaagcgatgctcaagacatgcttaatgacggggcctcatttgaagcaaagaagcagaacagctggcgcatttaaaattatgaaggccctgctgtcgtcggcatgggtttgggcggcaactggggaagaaatcttgcgagggcaattatatttaggagtggatgttgcctcccttttttcagaaaacgtagtaattttcccacagaaaaaaaaaaacaaaatatatataaaaaacttaatttagatgagaagaaataagtagagaaaacagcaaagctagagccaatccccttaagcaagcgtcctagctgcctacgtagcgggtgggtaagaacgaagtggtgtaactcttttggcatgcgagccaatgcagagggcggcggcggcggcagcagctggatgatgatggattaaggagactcgtcagaaacagcagtaaactatgttgtcaaccagtttgaggtgtaatagatgaagagaagagtgaaaaggttgttgttgttctgcaaactgcttgtgcttgaaagacaaccaccacagccaatgaatgaatgaaatatagtgttgagaacattttttgttttgggtagtgtttgttttcgaggataagtgtttttgaaaatatattttttaaaattaa

SEQ ID NO: 1239 - DNA, 1900 bp, Musa acuminata
tctctacgccttccgcggcccctccgaagctgatgggattctagggctcggaccgtcgccgttggagatgggctgcttccactccaagaccaccaacgtccagtcccccgacgacgagtccctcgtcgccgtcaagacagatccactcaatggggacacgagggagcaggaccaggtgccggtgttcaaggagtacgggcttgctgagctgagggcggccaccaaagggttcagccccgagacgatcgtttccgagagcggcgagaaggcgccgaacgtggtgtaccgggggaagctcgaggggggccggctggtggccgtgaagaggttctcgaagcagtcgtgggccgacgcccagcagtttgtggcggaggcggcgggcgtggggaagttgcggcataaaaggttggtgaacttgatcggatgctgtgcagagggtgatgagaggcttctagtgtcggagttcatgcctaatgatacattgtccaagcatctcttccactgggataagcacccattaccatggcagatgagagtgagggtggcatactacattgcccaagcacttgaccattgtaatactgagaatcggagaatatatcatgatctaaatgcttatagagttctatttgatgaggatggggatcctcgcttgtctagcttcggtctaattaaaaacagccgagatggaaaaagttacagcactaatcttgcttacactccaccagagttcatgcgcactggcagggtaattccagaaagtgtaacctatagttatggaacagttctcttggatcttttgagtgggaagcatattcctcctagtcatgctctagatcttataagaggaaaaaacatgttacttataatggattcatccttggaggggcaatatgctaatgaagatgctaccaagcttgttgaattagcctcaacatgtctacagtttgaggctagagatcggcccaattctaagtctcttctctctgccttggaacctctgcaaaatcagaaagaggtgccatcgcacgtattaatgggcataacaaaagcaacacaagtactaccaacaatgcttgctccacttggaaaggcttgtgtaaatatggacctaactgctgtgcatgatatattgctcaagacaggttacaaggatgaagaaggtgcagaaaatgagctttcttttcaagaatggactcaacgagtgcaagagatgttgaatacaaagaagtttggagacattgcatttagagataaagatttcaaaagtgctattgagtattattctcagttggtggcaatgatgtcagttccatcagccacggtttttgctaggcggggcctgtcgtacttgatgaatggccaaccagagcttgcactgagagacgccatgcaagcgcaggtgtgtatgcccgaatggccagtagccttctacttgcaagctctatccctatcgaaacttggaatggaaaccgatgcccaggacatgctcaatgacggggtcgccttggaactcaagaggcagagcagctggcgaggctagatgacatggattcaaccctcgtgggtctccttgcagttctacatgtttatcttcagtagtcaagagcaggagagtagtaacttgatagaggctattggtgagaaagtggagctgcggcctccaacagtggatgtggatgtggatgctgagaagggaaccagccgatttattgtacaggatctcgagggaaagaatgattagttatagtgaagttccataaacaatgcattagaatcttcatttatggtcgtattgatgttctgcttgtaatcataacaaaggtgggatatgtagcatggatatgagaatctatgaatctccactgggacaagtacaaaaattaactagaacttaata

SEQ ID NO: 1240 - DNA, 1749 bp, Cichorium intybus
acactctccatcaacccccaaaactcccctcacttgtacatttctagggttttcattcattacaactaaaagagagtgttttctttgaaatttatgtgaagaaatcatcagaaatgggctgttttcagtccaaaaccgccaatgttcaatctcctgaccaagtacctgaatcgaaaccagatccaggtgatggagagcaaggattaggtcaacaggatcaagagcatgccgtccctgcattcaaggagtttgaacttacagagcttcgagctgctacaaatggcttcagcagtgagcttatagtttcggaaagcggtgagaaagctcccaatgtggtttatagaggaaaacttcgtagcaataaagtcgttgccattaagcgcttctccaagctctcttggccagacccccaacaatttgtggcagaagcttctggagttggtaaggttcggcataatagattggtgaatctaattgggtgttgtgctgagggcgatgagcgtcttttagtggctgaatacatgcccaatgatactctttcaaaacatctatttcactgggataaacagcctctaccatgggaaatgcgtgttagagttgcataccatattgcacaagcacttgagcattgcaatgcggaaaataggaaaatttatcatgatttgaatgcttatcgggttctttttgatgaggacggtgacccgcgcttatctagttttggtttaatgaagaacagccgagatgggaaaagctacagcactaatcttgcttacacacctcccgagtttttgcgaacaggcagggtaattccagagagtgtgatttacagttacgggacagtactccttgacctattgagcggaaagcacatacctccaagccatgcattggatttgatacgtgggaaaaatgttttattgctgatggattcatcattggaagggcaatatgcagatgaagatgcaaccgtgatggtggaacttgcttcaaagtgtcttcaatacgagggtagagatcgtcctgatgtcaaattccttcttacagctgtcgcaccccttcaaaagcagaaagaggttgcatcacatgttttaatgggtctaacaaaaacacccgtaattgttccaaccttactttcacctcttggaaaagcatgtgcacgaatggacctcactgcagtacacgacattctgctaaaaactggatatagagacgaagagggcgctgaaaacgagctatcatttcaagaatggacgcagcaagtgcaagacatgctaaacacaaaaaagtttggagatattgcatttagggacaaggattttaacggtgcagttgaatactactcaaagttggttacaatgatgtcggtgccttcggggacaatctttgtgaggcgggccctgtcttatttgatgattggacaaccggaattggcattgagggatgcaatgcaagctcaggtgtgcttgccggaatggccaaccgccttttacatgcaggcattggctctctcgaagctcggaatggaaacagatgctcaagatatgttgaatgacgggtcgtcatttgaggcaaagaaacaaaacagctggcggaattaagattccgaactttgcgataattttaaatgatgtggatgtgatgtggcacaagggttgtgtgatgaaattactacccacttgtctgtctacagtttttgaaattagtttgtataaattatttctgaaatgtcgaaaaaaactagtatttgag

SEQ ID NO: 1241 - DNA, 1894 bp, Aquilegia formosa
ttattactattactataattatgggttgtttacagtcaaaaacaagtaatgttcaatcacctgatgatgataatgaagaagaagaaacaatacaagttgatttaaaaccagcagatgcagatgcagatgtagatgtagatcatcaagttggaggagtagtagttttattagatcaaattccgattttcaaggaatatagtttatctgaacttcgaaatgctactaatggatttagttccgattatattgtttctgaaagtggtgaaaaagctcctaatgttgtttatagagcaaaacttgagaataatcgattagttgctgttaaacgtttttcaaaattatcttggcctgatgctcatcagttcattgtggaagcagcaggagtagggaaacttcggcataagagattagtaaatctcatcgggtgttgtgctgaaggagatgaacggttgttagttgctgagttcatgcccaatgatactctttccaagcatcttttccactgggacaagcagccattgccatgggaaatgcgattgagggtcacacaatatattgcgcaagcacttgaccattgtaatactgaaaaccggaggatttatcatgatttgaatgcttacagaattctttttgacgaggatggcgaccctcgtttatccagttttggccttatgaaaaatagtcgagatgggaagagctatagcacaaatctagcttatactccacccgagtttttaaggacaggtagagtcatcccggagagtgtgatctacagttatggaacaattttattggaccttttgagtggcaagcatatcccacctagccatgctcttgatttgataagaggcaaaaatgtattattgttgatggattcatcgttagagggacaatatgctaatgaagatgctaccaagttggttgaacttgcttcaaaatgtcttcagtctgaggccagagatcgaccaaatacaaaatttcttgtaacatcagtagcacctcttcaaaagcagagagaggtggcatcgtatgtactcatgggcctgcaaaaaaacacggcagtgctgccaacaatgctttctcctcttgggaaggcttgtgccaggatggatcttacggctgtgcatgatatcttgctaaaaactggttacaaggatgaagagggtgcagaaaatgagctgtcattccaagaatggacacaacaagtgcaggatatgttgaatacgaagaaatttggggatattgccttccgagacaaggattttaaaagtgccattgactattattcaaagttagtggtgatgatgtctgttccttcggctactatctttgctagacgcgccttagcgtacctgatgagtggtcaaccagaacttgctctcagggatgccatgcaagcccaagtatgcataccagagtggccaactgccttttacctgcaagctcttgctctttccaagctcggaatggaaactgatgctcaggacatgctcaatgatggcgctgccttcgaatcaaagaaacaaaatagctggcgaggttaaagtgcgtacttcacaagttcataatagttgaaaggaaaaaaaatcccaatggaatactgctagtatggtttttgctacactaaggcacttaattcaggtagagcaaaactttagtagaagaggttttgagtaggggcgagcttgttagtgaagatttacagaggggagatgggagtataatgtacagttttattcacggaataagcaagcattcacatttcatattgactgctttggcgtactgtattgttttccatttgtcttgctgagttactattagctctacattgtactgtacatctttagctataacttttagataaacatgatgaaaataagttgttacagtt

SEQ ID NO: 1242 - DNA, 1802 bp, Artemisia annua
aaaacacactttttttcacacacccaaatcagcaaacaccatattttagggtttttactcttttttatataaaacactagtcataagttttttataaaattttatgtgattaagttttttataaaaaaaaatgggctgttttcagtccaaaactgctaatgttcaatcccctgatcaagttcctgaatctaaaccagatccaggtgatggagaacaagtagcaggtcaacaggatcaagagcatgcagtgcctgtgtttaaggaatttgagttgacggaacttcgagcggctacaaatggttttagtagcgaattaatcgtttcggaaagtggtgaaaaggctcctaatgtggtgtatagaggaaaactaaagaataataaagttgttgctattaagcggttttcgaagctatcttggcctgacccgcaacaatttgtggcagaagctgctggagttggcaaggttcggcataatagattggtgaatctgattggctgttgtgcagagggagatgagcgtcttttagttgctgaatacatgcccaatgatacactctcaaagcatctatttcactgggataaacagcctttgccatgggaaatgcgtgttagagttgcttaccatattgcacaagcactcgagcattgcaatgtggagaatcggaaaatatatcacgatttgaatgcatatagggttctctttgatgaggatggagaccctcgcttatctagctttggtttgatgaagaatagtcgtgatgggaagagctatagcactaatcttgcttacactcctcccgagtttctgaggacaggcagggtaattcctgagagtgttatttatagttatggaactgtcctgctggaccttttgagcgggaaacatatccctccaagccatgcattggatttaatacgagggaaaaacgttttgttgctgatggattcatccttggaaggacaatatgcagatgaagatgcaaccgtgatggttgaacttgcttccaagtgtcttcagtacgagggtagagatcgtcctgatgtcaagtttcttctgacagcagtggcaccacttcaaaagcagaaagaggttgcatcccatgtcttaatgggtctgacaaagactccggtggtggttccaaccttactttctcctcttggcaaggcgtgtgcacgaatggatcttactgcagtacatgacatcttgctaaaaacgggatatagagacgaagagggtgctgagaatgagctatcatttcaagaatggacccagcaagtgcaagatatgttaaatacaaagaagttcggggatatcgcgtttagggacaaggatttcaatgggtcagttgaatactattccaagttggtaacgatgatgtctgtcccgtccggtactatctttgtgaggcgggccctctcgtacttgatgattggacaaccagaactcgcattgagggatgcaatgcaagctcaggtatgcctgcctgagtggccgactgctttttacatgcaagctttagctttgtctaagcttggaatggaaactgatgctcaagacatgcttaacgatgggtcatccttcgaggcaaagaggcaaaacagttggcgtaattaaaactcgaccagaggcaatgtttatttgaatcactactcacccttctgtcgttgactacatttttcgatattagcattgtataaatcactctttaaatgccgaagaaactagtatttgagttatgttatttccgtgccttttactttaacctttcgttggttgttctttacatgcaataaattgaaag

SEQ ID NO: 1243 - DNA, 1674 bp, Fragaria vesca
ttaccactgtaaaatgggttgcttacaatccaaaactgcccacctccactcccccgacgacccatctcctcttcccgaacctctgaaactcgacccggctgatggggatcaagctgaggctggggaccaagtgccggcgtttaaagagtacagcctacacgagctgcggaaggccactaatgggttcagctctgattttatagtttctgagagcggcgaaaaagccccaaatgtggtttacaaagggaagcttgaaaacaatcggcttgttgctgttaaacgcttctccaagcagtcttggccggacgctcagcagtttgtggctgaggctgcgggagttgggaagttgaggcataagagattggtgaatctgattggttgctgtgccgagggagatgaacgcctcttggtggctcagtacatgtccaatgatactctttccaagcatctcttccattgggataagcagccattgccatgggaaatgcgtgttagagttgcatattatattgcccaggcacttgatcattgtaatacagaaaaccggaagatctatcatgatttgaatgcatatagagttctatttgacgaggatggtgaccctcgcttgtctagttttggcctcatgaaaaatagtcgagatgggaaaagctacagtactaatttagcttacactccacctgagtttttacggacaggcagggtcatcccagagagtgtaatctacagttatggaactgtcctcttggacctattgagtggaaagcatatccctccactccatgcactagacctcataaggggaaagaatgtattgttgttgttggattcatcattggaaggacagtatgagaatgatgatgctaccaaattggttgaacttgcttccaaatgtctccagtctgaggctagggatagaggagatattaagtctcttctcacagctgttgcacctcttcaaaagcagaaagaggtggcgtctcatgttttaatgggcctcccgaaaaacaaaaatacagttgtggtgccaaccatgctttctcctcttgggaaggcttgtgcaaggatggatcttactgctgtgcatgatattttgctaaaaacgggttatagagatgaagaaggtgcagaaaatgagctttcatttcaagaatggacacagcaagtccaagacatgttgaacacaaagaaatttggagatattgcatttagagacaaggatttcaagaatgcaattgagtattattctaagttaattgttatgatgtctgttccttctgcaactgtgtttgcaagaagagctttctcctacttgatgaatggccaagcggaacttgctttgagagatgccatgcaggcacaggtttgcataccagagtggccaactgcattctacttacaggcccttgcactctcaaagctcggaatggagactgatgcccaggacatgcttaatgatggagcagcctttgaagcaaagagatacagcatctggcggggttgagctgcaacgttatatactcaaaaaaatcaataggcccctgtttttgtcactgctgggcaaaaatgactagactagaaggtactaggcaaatgtgtaatgtggttgatagaattcttcaaaatgtccacgaaaatcattctgattatattcacaatctttcatctttcata

SEQ ID NO: 1244 - DNA, 1642 bp, Amorphophallus konjac
tggggaggagggacgcgccgccggcgggacggagggcgagcgggtggcggtgccgggcgtttccgggagtacgggctggcggagctgagggcggcgaccaacgacttcagcagcaagctgatcgtgtcggagagcggggagaaggcccccaacgtcgtctaccgcggccgcctcgacgccagccgcgtcgtcgccgtcaagcgcttctccaagcaggcctggcccgacgcccagcagttcgtggcagaggccgctggggtggggaaggtgcgtcataagaagctggtgaacttgataggatgctgcgccgagggagacgagcgcctcctggttgcggagtacatgcccaacgatactctctccaagcacctgttccattgggataagcagcctttgccctgggaaatgcgtatgagggttgcatatcacattgcacaagcactagatcattgcaatattgaaaataggcaaatctatcatgatctaaatgcatacagagtcctttttgatgaggatggtgatcctcgtctatctagctttggtcttatgaaaaatagtcgagatggtaaaagctacagtacaaacttggcctacacgcctccagagttcctgcggacaggcagagttatcccagaaagtgtcatctacagttttgggacaattcttttggaccttatgagtgggaagcatatacctccgagtcatgcactagatttaatccgaggaaacaatatgttgctgttgttggattcatccttggagggacagtatgctaatgaagatgccacaaagttggttgaacttgcttcaaagtgtctacagtttgagcctagagaccgacccagttgtaaatttcttcttgctgcggtatcacctttgcagaagcaaacagaggttgcatcacatgttttaatgggtctaccaaaagtagcagctgtcctgcccactctgttatctccgcttgggaaggcttgtgcaaagatggatcttactgcagtacatgatatccttcttaagacaggttatagggatgaggaaggtgcggaaaatgagctctctttccaagaatggacacaacaagtgcaagagatgttgaacacaaagaaatttggagatattgcatttagagacaaggatttcaagaatgctattgattattattcaaagttggtgggtctgatgtcagttccttcagccaccgtctttgcgaggcggagcctgtcctacttgatgaacgaccaagccgagcttgcccttcgggatgccatgcaggcccaagtttgcatgcccgaatggcctaccgcattttatctgcaggcccttgcactttccaagctcggaatggagactgatgcgcaggatatgcttaatgatggagctgcttttgaggcaaagaagcagagtggctggcgtggctaggtttatgtttgagaactgtgaaattatctctcagtagtagtccaacagttcttgagctgctgctggttgggatgaaattgacatttctctggtgattcagatgagctaaaattgttgttactgctgggttgcgtgaggataggtctcagctccccagcacctctagtttcaatgccgagtcctcggagcaaatgtacagtagcgtttatattggaataaagca

SEQ ID NO: 1245 - DNA, 1509 bp, Prunus persica
atccacccacaacactcaaaatgggctgcttacactccaaaaccacccacctccacctctcccctgacgacccatcttctctacccgacactcacaaacccgactcagctaatggagatcaagctgagctagaggcccaagcccctgtgttcaaagagtacagtctagacgagctacgaaaggccaccaatgggttcagctccgaatgtattgtttccgagagtggtgaaaaagcccccaatgtcgtctacagaggaaaacttgataacaatcgccttgtcgctgttaaacgcttctccaagcagtcttggcccgacgcccaacagtttgtggttgaggctgtgggagtggggaagttgaggcacaagagattagtgaatctggttggttgctgtgccgagggagatgaacggctcttggtggctgagtatatgcccaatgatactctttccaagcatctctttcattgggacaagaagccattgccatgggaaatgcgtgttagagttgcatactatattgcacaggcactcgatcattgtaatatcgagaaccggaagatctatcatgatttaaatgcatacagagttctttttgatgaggatggtgaccctcgtttgtctacctttggtcttatgaaaaatagtcgagacggaaaaagctacagtacaaatttagcttatactccacctgagtttctacgtacaggcagggtcattccagagagtgtaatctacagttatggaactgtcctgttggaccttttgagtggcaagcatattcctccaagccatgcactggacttgataagggaaaagaatgtattgttgttgatggattcatcattggaagggcagtatgtgaatgatgatgccactaaattggttgaacttgcttccaaatgtcttcagtctgaggctagggatagaggagatattaagtttcttcttacagtcgttgcaccacttcaaaagcagaaagaggcggcatctcatgttctaatgggccttcctagaaatactgttgtggttccaaccatgctttctcctcttggaaaggcttgtgcaaggatggatcttactgctgtgcatgatattttgctaaaaacaggctataaagatgaagaaggtgcagaaaatgagctctcattccaagaatggacacaacaagtccaagatatgttgaacacgaagaaatttggggatattgcatttagggacaaggatttcaagaatgcaattgagtattattccaagttagtcgctatgatgtctggcccttcagcaactgtctttgcgagaagagccttctcctacttgatgaacggccaagcagaacttgctttaagagatgcgatgcaggcacaggtgtgtataccagagtggccaactgctttctacttgcaagctctggcactctcaaagcttggaatggagactgatgctcaggacatgcttaatgatggagcagccttcgaagcaaagcggcacaacacatggcgtagctaaa

SEQ ID NO: 1246 - DNA, 1630 bp, Cirsium arvense
tttatgtgaataaatcatcactatgggctgttttcagtccaaaactgccaatgttcaatctcctgatcaggttcctgaatccaaaccagatccaggtgatggagagcaaggattaggtcaacaggatcaagagcaagcagttcctgcattcaaggagtttgagcttacggagcttcgagctgctacaaatgggttcagtagtgagcttatagtatcggaaagtggagagaaagctcccaatgtggtttatagaggaaaacttcgtagcaataaagtcgttgccattaagcgtttctccaagctctcttggccggatccacaacaatttgtggcagaagctgctggagttggcaaggttcggcataatagattggtgaatctaattggctgttgtgcggagggagatgagcgtcttttagtggctgaatacatgcccaatgatacactctcaaaacatctatttcactgggataaacagcctttgccatgggaaatgcgtgttagagttgcgtaccatattgcacaagcacttgagcattgcaatgcagaaaatcggaaaatctatcatgatctgaatgcctatagggtcctctttgatgaggatggtgaccccgcttatctagttttggtttgatgaaaacagtcgagatgggaagagctatagcactaatcttgcttacactcctcccgaatttttgcgcacaggcagggtaattccagagagcgtgatttacagttacggaactgtcctgctggatcttttgagtggaaagcatatccctccaagccatgcattggatttaatacgtgggaaaaatgttttgttgctgatggattcatccttggaaggacaatatgcagatgaagatgcaaccgcaatggtggaacttgcttcaaaatgtcttcaatacgagggtagagatcgtccagatgtcaaatttcttcttacagcagtcgcaccccttcaaaagcagaaagaggttgcatcacacgtcttaatgggtctgacaaaaactcctgttgttgttccaaccttactttctcctcttggcaaggcgtgtgcgcggatggatcttactgcagtgcatgacattttgctaaaaacgggatatagagatgaagagggggctgaaaatgagctatcatttcaagaatggacccaacaagtgcaagatatgctaaatacgaagaagtttggagatattgcatttagggacaaagatttcaatggtgcggttgaatactattcaaagttggtttcaatgatgtcggtcccttcgggtaccatctttgtgcggcgggccctcgcttacttgatgatcgggcaaccagagcttgcattgcgagacgcaatgcaagctcaagtatgtttgcccgaatggccgaccgccttttacatgcaggctttagctctctcaaaacttggaatggaaaccgatgctcaagatatgctcaatgacgggtcctcctttgaggcaaagaggcaaaacagttggcgcaactaaaattttacgtaataatcacatgtgattaattaagccaatgctatgttagcctctgcaaaacgctcgcttgatttgaggtaatgtttatttgaaattattacttgttattctgtgttgtagactac

SEQ ID NO: 1247 - DNA, 2014 bp, Cichorium intybus
tcatcacactctccatcaacccccaaaactcccctcacttgtacatttctagggttttcattcattacaactaaaagagagtgttttctttgaaatttatgtgaagaaatcatcagaaatgggctgttttcagtccaaaaccgccaatgttcaatctcctgaccaagtacctgaatcgaaaccagatccaggtgatggagagcaaggattaggtcaacaggatcaagagcatgccgtccctgcattcaaggagtttgaacttacagagcttcgagctgctacaaatggcttcagcagtgagcttatagtttcggaaagcggtgagaaagctcccaatgtggtttatagaggaaaacttcgtagcaataaagtcgttgccattaagcgcttctccaagctctcttggccagacccccaacaatttgtggcagaagcttctggagttggcaaggttcggcataatagattggtgaatctaattgggtgttgtgctgagggcgatgagcgtcttttagtggctgaatacatgcccaatgatactctttcaaaacatctatttcactgggataaacagcctttaccatgggaaatgcgtgttagagttgcataccatattgcacaagcacttgaacattgcaatgtggaaaataggaaaatttatcatgatttgaatgcttatcgggttctttttgatgaggacggtgacccgcgcttatctagttttggtttaatgaagaacagccgagatgggaaaagctacagcactaatcttgcttacacacctcccgagtttttgcgaacaggcagggtaattccagagagtgtgatttacagttacgggacagtactccttgacctattgagcggaaagcacatacctccaagccatgcattggatttgatacgtgggaaaaatgttttattgctgatggattcatcattggaagggcaatatgcggatgaagatgcaaccgtgatggtggaacttgcttcaaagtgtcttcaatacgagggtcgagatcgtcctgatgtcaaattccttcttacagctgtcgcaccccttcaaaagcagaaagaggttgcatcacatgtcttaatgggtctgacaaaaacacccgtaattgttccaaccttactttcacctcttggaaaagcatgtgcacgaatggaccttactgcagtacatgacattctgctaaaaaccggatatagagacgaagagggcgctgaaaacgagctatcgtttcaagaatggacacaacaagtgcaagacatgctaaacacaaaaaagtttggagatattgcatttagggacaaggattttaacggtgcagttgaatactattcgaagctggttacaatgatgtcggtgccttcggggacaatctttgtgaggcgggccctgtcttatttgatgattggacaaccggaattggcattgagggacgcaatgcaagctcaggtgtgcttgccggaatggccaaccgccttttacatgcaggcattggctctctcgaagctcggaatggaaacagatgctcaagatatgttgaatgacgggtcgtcatttgaggcaaagagacaaaacagctggcggaattaagattccgaactttgtgataattttaaatgatgtggatgtgatgtggcacaagggttgtgtgatgaaattactacccacttgtctgtctacagtttttgaaattagtttgtataaattatttctgaaatgtcgaaaaaaactagtatttgagttgtgttattgttggtaatttccggataatgacgactttgagatatactttacataatgagttgtaaggataagtgctatctattcaatacaagttggtattagattagaattcaaagtcgtagttgtagttatccacatatatacggtttgtatatatacctctctagatgtcgagttagggcaagagagagaatagaggaatgattgtaatcaagtttgagttatttcttggttataataagcagttttcctgaattc

SEQ ID NO: 1248 - DNA, 1689 bp, Malus domestica
cagattcacttctcactgggtgagtcagcagtcacccttgtcctcagctgcagcaacacaacactcgtgtcgtttgttgtctctccatttccgaagctcttcacttcagcgctttcacattccccttcttctatgtagccccacttccaacacaaactactaccactaccactgccactaccactaccactcaaatgggttgcttacactccaaaaccgcccacctcctccgctcccccgaccacccctcttctctacccgacacccacaaacctgacccggctaatggggatccagctgcggcggcggatcccctggtgccggcattcaaagagtacggcgtcgacgagctccggaaggccacgaacgggttcagctccgaatgcattgtttccgaaagcggcgaaaaagctcccaatgttgtttacagagggaagcttgatggcaatcgccttgtcgctgttaaacgcttctccaagcaatcttggcccgacgcccagcagttcgtggctgaggcttctggagtagggaagttgaggcacaagagattggtgaatctgattggttgctctgccgagggtgacgaacggctcttggtggccgagtatatgcctaatgatactctttccaagcatctcttccattgggacaagaagccattgccatgggaaatgcgtgttagagttgcataccatattgcagaggcacttgatcattgtaatacagaaaaccggaagatctatcatgatttgaatgcatatagagttctttttgacgaggatggtgaccctcgattgtctacctttggccttatgaaaaatagtcgggatggaaaaagctacagtaccaatttggcttatactccacctgagtttctacggacaggcagggtcatcccagagagtgtaatctacagttatggaactgtcctgttggaccttttgagtggaaagcatattcctccaagccatgcactggatttgataaggggaaagaatgtattgctgttgatggattcatcattggaagggcagtatgcgaatgatgatgccacgaagttggttgaacttgcttccaaatgtcttcagtctgaggccagggatagaggagatattaagtttcttctcacagccattgccccgtttcaaaaacagaaagaggtggcatctcatgttttaatgggcctcccaaaaaacactgttgtggtgccaaccatgctttctccccttggaaaggcgtgtgccaggatggatcttactgctgtgcatgatattttgctaaaaacaggctataaagatgaggaaggtgccgaaaatgagctctcattccaagaatggacacaacaagtccaagatatgttgaacacaaagaaatttggtgatattgcatttagggataaggatttcaagaatgcaatcgagtattattccaagttggttgctatgatatctggccctccagcaactgtctttgcgagaagagccttctcgtacttaatgaatggccaagcagagcttgctttaagagatgcgatgcaggcacaggtatgcataccagagtggccgactgcattctacttgcaggcgcttgcgctctcaaggctcggaatggagactgatgctcaggacatgctaaatgatggagcggcctttgacacaaagaaacacaacgcctggcgtaactaaactt

SEQ ID NO: 1249 - DNA, 1593 bp, Musa acuminata
atgggctgcttccactccaagaccaccaacgtccagtcccccgacgacgagtccctcgtcgccgtcaagacagatccactcaatggggacacgagggagcaggaccaggtgccggtgttcaaggagtacgggcttgctgagctgagggcggctaccaaagggttcagccccgagacgatcgtttccgagagcggcgagaaggcgccgaacgtggtgtaccgggggaagctcgaggggggccggctggtggccgtgaagaggttctcgaagcagtcgtgggccgacgcccagcagtttgtggcggaggcggcaggcgtggggaagttgcggcataaaagattggtgaacttgatcggatgctgtgcagtgggtgatgagaggcttctagtgtcggagttcatgcctaatgatacattgtccaagcatctcttccactgggataagcacccattaccatggcagatgagagtgagggtggcatactacattgcccaagcacttgaccattgtaatactgagaatcggagaatatatcatgatctaaatgcttatagagttctatttgatgaggatggggatcctcgcttgtctagcttcggtctaattaaaaacagccgagatggaaaaagttacagcactaatcttgcttacactccaccagagttcatgcgcactggcagggtaattccagaaagtgtaacctatagttatggaacagttctcttggatcttttgagtgggaagcatattcctcctagtcatgctctagatcttataagaggaaaaaacatgttacttataatggattcatccttggaggggcaatatgctaatgaagatgctaccaagcttgttgaattagcctcaacatgtctacagtttgaggctagagatcggcccaattctaagtctcttctctctgccttggaacctctgcaaaatcagaaagaggtgccatcgcacgtattaatgggcataacaaaagcaacacaagtactaccaacaatgcttgctccacttggaaaggcttgtgtaaatatggacctaactgctgtgcatgatttattgctcaagacaggttacaaggatgaagaaggtgcagaaaatgagctttcttttcaagaatggactcaacgagtgcaagagatgttgaatacaaagaagtttggagacattgcatttagagataaagatttcaaaagtgctattgagtattattctcagttggtggcaatgatgtcagttccatcagccacggtttttgctaggcggggcctgtcgtacttgatgaatggccaaccagagcttgcactgagagacgccatgcaagcgcaggtgtgtatgcccgaatggccagtagccttctacttgcaagctctatccctatcgaaacttggaatggaaaccgatgcccaggacatgctcaatgacggggtcgccttggaactcaagaggcagagcagctggcgaggctagatgacatggattcaaccctcgtgggtctccttgcagttctacatgtttatcttcagtagtcaagagaaggagagtagtaacttgatagaggctattggtgagaaagtggagctgcgg

SEQ ID NO: 1250 - DNA, 3262 bp, Secale cereale
cccgtctcctctgttcacccaattcgactctaaaaccctaaaaacctcgccaccggccacggccatggcggccatcaccgctatccccgccttcctccgtgcggccgagctccgcctccttcgctgcaccctctcctccccgatctcccaaccagctcccccctcacctcccccagctcacccgctcggtcccgccgtggcctccgccctcgccgccgtcgaggccggggattacgcggctactatcgcctccgccgtcccccacatcttccattcatccgccttcgccgaggttgcccatggctccccggcgcaagtttacgacgacctcactgccgctgctgaggcgttcctccggggggatggcggaggggccgcaggcgaggggttccagtgcaggtgcgcgcttgttctctccacagcggtgtccgcgctgctcgctttcacgcagcagaacgtgacgggaccgtccggaaagttttcacccttccctttccagactccacccttggatggaggggagtatagtgattctggaggcaaatgggatgattgggcttcggatcatttagcttcttttggttcccatgttcatgggaaattcgctctcttgccgttcgttgtctttgcagaactactcttcacaagcataaagggtctggactcctctgattgttggagtgtgtcatggtggttgtgcagaatatccttgtcccagcaaaacattttagatgagctatcttcctctttgtttgatcaagtacaagtgtacaagaatgaaatgttgacccactttggtgaacttgaaaaggtctctagctactggggttctttgttatgtgatggagaaggcttttcttttgtctcagctgcttttctggaagctggaatcgtggagtataaatatggccgagttgatgcttcaaggctgcatctggatagtgctcaagaggcatgtgggattcatctctctctcacagggattcttggttttcgaactatacaccaggtggacgccaagtcccaaatggttctagttgcgaagacttctaaaccagcagctgatgatggccaatcaacagagttagcaggacctcagggtgatggtgtggctttcagaagcgcgacgagctctgttccagatgaaagtgatgaattttgtgatatactaagaacaccaagactggctgaaaatgggaatgactcgagcagtgagagtatgacatctgcaaacatacatatatctttatctgctatccagcaggccgctgtacttgcacaatgtttacatgtgagtcggaggagtcggagtgatgaaatgtctgggtgggagatggcaccatacatagagtcaattgattctcaagacaagtcatactttgttgtcaggagcttgtgtgatgttctgcgtattaggtgggagtccacccgcagtcggacaaaacagcgggcactgttaatgatggagaatttggttgaagatattgccaaagaatttcctgtagtttcacaaagagccaaaatggtttttggagttcatatgccgcctatccctgcattaaggaaagagtatggtgaacttttgataagttgtggtttacttggtgaagctcttaatgtcttcagagaactcgaattgtgggataatctaatctattgctatcaattatccggtaaagttgctgatgctgttagtctaataaatacccggctctctgttacaccaaatgacccaaggttatggtgttcacttggtgatgctactaataatgatgaccattataagaaagcactggaagtctcaaataacaaatctgctcgagctctgcgctctctggctcgcagtgcatacaacaagaatgatttccatacatccaaaattctttggggatctgcattggcattgaattctttgtatccagatggctggtttgcctatggtacagctgcatggaaggataaagatcttgagaaggcagtggatgcttttagtcgtgctgtgcagatagatcctgaaaacggagaagcatggaacaacatagcctgcttgcacatgattagaggaaagagccaagcggcagtccaggcattcaaggaagctgtaaagttcaagaggaacagctgggaagtttgggaaaattacagtaaggttgctttggacacaggcaacatgcgactgacacttgaagctgtcaaaatggtattgaatctgtcctcgaacaagcgcttcaatgttgatttattggacaaggtgatggcctctgtcgaagaacaaggcacacatcttactcaagaagctaaatccataagcaacgcttcagatgatgcaaacaaagagaccaggctaccaaatcaattgctagatataattggtgatatccttcagcagattgtacggagcggggctagcaatgcagagatatggggattatatgcaagatggcataaaagcaagggcaacctcatggcatgctctgaagctttgttgaagcaagttcgatccctccagggttcaggattatggcatgatcagaagaagttcacgaagtatgctcaagcttctctgcaactttgcaaggtctatatcgaaatttcctccacaactggaagcagacgagaattattgtcagctgagatgcatcttaaaagctccttgaaacaggcaacggacttctcaggtacggaggagtataaatcgcttaatgactgccttgaccaattaaggggcctgattggcgctgcatagagttactgatatcttggttgcgaatcaaggtcaccttgtcatatggcttatcacagaccctttataaatgacaagcatcgtcaaatcgcatcatccgatgggtctatgctcaagttctgcacgaagaatacactagattctttacttactcttgttctgttattcatgttggtcgtttgctgaatgtttcagggcacaatccagctcgtagctgtgagcattctgttaatcaggtttatcatgtgtaatcccagactgtatttgggaaagtatttgtactgttacttctgtttgaatgaaagtgttgtcatgctctaaaaaaaaagagcacttatccaatctattctttcgcccaattctccttagtttaggattgggcacattgaacacaatgatgttctgcagtaccagttttattctgagatacatatactattcgtaaagaggattggtactgtcatcatttgaccttccatacaatatcaatatacggggtgattttaacgcttagaaaac

SEQ ID NO: 1251 - DNA, 3114 bp, Brachypodium distachyon
gtaaaaccctaaaacctcgccatcggccaccccatggcggccttcatccgggaggctgagcttcggctcctacgctgcaccctaccttccccggcctcgcaaccaccgcccccttcaccttctcaatccaactcgctcggccacgtcgccgcctccgtcctcgccgccgtcgaggccggggactacgcggcggcgctcgcctccgctgcccctcatcttctccacgcctccgccaccaccgaggatttacatggatccccagcgaagttctatgcggacctcgctgccgctgctgaggtattcctccgtggggatggcggagggacggccgacgaggggtatgagtgtaggtgcgcgattgttctctccattggggtggccgcgctgctcgcattcacgcaacagaacgtgacggggcctttggggaagttttcgccctttcccttctggacgtcatcgttggatgaagggtggaatagtgatcctggaggcaaatgggatgcatgggcttctgaccgtttagcttcttttgggtcccatgttcatggaaaattctcgctcttgcagtacattgtctttgcagaacttctgttcacaagcataaagagtctggactcgtctgattgttggagtgtgtcatggtggctgtgtagaatatccatatcccagcagaacattttagatgagctatcgtcctctttgtttgatcaattacaagtgtacaagaataaaatgttgacccactttggtgaacctgaaaaggtttctagctactggggtcctttgttatgtgatggagaagattcttcttttgtctctgctgcttttttagaagctggaattgtggagtataaatatggtcgagttgatgcttcaaggttgcatctggatagtgctcaagaagcatgtgggattcatctctctctcacagggattcttggttttcgaacaatacaccaggtggaatcaaagtcccaaatggtacttgttgcaaagaccactataccagcaggggggaaatcaacagaacttacaggagctcagagtgatggcctggctatgagaaacgagaggagctctgttcctggtgaaagtgatgaattttgtgatatactaagaatgcctaggctggcccaaaatggcaatgattcaagtagtgaaattacaacatgtgaaagcacacaaatatccctaactgcaatccagcaggctgctgtacttgcacaatgtttacatgtgagtcggaggagtcggagcgatgaaatgtctgggtgggagatggcaccatacatagaatcaattgattctcaagacgagtcttactttgcggtcaggagcttgtgtgatgttttgcgtattaggtgggagtccacccgcagtcggacaaaacagcgggcactgctaatgatggaaaatttggttgaagatatcagcaaagaatttcctgtggcttcacaaagggccaaattggtttttggagtccatatgccgacacttcctgcattaaggaaagaatatggtgaacttttgataagttgtggtgtaattggagaagcgctggatgttttcaaagatctcgaattgtgggataatctaatctattgctatcgattattaggtaaaattgctgatgcagtaagtctaataaatgatcggctatccgtgtcaccctgtgacccaaggttatggtgttcacttggtgatgctacaaataatgacgatcattataggaaagcattggaagtctcaaataacaaatctgctcgagcactgcgttctctggctcgcagtgcatacaacaagaatgacttcaatgcatccaaaattctttgggaatctgcactggcattgaattctttgtatccagatggatggtttgcctatggcacagttgcgtggaaggataaagatcttgggaaagctgtggatgcttttagtcgtgccgtgcagatagatcctgaaaacggagaagcatggaacaacatagcctgcctgcacatgattaggggaaagagcccagcggcagtccaggcattcaaagaagctgtaaagttcaagaggaatagctgggaagtttgggaaaattacagtaaggttgctttggacacaggcaatattcaactgacacttgaagctgtcaaaatggttttaaatttgtccttaaacaaacgcttcaatgttgatttattggagaaggcgatggcagctcttgatgaacaaggcacacatctttttgatccgcaagaagctgaatctgcaagcaacacttcagatgatgcaagcaaagagaccaggcgatcgaatcaattattagatataattggtgatatccttcagcagattgtacgaagtggggctagcaatgcagagatatggggattatatgcaagatggcataaaaacaagggaaacctcatggcatgttctgaagcattgttgaagcaagttcgatccctccagggttcaggattgtggaacgaccagaagaaattcacaaagtatgctcaagcttctctccaactttgcaaggtgtacatggaaatttcttccttgactggaagcagacgagaattgttatcagccgagatgcatctcaaaagctccttgaaacaggcaacggacttctcaggtacagaggagtatcaagcactcgatgactgccttgttgaactaaaggatctgattggtgctgcaaaaacttagcgaaatctcacttgtgaatcgtggacacctcatcagaatgacaaccctgaggccatctggatggcgtaatcttggtaaaccttgtcaacaaggaagaggtcttgcctctcaaaatacggcacacatcatttgtcaggaaagcgaaatggctggttatgtgttgtacctgtgtaacttaaagctcaagttatttgtctgatgagtgatgagagctgtgctcaagtttaactcctagttctggtcatggaatcttgttgtaatcaagtttaactcctagctgtggttaagtcgtggcgaattggggtgtacggcattttgtatttttctcttatggtttgttcggtgatttttttttcttgttctgaaattttgaaatagagaagtttggaacaatcaatatagtttatgata

SEQ ID NO: 1252 - DNA, 3130 bp, Brachypodium distachyon
ttctccccttctttgtaaaaccctaaaacctcgccatcggccaccccatggcggccttcatccgggaggctgagcttcggctcctacgctgcaccctaccttccccggcctcgcaaccaccgcccccttcaccttctcaatccaactcgctcggccacgtcgccgcctccgtcctcgccgccgtcgaggccggggactacgcggcggcgctcgcctccgctgcccctcatcttctccacgcctccgccaccaccgaggatttacatggatccccagcgaagttctatgcggacctcgctgccgctgctgaggtattcctccgtggggatggcggagggacggccgacgaggggtatgagtgtaggtgcgcgattgttctctccattggggtggccgcgctgctcgcattcacgcaacagaacgtgacggggcctttggggaagttttcgccctttcccttctggacgtcatcgttggatgaagggtggaatagtgatcctggaggcaaatgggatgcatgggcttctgaccgtttagcttcttttgggtcccatgttcatggaaaattctcgctcttgcagtacattgtctttgcagaacttctgttcacaagcataaagagtctggactcgtctgattgttggagtgtgtcatggtggctgtgtagaatatccatatcccagcagaacattttagatgagctatcgtcctctttgtttgatcaattacaagtgtacaagaataaaatgttgacccactttggtgaacctgaaaaggtttctagctactggggtcctttgttatgtgatggagaagattcttcttttgtctctgctgcttttttagaagctggaattgtggagtataaatatggtcgagttgatgcttcaaggttgcatctggatagtgctcaagaagcatgtgggattcatctctctctcacagggattcttggttttcgaacaatacaccaggtggaatcaaagtcccaaatggtacttgttgcaaagaccactataccagcaggggggaaatcaacagaacttacaggagctcagagtgatggcctggctatgagaaacgagaggagctctgttcctggtgaaagtgatgaattttgtgatatactaagaatgcctaggctggcccaaaatggcaatgattcaagtagtgaaattacaacatgtgaaagcacacaaatatccctaactgcaatccagcaggctgctgtacttgcacaatgtttacatgtgagtcggaggagtcggagcgatgaaatgtctgggtgggagatggcaccatacatagaatcaattgattctcaagacgagtcttactttgcggtcaggagcttgtgtgatgttttgcgtattaggtgggagtccacccgcagtcggacaaaacagcgggcactgctaatgatggaaaatttggttgaagatatcagcaaagaatttcctgtggcttcacaaagggccaaattggtttttggagtccatatgccgacacttcctgcattaaggaaagaatatggtgaacttttgataagttgtggtgtaattggagaagcgctggatgttttcaaagatctcgaattgtgggataatctaatctattgctatcgattattaggtaaaattgctgatgcagtaagtctaataaatgatcggctatccgtgtcaccctgtgacccaaggttatggtgttcacttggtgatgctacaaataatgacgatcattataggaaagcattggaagtctcaaataacaaatctgctcgagcactgcgttctctggctcgcagtgcatacaacaagaatgacttcaatgcatccaaaattctttgggaatctgcactggcattgaattctttgtatccagatggatggtttgcctatggcacagttgcgtggaaggataaagatcttgggaaagctgtggatgcttttagtcgtgccgtgcagatagatcctgaaaacggagaagcatggaacaacatagcctgcctgcacatgattaggggaaagagcccagcggcagtccaggcattcaaagaagctgtaaagttcaagaggaatagctgggaagtttgggaaaattacagtaaggttgctttggacacaggcaatattcaactgacacttgaagctgtcaaaatggttttaaatttgtccttaaacaaacgcttcaatgttgatttattggagaaggcgatggcagctcttgatgaacaaggcacacatctttttgatccgcaagaagctgaatctgcaagcaacacttcagatgatgcaagcaaagagaccaggcgatcgaatcaattattagatataattggtgatatccttcagcagattgtacgaagtggggctagcaatgcagagatatggggattatatgcaagatggcataaaaacaagggaaacctcatggcatgttctgaagcattgttgaagcaagttcgatccctccagggttcaggattgtggaacgaccagaagaaattcacaaagtatgctcaagcttctctccaactttgcaaggtgtacatggaaatttcttccttgactggaagcagacgagaattgttatcagccgagatgcatctcaaaagctccttgaaacaggcaacggacttctcaggtacagaggagtatcaagcactcgatgactgccttgttgaactaaaggatctgattggtgctgcaaaaacttagcgaaatctcacttgtgaatcgtggacacctcatcagaatgacaaccctgaggccatctggatggcgtaatcttggtaaaccttgtcaacaaggaagaggtcttgcctctcaaaatacggcacacatcatttgtcaggaaagcgaaatggctggttatgtgttgtacctgtgtaacttaaagctcaagttatttgtctgatgagtgatgagagctgtgctcaagtttaactcctagttctggtcatggaatcttgttgtaatcaagtttaactcctagctgtggttaagtcgtggcgaattggggtgtacggcattttgtatttttctcttatggtttgttcggtgatttttttttcttgttctgaaattttgaaatagagaagtttggaacaatcaatatagtttatgatacc

SEQ ID NO: 1253 - DNA, 3403 bp, Brachypodium distachyon
cgctacagtacatctttttcttttaagtacatacggcaagagcaccgccgttggatgcagatctaacagttgcggtgcacagtgaagcgacacgggcaggattctttgccgtacgctgcgcacacacgctctcctacacttcactccaacgccaccaggaactgctcgacggaatgcctcgctaggccactatcgcccccccccccagttccccactcctccccaacgccgccaccccaccgagagaaacgccgccgagatgaagggagcaatgcagccgcggccgttcatgatgcacggcccgatgcctccgccgccgcagcagtttggcctcgtggagacgcgcccgccgctggccgccatgctgcggccccgcttcaacatcccggggctgaacccttccgccgccgcggcgtccgcggcgggcaagatctcttcgacctacgacctcgtggagccgatgaggttcctctacgtccacgtggtcaaggcgcgggacctccccgccgtctcccccaccggctccatcgaccccttcgtcgaggtcaagctcggcaacttcaagggccacacatccgtccacggcgccaaccacaacccgtcctggcagcaggtgttcgccttctcggccacgcacctccaatcgcatctgctcgaggtgtccatcaaggccaaagatctcgccggcggagacgacctcatcggccgcatggcgttcgacctgtccgaggtgccggtccgcgtgccgcctgactccccgttagccccccaatggtacaggctcgaggggaaacggggtgagaagcttccccgcggcgagatcatgctctccgtgtggctcgggacccaagccgacgaggcgttcccagaggcctggcattccgacgcccatggggcggctggcccggcggccgtcttgtccactcgcgccaaggtatacttctcgcccaagctcgtgtacctccgcgtcgccgccatcggggcgcaggacctcatgccccacgacacgtcccgccccatgagcgcctccgtcaagctgcagctcgccgggcaggtgcgtcgcacgcgtcctgggggcccgccggggacgcccaacccaatgtggaacgaagagttcatgttcgtcgcctccgagcccttcgacgagcccctggtcgtcaccgtggaagaccgtgtcgcgcccggccgcgacgagccgctcgggcgcattatactgcccctcaacgccgcaatgccacgccatgaccacttcggcaagcctgtggagccgcgctggtacagccttgggcgtcccagtgacgatggtgagaagaaggaaggcaagttcgcgagcaagatacagcttcggatgtcactggactttggataccatgttctcgacgagtccacttactacagcagcgatctccagccatcgtcaaagcacacgcggaagccaagcattgggatccttgaggtgggagttttaggtgcacgcaacttgataccgatgaaagccaaggatgggcgcaccaccgacgcttactgtgttgccaaatatggaccgaaatgggtgcgcacaagaacaatccttaacacactgaatccgcagtggaatgagcagtatacttgggaggtgtttgatccatgcactgtgatcacagtggtagtgtttgacaatagccagattgggagcaagagtgctgatgcccgggatgagagtattggcaaggtcaggatccgtctctcgacactggagactgaccgggtgtacacccatttctaccctttgctggctcttaagccaagtggcctcaagaagaccggtgagttgcatttggctgtgcggtttacatgcacggcatgggtgaacatgatggcgatgtatggccgtcccctgctgccaaagatgcactacacacaaccaatatcagtgatgcagttggactacctgaggcatcaggcgatgcaaattgtttcagcgaggcttagtcgtgctgagcctccactgcgcagggaggtggtggagtacacgctcgacgtgggatcccacatgtttagtctccggcgcagcaaggccaacttttatcggatcacctctctgttctgttgttttgcggcaatggccaagtggtatgatggcatcaggagctggcgaaacccgattacaactatgctggtgcacatgttgttcctcatactgatctgctacccggagctcatcctgcctaccatcttcctctacatgttcatgatcggactgtggaactatcgttataggtcaaggcatccaccgcacatggacactaagctatcacaagctgagtttacacaccctgatgagcttgatgaggagttcgacacattcccaaccaacagatcagctgacattgtaagattgcgctatgacaggctgaggagtgttggaggtcgtgtccaaacagtggttggggacctggcgacacaaggtgagagagctcatgcattgctgagctggagagaccctcgggccactgccatcttcatattcttatccctagttgtagccattgtgctgtatgtgacgccattccaggttttgctggtcattaccatgctttacttgttgcgccatccccggttccgcagcaggatgccatctgtcccattcaacttctacagaagattgcctgccaagtctgatttgctcctttgaggccagagcattcaaaagaaggtaatgggggaaccttgttttccaaaaggaagtgggggaacattgtaacattgtctctttcatgctgttccttctgattaacatcagatcagatgtgaatataatccatgagttgattatttagttgctctggtagccctgcaataaggtgtccgtttgaatgatatctgcttgcatatgcagaaatgaagggaatgactagatccctttagagttttggatgaaaattgttagttttggttttctagtgtagagcaaaaggtgggcacaagataagttccggtgtgttataactatgaacttctgccaattttgttcatgttctgttattccgttcctttggtcatgtccttgcccctgaggccctgatcatgtcctttgtatatgtttctttcattctttttcttgtccggagaattctatgtcctacagtatgtactattattactcaaaaaagagagtgtgtactccgtagtactattcttcctgagctactcgccttctttgtttcagtggttgtcaccggtacctgcggttgtatactccccgtcagacagttttactgctaagttttagcaaattagcatacagtagttgattgcaaattagccttcgtcattgtgggcgtctactaaattgtagcagaggttgatatgttactggatgtgtcgtaatttagtgcgggtctagtgttaccccgtggttcag

SEQ ID NO: 1254 - DNA, 3493 bp, Brachypodium distachyon
gcacgcttctctaacttcgctgacacggaggcccttttgtttacgggcacacatgtcatggaaggatgtgttttcttgcgagcttggagtcgctacagtacatctttttcttttaagtacatacggcaagagcaccgccgttggatgcagatctaacagttgcggtgcacagtgaagcgacacgggcaggattctttgccgtacgctgcgcacacacgctctcctacacttcactccaacgccaccaggaactgctcgacggaatgcctcgctaggccactatcgcccccccccccagttccccactcctccccaacgccgccaccccaccgagagaaacgccgccgagatgaagggagcaatgcagccgcggccgttcatgatgcacggcccgatgcctccgccgccgcagcagtttggcctcgtggagacgcgcccgccgctggccgccatgctgcggccccgcttcaacatcccggggctgaacccttccgccgccgcggcgtccgcggcgggcaagatctcttcgacctacgacctcgtggagccgatgaggttcctctacgtccacgtggtcaaggcgcgggacctccccgccgtctcccccaccggctccatcgaccccttcgtcgaggtcaagctcggcaacttcaagggccacacatccgtccacggcgccaaccacaacccgtcctggcagcaggtgttcgccttctcggccacgcacctccaatcgcatctgctcgaggtgtccatcaaggccaaagatctcgccggcggagacgacctcatcggccgcatggcgttcgacctgtccgaggtgccggtccgcgtgccgcctgactccccgttagccccccaatggtacaggctcgaggggaaacggggtgagaagcttccccgcggcgagatcatgctctccgtgtggctcgggacccaagccgacgaggcgttcccagaggcctggcattccgacgcccatggggcggctggcccggcggccgtcttgtccactcgcgccaaggtatacttctcgcccaagctcgtgtacctccgcgtcgccgccatcggggcgcaggacctcatgccccacgacacgtcccgccccatgagcgcctccgtcaagctgcagctcgccgggcaggtgcgtcgcacgcgtcctgggggcccgccggggacgcccaacccaatgtggaacgaagagttcatgttcgtcgcctccgagcccttcgacgagcccctggtcgtcaccgtggaagaccgtgtcgcgcccggccgcgacgagccgctcgggcgcattatactgcccctcaacgccgcaatgccacgccatgaccacttcggcaagcctgtggagccgcgctggtacagccttgggcgtcccagtgacgatggtgagaagaaggaaggcaagttcgcgagcaagatacagcttcggatgtcactggactttggataccatgttctcgacgagtccacttactacagcagcgatctccagccatcgtcaaagcacacgcggaagccaagcattgggatccttgaggtgggagttttaggtgcacgcaacttgataccgatgaaagccaaggatgggcgcaccaccgacgcttactgtgttgccaaatatggaccgaaatgggtgcgcacaagaacaatccttaacacactgaatccgcagtggaatgagcagtatacttgggaggtgtttgatccatgcactgtgatcacagtggtagtgtttgacaatagccagattgggagcaagagtgctgatgcccgggatgagagtattggcaaggtcaggatccgtctctcgacactggagactgaccgggtgtacacccatttctaccctttgctggctcttaagccaagtggcctcaagaagaccggtgagttgcatttggctgtgcggtttacatgcacggcatgggtgaacatgatggcgatgtatggccgtcccctgctgccaaagatgcactacacacaaccaatatcagtgatgcagttggactacctgaggcatcaggcgatgcaaattgtttcagcgaggcttagtcgtgctgagcctccactgcgcagggaggtggtggagtacacgctcgacgtgggatcccacatgtttagtctccggcgcagcaaggccaacttttatcggatcacctctctgttctgttgttttgcggcaatggccaagtggtatgatggcatcaggagctggcgaaacccgattacaactatgctggtgcacatgttgttcctcatactgatctgctacccggagctcatcctgcctaccatcttcctctacatgttcatgatcggactgtggaactatcgttataggtcaaggcatccaccgcacatggacactaagctatcacaagctgagtttacacaccctgatgagcttgatgaggagttcgacacattcccaaccaacagatcagctgacattgtaagattgcgctatgacaggctgaggagtgttggaggtcgtgtccaaacagtggttggggacctggcgacacaaggtgagagagctcatgcattgctgagctggagagaccctcgggccactgccatcttcatattcttatccctagttgtagccattgtgctgtatgtgacgccattccaggttttgctggtcattaccatgctttacttgttgcgccatccccggttccgcagcaggatgccatctgtcccattcaacttctacagaagattgcctgccaagtctgatttgctcctttgaggccagagcattcaaaagaaggtaatgggggaaccttgttttccaaaaggaagtgggggaacattgtaacattgtctctttcatgctgttccttctgattaacatcagatcagatgtgaatataatccatgagttgattatttagttgctctggtagccctgcaataaggtgtccgtttgaatgatatctgcttgcatatgcagaaatgaagggaatgactagatccctttagagttttggatgaaaattgttagttttggttttctagtgtagagcaaaaggtgggcacaagataagttccggtgtgttataactatgaacttctgccaattttgttcatgttctgttattccgttcctttggtcatgtccttgcccctgaggccctgatcatgtcctttgtatatgtttctttcattctttttcttgtccggagaattctatgtcctacagtatgtactattattactcaaaaaagagagtgtgtactccgtagtactattcttcctgagctactcgccttctttgtttcagtggttgtcaccggtacctgcggttgtatactccccgtcagacagttttactgctaagttttagcaaattagcatacagtagttgattgcaaattagccttcgtcattgtgggcgtctactaaattgtagcagaggttgatatgttactggatgtgtcgtaatttagtgcgggtctagtgttaccccgtggttcag

SEQ ID NO: 1255 - DNA, 3195 bp, Oryza sativa
tttggaaacgtagggttgggtgcggggcgttggatggggatccgacgggtagggttggttggtgacggtggtacagatctctccgccgtacgcttcaacccccccgcagcagtaacccacgctgcggcgctccccccacgccaccaccaagcaactgttcggcggaatgccacactagaggcgagacccaaggacacgctccccacgccgcaaacaaagcgccgccgccgccgccgccgagatgaagggagcaatgccgccgcggccgttcatgatgccggggcctgggggcccgatgcccccgccgcagcagttcggcctggtggagacgcgcccgccgctggccgccgtgctgcggccgcggttcaacatcccgggcctccacccctccgccgccgcggcctccgcggcgggcaagatcgcgtccacctacgacctcgtcgagtcgatgcggttcctctacgtgcacgtggtgaaggccaaggacctccccgccgtctccgccgccggcaccatcgaccccttcgtggaggtgaagctcggcaacttcaagggcaccacgccggtcctcggcggcaaccacaacccgtcgtggaagcaggtcttcgccttctccgcgacgcacctccaggcgcacgtgctcgaggtggccgtcaaggccaaagatctcgccggcggcgacgacctcatcggccgcgtggggttcgacctctccgaggtgccgatccgtgtgccgccggactccccgctggctccccagtggtaccggctcgagaacaagcgtggcgagaagacccgcggcgagatcatgctctccgtgtggctggggacccaggccgacgaggccttccccgacgcctggcattccgacgcccatgcggcggccggcccgggggccgtcgcctccacgcgcgccaaggtatacttctcccccaagctcgtttacctccgcgtcgccgccatcggagcgcaggacctcgtgccgctggacgcgtcgcgccccgcgaacgcctgcgtcaagctgcagctcgccgggcaggtgcggcgcacgcgccccggcgcgccgcccggcacgttgaacccgatttggaacgaggagttcatgttcgtcgtgtccgagcccttcgacgagccgctgttcgtcaccgtcgaggaccgcgtcgggcctggccgcgacgagcctctcggccgcatcatgctgcccctcaacgccgcaatgccgcgccatgaccacttcggcaagccggtggagccgcggtggtacagcctcgcgcgccccagcgacgatcctgacaagaaggaaggcaagttcgcgagcaagatacagcttcggatgtcgctggactttgggtaccatgttcttgatgagtccacctactacagtagtgatctccagccatcatcgaagcacacacggaagccaagcattgggatccttgagctggggattcttggagcacgaaacttgataccaatgaaggggaaagatgggcgcaccaccgatgcttactgtgttgccaagtatggaccgaagtgggtgcgcacgagaaccattctcaacactctgaatcctcagtggaatgagcagtatacttgggaggtgtttgatccttgcacggtgattacagtggtggtgtttgacaataaccagattggcaagaatggcgatgcccgggatgagagtatcggcaaggtgagaatccggctctctaccctggagactgacagggtgtacacccatttctaccctttgttggctctcaagcccagtggacttaagaagactggagagttgcatttggctgtgcgatttacatgtacggcatgggtgaacatgattgcactgtatggccgtccattgctgccaaagatgcactacacacagccaatctcagtgatgcagttggattacctgaggcaccaggcaatgcagattgtcgcggcgaggcttagccgtgccgagcctccacttcgcagggaggttgtggagtacatgctcgatgtgggatcgcacatgttcagtctccgccgcagcaaggccaacttctaccgtatcacctcgctgttctgtggttttgcagcgacggccaagtggtatgatggcatcagaagctggcgaaacccaattacaaccgtgttggtgcatatgttgtttctaatactgatctgctacccagagctcatcctgcctaccatcttcctctacatgttcatgattggattatggaactaccgttacaagccaaggcatccaccttacatggacactaagctatgccatgctgagtttacaaacccagatgagcttgatgaggagtttgattcattccctagcagcaggccagcggacattgtaagaatgcgctacgatagactaaggagtgttggaggtcgtgtgcagacagtcgttggtgacctggcgacacaaggtgagagagcccatgctttgcttagctggagagaccctcgggccaccgccatcttcatattcttgtccctggttgttgccattgtgctgtatgtgacaccattccaggttctgctggttattgcaatgctatacctgttgcgccacccccggttccgcagcaggatgccctctgtgcctttcaacttctacaggagattgcctgccaagtctgatatgctcctttgagcccaatgcattgagaacaagagaaaatggaggaaaccctgtaactttgtttctctcttccattcagttccctactgattagcatcagatcagatgtgaatatacttaaggagttggtaaattagaggcaagttagcggccagggaataatgtgttcattcgaatgttatttgctcagataggcagaaagaagggattgactggacctcttcgagtttgggggggcagagtttgttaatgtcgtgtttcttggggtaagaacaataggcaggcgcaagctaatcttcagtgtattttgtttatggatttgtgccaattttgttattttcttcatgtaatcatgtactacctgttggatgatgatgttttgcatttctgtgtgcttattcctcttgaagcactcggccttctttttcagtggtcatgcactcatgctgttcttgctgaagttgtacttctcaggcttgcgatgtttgttgttgctgaagttggtgcgggtgtttattatcatgaaactttattgtcgttttggctttgca

SEQ ID NO: 1256 - DNA, 3554 bp, Zea mays
ctcaaccaaacactatagaaaatgtggccgcctcattccatccctctttgtacattcaaccaaacacatcctaaacggtggccgcagcccgcagccgcgggttagtgatacgattcatcgcaggaagattcggcctgatgcggagacgttggatcggcatccaacgactgcgttccgctacggtgcgccgcccacggcgacatgcgctgcatccacaccactccacgcaaacacgttgcgccggcaggggcagcagtagccccgctccgctccgttcacaacactcactgctcggtggaatgcctcactagtcactactctactcactagtagtagggctgcaggtccaaccgctcccccacgccgccgctccccactgagcaaaccccgcgcgccgccgacgagatgaagggagcaacgccgccgcggccgttcatggtgccgggccctgggggcccgatgccgcccccgcagcagcagttcgggctggtggagactcgccccccgctggccgccgtgctgcggccgcgcttcaacatcccgggcctccacccctcggcggccgccgccgccgcggcctcgggcgcgggcaagatcgcctccacctacgacctcgtcgagccgatgcggttcctctacgtgcacgtcgtcaaggcgcgcgacctgcccgcggtgtccgccacgggctccatcgaccccttcgtcgaggtcaagctcggcaacttcaagggcaccacgcccgtcagggcggccagccacagcccgtcctggcagcaggtcttcgccttctccgccgcgcacctccagtcccacctgctcgaggtcgccctcaaggccaaggacctcgccggcgacgacctcgtcggccgcgtcgcgttcgacctctcggaggtgcccgtccgcgtgcccccggactcgccgctcgcgccgcagtggtaccgcctcgagaccaagcgcggggagaagctgccccacggggagatcatgctctccgtctggctcggcacccaggccgacgaggcgttcccggacgcctggcactccgacgcgcacgccgccgcgggccccgccgccgtcgcgtccacgcgcgccaaggtatacttctcgcccaagctcgtgtacctccgcgtcgccgccatcgccgcgcaggacctcgtcccacacgacgcctcgcgcccgatgaccgcctgcgtcaagctgcagctcgccggccaggtgcgccgcacgcgccccggcgcgccgccggggacgcccaacccgatctggaacgaggagttcatgttcgtcgcgtcggagcccttcgacgagccgctccttgtcaccgtcgaggaccgcgtcgcgcccggccgcgacgagatcctcggccgcattgtcctgcccctcaaagcggcaatgccgcggcacgaccacttcggcaagcctgtggagccgcggtggtacagccttatgcgccactccgatgatcctgacaagaaggaggttaagttcgcaagcaagatacagattcggatgtcgcttgattttgggtatcatgttcttgacgagtccacctactacagcagtgatctgcagccatcgtcaaagcctgcaaggaaaccaagcattgggatgcttgagctgggagttctgggtgcccggaacttgataccgatgaagcccaaggatggacgcaccacagacgcctattgtgtggcaaaatatggaccaaagtgggtgcgcaccaggactattcttgacacactgaatccacaatggaatgagcagtacacttgggaggtgtttgatccttgcaccgtgatcacagtggtggtgtttgacaacgggcaaattgggagcaagaatggtggtggcccagatcagcgcattgggaaggtcaggatccggctctctacactggagacagacagagtgtacacgcatttctaccctttgctggttttacatccaagtggactcaagaagactggtgagcttcatttggctgtgcggtttacctgcacagcttgggtgaacatgatggcgctgtatggtcgaccgcttcttccaaagatgcactacacacatccaatcgcagtgatgcaattggactacctgaggcaccaggcaatgcagattgttgccgcaagactcagccgtgctgagcccccgctgcgcagggaagttgtggaatacatgctcgatgtggactcacatatgtttagtctccggcgcagcaaggctaattttcatcgcattacctcactgttctttggttttgtggcaatgctcaagtggtaccatagcatcaggagctggtgtaatccaatcacaacaatgctagtacacatgctgttcttgatactgatctgctatccggagctcatcctgcctaccatcttcctctacatgttcatgatcgggctgtggaactatcggtaccggccaaggcatccgtcacacatggatactaagctctcccatgctgagctgacacaccctgatgagcttgatgaggagtttgacacgttcccttcctccagaccagctgaaattgtaagaatgcgctatgacaggctgaggagcgttggaggtcgtgtgcaggctgtggttggggacctggcgacacaaggcgagagagcccatgctttgctgagctggagggaccctcgggccaccgccatcttcattttcttatccctggtgatcgccgttgtgctgtacgtgacgccgttccaggttttgatggtcatagccatgctttacctgctgcgacatccccggttccgcagcaggatgccctcagtgcctttcaacttctacaggagactgcctgccaagtctgatatgctcctttaagatccagtgtccaccataagagaaacaggtgcaagtcttacttatttatgtctgttccgctcggttccttctggttagcatcagatcagatgtgaatatacctgatgagttcatatattagaggtcattagtatccccggaataaggtgtcggtttaatggtttatttccttggttatgccaaagaaagggaacaactggatcccttttgagttttgggaaatagtgggaggaggattttggtgcagaattgtaatattaacttcaggttattagcatagaactaaaggcaggaacaatattatcccccgtgtattatgtttgtactatttgtgtcaattttgcttgtgtttcagtgatcttttgcctgcagctgggtcatgctgtttgtatttatgtgttcgaatccctcaccttgtttgggttcactggacatgcctgcttgctgcggttgtactccttgttaataggtggttttgctatcagggacagatccggccagcggtggggcgggcgaggctcgagcctcccctaccgcttcggatcctattccatggccgggtctcttcggatcctattccatgggcggtcgagcctccctgccgcttcggatcccattccatggagtctcactgtagacttccttaatctaaaatatagataatatagaagaatcttttatactgcagcagttagtttagtctcttctaaacttttttt

SEQ ID NO: 1257 - DNA, 3290 bp, Sorghum bicolor
ttcgccgcccacggcgacacgccctgcagatctcggcttggcccgtacgctgccggcccacgctcctccacgcaaacaaacacgtcgcgcagcgcaggcagcagtagcccccgctccgctcctttcgcaacactgttcggtggaatgcctcactagtagtcactggtagggctcctggctccaggtccaacccactctgccccccccacgccgccgttccccactgagcaaaccccgccgccgccgccgccgacgagatgaagggggcaatgccgccgcggccgttcatgatgccgggcccggggggcccgatgccgcccccgcagcagcagttcgggctggtggagacgcggcccccgctggcggccgtgctgcgtccgcgcttcaacatcccaggcctccacccctcggccgccgccgccgccgcggccacgggcgcgggcaagatcgcctccacctacgacctcgtcgagccgatgcggttcctctacgtgcacgtcgtcaaggcgcgggacctccccgcggtgtccgccacgggcgccatcgaccctttcgtcgaggtcaagctcggcaacttcaagggcaccacggccgtcaaggcggccagccacaacccgtcctggcagcaggtcttcgccttctccgccacgcacctccagtcccatctgctcgaggtcgcgctcaaggccaaggatctcgccggcgacgacctcgtcggacgcgtcgtcttcgacctcgccgaggtgcccgtccgcgtgcccccggactcgccgctcgcgccgcagtggtaccgcctcgaggccaagcgcggcgacaagctgccccatggggagatcatgctctccgtctggctcggcacccaggccgacgaggcgttcccggacgcctggcactccgacgcgcacgccgccgcgggacccgcggccgtcgcgtccacgcgcgccaaggtatacttctcgcccaagctcgtgtacctccgcgtcgcggccatcggcgcccaggacctcatcccgcacgacacctcgcgcccgatgagcgcctgcgtcaagctgcagctcgctggccaggtgcgccgcacgcgccccggcgcgccgccggggacgcccaacccgatttggaacgaggagttcatgttcgtcgcctcggagcccttcgacgagccgctcgtcgtcaccgtcgaggaccgcgtcgcgcctggccgcgacgagatgctcggccgcattgtgctgcccctcgcggcagcaatgccgcggcacgaccacttcggcaagcccgtggagccacggtggtacagcctcatgcgcccctccgatgatcctgacaagaaggaaatcaagttcgcaagcaagatacagattcggatgtcccttgattttgggtatcatgttcttgacgagtccacctactacagcagtgatctgcagccatcatcaaagcctgcaaggaaaccaagcattgggatgcttgagctgggagttctgggtgcgcggaacttgataccgatgaagcccaaggatggacgcaccacagatgcctattgtgtggccaaatatggaccgaagtgggtgcgcaccaggactattcttgacacgctgaatccacaatggaatgagcagtatacttgggaggtgtttgatccttgcaccgttatcacggtggtggtgtttgacaatggccaaattgggaagaatggtggaggcccagatcagcggattggaaaggtcaggatccggctctctacactggagactgacagagtgtacacacatttctaccctttgctggttttacatccaagtggactcaagaagactggcgagcttcatttggctgtgcggtttacctgcacagcttgggtgaacatgatggcgctgtatggtcgtccgctgcttccgaagatgcactacacacagccgatcgcagtgatgcaattggactacctgaggcaccaggcaatgcagattgttgcagcaagactcagccgtgctgagcccccgctgcgcagggagattgtggaatacatgctcgatgtggactcacatatgtttagtctccggcgcagcaaggctaattttcatcggattacctcactgttctttggttttctggcaatgctcaagtggtatgatggcatcagaagctggcggaacccaatcacaacaatgctagtacacatgctgttcctgatactgatctgctacccggagctcatcctgcctactgtcttcctctacatgttcatgattgggctgtggaactatcggtacaggccaaggcatccgtcgcacatggatactaagctgtcccatgctgagctgacacaccctgatgagcttgatgaggagtttgacacattcccttcctcaagaccagctgagattgtaaggatgcgctacgacaggctgaggagcgtcggaggccgtgtgcagactgtggttggggacctggcaacacaaggcgagagagcccatgctttgctgagctggagggaccctcgggccaccgccatcttcattttcttatccctggtggtcgccattgtgctgtacgtgacgccgttccaggttttgatggcgtgcgagctggtgagcggctcggacctcgtcatcggcgagggcgacgacagcgtcagcgcctaccttttcaaggccgtcaagaacaacaacggcaccggcatcctcctcctctccgacatcttcggcttcgaggactccgccacgcgcgacttcgcctaccgcgtcgcctgcaatggctacaatgtcctggttcccgacttgttccgagggaacccgtggaagctgaacctcccattcgacggcgacagcttccagcaatggctggccggacatgcgccggggcgggtgtccggcgacatcgacgcgtgcacgcggtggctggtggacgagttcaaagccgcgggggtgtccaagaagctgggcgtggtcgggttctgctacggcggcgggcgcctcgtcgagacgctggcgcgcgacgcggacagctgcttcagcgccggggtctgcttctacgggtcacggatggacgcgtccctgggcgaccgcatcgcggcgcccgtcctcttcgtgtgcggcgacggcgacccgctgtgcgccgtggagacggtgcgggagctggagagacgcgcgagaggcggcgcacgggcggcggtgtacgccggcaggggccatgggttcgcgcaccggccgcagtcggtggaggaggacgcggacgccgagaacgccttcaacgtgatgcgggggtggctgcacgaccacctgctcgcctgatca

SEQ ID NO: 1258 - DNA, 2968 bp, Setaria italica
gggcctccacccgtccgccgcggcggccgcggcggcctccggcgcgggcaagatcgcctccacctacgacctcgtggagccgatgcggttcctctacgtgaacgtcgtcaaggcgcgggacctccccgtgaccgccacgggcgccatcgaccccttcgtcgaggtcaagctcggcaacttcaagggcaccacgcccgtcaaggccgccagccacagcccggcctggcagcaggtcttcgccttctccgcgtcgcacctccaggcgcatgtgctcgaggtcgccgtcaaggctaaggatctcggcggcgacgacctcgtcggccgcgtcggcttcgacctcgccgaggtcccggtccgggtgcccccggactcgccgctcgcgccgcagtggtaccgcctcgagaccaagcgcggggagaagcttccccacggcgagatcatgctctccgtctggctcgggacccaggccgacgagtcgttcccggacgcctggcactccgacgcgcacgccgccgcgggcccggccgccgtcgcgtccacgcgcgccaaggtatacttctcgcccaggctcgtgtacctccgggtcgccgccatgggggcgcaggacctcatcccgcacgacacctcgcgccccatgagcgcctgcgtcaagctgcagctcgccggccaggtgcgccgcacgcgcccaggggcgccgccgggggcgcccaacccgatttggaacgaggagttcatgttcgtcgtctccgagcccttcgacgagccgctcgtcgtcaccgtcgaggaccgcgtcgcgccgggtcgcgacgagatgctcggccgcattgtcctgcccctccaagcagcaatgccgcggcacgaccattttggcaagcccgtggagccacgctggtacaacctcatgcgccccagcgatgatcctgagaagaaggaaatgaagttcgcgagcaagatacagatccggatgtcgcttgattttgggtaccacgtccttgacgagtccacttactacagtagcgatctccagccatcgtcaaagccagcaaggaaaccaagcattgggatgcttgagctgggggttctgggtgcccggaacctcataccaatgaagcccaaggatggacgcaccacggatgcctattgtgtggccaaatatggaccaaagtgggtgcgcacaaggaccattcttgacacgctgaatccacaatggaatgagcagtatacatgggaggtgttcgatccttgcaccgtgatcacagtggtggtgttcgacaatggccaaattgggagcaagaatggtggtggcccagatcagcggattggaaaggtcaggatccggctgtcaacactggagactgacagggtgtacacacatttctaccctttgctggttttacatccaagtggactcaagaagaccggtgagctgcatttggctgtgcggtttacctgcatggcttgggtgaacatgatggcgctgtatggtcgtccactgctaccgaaaatgcactacacacagccgatcccagtgatgcaattggactacctgaggcaccaggcaatgcagattgttgcagcaaggcttagtcgtgctgagcccccactacgcagggaagttgttgaatacatgctcgatgtggactcgcacatgtttagtctccgacgcagcaaggctaatttttatcgtattacctcactgttctatggttttctggcaatgctcaagtggtatgaaggcatcaggagctggcggaacccaattacgacaatgctagtgcacatgctgttcctgatactgatctgctacccggagctcatcctgcccaccttcttcctctacatgttcatgattgggctgtggaactatcgttacaggccaaggcacccgtcacacatggataccaagctatcccatgctgagatgacacaccctgatgagcttgatgaggagtttgacacattccccacatccagaccagctgacattgtaagaatgcgctacgacaggctgaggagcgtcggaggtcgtgtgcagacagttgtcggggacctggcgacacaaggtgagagagcacacgccctgctgagttggagggaccctcgggccaccgcaatcttcatattcttgtccctggtggtcgccattgtgctctatgtgacgccattccaggttttgatggtgatcaccatgctttacctgctgcgacatccccggttccgcagcaggatgccctccgtgcctttcaacttctacaggagactgcctgccaagtccgatatgctcctttgagctcacagcattcagcgtacgagaaatgggtgaaagttgtaacttatttatgtctgggtgaaagttgtaacttatttatgtctgttccactcggttccttctgattagcatcaggtctgatgtgaatatgcctgatgagttcgtatattagaggccaatagtggcccaggaataaggtgttggtttaatggtttatttccttggttatgccaaagaaagggaacaactgatcccttttgagttttgggacagtgagaagaggtttttgggtgctaaaatgtaatattagcttcaggttactagcgtagaactaaaggcaggaacaatattgtccccagtgtattttgtttgcatttgtgtcagtttttgtttgtgtttcagtaatcttgcccctgcacctggaccatgatgcttgttctggtcttggcactactaaccttcgttcagtggtcatgccctgcttgttttgctgcagttgtactcggcacctgccaggcggttttgctgcgttgtttgtttgttgagaagttgtgccggcactggcagattttgtgacttgaaagagtttgttgtgttgctaaatcttttggctgaaggtgccgtgttcgagcacactatgtttgttttctttgaaaagctgagcacactatgttgttttccgcggtccagtgcagaaat

SEQ ID NO: 1259 - DNA, 3011 bp, Setaria italica
gggcctccacccgtccgccgcggcggccgcggcggcctccggcgcgggcaagatcgcctccacctacgacctcgtggagccgatgcggttcctctacgtgaacgtcgtcaaggcgcgggacctccccgtgaccgccacgggcgccatcgaccccttcgtcgaggtcaagctcggcaacttcaagggcaccacgcccgtcaaggccgccagccacagcccggcctggcagcaggtcttcgccttctccgcgtcgcacctccaggcgcatgtgctcgaggtcgccgtcaaggctaaggatctcggcggcgacgacctcgtcggccgcgtcggcttcgacctcgccgaggtcccggtccgggtgcccccggactcgccgctcgcgccgcagtggtaccgcctcgagaccaagcgcggggagaagcttccccacggcgagatcatgctctccgtctggctcgggacccaggccgacgagtcgttcccggacgcctggcactccgacgcgcacgccgccgcgggcccggccgccgtcgcgtccacgcgcgccaaggtatacttctcgcccaggctcgtgtacctccgggtcgccgccatgggggcgcaggacctcatcccgcacgacacctcgcgccccatgagcgcctgcgtcaagctgcagctcgccggccaggtgcgccgcacgcgcccaggggcgccgccgggggcgcccaacccgatttggaacgaggagttcatgttcgtcgtctccgagcccttcgacgagccgctcgtcgtcaccgtcgaggaccgcgtcgcgccgggtcgcgacgagatgctcggccgcattgtcctgcccctccaagcagcaatgccgcggcacgaccattttggcaagcccgtggagccacgctggtacaacctcatgcgccccagcgatgatcctgagaagaaggaaatgaagttcgcgagcaagatacagatccggatgtcgcttgattttgggtaccacgtccttgacgagtccacttactacagtagcgatctccagccatcgtcaaagccagcaaggaaaccaagcattgggatgcttgagctgggggttctgggtgcccggaacctcataccaatgaagcccaaggatggacgcaccacggatgcctattgtgtggccaaatatggaccaaagtgggtgcgcacaaggaccattcttgacacgctgaatccacaatggaatgagcagtatacatgggaggtgttcgatccttgcaccgtgatcacagtggtggtgttcgacaatggccaaattgggagcaagaatggtggtggcccagatcagcggattggaaaggtcaggatccggctgtcaacactggagactgacagggtgtacacacatttctaccctttgctggttttacatccaagtggactcaagaagaccggtgagctgcatttggctgtgcggtttacctgcatggcttgggtgaacatgatggcgctgtatggtcgtccactgctaccgaaaatgcactacacacagccgatcccagtgatgcaattggactacctgaggcaccaggcaatgcagattgttgcagcaaggcttagtcgtgctgagcccccactacgcagggaagttgttgaatacatgctcgatgtggactcgcacatgtttagtctccgacgcagcaaggctaatttttatcgtattacctcactgttctatggttttctggcaatgctcaagtggtatgaaggcatcaggagctggcggaacccaattacgacaatgctagtgcacatgctgttcctgatactgatctgctacccggagctcatcctgcccaccttcttcctctacatgttcatgattgggctgtggaactatcgttacaggccaaggcacccgtcacacatggataccaagctatcccatgctgagatgacacaccctgatgagcttgatgaggagtttgacacattccccacatccagaccagctgacattgtaagaatgcgctacgacaggctgaggagcgtcggaggtcgtgtgcagacagttgtcggggacctggcgacacaaggtgagagagcacacgccctgctgagttggagggaccctcgggccaccgcaatcttcatattcttgtccctggtggtcgccattgtgctctatgtgacgccattccaggttttgatggtgatcaccatgctttacctgctgcgacatccccggttccgcagcaggatgccctccgtgcctttcaacttctacaggagactgcctgccaagtccgatatgctcctttgagctcacagcattcagcgtacgagaaatgggtgaaagttgtaacttatttatgtctgggtgaaagttgtaacttatttatgtctgttccactcggttccttctgattagcatcaggtctgatgtgaatatgcctgatgagttcgtatattagaggccaatagtggcccaggaataaggtgttggtttaatggtttatttccttggttatgccaaagaaagggaacaactgatcccttttgagttttgggacagtgagaagaggtttttgggtgctaaaatgtaatattagcttcaggttactagcgtagaactaaaggcaggaacaatattgtccccagtgtattttgtttgcatttgtgtcagtttttgtttgtgtttcagtaatcttgcccctgcacctggaccatgatgcttgttctggtcttggcactactaaccttcgttcagtggtcatgccctgcttgttttgctgcagttgtactcggcacctgccaggcggttttgctgcgttgtttgtttgttgagaagttgtgccggcactggcagattttgtgacttgaaagagtttgttgtgttgctaaatcttttggctgaaggtgccgtgttcgagcacactatgtttgttttctttgaaaagctgagcacactatgttgttttccgcggtccagtgcagaaatgaagccacattttctgcgcaactgatgcaagaaacaccagcgg

SEQ ID NO: 1260 - DNA, 2675 bp, Avena sativa
gccgaaacccgcaggaggcggggcggcgccagccccggcaccaggctccgcctatggcctcgtggagaccaagcctcccctcccggccaagatgggcccgcgctccggcgcggccaagatcgcctccacctacgacatggtggagccgatgaagtacctctacgtgtccgtcgtcaaggcgcgggacctgccgaccatggacatcaccggctcgctggacccctacgtggaggtgaagctcggcaacttcaagggcgtgacgcggcacctgcagaagaactccaaccctgtgtggcggcagacgttcgccttctccggcgcgcacctccaggccagccagatcgaggtcatcgtcaaggacaaggacgtggtccaggacgacttcgtgggccgcgtcatcttcgacatgtccgacgtgcccagcaggctgccgcccgactcgccgctcgcgccgcagtggtaccgcctctccgacgcccacggcaacaagctccgccacggcagccaccacggcttcggcgagatcatgctggcggtgtggctaggcacgcaggccgacgaggcgttcccggaggcgtggcactcggacgcgcactcgctgtctcaggaagggctcaccaacacgcgcgccaaggtgtactactcgcccaagctcatctacctcaagttcaacgtcatcgccgcgcaggacctggtcgccgccgacaaggaccggccgctagcggccaccatcaccaagatccaaatggggaaccagatccgtcggacaaagccccagagcgggacggcgaacccgacgtggaacgaggagttcatgttcgtcgcctccgagcccttcgacgagccgctcttcatcaccgtcgaggaccgcgtcgggcccggccgcgacgagccgctcggccgcatcgtgctgcccctcaacgtcgcgatgccgcgccacgaccactacggcaagcccgtggagccgcgctggttcagcctcggccggcccagcgacgatcctgacaagaaggaaggcaagttcgccagcaagatacagattcggatgtcgctggacttcgggtaccacgttctcgacgagtccacctactacagcagcgatctccagccgtcctcaaagcacacacggaagccaagcattgggatccttgaggtgggggttcttggcgcacgcaatctgataccgatgaaggccaaggatggtcgcagcaccgatgcttactgtgtcgccaagtatggtccgaaatgggtgcgtacaagaacaattctcaacacactgaatccgcagtggaatgagcagtacacctgggaggtgtttgatccctgcactgtgatcaccgtggtggtgttcgacaacagccagattgcgagcaagaatggtgaggcccgggatgagcatattggcaaggtcaggattcgtctgtcgacactagagaccgaccgggtgtacacccatttctacccgttgcttgctctgaagccaagtggactcaagaagaccggcgagctgcatttggctgtgcggttcacctgcacggcatgggtgaacatgattgcgatgtatggccgtcctctgctgccgaagatgcactactccgcaaacccaatatcagtgatgcagttggactacctgaggcaccaggcgacgcagattgtttcggcaaggcttagccgtgcagagcctccactgcgcagggaggtggtggagtacacgcttgatgtgggctcacacatgtttagtctccggcgcagcaaggccaacttttaccggatcacctccctgttctatggttgtgccgcgatggccaagtggtatgatggcatcaggagctggcgaaacccgatcacaacaatgctggtgcacatgctgttcctgattctgatctgctacccagagctcatcctgcctaccatcttcctctacatgttcatgatcgggctgtggaactacaggttcagatcaaggcacccaccacacatggacactaagctatcccaggctgagtttacacaccctgatgagctcgatgaggagttcgacacattcccaaccaacaggccagctgacattgtgagactgcgctacgacaggctgaggagtgttggaggtcgtgtgcagactgtggtgggtgacctggcgacgcaaggtgagagagctcatgcgttgctgagttggagggaccctcgggcgaccgccatcttcatattcctgtccctggtcgtggccattgtgctgtacgtgacgccgttccaggttttgatggtgatcactatgctctacttgctgcgccatccccggttccgcagcaggatgccctctgtcccgttcaacttctacagaaggttgcctgccaagtctgatttgctcatttgagaccagagcattcaacagaagataaatgagggagccctgtagcattatttgtctccctctattctgttccttctgattaacatcagatcagatgtgaatatactcaattagaggcagttggtgtcccaggaataaggtattggttcatatgttatctgcttaggcagaaatgaaaggaatgactggacgaccccttaatagttttggatgaaaatggttggtcttcaggcttctagtgtagggcaaattgcagggcacaggagtgagttccagtgtgttattaatttcgttcatgtatcgg

SEQ ID NO: 1261 - DNA, 658 bp, Secale cereale
agcagacagcatcctacctgcgatccgatacagatttccaccccgagctacaaagctacaaaccaaagcaacaccgataatgtcgatcgtgaggcggagcaacgtctttgaccccttcgccgacctctgggctgaccctttcgacacctttcgctccatcgtcccggcaatctcaggcaacaacagcgagacggcggccttcgccaatgcccggatggactggaaggagacccccgaggcgcacgtcttcaaggccgacctccccggcgtgaagaaggaggaggtcaaggtggaagtggaggacggcaatgtgctcgtcgtcagcggcgagcgcactaaggagaaggaggacaagaacgacaagtggcatcgcgtggagcgcagcagcggcaagttcgtgaggcgcttccggctgccggaggacgccaaggtggaggaggtgaaggccgggctggagaacggcgtgctcaccgtcaccgtgcccaaggccgaggtgaagaagcccgaggtgaaggccatcgagatctccggctgagtatttgggtcagagccagtttggttgattgtgctacagttgtgtcttgttcttgttgagtctggtgagagttgtctgaattttgtgtaatcaccaacagatttggcgatgaataaataagaa

SEQ ID NO: 1262 - DNA, 457 bp, Avena sativa
atgtcgatcgtgcggcggagcaacgtcttcgaccccttcgccgacctctgggcggaccccttcgacaccttccgctccatcgtcccggcgatctcaggtggcagcagcgagacggccgcgttcgccaatgctcgcatggactggaaggagacccccgaggcgcacgtcttcaaggccgaccttccaggcgtgaagaaggaggaggtcaaggtggaggtggaggacggcaacgtgctcgtcgtcagcggcgagcgcaccaaggagaaggaggacaagaacgacaagtggcaccgcgtggagcgcagcagcggcaagttcgtcaggcggttccggctgccggaggacgccaaggtggaggaggtgaaggccgggctggagaacggcgtgctcaccgtcaccgtgcccaaggccgaggtcaagaagcccgaggtgaaggccatcgagatctccggctgag

SEQ ID NO: 1263 - DNA, 805 bp, Secale cereale
gcaaaagcacacagcatcctacctgcgatccgttacagattttctccccgagctacagaccaaagcaacaccgactgagaatgtcgatcgtgaggcggagcaacgtcttcgaccccttcgccgacctctgggccgaccccttcgacaccttccgctccatcgtcccggcgatctcaggcggcagcagcgagacggccgcgttcgccaatgctcgcatggactggaaggagacccctgaagcgcacgtcttcaaggccgaccttccaggggtgaagaaggaggaagtcaaggtggaggtggaggacggcaacgtgcttgtcgtcagcggcgagcgcacaaaggagaaggaggacaagaacgataagtggcatcgtgtggagcgtagcagcggcaagttcgtgaggcgtttccggctgccggaggacgccaaggtggaggaggtgaaggccgggctggagaacggtgtgctcaccgtcaccgtgcccaaggcggaggtcaagaagccagaggtgaaggccatcgagatctccggctgagtgcatgcgtctcaacgtatgattgattgggtcggggccagtttggttgatgaatcatgagtgcgagtttggcaactttgagaatcatgcgtgtttttcttgatgagtctagtgagacaccgtccctgtattgctttcattccccaggcgtttatgtgtgtaatagccaacaggtttggccaagaataaatgagaaataaatctttgtgaatttttaaaaaaaaaaaaaaaagaaaaactgaagactcgacgaaggacacaacgaggga

SEQ ID NO: 1264 - DNA, 721 bp, Triticum aestivum
cctagtcctacctacgatctacagaattttccgagcgcacaagccgaagcaatcaacaccgacgatgtcgatcgtgcggcggagcaacgtgttcgaccccttcgccgacctctgggcggaccccttcgacaccttccgctccatcgtcccggcgatctctggcggcagcagcgagacggccgcgttcgccaacgcccggatggactggaaggagacccccgaggcgcacgtcttcaaggccgacctccccggcgtgaagaaggaggaggtcaaggtggaggtggaggacggcaacgtgctcgtcgtcagcggcgagcgcacaaaggagaaggaggacaagaacgacaagtggcaccgcgtggagcgcagcagcggcaagtttgtcaggcggttccggctgccggaggacgccaaggtggaggaggtgaaggccgggctggagaacggcgtgctcaccgtcaccgtgcccaaggccgaggtcaagaagcccgaggtcaaggccatcgagatatccggctgagtatttgggtcagagccagtctggttcatgtgtgtgcaagttctgcagcctaaaagtatgctacagttgtgtctttgttctcgccgagtctggtgaggcatttggtctctgtattgcgtttcttttccctgttgcgtctgtacttgtgtaatcgccaacagatttggcgatgaataaatgagaaataaattgttctgattt

SEQ ID NO: 1265 - DNA, 877 bp, Triticum aestivum
atcccaactcaaatcagcgtcaagcaaaagcagacagcatcctacctgcggtccgatacagattttcccccgagctacaacccaaagcaacatcgacaatgtcgatcgtgaggcggagcaacgtgttcgaccccttcgccgacctctgggccgaccccttcgacaccttccgctccatcgtcccggcgatctcaggcggcaacagcgagacggccgcgttcgccaacgcccggatggactggaaggagacgcccgaggcgcacgtcttcaaggccgacctccccggcgtgaagaaggaggaggtcaaggtggaggtggaggacggcaacgtgctcgtcgtcagcggcgagcgcacaaaggagaaggaggacaagaacgacaagtggcaccgcgtggagcgcagcagcggcaagttcgtcaggcgcttccgcctccccgaggacgccaaggtggaggaggtgaaggccgggctggagaacggcgtgctcaccgtcaccgtgcccaaggccgaggtcaagaagcccgaggtgaaggccatccagatctccggctgagtattcgggtcagagcctgtctggttcatgtgtgtgcgagctctgccacctaaaagtatgctatagttgtgtcttgttcttgctgatcgagtgtggcgaggcatctgtacttgtattgcgtttcttctccctgttgtgtctgtacttgtgtaatcgtcaaacagatttggcgatgaataaatgagaaataaattgttctgattttgagtgtgcagtgcagactttgcatacacaaaatttgacttgtttttgcttgtgtttcgaatggacaggatcaggagaaacatggcaagcgggaactaggtcgccatctgctaaagaat

SEQ ID NO: 1266 - DNA, 968 bp, Hordeum vulgare
ccatccaaactcaaccgagcgccaagcaaaagcagacaacaacctacctacgatcagaattttccccgagctacaaaccaaagcagcaccgacgatgtcgatcgtgaggcgtagcaacgcgttcgaccccttcgccgacctctgggctgacccgttcgacaccttccgctccatcgtcccggcgttctctagcaacagcgagacggccgccttcgccaatgctcgcgtcgactggaaggagaccccggaggcgcacgtcttcaaggccgaccttcccggcgtgaagaaggaggaggtcaaggtggaggtggaggacggcaacgtgctcgttgtcagcggcgagcgcactaaggagaaggaggacaagaacgacaagtggcaccgtgtggagcgtagcagcggcaagttcgtgaggcgcttccgcctgccggaggacgccaaggtggaggaggtgaaggccggactggagaacggtgtgctcaccgtcaccgtgcccaagacagaggtcaagaagcccgaggtgaaggccatcgagatctccggctgaatgcatgcgcctcgacgtatactctggttggagcgagtttggttgatgtgtgcgagttctgcaacctgaaactatgctacagttgtgtcgttgttcttgccgagtctagagagaaatctctgtattgtgtttctttccccagtcgtttcggtacttatgtaatcgccaacaggtgaataataaatgagaaataaagtgtgctgattttgggtgcagtgcagattttgcatacacaaaatttgaccctttttctcattgtaatttagatggacagcgtgaagagaattagagaaaaatgtcattcggtcatttccgataataaatcactcttttcttttatcaagtagccgcaaagattcattggtctcaaggaaagatttttggagtatggatgcttggctagcgggaactagggcaccac

SEQ ID NO: 1267 - DNA, 794 bp, Secale cereale
tccgcctcacgatcgacattgtcggtgttgctttggtttgtaactcaaatcagtttcaagcaaaagcacacagcatcgtacctgcgatccaatattgatttccccttgagctacaaccaaagcaacaccgacaatgtcgatcgtgaggcggagcaacgtgttcgaccccttcgccgacctctgggctgaccccttcgacaccttccgctccatcgtcccggcgatctcaggcggcagcagcgagacggccgcgttcgccaatgctcgcatggactggaaggagacccctgaagcgcacgtcttcaaggccgaccttccaggggtgaagaaggaggaagtcaaggtggaggtggaggacggcaacgtgctcgtcgtcagcggcgagcgcactaaggagaaggaggacaagaacgataagtggcatcgtgtggagcgtagcagcggcaagttcgtgaggcgtttccggctgccggaggacgccaaggtggaggaggtgaaggccgggctggagaacggtgtgctcaccgtcaccgtgcccaaggcggaggtcaagaagccagaggtgaaggccatcgagatcgccggctgagtgcatgcgtctcaacgtacaattgattgggtcgggaccagtttggttgatgaatcatgagtgtgcgagttcggcaactttgagaatcatgcgtgtttttcttgatgagtctagtgagacactgtccctgtactgctttcattccccaggcgtttatgtgtgtaatagccaacaggtttggccaagaataaatgagaaataaatc

SEQ ID NO: 1268 - DNA, 712 bp, Secale cereale
gtttcaagcaaaagcacacagcatcctacctgcgatccgttacagattttctccccgagctacagaccaaagcaacaccgactgagaatgtcgatcgtgaggcggagcaacgtgttcgaccccttcgccgacctgtgggccgaccccttcgacaccttccgctccatcgtcccggcgatctcaggaggcagcagcgagacggccgcttttgccaacgcccggatggactggaaggagacccccgaggcgcacgtcttcaaggctgatcttccaggggtgaaaaaggaggaggtcaaggtggaggtagaggacggcaacatgctcgtcgtcagcggcgagcgcacaaaggagaaggaggacaagaacgataagtggcatcgtgtggagcgtagcagcggcaagttcgtgaggcgtttccggctgccggaggacgccaaggtggaggaggtgaaggccgggctggagaacggtgtgctcaccgtcaccgtgcccaaggcggaggtcaagaagccagaggtgaaggccatcgagatctccggttgagtgcatgcgtctcaacgtatgattgatttggtcgggaccagtttggttgatgaatcatgagtgtttttcttgacgagtatagtgaaacaccgtccctgtattgctttcattcccttggcgtttatgtgtgtaatagccaacaggtttggccaagaataaatgagaaata

SEQ ID NO: 1269 - DNA, 734 bp, Secale cereale
caaaagcagacagcatcctacctaagatcccatacagaattttccagagcgcacgagcagaagcaatcaacaccgacaatgtcgatcgtgaggcggagcaacgtgttcgaccccttcgccgacctctgggcggaccccttcgacaccttccgctccatcgtcccggtgatctcaggcggcaacagcgagacggccgcgttcgccaacgctcgcgtggactggaaggagaccccggaggcgcacgtcttcaaggccgacctccccggcgtgaagaaggaggaggtcaaggtggaggtggaggacggcaacgtgctcgtcgtcagcggcgagcgcacgaaggagaaggaggacaagaacgacaagtggcaccgcgtggagcgcagcagcggcaagttcgtgcggcgcttccgcctgccggaggacgccaaggtggaggaggtgaaggccgggctggagaacggcgtgctcaccgtcaccgtgcccaaggccgaggtcaagaagcccgaggtgaaggccatcgagatctccggctgagtattcgggtcagagccagtctggtactctggttcgtatgtgtgtgagttatgcagcgtaaaagtatgctacagtcgtgtcgttgttttcgccgagcctggtgaggcttctctgtatttccgcagctgtgtatgtacttgtgtaatcgccaacagatttggcgatgaataaatgagaaataaactgttctgattttgagt

SEQ ID NO: 1270 - DNA, 1347 bp, Triticum aestivum
cagcaccaaccaaatggctcgcttcgccgtggtcgccgccatcgtcgccctcctggccatcaccgccgccgcgcagggtcccatgccggcgcccaagatggccccgctgccggcgcccccgacgaggtcgcccccggtcgccacgcctccgaccgcatcggcgccgtccccgatggcctctcccccggccccgcccaccgacgcccccaccggcgctccttccgcgatgacgccttccgcggtcgccggagcacccgcgggcgcacctgccggcgcgcccagcggcaccacccccgccagctccgccgtctacgcctcctccgtcagcttcgtcgccgtcgccggtgccgtcgccgccgccgtcatgttctagatgcagcggtcctcgctcgaccgccgcgggagtgccactctgttttcattagtactgttgtttatacaacgagattcatttttagaggctgcggagagagtgacatgacatgacattgccatgttatcttgctacatactgtatgctcgagatcattattaatagaattctttcatttgttaaaaaaaaaaaaaaaaaaactcgagactagttctctcaaaagccagcagtatcatattcctaccaacgatccgatacagaattttctgagctcacaacccgaagcaatcaacaccagcaatgtcgatcgtgcggcggagcaacgtcttcgaccccttcgccgacctctgggcggaccccttcgacaccttccgctccatcgtcccggcgatctcaggtggcagcagcgagacggccgcgttcgccaatgctcgcatggactggaaggagacccccgaggcgcacgtcttcaaggccgaccttccaggcgtgaagaaggaggaggtcaaggtggaggtggaggacggcaacgtgctcgtcgtcagcggcgagcgcaccaaggaaaaggaggacaagaacgacaagtggcaccgcgtggagcgcagcagcggcaagttcgtcaggcggttccggctgccggaggacgccaaggtggaggaggtgaaggccgggctggagaacggtgtgctcaccgtcaccgtgcccaaggccgaggtcaagaagcccgaggtgaaggccatccagatctccggctgagtgaatgcgtctctgcgaatgatcatcagggttggagccagtttggttaatgtgtgcgagttctgcaacctgaaagtatgctatagttgtgtcttcgtcttgccgagtctgatgagacatctctgtagtgcgtttctttccccagccgtgtatgttcttgtgtaatcgccaacagatttggcgatgaataaatgaaaaataaacccttctgtttttaa

SEQ ID NO: 1271 - DNA, 710 bp, Pseudoroegneria spicata
ttttttccgagcgcacaagccgaagcaaccaacaccgacgatgtcgatcgtgaggcggagcaacgtgttcgacccattcgccgatctatgggctgaccccttcgacaccttccgctccatcgtcccggcgatctcaggcggcaacagcgagacggccccgttcgccaacgcccgggtggactggaaggagacccccgaagcgcacgtctttaaggccgacctccccggcgtgaagaaggaggaggtcaaggtggaggtggaggacggcaacgtgctcgtcgtcagcggcgagcgcacaaaggaggaggaggacaagaacgacaagtggcaccgtgtggagcgcagcagcggcaagtttgtgaggcgtttccgcctgccggaggacgccaaggtggaggaggtgaaggccgggctggagaacggtgtgctcaccgtcaccgtgcccaaggctgaggtcaagaagcccgaggtgaaggccatcgagatctccggctgagtgcatgcatctcgacatatgatcattcgggttgatgtgtgtgtgagttctgcaacctaaaagtatgctacagttgtgtctttgttcttaccgagtctggtgagacagctctgtattgttttctttcccggctcagtcccttctgtacttgtgtaatcgccaacagatttggcgacgaacaaatgagaaataaactgttctgattttgggtgca

SEQ ID NO: 1272 - DNA, 588 bp, Secale cereale
caacaccgacaatgtcgatcgtgaggcggagcaacgtgttcgaccccttcgccgacctctgggcggaccccttcgacaccttccgctccatcgtcccggcgatctcaggcggcaacagcgagacggccgcgttcgccaacgctcgcgtggactggaaggagaccccggaggcgcacgtcttcaaggccgactccccggcgtgaagaaggaggaggtcaaggtggaggtggaggatggcaacgtgctcgtcgtcagcggcgagcgcacgaaggagaaggaggacaagaacgacaagtggcatcgcgtggagcgcagcagcggcaagtttgtgaggcgcttccggctgccggaggacgccaaggtggaggaggtgaaggccgggctggagaacggcgtgctcaccgtcaccgtgcccaaggcccaggtcaagaaacccgaggtgaaggccatcgagatctccggctgagtattcgggtcagacccactctggtactctggttcgtatgtgtgtgagttatgcagcctaaaagtatgctacagtcgtgtcgttgttttcgccgagcctcgtgaggcttctctgtatttccg

SEQ ID NO: 1273 - DNA, 528 bp, Secale cereale
gcatcctacctgcggtccgatacagattttctccccgagctacaaaccaaagcaacaccgaccggcaatgtcgattgtgaggcgtagcaacgtctttgaccccttcgccgacctctgggctgaccccttcgacaccttccgctccatcatcccggcgatctcaggcggcaacagcgagactgccgtgttcgccaatgcccggatggactggaaggagacccccgaggcgcacgtcggtcaagggctgacctccccggcgtgaagaaggaggaggtcaaggtggaggtggaggacggcaacgtgctcgtcgtcagcggcgagcgtactaaggagaaggaggacaagaacgacaagtggcatcgcgtggagcgcagcagcggcaagttcgtgaggcgcttccgcctgccggaggacgccaaggtggaggaggtgaaggccgggctggagaacggtgtgctcaccgtcactgtgcccaaggccgaggtcaagaagcctgaggtgaaggccattgagatctccggctgagtg

SEQ ID NO: 1274 - DNA, 833 bp, Secale cereale
agcagacagcatcctacctgcgatccgatacagatttccaccccgagctacaaagctacaaaccaaagcaacaccgataatgtccatcgtgaggcggagcaacgtgttcgaccccttcgccgacctctgggcggaccccttcgacaccttccgctccatcgtcccggcgatctcaggcggcaacaacgagacggccgtgttcgccaatgctcgcgtggactggaaggagacccccgaggcgcacgtcttcaaggctgatcttccaggggtgaagaaggaggaggtcaaggtggaggtggaggacggcaacgtgctcgtcgtcagcggcgagcgcacgaaggagaaggaggacaagaacgacaagtggcaccgcgtggagcgcagcagcggcaagttcgtgcggcgtttccggctgccggaggacgccaaggtggaggacgtgaaggccgggctggagaacggcgtgctcaccgtcaccgtgcccaaggccgaggtcaagaagcccgaggtgaaggccatcgagatctccggctgagtattcgggtcagacccactctggtactctggttcgtatgtgtgtgagttctgcagcctaaaagtatgctacagtcgtgtcgttgttttcgccgagcctggtgaggcttctctgtatttccgcagctgtgtatgtacttgtgtaatcgccaacagatttggcgatgaataaatgagaaataaactgttctgattttgagtgcagtacagactctgcacaacaaaataaaaaaaaaaaaaaaaagaaaaaaaaaaaaactaaaagagaactacgacgaacgacgacacaggagtagagg

SEQ ID NO: 1275 - DNA, 754 bp, Secale cereale
agcagacagcatcctacctgcgatccgatacagatttccaccccgagctacaaagctacaaaccaaagcaacaccgataatgtcgatcgtgcggcggagcaacgtgtttgaccccttcgccgacctctgggctgaccctttcgacaccttccgctccatcgtcccggcgatctcaggcggcagcaacgagacggcagcgttcgccaatgctcgcgtggactggaaggagacccccgaggcacacgtcttcaaggccgacctccccggcgtgaagaaggaggaggtcaaggtggaggtggaggacggcaacgtgctcgtcgtcagcggcgagcgcacgaaggagaaggaggacaagaacgacaagtggcatcgcgtggagcgcagcagcggcaagtttgtgaggcgcttccggctgccggaggacgccaaggtggaggaggtgaaggccgggctggagaacggcgtgctcaccgtcaccgtgcccaaggcccaggtcaagaagcccgaggtgaaggccatcgagatctccggctgagtattcgggtcaaacccactctggtactctggttcgtatgtgtgtgagttctgcagcctaaaagtatgctacagtcgtgtcgttgttttcgccgagcctggtgaggcttctctgtatttccgcagctgtgtctgtacttgtgtaatcgccaacagatttggcaatgaataaatgagaaataaactgttctgattttgagtgcagtacagactctgcaca

SEQ ID NO: 1276 - DNA, 747 bp, Secale cereale
agcagacagcatcctacctgcgatccgatacagatttccaccccgagctacaaagctacaaaccaaagcaacaccgataatgtcgatcgtgaggcggagcaacgtgtttgaccccttcgccgacctctgggctgaccctttcgacaccttccgctccatcgtcccggcgatctcaggcggcagcaacgagacggcagcgttcgccaatgctcgcgtggactggaaggagacccctgaggcacacgtcttcaaggccgacctccccggcgtgaagaaggaggaggtcaaggtggaggtggaggatggcaacgtgctcgtcgtcagcggcgagcgcacgaaggagaaggaggacaagaacgacaagtggcaccgcgtggagcgcagcagcggcaagttcgtgcggcgtttccggctgccggaggacgccaaggtggaggaggtgaaggccgggctggagaacggcgtgctcaccgtcaccgtgcccaaggcccaggtcaagaagcccgaggtgaaggccatcgagatctccggctgagtattcgggtcagagccagtttggtactctggttcatgtgtgtgcgagttctgcagcctaaaagtatgctacagttgtgtcgttgttttcgccgagcctggtgaggcttctctgtattgcgtttcttttcccagttgtgtctgtacttgtgtaatcgccaacagatttggcgatgaataaatgagaaataaactgttctgattttgagtgca

SEQ ID NO: 1277 - DNA, 737 bp, Secale cereale
tcaagcaaaagcaaacagcatcttacctacgatccgatacaggttttctgcccgagctacaaacaaagcaacaccggcaatgtcgatcgtgcggcggagcaacatgttcgaccccttcgccgacctctgggcggaccccttcgacaccttccgctccatcatcccggccatctcaggcggcaacagcgagacggctgcattcgcgaacgcccggatggactggaaggagacccctgaggcgcacgtcttcaaggccgacctccccggcgtgaagaaggaggaggtcaaggtggaggtggaggacggcaacgtgctcgtcgtcagcggcgagcgcacgaaggagaaggaggacaaaaacgacaaatggcatcgtgtggagcgcagcagcggcaagttcgtgcggcgctttcgcctaccagaggacgccaaggtggaggaggtgaaggccgggctggagaacggcgtgctcgccgtcaccgtgcccaaggcccaggtcaagaagcccgaggtgaaggccatcgagatctccggctgagtattcgggtcagacccactccggtactctggttcgtatgtgtgtgagttatgcagcctaaaagtatgctacagtcgtgtcgttgttttcgccgagcctggtgaggcttctctgtatttccgcagctgtgtatgtacttgtgtaatcgccaacagatttggcgatgaataaatgagaaataaactgttctgattttgagtgc

SEQ ID NO: 1278 - DNA, 697 bp, Secale cereale
cctgcgatccgatactgatttcctccttgagctacaaaccaaagcaacaccgaccatgtcgatcgtgcggcggagcaacgtgttcgaccccttcgccgacctgtgggccgaccccttcgacaccttccgctccatcgtcccggcgatctcaggcggcagcagcgagacggccgcttttgccaacgctcgcgtggactggaaggagacccccgaggcacacgtcttcaaggctgacctccctggagtgaagaaggaggaggtcaaggtggaggtggaggacggcaacatgctcgtcgtcagcggcgagcgcacaaaggagaaggaggataagaacgacaagtggcaccgtgtggagcgcagcagcggcaagtttgtgaggcggttccggctgccggaggacgccaaggtggaggaggtgaaggccgggctgaagaacggtgtgctcaccgtcaccgtgcccaaggcggaggtcaagaagccagaggtgaaggccatcgagatctccggttgagtgcatgcgtctcaacgtatgattgattgggtcgggaccagtttggttcatgaatcatgagtgtgctacagatgtgtgcttttcttgatgagtctagtgagataccgtccctgtattgctttcattcccaggcgtttatgtgtgtaatagccaacaggtttggccaagaataaatgagaaataaat

SEQ ID NO: 1279 - DNA, 606 bp, Triticum aestivum
atgtcgatcgtgaggcggagcaacgtgttcaacccctttgccgacctttgggcggaccccttcgacaccttccgctccatcgtcccggcgatctcaggcggcaacagcgagacggcggcattcgccaacgcccgcgtggactggaaggagagccccgaggcgcacgtcttcaaggcagatcttccaggggtgaaaaaggaggaggtcaaggtggaactggaggacggcaacgtgctcgtcgtcagcggcgagcgcacaaaagagaaggaggacaagaacgacaagtggcaccgcgtggagcgcagcagcggcaagttcgtgcggcgtttccggctgccggaggacgccaaggtggaggaggtcaaggccgggctggagaacggcgtgctcaccgtcaccgtgcccaaggccgaggtcaagaagcccgaggtgaaggccatcgagatctccggctgagtgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagat

SEQ ID NO: 1280 - DNA, 1055 bp, Triticum aestivum
aaggcccacaagaccaaagcaggagagtactccagaacaccgtgggatcgtcgtgggctgaaaatagaagcaacaggaagctcacagccgagctggaaagcgataaagtaccaccaaacgctcgtccactggagagacctcgagacgcttcaagagcatcacccggcgaccctataaatacctggcctccatcgccctccaccccaactcaagccagtgtcaaccaaaagtagacagcatcctacctgcgacccaatccagaacagattttttccccgagctagaaaccaaagtaacaccgacgatgtcgatcgtgcggcggagcagcgtgttcgaccccttcgccgacctctgggctgaccctttcgacaccttccgctccatcatcccggcgatctcaggcggcaacagcgagacggccgcgttcgccaatgctcgcatggactggaaggagacccccgaggcgcacgtcttcaaggccgacctccccggcgtgaagaaggaggaggtcaaggtggaggtggaggacggcaacgtgctcgtcgtcagcggcgagcgcacaaaggagaaggaggacaagaacgacaagtggcaccgcgtggagcgcagcagcggcaagttcgtcaggcgcttccgcctccccgaggacgccaaggtggaggaggtgaaggccgggctggagaacggtgtgctcaccgtcaccgtgcccaaggcccaggtcaagaagcccgaggtgaaggccatccagatctccggctgagtggacgcgtctcggcgtatgatcatcagggatggagccagtttggttgatgtgtgtgcgaggtctgcaacctgaaagtatgctacagttgtgtcttgttcttggcgagtctggtgagacatctctgtagtgcgtttctttccccagttacttgtgtaatcgccaatagatttggtgatgaataaatgagaaataaatccttctgtttttgagtgcaatgcagattttgcatagacaaaatttgagccttttttttgcttgtatagttcggatggaaaggatcaagagaaaaatg

SEQ ID NO: 1281 - DNA, 873 bp, Hordeum vulgare
atcccaactcaagccagcgtcaagcaaaagcgaacaacatcctacctacaatccgatacagattaatttcaacgcgagctacaaaccaaagcaagcaacaccgacaatgtcgatcgtgaggaggagcaacgtgctggaccccttcgccgacctctgggccgaccccttggacaccttccgctccatcttcccggcgatctcaggcgggaacagcgagacagctgcgttcgcgaacgcccggatggactggaaggagacgcctgaggcacatgtcttcaaggctgatcttcctggcgtgaagaaagaggaggtcaaggtggaggtggaggacggcaacgtgctcatcgtcagcggcgagcgcaccaaagagaaggaggacaagaacgacaagtggcatcgggtggagcgcagcagcgggaagttcgtgcggcgcttccgcctgccagaggacgccaaggttgatgaagtgaaggccggactggagaacggtgtgctcaccgtcaccgtgcccaaagccgaggtcaagaagcccgaggtgaaggccatcgagatctccggctgagtgcatgcttttttctacaaaaatatctgcttaagaatagagtaagaaaactgtgcacgaagaatataggtacgaagggtctgaaatattggtgatcgatgagctgaatgtgacctgtcttatcttcaggttcactaatcatgggtctacgatgatcaataccctaaatattcattgtatacccttttaccatgacgtgatacacaacttctgtaatgctacagtattaaaagagtatctttggtccatcataccgtacaagagaccagtggcgaatcttggaagaaaatgaaggaagggttcaaagtcaa

SEQ ID NO: 1282 - DNA, 731 bp, Triticum aestivum
agccagtgtcacgcaacagcaaacaacatccttttcctacctacgatccgataccgaattttccgagcgcacaagccaaaccaaagcaaacactgacgatgtcgatcgtgaggcggagcaacgtgttcgaccccttcgccgacctttgggcggaccccttcgacaccttccgttccatcgtcccggcgatctcaggcggcagcagcgagacggccgcgttcgccaacgcccgtgtggactggaaggagacccccgaggcgcacgtcttcaaggtcgacctccccggcgtgaagaaggaggaggtcaaggtggaggtggaggacggcaacgtgctcgtcgtcagcggcgagcggagcagggagaaggaggacaagaacgacaagtggcaccgcgtggagcgcagcagcggcaagttcgtgcggcgtttccggctgccggaggacgccaaggtggaggaggtcaaggccgggctggagaacggcgtgctcaccgtcaccgtgcccaaggccgaggtcaagaagcccgaggtgaaggccatcgagatctccggctgagtgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaat

SEQ ID NO: 1283 - DNA, 753 bp, Secale cereale
gcaaaagcagacagcatcctacctgcgatccgatacagacttccaccccgagctacaaagctacaaaccaaagcaacaccgataatgtcgatcgtgaggcggagcaacgtgtttgactttgaccccttcgccgacctctgggctgaccctttcgacaccttccgctccatcgtcccggcgatctcaggcggcagcaacgagacggcagcgttcgccaatgctcgcgtggactggaaggagacccctgaggcacacgtcttcaaggccgacctccccggcgtgaagaaggaggaggtcaaggtggaggtggaggatggcaacgtgctcgtcgtcagcggcgagcgcacgaaggagaaggaggacaagaacgacaagtggcaccgcgtggagcgcagcagcggcaagttcgtgcggcgtttccggctgccggaggacgccaaggtggaggaggtgaaggccgggctggagaacggcgtgctcacagtcaccgtgcccaaggcccaggtcaagaagcccgaggtgaaggccatcgagatctccgggtgagtattcgggtcagagccagtctggtactctggttcatgtgtgtgcgagttctgcagcctaaaagtatgctacagttgtgtcgttgttttcgccgagcctggtgaggcttctatgtattgcgtttctttccgcagctgtgtctgtacttgtgtaatcgccaacagatttggcaatgaataaatgagaaataaactgttctgattttga

SEQ ID NO: 1284 - DNA, 481 bp, Hordeum vulgare
agaattttccccgagctacaaaccaaagcagcaccgacgatgtcgatcgtgaggcgtagcaacgcgttcgaccccttcgccgacctctgggctgacccgttcgacaccttccgctccatcgtcccggcgttctctagcaacagcgagacggccgccttcgccaatgctcgcgtcgactggaaggagaccccggaggcgcacgtcttcaaggccgaccttcccggcgtgaagaaggaggaggtcaaggtggaggtggaggacggcaacgtgctcgttgtcagcggcgagcgcactaaggaggaggaggacaagaacgacaagtggcaccgtgtggagcgtagcagcggcaagttcgtgcggcgcttccgcttgccggaggacgccaaggtggaggaggtgaaggccggcctggagaacggtgtgctcactgtcaccgtgcccaaggccgaggtcaagaagcctgaggtgaaggccatcgaga

SEQ ID NO: 1285 - DNA, 876 bp, Hordeum vulgare
catcccaacccaagccagtgccaagtgcaaaagcaagcagcatccaacgatccgatacagaattttccgagcgcacaagcctaagcaatcaatcaacaccgacaatgtcgatcgtgaggcggagcaacgtgttcgaccccttggccggcctctgggcggaccccttcgacgccttccgctccatcgtccccccggcgatcgcaggcggcaacagcgagacggccgcgttcgccagcgcccgggtggactggaaagagacccccgaggcgcacgtcttcaaggccgaccttccgggagtgaagaaggaggaggtcaaggtggaggtggaggacggcaacgtgctcgtcgtcagcggcgagcgcaccaaggagaaggaggacaagaatgacaagtggcaccgcgtggagcgcagcagcggcaagttcgtcaggcgcttccgcctgccggaggacgccaaggtggaggaggtgaaggccgggctggagaacggcgtgctcaccgtcaccgtgcccaaggcccaggtcaagaagcccgaggtgaaggccatcgagatctccggctgagcgcatgcatgtgcctcgacgtatgatcatccggattggagtcagtttggttgatgtgcgtgcgagttctgcaacctgaaagtatatatgctacagttgtgtcctgctcttgccgagtctggtgagacgtctctgtactgtattgcgtttgtttccccacttgtttatgtacatgtgtaatcgccaacagatttgaccatgaataaacgagagataaatcgttctgatcttgactgcggtgcagattttgcatacgcaaaattttacccttttgcttgtggttgggatggacaggatcgacagaaaaatggca

SEQ ID NO: 1286 - DNA, 446 bp, Hordeum vulgare
aatgtcgatcgtgaggaggagcaacgtgctggaccccttcgccgacctctgggccgaccccttggacaccttccgctccatcttcccggcgatctcaggcgggaacagcgagacagctgcgttcgcgaacgcccggatggactggaaggagacgcctgaggcacatgtcttcaaggctgatcttcctggcgtgaagaaagaggaggtcaaggtggaggtggaggacggcaacgtgctcatcgtcagcggcgagcgcaccaaagagaaggaggacaagaacgacaagtggcatcgggtggagcgcagcagcgggaagttcgtgcggcgcttccgcctgccagaggacgccaaggttgatgaagtgaaggccggactggagaacggtgtgctcaccgtcaccgtgcccaaagccgaggtcaagaagcccgaggtgaaggccatcgaga

SEQ ID NO: 1287 - DNA, 506 bp, Festuca arundinacea
acaccaaccatgtcgatcgtgagaaggagcaacgtgttcgaccccttcgccgacctctgggccaaccccttcgacgccttccgctccatcgtccccacgatgtcggattccgacaccaccgccttcgccaatgctcgcatggactggaaggagacccctgaggcacacgtgttcaaggcggatcttcccggcgtgaagaaggaggaggtcaaggtggaggtggaggatggcaacgtgctcgttgtcagcggcgagcgcaccaaggagaaggaggacaagaacgagaagtggcaccgcgtcgaacgcagcagtggcaagttcgtcaggcgcttccgcctcccagagaacgccaaggtggaggaggtgaaagctgggctggagaacggcgtgctcaccgtcaccgtgcccaaggctgaggtcaagaagcccgaggtgaaggccatcgagatctctggttgagcgataaggaccagcttggtcggtgtgagtgcgaatacacccatttg

SEQ ID NO: 1288 - DNA, 703 bp, Hordeum vulgare
gccagtgtcaaacaaaagcagataacatccgacgatccgatacagaattttccgaacgcacaagccgaagcaatcaacaccggtaatgtcgatcgtgaggcggagcaacgttttcgaccccttcgctgacctctgggcggaccccttcgacaccttccgctccatcatcccggcgatctctggcaacagcgagacggccgccttcgccaatgctcgcatggactggaaggagaccccggaggcgcacgtcttcaaggccgaccttcccggcgtgaagaaggaagaggtgaaggtggaggcgtcgtcagcggcgagcgcagtaaggagaaggaggacaagaatgataagtggcaccgtgtggagcgcagcagcggcaggtttgtgaggcgcttccgcctgccggaggacgccaaggtggaggaggtgaaggctgggctggagaacggtgtgctcaccgtcaccgtacccaaggccgaggtgaagaagcccgaggtgaaggccatcgagatctccggctgagtattggggtaagaggtctccagtttggttgatgtgtgtgtgagctctgcagcctaaatacagttgtgtctttcttcttgtcgagtctggttgagacatgtctgtatcgcgttttttttcctcggtcctttgtgtacttgtgtaatcgcaatgaataaataagatataaaccgttatgaatttg

SEQ ID NO: 1289 - DNA, 710 bp, Avena sativa
cttccgatctgacatcgagaagagcgcagattacagagcaacaaagcctattgtatccaacaaacaatcaagcactttcagtctctcacctacgcgtcagttcacctccacacgcagcaacaatgtcgatggtgaggcggagcaacgtgttcgaccccttctccatggacctctgggccgaccccttcgaggccttccgctccatcgtccctgcagcctccggcaacagcgagacggccgcctttgccaacgcccgtgttgactggaaggagacccccgaggctcatgtcttcaaggccgatcttccaggggtgaagaaggaggaggtcaaggtggaagtggaggacggcaacgtgctggtcgtcagcggcgagcgcaccaaggagaaggaggacaagaacgacaagtggcaccgcgtcgagcgcagcagcggcaagttcgccaggcgcttccgtctgccggacaacgccaaggtggaggaggtcaaggctgggctggagaatggcgtgctgacggtcacggtgccaaaagccgaggtcaagaagcccgagacgaaggccatcgagatttccggctaaaaatgtgtgaccaatccatgccagcgtgaatcgtgcggcgttgtgtttccttccttggtcactagtggcctgtgtgacccatcgtcttgcattgacgaagaataaataagaataagttgtttggactttgga

SEQ ID NO: 1290 - DNA, 449 bp, Hordeum vulgare
aatgtcgatcgtgaggcggagcaacgtgttcgaccccttggccggcctctgggcggaccccttcgacgccttccgctccatcgtccccccggcgatcgcaggcggcaacagcgagacggccgcgttcgccagcgcccgggtggactggaaagagacccccgaggcgcacgtcttcaaggccgaccttccgggagtgaagaaggaggaggtcaaggtggaggtggaggacggcaacgtgctcgtcgtcagcggcgagcgcaccaaggagaaggaggacaagaatgacaagtggcaccgcgtggagcgcagcagcggcaagttcgtcaggcgcttccgcctgccggaggacgccaaggtggaggaggtgaaggccgggctggagaacggcgtgctcaccgtcaccgtgcccaaggcccaggtcaagaagcccgaggtgaaggccatcgaga

SEQ ID NO: 1291 - DNA, 639 bp, Avena sativa
cctccacacgcagcaacaatgtcgatggtgaggcggagcaacgtgttcgaccccttctccatggacctctgggccgaccccttcgaggccttccgctccatcgtccctgcagcctccggcaacagcgagacggccgccttcgccaacgcccgtgttgactggaaggagacccccgaggctcatgtcttcaaggccgatcttccaggggtgaagaaggaggaggtcaaggtggaagtggaggacggcaacgtgctggtcgtcagcggcgagcgcaccaaggagaaggaggacaagaacgacaagtggcaccgcgtcgagcgcagcagcggcaagttcgccaggcgcttccgtctgccggacaacgccaaggtggaggaggtcaaggctgggctggagaatggcgtgctgacggtcacggtgccaaaagccgaggtcaagaagcccgagacgaaggccatcgagatttccggctaaaaatgtgtgaccaatccatgccagcgtgaatcgtgcggcgttgtgtttccttccttggtcactagtggcctgtgtgacccatcgtcttgcattgacgaagaataaataagaataagttgtttggactttggactatatatagtaccgcggtgcataattatatgg

SEQ ID NO: 1292 - DNA, 684 bp, Festuca arundinacea
atagcattcgattcgaatcaggcacttgcaaacacttccgccgagcagaaaccgaagtagcgccaagccaccaatcatgtcgatcgtgaggcgcaacagcgtgttcgaccccttctccttcgatctctgggctgaccctttcgacgccttccgctccatcgtaccagcagcttccggcaatagcgagacggccgcgttcgccaacgcccgcgtggactggaaggagacccccgaggcccatgtcttcaaggcggacctccccggcgtgaaaaaggaggaggtcaaggtggaggtggaggatggcaacgtgctcgtcgtcagcggcgagcgcagcagggagaaggaggacaagaacgacaagtggcaccacgttgagcgcagcagcggcaagttcgtcaggcgcttccgcctgccggagaacgccaaggtggaggaggtgaaggccgggctggagaacggcgtgctcaccgtcaccgtgcccaaggttgaggtcaagaagcccgaggtcaaggccatcgacatctctggttgagcgtgcacgcgatatggaccagcttggtcgatgtctgcgcgagtacaccatttgccgccgttgtgtcctattcgtgtggagtcctatgtagttgtgtaccgaactcttttgtatatttcagttgtactcgtgtgatcgtgtctcagttttcc

SEQ ID NO: 1293 - DNA, 608 bp, Secale cereale
cttcgccgacctctgggctgaccccttcgacaccttccgctccatcgtcccggcgatctcaggcggcagcagcgagacggccgcgttcgccaatgctcgcatggactggaaggagacccctgaagcgcacgtcttcaaggccgaccttccaggggtgaagaaggaggaagtcaaggtggaggtggaggacggcaacgtgctcgtcgtcagcggcgagcgcactaaggagaaggaggacaagaacgataagtggcatcgtgtggagcgtagcagcggcaagttcgtgaggcgtttccggctgccggaggacgccaaggtggaggaggtgaaggccgggctggagaacggggtgctcaccgtcaccgtacccaaggccgaggtcaagaagcctgaggtgaaggccatcgagatctccggttgagtgcatgcgtctcaacgtatgattgattgggtcgggaccagtttggttgatgaatcatgagtgtgctacagatgtgtgcttttcttgatgagtctagtgagataccgtccctgtattgctttcattcccaggcgtttatgtgtgtaatagccaacaggtttggccaagaataaatgagaaataaatt

SEQ ID NO: 1294 - DNA, 700 bp, Festuca arundinacea
gcgaattgcagagcgaagcagcatacgatccagatcaaattaacacttgcagacactcatcagctcacgcagcagcaacaatgtcgatcgtgaggcgcagcagcgtgttcgatcccttctccctggacctctgggccgatcccttcgacgccttccgctccatcgtcccggcagtctccggcaacagcgaggcggccgctttcaccaacgcccgcatggactggaaggagacacccaaggcgcacgtcttcaaggccgatctccctggtgtgaaaaaggaggaggtcagggtggaggtggaggacggcaacgtgctggtcgtcagcggcgagcgcaccagggacaaggaggacaagaatgacaagtggcaccgcgtcgagcgcagcagcggcaagttcgtcaggcgcttccggctgccggagaacgccaaggtggacgaggtgaaggccgggctggagaacggcgtcctcaccgtcaccgtgccaaaagcagaggttaagaagcccgaggcgaaggcaattgagatctccggctaaatgtgtcgataatgttgatcgatcagctttgatttgtcgcagctgtgttgtgttctcgtggagtcgtgctatgtactggctgtgcttccttcgtaggtcgctacgatgtactcgtgtgattgtcttccagtttgccaataagaaataaattgtttggaatttaa

SEQ ID NO: 1295 - DNA, 712 bp, Avena sativa
cttccgatctcaactcaaagccagtgtagcaacagacgaacacaatcacatcattctaaagcagacagcccctatagaaatttccacccaaacaaaccgaagaaaccccagcaatgtcgatcgtgaggaggagcaacgtgttcggccccttcgctgacttctgggtcgaccccttcaatgccttccgctccatcgtcccggcggcctcagactctgacaccgctgcgttcgtgaatgcccgtatggactggaaggagaccccagaggcgcatgtcttcaaggcggacctccctggcgtgaagaaagaggaggtgaaggtggaggtggaagacgggaacatgctcgttgtcagcggcgagcgtaccatggagaaggaggacaagaatgacaagtggcaccgcgtcgaacgtagcagcggcaagttcgtcagacgcttcaggctgccggagaatgtgaaggtggaggaggtgaaggccgggctggagaacggcgtgctcactgtcactgtgcccaaggccgaggtcaagaagcctgaggtgaaggccatcgagatatccggctaggcgcgtcttgcttgattgatgtgtgatcggcaagtagcagcttgatttgccgccgatgtgtcgtgttcttggagagtcgtgtgtcgttgtgcatggatctttcagttgttccactttgcgacgaatgaataagaaataaattgtttgga

SEQ ID NO: 1296 - DNA, 545 bp, Lolium multiflorum
agccagtgtaaatcacatcaagcaagagctaccaacaaacatcttttcgatcccttcatttttccctcgcacagacctcagcaacattgaccatgtccatcgtcaggaggagcaacgtgttcgaccccttcgccagtctctgggccgacccctttgatgccttccgctccatcgtccccgatatgtcggactctgacactgccgccttcgctaatgcccgtatggactggaaggagacgcctgaggcacacgtgttcaaggctgatcttcccggcgtgaagaaggaggaggtcaaggtggaggtggaggacggcaacatcctcgtcgtcagcggcgagcgcacaaaggagaaggaggacaagaacgagaagtggcatcacgtcgagcgcagcagtgggaaatttgtcaggcgcttccgcctcccagaaaacaccaaaattgaggaagtgaaagccgggctggagaacggcgtgctcacagtcaccgtgcccaaggttgagaccaagaagcccgaggtgaaggctatcgagatctctggttgagca

SEQ ID NO: 1297 - DNA, 455 bp, Avena sativa
atgtcgatcgtgaggcggagcaacgtgttcgaccccttctccatggacctctgggctgaccccttcgacgccttccgatccatcatcccggcggcctctggcaacagcgagatggcggcgttcaccaacgcccgcttcgactggaaggagacgcccgaggcgcacgtgttcaaggcggacttgcctggcgtgaagaaggaggaggtcaaagtggaggtggaggacggcaacgtgctcctcgtcagcggagaacgcagcagggagaaggaggacaagaacgataagtggcaccacgtggagcgcagcagtggcaagttcgtccggcgcttccgtctgccggagaacgccaaggtggacgaggtgaaggccgggctggagaacggcgtgcttacggttacagtgcccaaggcagagatcaagaagcctgaggtgaaggccatcgagatctccggcta

SEQ ID NO: 1298 - DNA, 620 bp, Festuca arundinacea
ggcacgagggacacttgcaagcactttccccgctcaggaacagaagtagcgccaagaaaccgacaatgtcgatcgtgaggaggagcaacgtaatcgaccccttctccttggacctctgggctgaccccttcgaggccttacgctccatcgtaccggcagcttccggcaacaacgagacggccgcgtttgccaacgcccgcgtggactggaaggagacccccgaagcccatgtcttcaaggcggatctccccggcgtgaagaaggaggaggtcaaggtggaggtggaggatggcaacgtgctcgtcgtcagcggcgagcgcagcagggaaaaggaggataagaacgataaatggcaccacgtcgagcgcagcagcggcaagtttgttcggcgcttccgcctgccggagaacgccaaggtggaggaggtgaaggctgggctggagaacggcgtgctcactatcaccgtgcctaaggttgaggccaagacgcccgaggtgaaggccatcgagatctccggctaaagtgcgtgccgattgggaacagctaaagtgtgcgcgagtacagccttgatatgcaacagttttgtcagtgttttgtggattccttttttttttttgacg

SEQ ID NO: 1299 - DNA, 595 bp, Festuca arundinacea
ggcacgaggagcaaattcagatagagcatagcattcgattcaaatcagacactcgcaaacacttcccccgagcagaaaccgaagtagcgccaagacaccgacaatgtcgatcgtgaggcggagcaacgtgttcgaccccttctccctggacctctgggccgaccccttcgattccttccgctccatcatcccggcagtctccggcaataacgatactgccgcgttcgccaacgcacgcgtggactggaaggagacccccgaggcgcatgtcttcaaggccgatctccccggcgtgaagaaggaggaggtcaaggtggaggtggaggacggcaacgtgctcgtcgtcagcggcgagcgcagcagggagaaggaggacaagaacgacacgtggcaccgcgtggagcgcagcagcggcaagttcgtcaggcgcttccgcctgccggagaacgccaaggtggaggacgtgaaggccgggctggagaacggcgtgctcaccgtcacggtgcccaaggttgacatgaagaagcccgaggtgaaggccatcgatatctctggttgagcgtgtacgcgatacgcaccagcttggtagatctct

SEQ ID NO: 1300 - DNA, 646 bp, Avena sativa
gatcgagaagacccacaaattacagagcatacgaccagacaatcaaacaccagcgatcacacgccatatcccacacgcagcaaccatgtcgatcgtgaggcggagcagcgtgttcgaccccttctccatggacctctgggccgaccccttcgacgccttccgctccatcctcccggcggccgccggcaacagcgagacggccgcgttcaccaacgctcgctttgactggaaggaaaaccccgaggcgcacgtcttcaaggccgatcttcccggaatgaagaaggaggaggtcaaggtggaggtcgaggacggcaacgtgctcgtcgtcagcggcgagcgcaccaaggagaaggaggacaagaatgataggtggcagcatgtggagcgcagcagcggcaagttcgtccggcggttccgtctgccggagaacgccaaggtggaggaggtgaaggcggggctcgagaacggcgtgcttacggttacagtgcccaaggctgagatcaagaagcctgaggtgaaggccatcgagatctccggctaggtgtgtcttgcttgatcgatgcctgagcgtgagcgtgagcggcatgtaaagtgagcttcattgtgtttacttcattgtgtgtcgtgttcttgtggagtcactgtg

SEQ ID NO: 1301 - DNA, 463 bp, Avena sativa
agcaatgtcgatggtgaggaggagcaacgtgttcggccccttcgccgacctctgggtcgaccccttcaatgccttccgctctatcatcgtcccggcggcggcctcatcagactctgacaccgctgcgttcgtgaacgcccgtatggactggaaggagaccccagaggcgcacgtcttcaaggcggacctccctggcgtgaagaaggaagaggtgaaggttgaggtcgaggacggcaacacgctcgtcgtcagcggcgagcgcagcagggagaaggaggacaaaaatgacaaatggcaccgcgtcgagcgcagcagcggcaagttcgtcaggcgcttcaggctgccggagaacgcgaaggtggaggaggcgaaggccgggctggagaacggcgtgcttacagttaccgtgcccaaggccgaggtcaagaagcctgaggcgaaagccatcgagatctccggctaa

SEQ ID NO: 1302 - DNA, 593 bp, Avena sativa
atgtcgatggtgaggcggagcaacgtgttcgaccccttctccatggacctctgggccgaccccttcgaggccttccgctccatcatccctgcagcctccggcaacagcgagacggctgcgttcgccaacgcccgtgttgactggaaggagacgccggaggctcatgtcttcaaggccgaccttccaggggtgcagaaggaggaggtcaaggtggagctggaggacgacaacgtcctcgtcgtcagcggcgagcgcaccaaggagaaggaggacaacaacgacaagtggcaccgcatggagcgcagcagcggcaagttcgttaggcgttttcgcctgccggacaacgccaaggtggaggaggcgaaggccgggctggagaatggcgtgctgacggtcacggtgccaaaagccgaggtcaagaagcccgagacgaaggccatcgagatttccggctaaaaatgtgtgaccaatccatgccagcgtgaatcgtgcggcgttgtgtttccttccttggtcactagtggcctgtgtgacccatcgtcttgcattgacgaagaataaataagaataagttgtttggactttggaaaagg

SEQ ID NO: 1303 - DNA, 698 bp, Brachypodium distachyon
agccagtaagtacaaatcgcaaacatcacaccgagcaaatccaatacatctatctctcctctgagttaacccgacgacaatgtcgctcgtgaggcgcagcgcattcgaccccttcgccgacttctgggaccctctggacgtgttccgctccatcgtccccgcagcgtccggcagcgagaccgccgctttcgccaacgcccgtgtggactggaaggagaccccggaggcgcacgtgttcaaggccgacctccccggcgtgaagaaagaggaggtcaaggtggaggtggaggacggcaacgtgctcgtgatcagcggcgagcgcagcaaggagaaggaggagaagagcgacaagtggcaccgcgtggagcgcagcagcggggcgttcgtgaggcggttccgcctgccggagaacgccaaggtggagcaggtgaaggccgggctggagaacggcgtgctcacggtcaccgtgcccaaagccgaggtgaagaagcctgaggtgaaggccatcgagatctctggctgaacctgaacctgaacgcttgtcttgatgtggtgtgtgtaagagtcgtgtttggtccaagtctggcagcggttgactcgatctgtgagtcaaggctccattgtcgcctttctgtttgcgtatgaataaatgaataggaataaatcaatcagtttgtactaatattctgaacgcaaac

SEQ ID NO: 1304 - DNA, 621 bp, Festuca arundinacea
caacatcctttcgatcccttcattttcccctcgcatagacctcggcaacaccaaccatgtcgatcgtaaggcgaagcaacgtgttcgaccccttcactgacctctgggtcgacccctttgacgccttccgctccattatcccggcagcatcagattccgacaccgtcgccttcgccaatgttcgtatggactggaaggagacacccgaggcgcatgtgttcaaggcggatcttcccggcgtgaagaaggaggaggtcaagctggaggtggaggacggcaacgtcctcgttgtcagcggcgagcgcaccaaggagaaggaggacaagaacgataagtggcatcgcgtggagcgcagtagcggcaagttcgtccggcgcttccgcctcccggagaacgctaagttggaagaggtgaaggccgggctggagaacggtgtcctcactgtcaccgtgcccaaggctgagatcaagaagcccaaggtgaagcccatcaagatctccggctaagtgcgtgtcgatcatggaaaagtatcaactgcttgagtggggtatcgttagggtgttctatgtttgatgcattccgccggtgtgccctcgtatcatgtttcgtatggacattatg

SEQ ID NO: 1305 - DNA, 722 bp, Brachypodium distachyon
aacccaagaagccagtaagtacaaatcgcaaacatcacaccgagcaaatccaatacatctatctctcctctgagttaacccgacgacaatgtcgctcgtgaggcgcagcgcattcgaccccttcgccgacttctgggaccctctggacgtgttccgctccatcgtccccgcagcgtccggcagcgagaccgccgctttcgccaacgcccgtgtggactggaaggagaccccggaggcgcacgtgttcaaggccgacctccccggcgtgaagaaagaggaggtcaaggtggaggtggaggacggcaacgtgctcgtgatcagcggcgagcgcagcaaggagaaggaggagaagagcgacaagtggcaccgcgtggagcgcagcagcggggcgttcgtgaggcggttccgcctgccggagaacgccaaggtggagcaggtgaaggccgggctggagaacggcgtgctcacggtcaccgtgcccaaagccgaggtgaagaagcctgaggtgaaggccatcgagatctctggctgaacctgaacctgaacgcttgtcttgatgtggtgtgtgtaagagtcgtgtttggtccaagtctggcagcggttgactcgatctgtgagtcaaggctccattgtcgcctttctgtttgcgtatgaataaatgaataggaataaatcaatcagtttgtactaatattctgaacgcaaacaacgactgtttcgat

SEQ ID NO: 1306 - DNA, 711 bp, Avena sativa
agacgaacacaatcacaccaatctaaagttaagcagacagcatcgccccgatcctctctactcgaatttccaccccacacaaattaaaccgaagcagcactagcaatgtcgatggtgaggaggagcaacgcgttcgaccccttcgccgacctctgggtcgaccccttccatgccttccgctctatcgtcccggcggcggcctcgtcagactctgacaccgctgctgcgttcgtgaacgcccgtatggactggaaggagaccccagaggcgcacgtcttcaaggcggacctccccggcgtgaagaaggaggaggtgaaggtggaggtcgaggacggcaacacagtcgtcgtcagcggcgagcgcagcagggagaaggaggacaaaaatgacaaatggcaccgcgtcgagcgcagcagcggcaagttcgtcaggcgcttcaggctgccggagaacgcgaaggtggaggaggcgaaggccgggctggagaacggcgtgcttacagttaccgtgcccaaggccgaggtcaagaagcctgaggcgaaagccatcgagatctccggctaataagtgcgtacgtgatgttggaaatatttgatgcactcggccggtgtgcgcttgtatcatgtatcgtatgtagacgcatgtgtatttgtactgtacatgcttcgtggtactaattaatgaataaataaataaattataagttctggt

SEQ ID NO: 1307 - DNA, 886 bp, Panicum virgatum
agaaaaaagaaaagcagagaccagagaaagaaggaagaatatgccgcgaagcaatcggaaggtgaagccagagaactccagacggttcacgcgacacgtccggcatcaacctataaataacctgcctcgtccccaacctcgagccatcgagcagagcacgcagacagagcaaacgcatacaaccttcagcaatccactcgcactcgaccgcgctcagtcacctaaccgacgacgatgtcgctggtgaggcgcagcaacgtgttcgaccccttcgccgacttctgggaccccttcgacggcgtcttccgctccctggtcccgtccgtcgcgccgtcgggccgcgacaccgccgccttcgccaacgcgcgcatcgactggaaggagacccccgaggcgcacgtcttcaaggccgacctccccggtgtcaagaaggaggaggtcaaggtcgaggtggaggacggcaacgtcctggtcatcagcggcgagcgcagtaaggagaaggaggacaagaacgacaagtggcaccgcgtcgagcgcagcagcggcaagttcctccgccggttccgcctgccggagaacgccaagacggacgaggtgaaggccgggctggagaacggcgtgctcacggtcaccgtgcccaaggccgaggtcaagaagcctgaggtgaaggccatcgagatctccggttaagcaaccctggtccctggacgtgggaagaagctgtgatgatgatgctccggttctggtcgtgatcggttgatgtctgtgtcatgcataagcgtaacctgctgcctgcaatcagtgttctctgtatgaaatcatgcatgttgagcatatatgaaagtaaataaagcactactcctgcatccagcatcctttctgagag

SEQ ID NO: 1308 - DNA, 942 bp, Festuca arundinacea
caagcaagagcagccaaaacatctttttgatccccgtattttcccctcgcacagatctcagcaagactgaccatgtcgctcgtgaggcagagcaacgtgttcaaccccttcgctgacctctgggtcgaccccttcaaagctttccgctcagtcatcccggcagcatcagattccgacaccgccgccttcgtgaacgctcagatggactggaaggagacacccgaggcgcacgtgttcaaggccgatcttcccggcgtgaagaaggaggaggtcaaggtggaggtggaggacggcaacgtgctcgtcgtcagcggcgagcgcacaaaggagaaggaggacaagaacgacaagtggcaccgcgtggagcgcagcaaaggaaagttcgtccggcgattccgactacctgagaacgccaaggtggaggaagtgaaggccgggatggaaaacggcgtgctcaccattacggtgcccaaagcagaggtcaagaagccccaggtgaaagccatcgagatctccggctaagatgcgtgccgatcgggaccagcttggtccatgtccttgatttgtagcagcagctgtgtcggtgctcctatggagtcgtgtgttgttttgtatcgaactcttctgtatctttcagctgtgcgaggttgatcgtgttccagatttcagaagaacaaataaatgagaaatacaccgtttttttttacttgagaaaaaaaaaaaaaaaaaaaaaaatacccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccgc

SEQ ID NO: 1309 - DNA, 795 bp, Brachypodium distachyon
gaaacccatccgtcaagaaacagagcaaaagcagagcatatcatcccttcacaaacacacacttgaaatcaatcacatttcaccacagatctccatcaaacccgaaaccaacaaacaacaatgtcgctggtgaggcgcggcagcgtgttcgacccattctcccaggacctctgggacccgatcgacagcatcttccgctccatcgtcccggcagccgcggcctcctccgacttcgacactgcggccttcgtcaacgcccgcatggactggaaggagactcccgaagctcacgtgttcaaggcggaccttcccggagtgaagaaggaggaggtgaaggtggaggtggaagacggcaacgtgctggtggtgagcggcgagcgcagcagggagaaggaggacaagaacgacaagtggcaccgcgtcgagcgcagcagcggcaagttcgtcaggcgcttccgtttgccggagaacgctaaggtggagcaggtcaaggctgggctggagaacggcgtgctcacggtcaccgtgcccaagtctgaggtcaagaagccagaggtgaaggccatcgagatctctggttaattgcctgatcgtggagactggagaagcatcgtgatcgtatcgagtgtgcttgtgtcagctgtgctccttgatgtggttcctttgatgtttttggtgtgtctgtctgtgtgtgctggcatcttgctttgtagtcacattgtgtgatgtgtgtactttgtttgcttcgtgagaaataatgaataaataaaatttcgaaattaatatcttaaagta

SEQ ID NO: 1310 - DNA, 776 bp, Brachypodium distachyon
ccatccgtcaagaaacagagcaaaagcagagcatatcatcccttcacaaacacacacttgaaatcaatcacatttcaccacagatctccatcaaacccgaaaccaacaaacaacaatgtcgctggtgaggcgcggcagcgtgttcgacccattctcccaggacctctgggacccgatcgacagcatcttccgctccatcgtcccggcagccgcggcctcctccgacttcgacactgcggccttcgtcaacgcccgcatggactggaaggagactcccgaagctcacgtgttcaaggcggaccttcccggagtgaagaaggaggaggtgaaggtggaggtggaagacggcaacgtgctggtggtgagcggcgagcgcagcagggagaaggaggacaagaacgacaagtggcaccgcgtcgagcgcagcagcggcaagttcgtcaggcgcttccgtttgccggagaacgctaaggtggagcaggtcaaggctgggctggagaacggcgtgctcacggtcaccgtgcccaagtctgaggtcaagaagccagaggtgaaggccatcgagatctctggttaattgcctgatcgtggagactggagaagcatcgtgatcgtatcgagtgtgcttgtgtcagctgtgctccttgatgtggttcctttgatgtttttggtgtgtctgtctgtgtgtgctggcatcttgctttgtagtcacattgtgtgatgtgtgtactttgtttgcttcgtgagaaataatgaataaataaaatttcgaaatt

SEQ ID NO: 1311 - DNA, 747 bp, Sorghum bicolor
aattcacagagcgaactccatcgcaatagcaaagcataagcactcttgcagtccactgagttctgtttattcacagtttcagacgcaagagcatcatcggcaatgtcgctggtgaggcgcagcaacgtgttcgaccccttctccctcgacctctgggacccgttggacaacatgttccgttccatcgtcccgtcggcctccggcgactccgagaccgccgcgttcgccaacgcgcgcatcgactggaaggagacgcccgaggcgcacgtgttcaaggccgacctccccggcgtcaagaaggaggaggtcaaggtggaggtggaggacggcaacgtgctcgtcatcagcggccagcgcagcagggagaaggaggacaagaacgacaagtggcaccgcgtggagcgcagcagcggccagttcctcaggcgcttccgcctgccggagaacgccaagacggaggaggtgaaggccgggctggagaacggcgtgctcacggtcaccgtgcccaaggcggaggagaagaagcctgaggtgaaggctatcgagatctctggttaagcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatc

SEQ ID NO: 1312 - DNA, 657 bp, Saccharum officinarum
caaagcttagcgatacaggtatctccagctgcgaacaagcacttcagcaaatccatccacagtctctctcagcactcagcactcagcactcaacaaacccaaccgacgacaatgtcgctggtgaggcgcagcagcgtgttcgaccccttctctctcgacctctgggaccccttcgacaacatgttccgctccatcgtgccgtcggcctccggcgactccgagaccgcggcgttcgcgaacgcccgcatcgactggaaggagacgcccgaggcgcacgtgttcaaggccgacctccccggcgtgaagaaggaggaggtcaaggtggaggttgaggacggcaacgtgctggtcatcagcggcgagcgcagcaaggaggaggacaagaacgacaagtggcaccgcgtcgagcgcagcagcggaaagtttatgagacggttccggctgccggagaacgccaagacggaggaggtgaaggccgcgctggagaacggcgtgctcaccgtcaccgtgcccaaggctgaggtcaagaagcccgaggtgaagagcgtcgagatctctggctaaggatttcgctgttcgttcattcaaggtcgcttcgcgcgagctatcgtcgtgctcgaagtgtgtttggtcccaagcgggtcctgtcgagtcaca

SEQ ID NO: 1313 - DNA, 477 bp, Brachypodium distachyon
caaatccaatacatctatctctcctctgagttaacccgacgacaatgtcgctcgtgaggcgcagcgcattcgaccccttcgccgacttctgggaccctctggacgtgttccgctccatcgtccccgcagcgtccggcagcgagaccgccgctttcgccaacgcccgtgtggactggaaggagaccccggaggcgcacgtgttcaaggccgacctccccggcgtgaagaaagaggaggtcaaggtggaggtggaggacggcaacgtgctcgtgatcagcggcgagcgcagcaaggagaaggaggagaagagcgacaagtggcaccgcgtggagcgcagcagcggggcgttcgtgaggcggttccgcctgccggagaacgccaaggtggagcaggtgaaggccgggctggagaacggcgtgctcacggtcaccgtgcccaaagccgaggtgaagaagcctgaggtgaaggccatcgaga

SEQ ID NO: 1314 - DNA, 830 bp, Setaria italica
agctgaagagcacacagacagagcaacgcgtgcaaacgacttgatccatccacgcgcgctcacaaacccaaccgacaacaacgatgtcgctcgtgaggcgcagcaacgtgttcgaccccttcgccgacttctgggaccccttcgacgtcttccgctccctggtcccgtccgtcgcgtcgtcggaccgtgacaccgccgccttcgccaacgcgcgcgtcgactggaaggagacccccgaggcgcacgtcttcaaggccgacctccccggcgtcaagaaggaggaggtcaaggtcgaggtggaggacggcaatatcctggtgatcagcggcgagcgcagcaaggagaaggaggacaagaacgacaagtggcaccgcgtcgagcgcagcagcggcaagttcctccgccgcttccgcctgccggaggacgccaagacggaccaggtgaaggccggcatggagaacggcgtgctcacggtcaccgtgcccaaggcagaggtgaagaagcctgaggtgaaggccatcgagatctccgggtaggcaaccatgcatggacatgggacgacgatgatgctccggttctggtcgtgattggttgatgtgtgtgacatgcatggtctactgcgtatttctcttggttgtgtctgtgtaatcgtctgcaatccatgttctccctgtgcgtcttgagcatatataaaagtgaataaagtatcgtctgcatcatttaaaagagaacgagtgccgactgttaagtttttcacaagtgttttcctgctctgtttcagtgcaggggataatgcagtatgaattgtatgggtcgctcgtttgggaagc

SEQ ID NO: 1315 - DNA, 773 bp, Setaria italica
agcttactacagcagaacagcgagctctagctgcgaacaaaacacttcagcaaatccacccgtagtctccgagctcataaacccaaccaaccgacgaaaatgtcgctggttaggcgcagcaacgtgttcgaccccttcgccgacttctgggaccccttcgacgtcttccgctccgtagtgcccgcggcatcacctgaccgcgacgccgccgccttcgccgccgcgcgcatcgactggaaggagacgccggaggcgcacgtcttcaaggccgacctccccggcgtcaagaaggaggaggtcaaggtcgaggtggaggacggcaacgtcctggtgatcagcggcgagcgcagcaaggagaaggaggacaagaacgacaagtggcaccgcgtcgagcgcagcagcggcaagttcctccgccgcttccgcctgccggagaacgccaagacggaccaggtgaaggccgggctggagaacggcgtgctcacggtcaccgtgcccaaagccgaggtgaagaagcctgaggtgaaggccattgaaatctctggctgaggaaagctcgtcaaggtcgcgattgctgctgtgtcgtgctcgggtcaaagtttggtcgtcgtgtttctgaatcttttgtgatgatgtcgtacccctcggtcatggtgtggtcaatgttgtgtttgccgggtcgacccaggcgcgctatgggttatgtgtgtgtgtgtctgtgcagttgtttggtgtcatggtgaataaatgaaaatataaaaagtttttcttat

SEQ ID NO: 1316 - DNA, 771 bp, Setaria italica
gcttactacagcagaacagcgagctctagctgcgaacaaaacacttcagcaaatccacccgtagtctccgagctcataaacccaaccaaccgacgaaaatgtcgctggttaggcgcagcaacgtgttcgaccccttcgccgacttctgggaccccttcgacgtcttccgctccgtagtgcccgcggcatcacctgaccgcgacgccgccgccttcgccgccgcgcgcatcgactggaaggagacgccggaggcgcacgtcttcaaggccgacctccccggcgtcaagaaggaggaggtcaaggtcgaggtggaggacggcaacgtcctggtgatcagcggcgagcgcagcaaggagaaggaggacaagaacgacaagtggcaccgcgtcgagcgcagcagcggcaagttcctccgccgcttccgcctgccggagaacgccaagacggaccaggtgaaggccgggctggagaacggcgtgctcacggtcaccgtgcccaaagccgaggtgaagaagcctgaggtgaaggccattgaaatctctggctgaggaaagctcgtcaaggtcgcgattgctgctgtgtcgtgctcgggtcaaagtttggtcgtcgtgtttctgaatcttttgtgatgatgtcgtacccctcggtcatggtgtggtcaatgttgtgtttgccgggtcgacccaggcgcgctatgggttatgtgtgtgtgtgtctgtgcagttgtttggtgtcatggtgaataaatgaaaatataaaaagtttttctta

SEQ ID NO: 1317 - DNA, 562 bp, Panicum virgatum
cacaccaaagatcaaagcttccagcactagaagagctagctccgaacaagcacttcagcaaatccaccagcagtgtccgatccgcgctcagaaacccaaccggcaacaatgtcactggtgaggcgcagcaacgtgttcgaccccttcgccgacttctgggaccccttcgacgtcttccgctccgtggtgcccgcggcatcgaccgaccgcgacaccgccgccttcgccaacgcgcgcatcgactggaaggagacccccgaggcgcacgtcttcaaggccgacctccccggcgtcaagaaggaggaggtcaaggtggaggtggaggacggcaatgtcctggtgataagcggcgagcgcagcaaggaggaggaggacaagtacgacaagtggcaccgcgtggagcgcagcagcggcaagttcctccgccggttccgcttgccggagaacgccaagacggaccaggtgaaggccgggctggagaacggcgtgctcaccgtcaccgtgcccaaggccgaggtcaagaagcccgaggtgaaggccatcgagatctctggctgagagc

SEQ ID NO: 1318 - DNA, 914 bp, Zea mays
ggaggattggtcctataaataacctgccacgcacagattgctgcaacccacaccaccaaggagaaattgcaaagctctatacctgacctgtcactagcgaagcatacttcgtcgagcacactcttgcaattaatccaccgagttcggtttagtagcatagcatcgacaataaatgtcgctcgtgagtcggcgcagcagcaacgtgttcgaccccttctccctcgacctctggtgggaccccttcgacatgttccgctccatcgtcccgtcggcggcctcctccggcggcggttccgagaccgccgccttcgccaacgcccgcgtggactggaaggagacgcccgaggcgcacgtgttcaaggccgacctccccggcgtcaagaaggaggaggtcaaggtcgaggtggaggacggcaacgtgctcgtcatcagcggcaagcgcagcagggaggaggaggacaagaacgacaagtggcaccgcgtcgagcgcagcagcggccagttcatgaggcgcttccgcctgcctgagaacgccaaggtcgacgaggtgaaggctggcctcgagaacggcgtgctcacggtcaccgtgcccaagacggaggtgaagaagcccgaggtgaaggctatcgagatctctggttgagcgtccgttggacgtcgattggagctccgttgtgctgctactggtccgtggatgtcctgcatgttgcactgcagcggaggatgttcgctgcgtcttctacgcatttgctctgtttgtgctgtggtcgtcttccccgtatatggtttgtgtattgtcccttatcgataataataaataaaatcaggctttacgtctatttactgttgttaagtatagaaaaatgtaaagttttaggtggactaaaacaactctatcttgagccttcaggttg

SEQ ID NO: 1319 - DNA, 765 bp, Zea mays
accaaggaaattcacaaagcgcctagcaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaggaggtcaaggtcgaggtcgaagacggcaacgtgctggtcatcagcggccagcgcagcagggagaaggaggacaaggacgacaagtggcaccgcgtcgagcgcagcagtggccagttcgtcaggcgcttccgcctgccggagaacgccaaggtggatcaggtgaaggctggccttgagaatggcgtgctcacggtcaccgtgcccaaggcggaggagaagaagcctgaggtgaaggctattgagatctctggttgagcatccaatccaatatggacgtggaaggaaggtgtactgctgctggtccgtggctgtcgctgtcttgtgtgatgtttcctgtgtcttctacgatatataacgtacttccgtttgtttcgtttcgtatgtacaatcttccgggtatcgttcatgtatccctttgaataataacaaataaaatcgggttttcacggtaa

SEQ ID NO: 1320 - DNA, 677 bp, Cynodon dactylon
caatgtcgctcgtcaggcgcagcaatgtgttcgaccccttcgccgacttctgggaccccttcgacgtcttccgctccgtcgtgcccgcggccgcatcgtctgacagcaacacggctgcgttcgccaatgcccgcatcgactggaaggagacccccgaggcgcatgtcatcaaggccgacatccccggcgtgaagaaggaggaggtcaaggtcgaggtggaggacggcaacgtgctcgttatcagcggcgagcgctgcaaggagaaagaggacaaggacgacaagtggcaccgcatcgaacgcagcagcggcaagttcatgaggcgcttccgcctgcccgagaatgccaaggtggacgaggtaaaggccggcctggagaacggtgtgctcactgttaccgtgcccaaggccgaggtcaagaagcctgaagtgaagaccattcagatctctggctaagagctcgtcaagattgcataatctaacgttgtgctcgggtagtgttttttatccatgtgttgtgagtcatgtcatatgcgtctgtcgtacgtgtcttggtcaatgctctgtttgccgttaagacccgatgcacacacgataaggactgtgcttatgtgtgtttgtgagtccagtgctttggtatctggagaagtaatgaaatcaaaataaatcgtttgcccg

SEQ ID NO: 1321 - DNA, 668 bp, Panicum virgatum
acccaaccgacgacgatgtcgctggtgaggcgcagcaacgtgttcgaccccttcgccgacttctgggaccccttcgacgtcttccgctccgtggtgcccgcggcatcgaacgaccgcgacaccgtcgccttcgccggcgcgcgcatcgactggaaggaaacccccgaggcgcacgtgttcaaggctgacctccccggcgtcaagaaggaggaggtcaaggtggaggtggaggacggcaacgtcctggtgatcagcggcgagcgcagcagggagaaggaggacaagaatgacaagtggcaccgcgtcgagcgcagcagcagcaagttcctccgccggttccgcttgccggagaacgccaagacggaggaggtgaaggccggcttggagaacggcgtgctcacgatcaccgtgcccaaagcagaggtcaagaagcccgaggtgaaggccatcgagatctctggctgagagttcaatctttacggtcgcgcaagctgctacgtcgtgctgtggtcgaagtatggtcgtcgtgttcctcaatcctgtgtcggtcatgtcgtggtcaatggtgtgcttgccggctggccgcgtcgacccgggagcggtattggtatttgtgtgtttcccagtggagtcgtctttgggtgttgaataaatgaaaatataaagag

SEQ ID NO: 1322 - DNA, 721 bp, Setaria italica
atcgcaatcgcactgatcagcaacacaattcttcacttccgattccacacattccacagtcccaatcgcagcaaccaaccgacaatgtcgctcgtcaggcgtagcaacgtgttcgaccccttctccctcgacctctgggaccccttcgacaacatgttccgctccatcgtcccgtcggcaggctccgactccgacaccgccgccttcgccgccgcgcgcatcgactggaaggagacccccgaggcgcacgtgttcaaggccgaccttcctggagtcaagaaggaggaggtcaaggtcgaggtggaggacggcaacgtcctcgtcatcagcggccagcgcagcaaggagaaggaggacaagaacgacaggtggcaccgcgtcgaacgcagcagcggccagttcatgaggcgcttccgcctgccggagaacgccaagacggagcaggtgaaggccgggctcgagaacggtgtgctcaccgtcaccgtgcccaaggccgaggagaagaagcctgaggtgaaggctatcgagatctctggttaagcatcgtatatggaactacgatggaagaaaatggtggtggtgcgatgtgatgctacgagtcgtgcttgtttgctctgttcatgagcttgtgttgtggacgatgtgtacttcccttgccgtgtatcagtcttgtgtttccttgaggaagaaataaaagctgctttcatatggctttgttaca

SEQ ID NO: 1323 - DNA, 785 bp, Setaria italica
gcagaagatcgcaaaagcattactccctacaagcactccttcaatccactgagaagtttcagttcgtccaaacacagagagcttcagcaatgtcgctggtgaggcgcagcaacgtgttcgaccccttctccatggacctctgggaccccttcgacaacatgttccgctccatcgtcccgtcggcaggctccgactccgacaccgccgccttcgccaacgcccgcatcgactggaaggagacccccgaggcgcacgtgttcaaggccgacctccccggcgtcaagaaggaggaggtcaaggtcgaggtggaggacggcaacgtgctggtgatcagcggccagcgcagcaaggagaaggaggacaagaacgacaggtggcaccgcgtcgagcgcagcagcggccagttcatgaggcgcttccgcctgccggaggacgccaagacggagcaggtgaaagccgggctggagaacggcgtgctcacggtcaccgtgcccaaggccgaggggaagaagcccgaggtgaagagcatccagatctccggctgagcggtcatggacggactcgtggggtgagcatgcggcggacggaggatctgcggtttgagctacttgtatgtcgttggttactctgctttggtatgtttggtgtgttctgttccagcgttccatggtagtggctactagtagtgtcatgtgtctgtactctgtactttccctcttcggtgagcttggctcagtatgttctgcgagtgaataaataaaagaaagcagttcttgttgtgtcca

SEQ ID NO: 1324 - DNA, 470 bp, Sorghum bicolor
ttcagacgcaagagcatcatcggcaatgtcgctggtgaggcgcagcaacgtgttcgaccccttctccctcgacctctgggaccccttcgacaacatgttccgttccatcgtcccgtcggcctccggcgactccgagaccgccgcgttcgccaacgcccgcatcgactggaaggagacgcccgaggcgcacgtgttcaaggccgacctccccggcgtcaagaaggaggaggtcaaggtggaggtggaggacggcaacgtgctcgtcatcagcggccagcgcagcagggagaaggaggacaagaacgacaagtggcaccgcgtggagcgcagcagcggccagttcctcaggcgcttccgcctgccggagaacgccaagacggaggaggtgaaggccgggctggagaacggcgtgctcacggtcaccgtgcccaaggcggaggagaagaagcctgaggtgaaggctatcgaga

SEQ ID NO: 1325 - DNA, 993 bp, Saccharum officinarum
attcagcgaccgctcttgacgatgctataaatacgtcaccgcagaaggccacaactcatcccaatccacagcaaagatcgcaatcagaccaagcagcgcacggcgaaatcctccaatccacagactcacttcccccagttcgcactcggcactcgcacgcaccgagcagctagcaatcaaaaccagcaatgtcgctcgtgaggcgcagtaacgtgttcgaccccttctccatggacctctgggaccccttcgacaacatgttccgctccatcgtcccgtcggccagctccaccgactccgagaccgccgccttcgccaacgctcgcatcgactggaaggagacgcccgaggcgcacgtgttcaaggccgacctccccggcgtcaagaaggaggaggtcaaggtcgaggtggaggacggcaacgtgctggtcatcagcggccagcgcagcagggagaaggaggacaagaacgacaagtggcaccgcgtcgagcgcagcagcggccagttcatgaggcgcttccgcctgccggagaacgccaagacggaggaggtgaaggccgcgctggagaacggcgtgctcacggtcaccgtgcctaaggccgaggtcaagaagcccgaggtgaagagcatccagatctccggttgaagagtcaccatggacgccaggtcaagctcgcagtgtcggatgtccggtttcagctacgcggctcgtgtgtgggtactctgctttgtaagtctggtgtgtacgagtgttcagtggttcatggtactactgctacgtaacagtgtcatgtactagtctctgtactttgccttgatgttgagctcggcttaatatgttctgggagggaataaataaataaaccaggcgcgtgttccggtttacttaaaatattaaaaagaagtttttacttagaatcaattggtggaaatggggggccggttttaaaggaatccaagtttaccttcgcgtgcttgcgaacgtataactc

SEQ ID NO: 1326 - DNA, 803 bp, Saccharum officinarum
aacacacatcaaagcaaagcttagcgatacagctatctccagctgcgaacaagcactccagcaaatccatccacagtctctctcagcactcagcactcaacaaacccaaccgacgacaatgtcgctcgtgaggcgcagcaccaacgtgttcgaccccttcgccgacttctgggaccccttcgacgtcttccgctccgtagtgcccgccgcggcggcgtcggcggaccgcgacacggcggcgttcaccaacgcccgcatcgactggaaggagacgcccgaggcgcacgtgttcaaggccgacctccccggcgtgaagaaggaggaggtcaaggtggaggttgaggacggcaacgtgctggtcatcagcggcgagcgcagcaaggagaaggaggacaagaacgacaagtggcaccgcgtcgagcgcagcagcggaaagtttatgaggcggttccggctgccggagaacgccaagacggaggaggtgaaggccgcgctggagaacggcgtgctcaccgtcaccgtgcccaaggctgaggtcaagaagcccgaggtgaagagcatccagatctccggttgaagagccaccatggacgccaggtcaagctcgccgtgtcggatgtccggtttcagctacgcgactcgcgcgcgcgcgcgcgtgtgtggttactctgctttggtacgtctggtgtgtacgagtgttcagtgtttcatggtactactgctacgtagcagtgtcatttactagtctctgtactttgcctgtatgttgagctcggctcagtatgttctgtgagtgaataaat

SEQ ID NO: 1327 - DNA, 1119 bp, Panicum virgatum
ccctgcctcgcacccagctgcaacccaccgaagaacacacaacaccaccagagagataacaaagccttcttcctacagcactcttgcaatccacagagctagctcagttcatccaagcacacagaagcatcagcaatgtcgctcgtcaggcgcggcaacgtgttcgaccccttctccatggacctctgggaccccttcgacagcatgttccgctccatcgtcccatcgtcctcctccgactccgacaccgccgccttcgccaacgcccgcatcgactggaaggagacccccgaggcgcacgtcttcaaggccgacttccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccagatctccggttaagcggccgtggagacggatggtgaggtgagcgtgtgcggcggaggggacaggggaggaccgccggttcgcgctactacagtctgtcgttgctctgctttggtgtgtttggtgtgtgtactgttgttcagcctgccatggtagtgcctgctactggtgtcatgtgctagtctgtattttctatgtttggtgagtctgtatgttcgactttctgcgagtgaataaataaataataaagcagttcttgtatatattcatcttttctactcttgtccatctcacaaaaaaatgctaatctgtattttctatgtttggtgagtctgtatatattcgtcttttctactcttgtccatctcacaaaaaaaaaacgaatcccatacactggtgcttttcttttgtagaaaaaccgtatctttttctactttttggtaaggagtttgtagaatatatatctcgtgagctggtttcatcagaatgatgatctaggcccagttgcattcaggtttggtacagcctaaggtaacagattga

SEQ ID NO: 1328 - DNA, 827 bp, Panicum virgatum
aggaacgcccaacacacagagataacaaagccttcttcttacagcgcacttgcaatccacagacagagctcagctcatccaagcacacagagcaccagcaatgtcgctcgtcaggcgcagcaacgtgttcgaccccttctccatggacctctgggaccccttcgacagcatgttccgctccgtcgtcccgtcgtcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaacgtgctggtcatcagcggccagcgcagcaaggagaaggaggacaagaacgacaggtggcaccgcgtggagcgcagcagcggccagttcatgaggcgcttccgcctgcctgaggacgccaaggtggagcaggtcaaggccgggctggagaacggcgtgctcaccgtcaccgtgcccaaggccgagggcaagaagcccgaggtgaagagcatccagatctccggttaggcgaccgtggggacggacggtgaggtggtgagcgtgtgcggcggaggaactgccggttcgagctactagtctcgttgctctgctttggtgtgtttggtttgtactgttcagtcctttcagcctgcagactgtgtcatgtactcctactatgtgctagcttctttcctgtttggtgagatcgggtgtgtaggagtatgttctaccttctgcgagtgaataaataaagaataaagcagatcttgtgtatattcatctttttctactcgtg

SEQ ID NO: 1329 - DNA, 766 bp, Panicum virgatum
agagctctccagacgtctcaggaagggcttgtacgggctcagacaatccctcctataaattccctgcctcgcacccagctgcagcccaccaaagaggaacgcccaacacacagagataacaaagccttcttcttacagcgcacttgcaatccacagacagagctcagctcatccaagcacacagagcaccagcaatgtcgctcgtcaggcgcagcaacgtgttcgaccccttctccatggacctctgggaccccttcgacagcatgttccgctccgtcgtcccgtcgtcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaacgtgctggtcatcagcggccagcgcagcaaggagaaggaggacaagaacgacaggtggcaccgcgtggagcgcagcagcggccagttcatgaggcgcttccgcctgcctgaggacgccaaggtggagcaggtcaaggccgggctggagaacggcgtgctcaccgtcaccgtgcccaaggccgagggcaagaagcccgaggtgaagagcatccagatctccggttaggcgaccgtggggacggacggtgaggtggtgagcgtgtgcggcggaggaactgccggttcgagctactagtctcgttgctctgctttggtgtgtgtggtttgtactgttcagtc

SEQ ID NO: 1330 - DNA, 522 bp, Avena sativa
cccttctccatggacctctgggccgaccccttcgacgccttccgctccatcatccctgcagcctccggcaacggcgagacggccgcgttcgccaccgcccgcttcgactggaaggagacccccgaggctcacatattcaaggccgatcttccaggggtgaagaaggaggaggtcaaggttgaggtcgaggacggcaacgtgctcgtcgtcagcggcgagcgcacaaaggagaaggaggacaagaatgacaagtggcaccgcgtcgagcgcagcagcggcaagttcgtcaggcggttccgtctgccggagaacgccaaggtggaggaagtgaaggcagggctggagaacggcgtgcttacggtcacagtgcccaaagccgaggtcaagaagcccgagacgaaggccatcgagatctccggctaaaaatgtgtgaccaatccatgccagcgtgaatcgtgcggcgttgtgtttccttccttggtcactagtggcctgtgtgacccatcgtcttgcattgacgaa

SEQ ID NO: 1331 - DNA, 956 bp, Sorghum bicolor
agcgactaccagcacagacgaacagtctagagcgaaacaaagagaggtcgagagcattcaagatttgttcctgacgaacctataaatactctgcctcactcccagcaagttctcaacacacatcaaaacaaagcttagcgatacaggtagcttgaacctagctctaactccgaacaggcaacttcagcaaatccgatccatccagagtctctctcagcactcagcaaaacccaaccgacgacaatgtcgctggtgaggcgcagcaccaacgtgttcgaccccttcgccgacttctgggaccccttcgacgtcttccgctccatagtgcctgctgcatcaacggaccgcgacacggcggccttcgcgaacgcgcgcatcgactggaaggagacgccggaggcgcacgtgttcaaggccgacgtccccggcgtgaagaaggaggaggtcaaggtggaggtggaggacggcaacgtgctcgtcatcagcggcgagcggcgcaaggagaaggaggacaaggacgacaagtggcaccgcgtggagcgcagcagcggcaggttcatgaggcggttccggctgccggagaacgccaagacggaggaggtgaaggccgggctggagaacggcgtgctcacggtcaccgtgcctaaggccgaggtcaagaagcccgaggtgaagagcgtcgagatcgccggctaaaggatcgatttcgccgttcgttcgttcaaggtctcgcgtcgcgtgagtttcgggtcgtgctacgaggtcgtgtttggtcgaagcagttggagtcctgtcgagtcagaagggtgtcgagttgtgtcggtcaatgctgttgtgtctgccggttggaaccgtgcgcgttattgttgtgtgtgtgtgtgtgtgtgttggtgctcggcacaaacgtgtgtgatgttatgattattcatggttaaataaataaatggttttcttta

SEQ ID NO: 1332 - DNA, 446 bp, Panicum virgatum
gatgtcgctggtgaggcgcagcaacgtgttcgaccccttcgccgacttctgggaccccttcgacggcgtcttccgctccctggtcccgtccgtcgcgccgtcgggccgcgacaccgccgccttcgccaacgcgcgcatcgactggaaggagacccccgaggcgcacgtcttcaaggccgacctccccggtgtcaagaaggaggaggtcaaggtcgaggtggaggacggcaacgtcctggtcatcagcggcgagcgcagtaaggagaaggaggacaagaacgacaagtggcaccgcgtcgagcgcagcagcggcaagttcctccgccggttccgcctgccggagaacgccaagacggacgaggtgaaggccgggctggagaacggcgtgctcacggtcaccgtgcccaaggccgaggtcaagaagcctgaggtgaaggccatcgaga

SEQ ID NO: 1333 - DNA, 766 bp, Panicum virgatum
cacaccaaagatcaaagcttccagcactagaagagctagctccgaacaagcacttcagcaaatccaccagcagtgtccgatccgcgctcagaaacccaaccggcaacaatgtcgctggcgaggcgcagcaacgtgttcgaccccttcgccgacttctgggaccccttcgacgtcttccgctccgtggtgcccgcggcatcgaccgaccgcgacaccgtcgccttcgccaacgcgcgcatcgactggaaggagacccccgaggcgcacgtcttcaaggccgacctccccggcgtcaagaaggaggaggtcaaggtggaggtggaggatggcaacgtcctggtgatcagcggcgagcgcagcaaggaggaggaggacaagaacgacaagtggcaccgcgtggagcgcagcagcggcaagttcctccgccggttccgcctgccggagaacgccaagacggaccagcaggtgaaggccgggctggagaacggcgtgctcaccgtcactgtgcccaaggccgaggtcaagaagcccgaggtgaaagccatcgagatctctggctgagagcttgatcttgaagaggtcgcgcaagctactatatcgtgctcgggtcagtgtttggtcgtcgtgttcctgaatcctcttctttgatgatgtcgtacgtgtcggtcatgttgtggtcaatgttgttatttctgtgtttgtcagtggagtcgtctttgggtttcatggtgaataaatgaaaaatataaagagtttttcttatatg

SEQ ID NO: 1334 - DNA, 650 bp, Festuca arundinacea
ggcacgaggatcaattcaaatcagacactcgccatcactttctccgcgaaggctgaaaccgcagccaacaatgtcgatggttaggcgctgccccttcgccgacctctgggtcgacccattcgacggcttctgctccatcgtcccagcatcctgggactccgacacagccggatttccaaacgctcgcgtggactggaaggagacgccggaggcgcacgtcttcaaggcggacctacccggagtgaagaaggaggaggttaaggtggaggtggaggacggcaacgtgctcgtcgtcagcggcgagcgcaccaaagagaaggaggacaaaaaggaaaagtggcaccgcgtggagcgcagcagcggcaagttcgtgaggcgctttcagctgccggagaacgccaagctggaggaggtgaaggccgggctggagaacggcgtgctcacggtcaccgtgcctaaagttgaggtcaagaagccagaggtgaaggccatcgagatctccggctaaatgtgtgtgtgatcgatcagtaccactgtaccagcttgatttgccgcagctgggtcttgttcttgtggagtcctactatgtagttgtgttcccttccttggtcgccacaatgtactggtgtgatcgtcttccagtgtgcctg

SEQ ID NO: 1335 - DNA, 700 bp, Brachypodium distachyon
atcccaacccaagccagagcaaatcagcaagaaaacaccacaaatcacaccaaagcaacgcacacaatgtcgctggtgaggaggagcagcgtgttcgacccgcggtccgacttctggttcgaccccatggacaccatcgacggcatcttccgctccgtcgtcccggcggccgccacggattccgacgccgccgccttcgccaacgcccgcatggactggaaggagacgcccgaggcgcacgtgttcaaggccgacctcccgggagtgaagaaggaggaggtgaaggtggaggtggaagacggcaacgtgctggtggtgagcggcgagcggagcaaggagaaggaggacaagaacgacaagtggcaccgcgtcgagcgcagcagcggcaagttcgtccgccgcttccgtctgccggacaacgctaaagtggagcaggtcaaggccgggctcgagaacggcgtgctcacggtcaccgtgcccaaggccgaggtcaagaagccccaggtgaaggccatcgagatctccggttgagtagtccgtctgcttgtgtgaacggtgtgatcaattggggacagtttgttatgttcatgcactgcacctttggtttcctctgtagtctgtaactgccttgtgtaatctcctgtcctctgttcgcctgaagaataaacatgaaataaatctttcaagactttttgagtgc

SEQ ID NO: 1336 - DNA, 780 bp, Brachypodium distachyon
gagagcggtcgggatgcttcgagaccaacacccggcgacattataaagctcccctcatctcccacctccggatcccaacccaagccagagcaaatcagcaagaaaacaccacaaatcacaccaaagcaacgcacacaatgtcgctggtgaggaggagcagcgtgttcgacccgcggtccgacttctggttcgaccccatggacaccatcgacggcatcttccgctccgtcgtcccggcggccgccacggattccgacgccgccgccttcgccaacgcccgcatggactggaaggagacgcccgaggcgcacgtgttcaaggccgacctcccgggagtgaagaaggaggaggtgaaggtggaggtggaagacggcaacgtgctggtggtgagcggcgagcggagcaaggagaaggaggacaagaacgacaagtggcaccgcgtcgagcgcagcagcggcaagttcgtccgccgcttccgtctgccggacaacgctaaagtggagcaggtcaaggccgggctcgagaacggcgtgctcacggtcaccgtgcccaaggccgaggtcaagaagccccaggtgaaggccatcgagatctccggttgagtagtccgtctgcttgtgtgaacggtgtgatcaattggggacagtttgttatgttcatgcactgcacctttggtttcctctgtagtctgtaactgccttgtgtaatctcctgtcctctgttcgcctgaagaataaacatgaaataaatctttcaagactttttgagtgcaaaacacaa

SEQ ID NO: 1337 - DNA, 795 bp, Cenchrus ciliaris
aattcgcgggcgctcgcaaagcaacctcctacaatccattgtgacagttcagttcgtccaaacacagagagcttcagcattcagcaatgtcgcttgtgaggcgcggcaacgtctttgaccccttctccatggacctctgggaccccttcgacaacatgttccgctccatcgtcccgtcgtcctcctcctccgacaccgccgccttcgccaacgcccgcatcgactggaaggagacccccgaggtgcacgtcttcaaggccgacctccccggcgtcaagaaggaggaggtcaaggtggaggtggaggacggcaacgtcctggtgatcagcggccagcgcagcaaggagaaggaggacaagaacgacaggtggcaccgcgtcgagcgcagcagcggccagttcgtgaggcgcttccgcctgccggaggacgccaagacggaccaggtgaatgccgggctggagaacggcgtgctcacggtcaccgtgcccaaggcagaggggaagaagccagaggtcaaggccatcgagatctccggttgagcggccatggacggattcgtgaggtgaaggtatgcggcgggcggaggatctgctggttgagctacctgtgtatgtcgtcgttgctctgcttttggtacgcttggtgtgttctgttcagagttccatggtagtgatagtgcctactagtattgtcaattgtcatgcactctctactctcgctgtattgtgagctcggctcagaatgttctgcgagtgaataaataaaataaagcagttcttggtgtgtgttcaaaaa

SEQ ID NO: 1338 - DNA, 843 bp, Zea mays
aaataccctgccacgcgcagggctgcaagccaccaaggaaattcacaaagcgatactagctagtccctaccaaagcatacttcctgaaacactcttgcaatccactgagttctgtttgttgagacgcatagagctagagtcgacaatgtcgctcgtgaggcgcagcaacgtgttcgaccccttctcgatggatctctgggaccccttcgacaccatgttccgctccatcgtcccgtcggcgacctccaccaactccgagactgccgccttcgccagcgcccgcatcgactggaaggagacgcccgaggcgcacgtgttcaaggccgacctccccggcgtcaagaaggaagaggtcaaggtcgaggtcgaggacggcaacatgctggtcatcagcggccagcgcagcagggagaaggaggacaaggacgacaagtggcaccgcgtcgagcgcagcagcggccagttcgtcaggcgcttccgcctgccggagaacaccaaggtggatcaggtcaaggctggcctcgagaacggcgtgctcacggtcaccgtgcccaaggcggaggagaagaagcctgaggtgaaggctattgagatctctggttgagcatccaatccaatatggacgattggacgtggaaggtttcctgtgtcttctacgatataataattggttgctgtcgtgtgtggatgtttcctgtgtcttctacgatataataacaaatcttccgggtatcgttcatgtatccctttgaataataacaaataaaatcgggtttgtcacggtaatctggatagccttttatcagccaatgtttaaccaaaattacgtattgcacgtaaaaa

SEQ ID NO: 1339 - DNA, 891 bp, Oryza sativa
gaggaacacacaacaaacaagacttgcatacgtcccaaactcccaaatcgccctctttgcaatcacttcttccgttccatttcagtagcccacaacttcgcatcagaaagcgaaagctagagcaaccatgtcgctggtgaggcgcagcaacgtgttcgacccattctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcgggcagcgcagcaaggagaaggaggacaagaacgacaagtggcaccgcgtggagcgcagcagcgggcagttcatgcggcggttccggctgccggagaacgccaaggtggaccaggtgaaggccggactggagaacggcgtgctcactgtcaccgtgcccaaggccgaggtcaagaagcctgaggtgaaggccattgagatctccggttaagctcctgaagatgtgatcgtatggtctgctgctggtgtgtcgtacccgttgggagtccgagtggctgagtcggccggtttcatgtattcctttgtgagtacttgtgtaatcgccttcttagttcttgctcgttgaggaataaataaagagcttttcaggttgcaaacatcatgcaaacgtttttgaattccgatgttatatatactgtgttatactagcttttgacaacagttatactcctaggtgtgcggtggtctgatttgaaacttcagccgaagaaatggaatgtgataagagtcgataagtttcag

SEQ ID NO: 1340 - DNA, 858 bp, Sorghum bicolor
ttcagcgaccgctcttgacgatgctataaatagatcaccaccactcatcccaatccgcagcaaatatcgcaatcagaccaagaacagcacagcgaaatcttccaacccacagactcacttcccagttcgcactcagctagcatagcaaatcagaagcagcaatgtcgctggtgaggcgcagcaacgtgttcgaccccttctccctcgacctctgggacccgttggacaacatgttccgctccatcgtcccgtcggccgcctccggcgactccgagaccgcggccttcgccaacgcgcgcatcgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaggaggtgaaggccggcctcgagaacggcgtgctcacggtcaccgtgcccaaggctgaggtcaagaagcccgaggtgaagagcatccagatctccggttgaagagccatgggggcggtgagagctcgcggcgtcggatctccggtttcagtttcagctacgcgacttgtgtgtgtgtgtgtgtgtcagtgcgtggttactctgagcttcggtatgtttggtgtgtactgttcagtgtttcatggtgcttcctagcagtgtctgtcgtgtactttgcctgtatgttgagctcggctcagtatgttctgggagtgaataaataaaaaaaaattaaccagat

SEQ ID NO: 1341 - DNA, 449 bp, Sorghum bicolor
aatgtcgctggtgaggcgcagcaccaacgtgttcgaccccttcgccgacttctgggaccccttcgacgtcttccgctccatagtgcctgctgcatcaacggaccgcgacacggcggccttcgcgaacgcgcgcatcgactggaaggagacgccggaggcgcacgtgttcaaggccgacgtccccggcgtgaagaaggaggaggtcaaggtggaggtggaggacggcaacgtgctcgtcatcagcggcgagcggcgcaaggagaaggaggacaaggacgacaagtggcaccgcgtggagcgcagcagcggcaggttcatgaggcggttccggctgccggagaacgccaagacggaggaggtgaaggccgggctggagaacggcgtgctcacggtcaccgtgcctaaggccgaggtcaagaagcccgaggtgaagagcgtcgagatcgccg

SEQ ID NO: 1342 - DNA, 404 bp, Avena sativa
atgtcgatcgtgaggcggagcaacgtgttcgaccccttggcggacctctgggcggaccccttcgacaccttccgctccatcgtcccggcgatctcaggcggcaacagcgagacggccgcgttcgccaacgcccggatggactggaaggagacccccgaggcgcacgtcttcaaggccgacctccccggcgtgaagaaggaggaggtcaaggtggaggtggaggacggcaacgtgctcgtcgtcagcggcgagcgcacgaaggaggaggaggacaagaacgacaagtggcaccgtgtggagcgtagcagcggcaagttcgtgaggcgcttccgcctcgcccgaggacgccaaggtggaggcggtgaacggccggtctaggagacggtgtgctcactgtcgacggt

SEQ ID NO: 1343 - DNA, 452 bp, Setaria italica
ccaaccgacgaaaatgtcgctggttaggcgcagcaacgtgttcgaccccttcgccgacttctgggaccccttcgacgtcttccgctccgtagtgcccgcggcatcacctgaccgcgacgccgccgccttcgccgccgcgcgcatcgactggaaggagacgccggaggcgcacgtcttcaaggccgacctccccggcgtcaagaaggaggaggtcaaggtcgaggtggaggacggcaacgtcctggtgatcagcggcgagcgcagcaaggagaaggaggacaagaacgacaagtggcaccgcgtcgagcgcagcagcggcaagttcctccgccgcttccgcctgccggagaacgccaagacggaccaggtgaaggccgggctggagaacggcgtgctcacggtcaccgtgcccaaagccgaggtgaagaagcctgaggtgaaggccattgaaa

SEQ ID NO: 1344 - DNA, 625 bp, Pennisetum glaucum
cggcggtatcggagtcggaggacgacgacggcacgatggagcggaacatgttgtcgaaggagtccagagtgtgaagatcgaaatcgcacactgatcagcaagcaacacacttctttcgcttccgattccaccacacattccacagttccccaatcgcagcagccaacccgacaatgtcgctggtgaggcgcagcagcgtcttcgaccccttctccatggacctctgggaccccttcgacaacatgttccgctccatcgtgccgtcgtcgtcctccgactccgataccgccgccttcgccgccgcgcgcatcgactggaaggagacccccgaggcgcacgtcttcaaggccgatctccccggcgtcaagaaggaggaggtcaaggtcgaggtggaggacggcaacgtcctggtgatcagcggcgagcgcagcaaggagaaggaggacaagaacgacaagtggcaccgcgtcgagcgcagcagcggcaagttccgccgccgcttccgcctcccggagaacgccaagacggaccaggtgaaggccggcatggagaacggcgtgctcaccgtcaccgtgcccaaggccgaggagaagaagcccgaggtgaagagcatcgagatctccgg

SEQ ID NO: 1345 - DNA, 754 bp, Oryza sativa
attcaaggcagagctagtagtggtcacatcgccaattcacagtcgaatcaagcaaaccatccaaatcacacccaactcttcttcttcccatcctccagagatccaagcagcttagccatgtcgctggtgaggcgcagcaacgtgttcgaccccttctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttccggctgccggagaacgccaaggtggaccaggtgaaggccggcatggagaacggcgtgctcaccgtcaccgtgcccaaggccgaggtcaagaagcccgaggtgaaggccattgagatctctggctaaaatggtgaaaacgggagtttgtcaaggtcaaggcgtgtcatgcatgttcactctgaactgtttgcggtgtttcactcgggtttgatggtttttactagtcctatgaactgtgtattcttttgtactctgttgtgagcgcgtttgcacgaagcaataaataaaaataaaatcagcttgtttgtat

SEQ ID NO: 1346 - DNA, 735 bp, Panicum virgatum
ctcgcacccagctgcagcccaccaaagaggaacgcacgacacacagagataacaaagccttcttcctacagcgcacttgcaatccacagacagagctcagctcatccaagcacacagagcaccagcaatgtcgctcgtcaggcgcagcaacgtgttcgaccccttctccatggacctctgggaccccttcgacagcatgttccgctccgtcgtcccgtcctcctcctcctccgactccgacaccgccgccttcgccaacgcccgcatcgactggaaggagacccccgaggcgcacgtcttcaaggccgacctccccggcgtcaagaaggaggagctcaaggtggaggtggaggacggcaacgtgctggtcatcagcggccagcgcagcaaggagaaggaggacaagaacgacaggtggcaccgcgtggagcgcagcagcggccagttcatgaggcgcttccgcctgcctgaggacgccaaggtggagcaggtcaaggccgggctggagaacggcgtgctcaccgtcaccgtgcccaaggccgagggcaagaagcccgtggtgaagagcatccagatctccggttaggcggccgtggggacggacggtgaggtggtgagcgtgtgcggcggaggaactgccggttcgagctactagtctcgttgctctgctttggtgtgtttggtttgtactgttcagtcctttcagcctgcagactgtgtcatgtactcctagtc

SEQ ID NO: 1347 - DNA, 1289 bp, Oryza sativa
actcgctatcccctccatcacagaataaatgcaacaatgagtttccgtgtacaaatttaatcgttcgtcttatttaaaatattttttaaaaaactaaaaaacaaaagtcacgcataaagtactattcatgttttataatctaataacagtataaatactaatcataaaaaaaaattcaaataagatggacgattaaagttgaacactgaaattcatggctgcttttgttttgagactgagggagtacacgataagatttgatcgcaatcaaagtaacctacatcaaagaagcaagatatgtgggggaaaaatgaatactctagagcaaattaaggtgagccccgctttgtagaggctgatggagtactggagcgacggaagcgaagcagatcgagtgtgctgtaaagcgaaacgagcaagaaccagagaagtccagagatttcaggacagattagttgtgaacctataaatatcctgcctcattccccaacctccatccatcgagccaagactgaagcatttgatcgagctccaaacaaacactcgttccaaacttcctccaatccacttcatacaaagaaacctaagcagctagcgatccacgacaaaccaacaatgtcgctcgtgaggcgcagcaacgtgttcgaccccttcgctgacttctgggaccccttcgacggcgtcttccgctccctcgtcccggcgacctccgaccgcgacaccgccgctttcgccaacgcccgcgtcgactggaaggagacgccggagtcgcacgtcttcaaggccgacctccccggcgtcaagaaggaggaggtgaaggtggaggtggaggagggcaacgtgctggtgatcagcgggcagcgcagcaaggagaaggaggacaagaacgacaagtggcaccgcgtggagcgcagcagcgggcagttcatgcggcggttcaggctgccggagaacgccaaggtggaccaggtgaaggccagcatggagaacggcgtgctcaccgtcaccgtgcccaaggctgaggtcaagaagcccgaggtgaaggccattgagatctctggctgagaaggagagaagctatatacgtcgtgctgtgctcgagtccggtcgtgtcaggtccatgtgtggcgagtctcgtgtctgtgtggcagttgtgtcgtggcctccgccaatgtaatgtattctggttagaccggagcacaacattggttcggtccttggaattgtcccatggcgtctgaatgaatgagtaaataaagtgtccggccgatttgcacaagtgtcattca

SEQ ID NO: 1348 - DNA, 610 bp, Avena sativa
caatgtcgatcgttaggcgctgccccttcttctccgacctctgggtcgacccattcgacgccttccgctccatcatcccagccgctgacaacaacgacgccaccgccgccttcgtgaatgcccgtgtggattggaaggagacgccggaagcacacgtcttcaaggcggacctccccggcgtgaagaaggaggaggtcaaggtggaggtggaggacggcaacgtgctggtcgtcagcggcgagcgcagcagggagaaggaggacaagaatgacaagtggcaccacgtcgagcgcagcagcggcaagtttgtgagaagattccgcctgccggagaattccaaggtggaggaggtgaaggccgggctggaggacggcgtgctcaccgtcaccgtacccaaggcagaggtcaagaagcccgtggtgaaggccatcgatatctccggctaactgcgccttccttgatcggtgcgtgattggacgaccagcctggtagatgtatgtgcgagtatataccaatgagttgcagaattcgtgtcagtgatccagtgttcatgaggagttgtttgtggtagtgtttccttccgtggtacttgtgtcttgtgtgatcgtct

SEQ ID NO: 1349 - DNA, 440 bp, Panicum virgatum
gatgtcgctggtgaggcgcagcaacgtgttcgaccccttcgccgacttctgggaccccttcgacgtcttccgctccgtggtgcccgcggcatcgaacgaccgcgacaccgtcgccttcgccggcgcgcgcatcgactggaaggaaacccccgaggcgcacgtgttcaaggctgacctccccggcgtcaagaaggaggaggtcaaggtggaggtggaggacggcaacgtcctggtgatcagcggcgagcgcagcagggagaaggaggacaagaatgacaagtggcaccgcgtcgagcgcagcagcagcaagttcctccgccggttccgcttgccggagaacgccaagacggaggaggtgaaggccggcttggagaacggcgtgctcacgatcaccgtgcccaaagcagaggtcaagaagcccgaggtgaaggccatcgaga

SEQ ID NO: 1350 - DNA, 841 bp, Sorghum bicolor
aacgtccccatccaggcatccacctataaataccctcctcggctgcaacctccggccatcgagaaaaaagcacaaagcagcaaccccatacaagcctgaaatccactcagcactgtcaagtgtcaagtctccgcgttcactaatccaaccgacgacaatgtcgctcgtgaggcgcagcaacatcttcgaccccttcgccgacttctgggaccccttcgacggcgtcttccgctccctcgtcgtcccgtctgtcgcctcgtcggggcgcgacaccgctgccttcgccaacgcgcgcatcgactggaaggagatgcctgaggcgcacgtgttcaaggccgacctccccggcgtgaagaaggaggaggtcaaggtggaggtggaggacggcaacgtgctcgtcatcagcggcgagcgcagcaaggagaaagaggacaagaacgacaagtggcaccgcgtcgagcgcagcagcggcaagttcatgaggcggttccgcctgccggagaacgccaagacggaccaggtgaacgccggcctcgagaacggcgtgcttaccgtcaccgtgcccaaggccgaggtcaagaaacctgaggtgaagaccattgagatttctggttgagcgaccatatatgggcgctggatgatgaagatgtggcgggaagcgtgatgctgttttcggtcggttgatgatgtgtgtcagatggtttgctgcaagtgaagtctattgcctgtccacgtatttctcttaccttgttggttgaataatctgtaatcagtgttctgcatgtgtaattgtcttgagactttataaaagtaaataaagcatcttctgtacctttccaga

SEQ ID NO: 1351 - DNA, 470 bp, Sorghum bicolor
gcatagcaaatcagaagcagtaatgtcgctggtgaggcgcagcaacgtgttcgaccccttctccatggacctctgggacccgttcgacaacatgttccgctccatcgtcccgtcggccgcctccggcgactccgagaccgcggccttcgccaacgcccgcatcgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaggaggtgaaggccggcctcgagaacggcgtgctcacggtcaccgtgcccaaggctgaggtcaagaagcccgaggtgaagagcatccaga

SEQ ID NO: 1352 - DNA, 625 bp, Panicum virgatum
tccaaaccgaagatcgaaatcgcaccgagctcgaacagcgcacacatcatcatcgtctcttttctgatcccacgcaaacgtttcaggttcccgttcgcagcaacccccgccgacaatgtcgctggtgaggcgcagtagcgtgttcgaccccttctccctcgacctctgggaccccttcgacagcatgttccgctccgtcgtcccgtcggccggcgcctccgactccgagaccgccgccttcgccaacgcccgcattgactggaaggagacgcccgaggcgcacgtcttcaaggccgacctccccggcgtcaagaaggaggaggtcaaggtcgaggtggaggacggcaacgtcctggtcatcagcggccagcgcagcaaggagaaggaggacaagaatgacaagtggcaccgcgtcgagcgcagcagcggccagttcatgaggcggttccgcctgccggagaacgccaaggtcgaccaggtgaaggccgggctggagaacggcgtgctcaccgtcaccgtgcccaaggcggaggagaagaagcctgaggtgaagagcatccagatctccagttaagcggccatggacgcgggttgaagatgatgcgatgtgatgctacgagtcgtg

SEQ ID NO: 1353 - DNA, 948 bp, Setaria italica
gagctgaagagcacacagacagagcaacgcgtgcaaacgacttgatccatccacgcgcgctcacaaacccaaccgacaacaacgatgtcgctcgtgaggcgcagcaacgtgttcgaccccttcgccgacttctgggaccccttcgacgtcttccgctccctggtcccgtccgtcgcgtcgtcggaccgtgacaccgccgccttcgccaacgcgcgcgtcgactggaaggagacccccgaggcgcacgtcttcaaggccgacctccccggcgtcaagaaggaggaggtcaaggtcgaggtggaggacggcaatatcctggtgatcagcggcgagcgcagcaaggagaaggaggacaagaacgacaagtggcaccgcgtcgagcgcagcagcggcaagttcctccgccgcttccgcctgccggaggacgccaagacggaccaggtgaaggccggcatggagaacggcgtgctcacggtcaccgtgcccaaggcagaggtgaagaagcctgaggtgaaggccatcgagatctccggtgcaggggataatgcagtatgaattgtatgggtcgctcgtttgggaagctaacggagtgcagttcgaagttgcaaggcatgcagatcagcaagctccccgaaaatgaagacggcggtaatgtaatactgcaaaaattgagccagaaacaagatggcccagctatattcaaacctctttgaggatgaacagtttccttaataagaagggttgtactctgaacgtgacaacctgaaactgcaaccggaaaaatgtgccgatccagattacaaatgtcatatagttcagaattctgacttagtagctattcccttcgaatgtttcagaaaaataaaatgtctactcctcacagtaaacaacatgtgatcacatatgatttttacaattaaccaaaatcaaggttttttagaaaataaa

SEQ ID NO: 1354 - DNA, 482 bp, Panicum virgatum
agcagtgtccgatccgcgctcagaaacccaaccggcaacaatgtcgctggcgaggcgcagcaacgtgttcgaccccttcgccgacttctgggaccccttcgacgtcttccgctccgtggtgcccgcggcatcgaccgaccgcgacaccgtcgccttcgccaacgcgcgcatcgactggaaggagacccccgaggcgcacgtcttcaaggccgacctccccggcgtcaagaaggaggaggtcaaggtggaggtggaggatggcaacgtcctggtgatcagcggcgagcgcagcaaggaggaggaggacaagaacgacaagtggcaccgcgtggagcgcagcagcggcaagttcctccgccggttccgcctgccggagaacgccaagacggaccagcaggtgaaggccgggctggagaacggcgtgctcaccgtcactgtgcccaaggccgaggtcaagaagcccgaggtgaaagccatcgaga

SEQ ID NO: 1355 - DNA, 709 bp, Avena sativa
gaaaccaagagacaagatcgcgaattgatacaccgagcatagcattcgattcgaatcaaacaccagcaatcactttgtccgcgcagaaaccgaagccgccaatgtcgatcgttaggcgctgccccttcttctccgacctctgggtcgacccattcgacgccttccgctccatcatcccagccgctgacaacaacgacgccaccgccgccttcgtgaatgcccgtgtggattggaaggagacgccggaagcacacgtcttcaaggcggacctccccggcgtgaagaaggaggaggtcaaggtggaggtggaggacggcaacgtgctggtcgtcagcggcgagcgcagcagggagaaggaggacaagaatgaaaagtggcaccacgtcgagcgcagcagcggcaagtttgtgagaagattccgcctgccggagaattccaaggtggaggaggtgaaggccgggctggaggacggcgtgctcaccgtcaccgtacccaaggcagaggtcaagaagcccgtggtgaaggccatcgatatctccggctaactgcgccttccttgatcggtgcgtgattggacgaccagcctggtagatgtatgtgcgagtatataccaatgagttgcagaattcgtgtcagtgatccagtgttcatgaggagttgtttgtggtagtgtttccttccgtggtacttgtgtcttgtgtgatcgtct

SEQ ID NO: 1356 - DNA, 454 bp, Panicum virgatum
gcatcagcaatgtcgctcgtcaggcgcggcaacgtgttcgaccccttctccatggacctctgggaccccttcgacagcatgttccgctccatcgtcccatcgtcctcctccgactccgacaccgccgccttcaccaacgcccgcatcgactggaaggagacccccgaggcgcacgtcttcaaggccgacttccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccaga

SEQ ID NO: 1357 - DNA, 828 bp, Panicum virgatum
ccgctcccgacgaagctataaattccatcacctcccaccgctctgctcagtccaaacctagatcgaaatcgcaccgagctcgaacagcgcacacatcatcatcgtttcttttctgatcccacgcaaacgtttcaggttcccgttcgcagcaacccccgccgacaatgtcgctggtgaggcgcagcagcgtgttcgaccccttctccctctgggaccccttcgacagcatgttccgctccgtcgtcccgtcggccggcgcctccgactccgagaccgccgccttcgccaacgcccgcattgactggaaggagacgcccgaggcgcacgtcttcaaggccgacctccccggcgtcaagaagggggaggtcaaggtcgaggtggaggacggcaacgtcctggtcatcagcggccagcgcagcaaggagaaggaggacaagaatgacaagtggcaccgcgtcgagcgcagcagcggccagttcatgaggcggttccgcctgccggagaacgccaaggtcgaccaggtgaaggccgggctggagaacggcgtgctcaccgtcaccgtgcccaaggctgaggagaagaagcctgaggtgaagagcatccagatctccagttaagcggccatggacgcgggttgaagatgatgcgatgtgatgctatgagtcgtgcgtgcttggctgcgtactctgtctgtgtgtgttcttgtcttcttgagtgtgtggtgtggacgatgtgtgcttcccttgccgctgtacttgcttttgcttcttccgtgtaaacgtcctgtggttcctctgacaaataaataaaagcagctttcaaatttac

SEQ ID NO: 1358 - DNA, 881 bp, Pennisetum glaucum
gtgaagatcgaaatcgcacactgatcagcaagcaacacacttctttcgcttccgattccaccacacattccacagttccccaatcgcagcagccaacccgacaatgtcgctggtgaggcgcagcagcgtcttcgaccccttctccatggaactctggaccccttcgacaacatgttccgctccatcgtgccgtcgtcgtcctccgactccgataccgccgccttcgccgccgcgcgcatcgactggaaggagacccccgaggcgcacgtcttcaaggccgacctccccggggtcaagaaggaggaggtcaaggtcgaggtggaggacggcaacgtcctcgtcatcagcggccaacgcagcaaggagaaggaggacaagaacgacaggtggcaccgcgtcgagcgcagcagcggccagttcatgaggaggttccgcctgccggagaacgccaaggtggaccaggtgaaggctgggctcgagaacggcgtgctcacggtcaccgtgcccaaggccgaggagaagaagcctgaggtgaaggccatcgatatctctggttgagcggccatggacggactcgagacgtgaaggaaggtatgcggtggacgggtggaggaagaggatctatggtttgaggcgagctacggagtacttgtacggagtatgtcgttactctgctttggtgtgtttggtgtgttctgttcagcgttccatggtagtagtgcctactagtagtgtcatgtattccgtacttcacctgtatggtgagctcagctcggttcagtatgagtatgatctgcgagtgaataaataaaataaagcagttcttggtgtgtactatattcattaattctctatttctgccgatctcaccaaaaactccg

SEQ ID NO: 1359 - DNA, 671 bp, Pennisetum glaucum
ctcctgcaatccaccgtgaagttcagttcatccaaacacagagtttcagcaatgtcgctggtgagtcgcagcagcgtgttcgaccctttctccatggacctctgggaccccttcgatagcatgttccgctccatcgtccagtcggcggggagccccgactccgacaccgccgccttcgccgccgcgcgcatcgactggaaggagacccccgaagcgcacgtcttcaaggctgacctcccaggcgtcaagaaggaggaggtcaaggtcgaggtggaggatggcaacgtcctcgtcatcagcggccagcgcagcaaggagaaggaggacaagaacgacaggtggcaccgcgtcgagcgcagcagcggccagttcatgaggaggttccgcctgccggagaacgccaaggtggaccaggtgaaggctgggctcgagaacggcgtgctcacggtcaccgtgcccaaggccgaggagaagaagcccgaggtgaaggccattgagatctctggttaagagtccgtatagggtgctacggttgaagaaaatggtggtgatgcgatgtgatgctacgagtcgtgcttgtttgctttcatgatcttgtgttgtggacggtgtgtacttcccttgccgtgtagtattgtgtttccttcagaaagaaataaaggcaggtttca

SEQ ID NO: 1360 - DNA, 554 bp, Sorghum bicolor
ggccatcgagaaaaaagcacaaagcagcaaccccatacaagcctgaaatccactcagcactgtcaagtgtcaagtctccgcgttcactaatccaaccgacgacaatgtcgctcgtgaggcgcagcaacatcttcgaccccttcgccgacttctgggaccccttcgacggcgtcttccgctccctcgtcgtcccgtctgtcgcctcgtcggggcgcgacaccgctgccttcgccaacgcgcgcatcgactggaaggagatgcctgaggcgcacgtgttcaaggccgacctccccggcgtgaagaaggaggaggtcaaggtggaggtggaggacggcaacgtgctcgtcatcagcggcgagcgcagcaaggagaaagaggacaagaacgacaagtggcaccgcgtcgagcgcagcagcggcaagttcatgaggcggttccgcctgccggagaacgccaagacggaccaggtgaacgccggcctcgagaacggcgtgcttaccgtcaccgtgcccaaggccgaggtcaagaaacctgaggtgaagaccattgagatt

SEQ ID NO: 1361 - DNA, 443 bp, Festuca arundinacea
caacaatgtcgatggttaggcgctgcccctttgcggacctctgggtcgacccattcgacggcttctgctccatcgtcccagcatcatgggactccgactcagccggctttgcaaacgctcgcgtggactggaaggagacgccggaggcgcacgtcttcaaggccgacctccccggagtgaagaaggaggaggtgaaggtggaggtggaggacggcaacgtgctcgtcgttagcggcgagcgcaccaaggagaaggaggacaagaaagaaaagtggcaccgtgtcgagcgcagcagcggcaaattcatcaggcgctttcagctgccggagaacgccaagatggaggaggtcaaggccgggctggagaacggcgtgctcaccgtcaccgttcccaaggttgacatcaagaagcccgacgtgaaggccatcgatatctccggctaa

SEQ ID NO: 1362 - DNA, 719 bp, Cenchrus ciliaris
gggctgcaggaattcgcggtcgctagcggccgcaattcgcggccgctctcctgcaatccaccgtgaagttcagttcatccaaacacagagtttcagcaatgtcgctggtgagtcgcagcagcgtgttcgaccctttctccatggacctctgggaccccttcgatagcatgttccgctccatcgtccagtcggcggggagccccgactccgacaccgccgccttcgccgccgcgcgcatcgactggaaggagacccccgaagcgcacgtcttcaaggctgacctcccaggcgtcaagaaggaggaggtcaaggtcgaggtggaggatggcaacgtcctcgtcatcagcggccagcgcagcaaggagaaggaggacaagaacgacaggtggcaccgcgtcgagcgcagcagcggccagttcatgaggaggtttcgcctgccggggaacgccaaggtggaccaggtgaaggctgggctcgagaacggcgtgctcacggtcaccgtgcccaaggccgaggagaagaagcccgaggtgaaggccattgagatctctggttaagagtccgtatagggtgctacggttgaagaaaatggtggtgatgcgatgtgatgctacgagtcgtgcttgtttgctttcatgatcttgtgttgtggacggtgtgtacttcccttgccgtgtagtattgtgtttccttcagaaagaaataaaggcaggtttcaa

SEQ ID NO: 1363 - DNA, 673 bp, Saccharum officinarum
atcgagaaaaagcacaaagcgcaacgcatacaaaagagcctcaaatccgctcgcactctcaagtgccaagtctccgccgttcactaatccaaccgacgacaatgtcgctcgtgaggcgcagcaacatcttcgaccccttcgccgacttctgggaccccttcgacggcgtcttccgctccctcgtcccttctgtcgtcgcgtcgtcggaccgcgacaccaccgccttcgccaacgtgcgcatcgactggaaagagactcccgaggcgcacgtgttcaaggccgacctccccggcgtcaagaaggaggaggtcaaggtcgaggtggaggacgacaacgtgctggtcatcagcggcgagcgcagcaaggagaaggaggacaagaacgacaagtggcaccgcgtcgagcgcagcagcagcaagttcctccgccggttccgtctgccggagaacgccaagacggaccaggtgaacgccggcctcgagaacggcgtgcttaccgtcaccgtgcccaaggccgaggtcaagaaacctgaggtgaagaccattgagatttctggttaagggaccatgggcgctggatgatgaagatgtggcgtggagcgcgatactgtttccggtcgtgattggttgatgcgtgtcagatggtttactgcagcttcaagtgaagtctatac

SEQ ID NO: 1364 - DNA, 1327 bp, Brachypodium distachyon
cgtgtccaagcaaaccacgcgccgccaccgccgttgtttcccaaagcagtttctcaatcaagcacactccactccaatcccccgccgcagtctgcaaaaccctcgtctccccccacattcctccggtcagatcgagtgctcgtcagtactacattcgaatctaggagccagagaatctagggcgatggcagcgacccacccggcctccccgaccgccgccggtgacaagtcatccccctcgccgccgccgccggtgcgcctggcgacggcggtcgcggccatccaacccagctcgccgcgcttcttcttctcctccctcgcggcttcctcctcgccgcaccgccgcatcggcatcgccgtcgacctctccgacgagtccgccttcgccgtcaagtgggccgtccagaactacctccgcccaggcgacgccgtcgtgctcctccacgtgcgccccacctccgtcctctacggcgccgactggggctccatccccgtctccgtcgacgacgacgacggcggggaagcgccggctggcgacgagccggaggacgcgcggaagaagcgggaggaggacttcgacaccttcacctccaccaagtcgcaggatctggcgcagccgctcgtcgccgcgcagatccccttcaagatccacatcgtcaaggaccacgacatgaaggagcgcctctgcctcgaggccgagcgcctcggcctgtccgcgatgatcatgggcagccgcggctttggtgccttccgcaggggagataaagggaggctcgggagtgtcagcgactactgcgtgcaccactgcgtctgccccgtggtggttgtgcggtaccctgatgatgctggggcagctggtggtgcggaggctgcgggcgatgagctgcggacggtccctgagaatgaggtcgtgttccatgaggcgcccgaggggcagaaagaaaactgaggtagccgcaagcagacagatcaagaggagaaagcaagacttggctgattccaaccatctgtaactttgtggctgcttgtatgctccactctgtgttgcactttgagtttgtatcagacttgtagatcatggacgagtcctcgttgattcgcttcctgagaattgaaaatgggaataatgtattactgcagatggtagctgttgtatgaatggatgtttctgcttgacttcactggaacatggttccgttagccaacctgttttcgctgcaaaccttgaccgttacaatgctgtgttgtatctctgccttgtctgatttgcataattctgcttgtaagggctgtagatcatggacggttcttggttccttcgcctctg

SEQ ID NO: 1365 - DNA, 1330 bp, Brachypodium distachyon
gcaaaccacgcgccgccaccgccgttgtttcccaaagcagtttctcaatcaagcacactccactccaatcccccgccgcagtctgcaaaaccctcgtctccccccacattcctccggtcagatcgagtgctcgtcagtactacattcgaatctaggagccagagaatctagggcgatggcagcgacccacccggcctccccgaccgccgccggtgacaagtcatccccctcgccgccgccgccggtgcgcctggcgacggcggtcgcggccatccaacccagctcgccgcgcttcttcttctcctccctcgcggcttcctcctcgccgcaccgccgcatcggcatcgccgtcgacctctccgacgagtccgccttcgccgtcaagtgggccgtccagaactacctccgcccaggcgacgccgtcgtgctcctccacgtgcgccccacctccgtcctctacggcgccgactggggctccatccccgtctccgtcgacgacgacgacggcggggaagcgccggctggcgacgagccggaggacgcgcggaagaagcgggaggaggacttcgacaccttcacctccaccaagtcgcaggatctggcgcagccgctcgtcgccgcgcagatccccttcaagatccacatcgtcaaggaccacgacatgaaggagcgcctctgcctcgaggccgagcgcctcggcctgtccgcgatgatcatgggcagccgcggctttggtgccttccgcaggggagataaagggaggctcgggagtgtcagcgactactgcgtgcaccactgcgtctgccccgtggtggttgtgcggtaccctgatgatgctggggcagctggtggtgcggaggctgcgggcgatgagctgcggacggtccctgagaatgaggtcgtgttccatgaggcgcccgaggggcagaaagaaaactgaggtagccgcaagcagacagatcaagaggagaaagcaagacttggctgattccaaccatctgtaactttgtggctgcttgtatgctccactctgtgttgcactttgagtttgtatcagacttgtagatcatggacgagtcctcgttgattcgcttcctgagaattgaaaatgggaataatgtattactgcagatggtagctgttgtatgaatggatgtttctgcttgacttcactggaacatggttccgttagccaacctgttttcgctgcaaaccttgaccgttacaatgctgtgttgtatctctgccttgtctgatttgcataattctgcttgtaagggctgtagatcatggacggttcttggttccttcgcctctgaggcatattcgt

SEQ ID NO: 1366 - DNA, 1330 bp, Avena sativa
acggcgcgtgccaatcccaaatctctagcagcagccgtctgcaaaaccctggtcctcatcccgtctcccccacctccattcccattcccattcccctgatccgatcagatcgagcgctccacgcattcgaatcgactagccgacgaagaaacctaaggcgatggcgtccccgacccaccacccggcctcgccgaacggcggcggcaagtcgtccccctcgccgccgccgccggtgcgcccgtccacggcgcaggcggcggcggtggccgcgatccagcccagctcgccgcgctacttcttctcctccctggccgcctcctcctccccgcaccgccgcatcgccatcgccgtcgacctctccgacgagtcagccttcgccgtcaagtgggccgtgcagaactacctccgcccgggcgacgccgtcgtgctcctccacgtgcgccccacctccgtcctctacggcgccgactggggctccatccccgtctccgtctccgacgacgacggagaggaggcggccccctccgcggaggagctgcagaagaagcgggaagaggacttcgacaccttcacctccaccaagtcggaggacctggcgcagccgctcgtcgccgcgcagatccccttcaagatccacatcgtcaaggaccacgacatgaaggagcgcctgtgcctcgaggcagagcgccttggcctgtgcgccatgatcatggggagccgcggctttggtgcctcgcgcaagggcgggaaggggaggctcgggagtgtcagtgattattgcgtgcatcactgtgtctgcccggtcgtggtcgttcgctacccggatgatgctgcaggtgtcgccggtgaggcagcaccagcaacagcagatgagctgcacactgtgcctgaggatgagcccgtgtatcatgatgcgcctgacgcacacaaagacaattgaggcaatgacatgcaacatggagcgcaaggaaaacatgaggcttgtacctaggcgatccctgtgtatctgagcgacacaacttctgtatccactgcatgagtcctgattgcacatcataactggcttggccagcaggctttgcttttcgagttactaccagactcctcagtcgcaggagcctttgttgaattgcgttgtgagacctttattgtcgactgcatgtagactgaattattcctgtgtgcaccagctgtatgtttatgccgggctcctgaatctctcttgctttgtaagttcaggcttcccagtgtggtacgtgttgtattatcccctagttttctgcatggatacatggatgtacaccatttagtttcatgcacatgtttgtaa

SEQ ID NO: 1367 - DNA, 2177 bp, Triticum aestivum
ccaggctccagccagccagctacaattcccagctcctcgccctccaaccccgctccaccacctcccacatgatgccatccccgcagatatacccgcagcaatgcagctgtcctctcacgccaacctgacacaccctcccatccttcccgttagttagttgccgctcgccaccgcaccgcaccgcaagggcactcgcccgccctgcccgccctcctcaccttgcttccgcagaaagatccatttggttggactggcggtggttcccctgcagactgcctgcagcggtaaagccgcgcccttttgtgtgtgcgcttgccttgccgccgcggcatccgtcccgccccgctccgtggataactagtgatagatctgggaggcgcagatctgactgaccggccggtgttcgtcctccttcctgtcggtgagtgtttgttggccaagaatttgttggggccatggggaagaagggcaagtggctgggcgccgtcaagaaggtgttcagccctgagtccaaggagaagaaggaggagaaactgaggaagaagttggctgcaagagaccccagtccaccagatctaacaccttccacttccttggaagtcaatgtttcgatgccgccgccgctgccgcctcccgccgttccatccccgcaccaaactgaggaggttcaggtccgtgatgttgagctggagcaggagcaggagcagagcaagcatgtgaccgtggaggcagcccctgatgctcctgcgcagacatcgtcggcattgccacctggtgtatcgagggaagagctagcagcaatcaagatccagaccgccttcaggggatacctggcaaggagggcactacgagccttgaggggccttgttagattgaagtcattggtcgagggtaattcggttaagcgtcaagctgcaagtactctgcgctgtatgcagactctcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcaataagaagagagagagcgctcgcatacgcgttttcccatcagtggaagagcagttcaaggtcctccaacccaatgtttgtagacccaaacaacccacactggggctggagctggctggagcgctggatggcagcaaagccttctgaggccggccgcactggaaccggcaaggaaagcaacattgaccagggatcagtgaagagcacgagtttgaaccttggagagggcgagatcactaaagccttcaaccgtaggggctccaagccagacaagtcgtcaccgacgactccaaagctgatccgcccagcctcccggctgtccccttccacacccactgccaaagtgacaccaatagttgtgaagaagaaacctgctacaccgaagaacgggatttcacaggtggatgacgatgcaaggagcgtgctcagtgtgcagtccgagcgaccaaggcggcacagcatagccacctcaacagtgcgggatgacgagagcctcgcaagctctccatcagtcccaagctacatggctgccacaaaatctgctagggccaagtcccgcctccaggggtcgccactgatcgatagtgcagagacgacaccagagaaaggaggctctattagcgttgggtcagccaagaagaggctgtctttcccagctggaggggtgcccccctcgccaatgaggcggcattctggccctccgaaggtggagagtgtggtgaaggacatcgctgtgacaccgcagccagaggccctggcgatcagcggttgagacaaacaagcaactcatacaagtggagacgggactatggattatgcagatacacatatttcacccatgaaaaaaaggtcaaagttcttcgaattgttgcattttgttttcatccaattattattgtgactacattgtcggcttcattagggaagactctcggtgtcgtctgtcggtccattccatttgttgcttgtgtaaaaccatatggggtttgctctttgtatgtacacaggtcttctatttatgcgagcaatatatttcttccatgcctttacg

SEQ ID NO: 1368 - DNA, 2052 bp, Secale cereale
cgccacggcccgccctcctcaccttgcttccgcagaaagatccatttgcactgcggcggtggttcccctgcacaccgcttgcagcagtaaagccgcgcccttttgtgcgcgcgcttgccttgccgccgcggcatccgtcccgtcccgtcgcgtgcgtagatctgggaggcgcagatctggctgactgaccggtggtattctcctccccgtcggcgagtgtttgttgggcgaggaatttgttgggggccatggggaagaagggcaagtggctgggcgccgtcaagaaggtgttcagccccgagtccaaggagaagaaggaggagaaactgaggaagaaattggctgcaagagaccccagtccactagatctaacaccttctacttccttggaagtcaatgtttcgatgccgccgccgcctcccgccgttccttctccgcgccaaactgaggaggttcaggtccgtgatattgagctggagctggagcaggagcaggagcagagcaagcatgtgaccgtggaggcagcccctgatgctcctgcgcaggcatcgtccgcattgccacctggtgtatcgagggaagagctcgctgcaatcaagatccagaccgcgttcaggggatacctggcaaggagggcactacgagccttgaggggccttgttagattgaagtcattggtcgagggtaattcggttaagcgtcaagctgcaagtactctgcgatgtatgcagacactcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcgataagaagagagagagcgcttgcatacgcattttcccatcagtggaagagcagttcaaggtcctccaacccaatgtttgtagacccaaacaacccacactggggctggagctggctggaacgctggatggcagcaaagccttctgaggctggccgcactggaaccggcaaggaaagcaacattgaccagggatcagtgaagagcacgagtttgaaccttggagagggcgagatcactaaagccttcaaccgtaggggctccaagccggacaagtcgtcaccgacgactccaaagctgacccgcccagcttcccggctatccccttctacacccactgccaaagtgacaccaatagtggtgaagaagaaatctgctacaccgaagaacgggatttcacaggtggatgacgatgcaaggagcgtgctcagtgtgcagtccgagcgaccacggcggcacagcatagccacctcgacggtgcgggatgacgagagcctcgcaagctctccatcagtcccaagctacatggctgccacaaaatctgctagggccaagtcccgcctccaggggtcaccactgatcgatagtgcagagacgacaccagagaaaggaggctctgttagtgttgggtcagccaagaagaggctgtccttcccagctggaggggtgcccccctcgccaatgaggcggcattctggccctccaaaggtggcggagagcatggtgaaggacatccccgagacgccgcagccagaggccctggcgatcagcggttgaaacaagcaagcgactcatacaagcggagacgggactatgtacggattacgcagatacacacatttcacccatgaaaaaaggttgaagttcttcgaattgttgctatttttttttgtttcatccaattatatcgtgactacattgtcggcttcattaggggaggactctcggtgtcgtctgtctgtcggtccatttcatttgttgcttgtgtaaaaaccatatggggtttgctgtttgtatgtacacaggtcttctatttatgcgagcaatatatttctaaccaaaaaaaaaaaaaaaaccaaaaaaaaaaaccaaaaaaaaaaccaaactgacagacacgacgacacacggagtagag

SEQ ID NO: 1369 - DNA, 2175 bp, Triticum aestivum
ccggaaactcccggcctcctcccctccaaccctcgcctccacccacctcccacactgactgccatccttccccgccacgatataccgcagcaattcagctgtcctctcacgccaacctgacacaccttcccatcccttccttcccgttagttagtgagttgccgctcgccaccgcaccccaccgcaccgcaagaggaagggcattcgctcgccctgcccgccctcctcaccttgcttccgcagaaagatccatttggttggactggcggtgcttcccctgcagaccgcctgcagtggtaaagccgcgcccttttctctgtgcgcttgccttgtcgccgcggcatccgtcccgtcccgtcccgtgcatagatctgggaggcgcagatctgtctaacaggtgttccttctccttcccgtcggcgagtgtttgttgggagagaatttgtcggggccatggggaagaagggcaagtggctgggcgccgtcaagaaggtgttcagccctgagtccaaggagaagaaggaggagaaactgaggaagaaattggctgcaagagaccccagtccaccagatctaacaccttctacttccttggaagtcaatgtttcgatgccgccgccgcctcccgccgttccttctccacaccaaaccgaggaggttcaggtccgggatgttgagctggagcaggagcaggagcagagcaagcatgtgaccgtggaggcagttcctgatgctcctgtgcagacgtcgtcggcattgccacctggtgtatctagggaagagctcgctgcaatcaagatccagaccgccttcaggggatacctggcaaggagggcactacgagccttgaggggccttgttagattgaagtcattggtcgagggtaattcggttaagcgtcaagctgcaagtactctgcgctgtatgcagaccctcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcgataagaagagagagagctctcgcatacgcgttttcccatcagtggaagagcagttcaaggtcctccaacccaatgtttgtagacccaaacaacccacactggggctggagctggctggaacgctggatggcagcaaagccttctgaggccggccgcactggaaccggcaaggaaagcaacattgaccagggatcagtgaagagcacgagtttgaaccttggagagggcgagatcactaaagccttcaaccgtaggggctccaagccagacaagtcgtcacccacgactccaaagctgacccgcccagcttcccgcctgtccccttctacgcccactgccaaagtgacaccaatagttgtgaagaaaaaatctgctacaccgaagaacgggatttcacaggtggatgacgatgcaaggagcgtggtcagtgtgcagtccgagcgaccaaggaggcacagcatagccacctcaacggtgcgggacgacgagagcctcacaagctctccgtcagtcccaagctacatggccgccaccaaatctgctagggccaagtcccgcctccaggggtcaccactgatcgatagcgcagagacgacaccagagaaaggaggctctgttagtgttgggtcagccaagaagaggctgtccttcccagctggaggtgttcccccctccccaatgaggcggcattctggccctccaaaggtggagagcatggtgaaggacatcgctgagacgccgcagccagaggccctggcgatcagtggttgaaacaaacaagcaactcatacaagtggagacgggactatggattattacgcagatacacacatttcacccatgaaaaaaaggttaaagttcttcgaattgttgcattttgttttcatccaattattattgtgactacattgtcggcttcattaggggaagactctcggtgtcctctgtctgtcggtccatttcatttgttgcttgtggaaaaaccatatggggtttgctgtttgtatgtacacaggtcttctatttatgcgagcaatatatttcttacatgccttc

SEQ ID NO: 1370 - DNA, 2240 bp, Triticum aestivum
gctccctctcagcgccgcgctgcgctgtgccctcctgtcagcctaccgcacctccagccagctagtacaaatccccagctcctccaaccccgctccaccacctcccacatgatgccatccccgcagatatacccgcagcaattcagctgtcctcctctcacgccaacctgacacacctccccttcccatcccttcccttccttcccgttagttagctgccgctcgccaccgcaccgcaccgcaagaggaagggcactcgcccgccctcctcaccttgcttccgcagaaagatccatttggttggactggcggtggctcccctgcacaccgcagtggtaaagtcgcgcccttttgtgtgtgcgcttgccttgccgccgcggcatccgtcccgccccgtggataactagtgatagatctgggaggcgcagatctgaccggtggtattctccttcccgtcccgtcggcgagtgtttgctgggagaaaatttgttggggccatggggaagaagggcaagtggctgggcgccgtcaagaaggtgttcagccctgagtccaaggagaagaaggaggagaaactgaggaagaaattggctgcaagagaccccagtccaccagatctaacaccttctacttccttggaagtcaatgttttgatgccgccgccgcctcccgccgttccttctccgcaccaaactgaggaggttcaggtccgtgatgttgagctggagcaggagcaggagcagagcaagcatgtgaccgtggaggcagcccctgatgctcctgcgcagacgtcggcggcattgccacctggtgtatcgagggaagagctcgcggcaatcaagatccagaccgccttcaggggatacctggcaaggagggcactacgagccttgaagggccttgttagattgaagtcattggtcgagggtaattcggtcaagcgtcaagctgctagtactctgcgctgtatgcagactctcgcacgggtgcagtcacagatacgttcaagaaggctgaagatgtctgaggagaaccaggccctccagcgccagctcctgctgaaacaagaattggacagtttgaggatgggggagcactgggacgacaccactcaatccaaggagaagatcgaagcaagtctaataagcaggcaagaggctgcgataagaagagagagagcgctcgcatacgcgttttcccatcagtggaagagcagttcaaggtcctccaacccaatgtttgtagacccaaacaacccacactggggctggagctggctggaacgctggatggcagcaaagccttctgaggccggccgcactggaaccggcaaggaaagcaacattgaccagggatcagtgaagagcacgagtttgaaccttggagagggtgagatcactaaagccttcaaccgtaggggctccaagccagacaagtcgtcaccgacgactccaaagctgacccgcccagcttcccggctatccccttctacacccactgccaaagtgacaccaatagttgtgaagaagaaatctgctactccgaagaacgggatttcacaggtggatgacgatgcaaggagcgtgctcagtgtgcagtctgagcgaccaaggcggcacagcatagccacctcaacggtgcgggatgacgagagcctcgcaagctctccgtcagtcccaagctacatggctgccacaaaatctgctagggccaagtcccgcctccaggggtcaccactgatcgatagtgtagagacgacaccagagaaaggaggctctgttagtgttgggtcagccaagaagaggctgtccttcccagctggaggggtgcccccctcgccaatgaggcagcattctggccctccaaaggtggagagcatggtgaaggacatccccgaggcgctgcagccagaggccctggcgatcagcggttgagacaaacaagcaactcatacaagtggggacgggactatggattatgcagatatatacacatttcacccatgaaaaaaaggttaaagttcttcgaattgttgcattttgttttcatccaattattattgcgactacattgtcggcttcattaggggaagactctcggtgtcgtctgtctgtccatttcatttgttgcttgcttgtgtaaaaccatatggggtttgttgtttgtatgtacacaggtcttctatttatgcgagcaatatatttcttccatgcatgccttcccaatgaacttgtcaatgt

SEQ ID NO: 1371 - DNA, 1865 bp, Triticum aestivum
ccgatccgtccgcccgtcggatacagtgatacgagtctcgggaggcgcacgatctgaccgtggatccctaccgtccgcgcgagtgtttgctgggagagatctgggcatgggaacaagggcaagtggctgggcgcgtcagagcgtcagcctgagtcaagagagtaagacggagagactgaggaacgagattggctgctaagagaccccagtccaccagatctaacaccttctacagtcccttggaagtcaacgttttgatgccgcgccgctccgcgtcctctccgcacaaactgagaggttcaggtccgtgatgttgagctggagcaggtagcaggagcagagcaaagcatgtgaccgtggaggcagcccctgatgctcctgcgcagacgtcggcggcattgccacctggtgtatcgagggaagagctcgcggcaatcaagatccagaccgccttcaggggatacctggcaaggagggcactacgagccttgaagggccttgttagattgaagtcattggtcgagggtaattcggttaagcgtcaagctgcaagtactctgcgctgtatgcagacactcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcgataagaagagagagagctctcgcatatgcgttttcccatcagtggaagagcagttcaaggtcctccaacccaatgtttgtagacccaaacaacccacactggggctggagctggctggaacgctggatggcagcaaagccttctgaggccggccgcactggaaccggcaaggaaagcaacattgaccagggatcagtgaagagcacgagtttgaaccttggagagggcgagatcactaaagccttcaaccgtaggggctccaagccagacaagtcgtcaccgacgactccaaagctgacccgcccagcgtcccggctatccccttctacacccactgccaaagtgacaccaatagttgtgaagaagaaatctgctacaccgaagaacgggatttcacaggtggatgacgatgcaaggagcgtgctcagtgtgcagtccgagcgaccaaggaggcacagcatagccacctcaacggtgcaggatgacgagagcctcgcaagctctccatcagtcccaagctacatggctgccacaaaatctgctagggccaagtcccgcctccaggggtcaccactgatcgatagtgcagagacgacaccagagaaaggaggctctgttagtgttgggtcagccaagaagaggctgtccttcccagctggaggggttcccccctcgccaatgaggcggcattctggccctccaaaaggtggagagcatggtgaaggacatcgctgagacgccgcagccagaggccctggcgatcagcggttgaaacaaacaagcaactcatacaagtggagacgggactatggattattacgcagatacacacatttcacccatgaaaaaaggttaaaagttcttcgaattgttgcattttgttttcatccaattattattgtgactctcggcgtcgtctgttagtccatttcatttgttgcttgtgcaaaaccatatggggtttgttgtttgtatgtacacaggtcttctatttatgcgagcaatatatttcttccatgccttctatttatggtcccaaattcccaatgagcttgtcaatgtagcactctgccccaataagtatcctatcttctttaatgtact

SEQ ID NO: 1372 - DNA, 2086 bp, Secale cereale
gacttgacacacctcccatcccctccccttccttccttcccgttagttagttgccgctcgccaccgcaccgcaccccccaccgcaccgcaagaggaagggcactcgctcgccccggcccgccctcctcaccttgcttccgcagaaagatccatttgcactgcggcggtggttcccctgcacaccgcttgcagcagtaaagccgcgcccttttgtgcgcgcgcttgccttgccgccgcggcatccgtcccgtcccgtcgcgtgcgtagatctgggaggcgcagatctggctgactgaccggtggtattctcctccccgtcggcgagtgcttgttgggcgaggaatttgttgcgggccatggggaagaagggcaagtggctgggcgccgtcaagaaggtgttcagccccgagtccaaggagaagaaggaggagaaactgaggaagaaattggctgcaagagaccccagtccactagatctaacaccttctacttccttggaagtcaatgtttcgatgccgccgccgcctcccgccgttccttctccacaccaaactgaggaggttcaggtccgtgatattgagctggagctggagcaggagcaggagcagagcaagcatgtgaccgtggaggcagcccctgatgctcctgcgcaggcgtcgtccgcattgccacctggtgtatcgagggaagagctcgctgcaatcaagatccagaccgccttcagaggatacctggcaaggagggcactacgagccttgaggggccttgttagattgaagtcattggtcgagggtaattcggtaaagcgccaagctgcaagtactctgcgctgtatgcagactctcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcgataagaagagagagagcgctcgcatacgctttttcccatcagtggaagagcagttcaaggtcctccaacccaatgtttgtagacccaaacaacccacactggggctggagctggctggaacgctggatggcagcaaagccttctgaggccggccgcactggaaccggcaaggaaagcaacattgaccagggatcagtgaagagcacgagtttgaaccttggagagggcgagatcactaaagccttcaaccgtaggggctccaagccggataagtcgtcaccgacgactccaaagctgacccgcccagcttcccggctatccccttctacacccactgccaaagtgacaccaatagtggtgaagaagaaatctgctacaccgaagaacgggatttcacaggtagatgacgatgcaaggagcgtgctcagtgtgcagtccgagcgaccaaggcgacacagcatagccacctcaacggtgcgggatgacgagagcctcgccagctcaccatcagtcccaagctacatggctgccacaaaatctgctagggccaagtcccgcctccaggggtcaccactgatcgatagtgcagagacgacaccagagaaaggaggctctgttagtgttgggtcagccaagaagaggctgtccttcccagctggaggggtcgcccccctcgccaatgaggcggcattctggccctccaaaggtggcggagagcatggtgaaggacatccctgagacgccgcagccagaggccctggcgatcagcggttgaaacaagcaagcgactcatacaagcggagacgggactatgtacggattacgcagatacacacatttcacccatgaaaaaaggttgaagttcttcgaattgttgcattttttttttggtttcatccaattatatcgtgactacattgtcggcttcattaggggaagactctcggtgtcgtctgtctgtcggtccatttcatttgttgcttgtggaaaaaccatatggggtttgctgtttgtatgtacacaggtcttctatttatgcgagcaatatatttcttcca

SEQ ID NO: 1373 - DNA, 1719 bp, Secale cereale
ctatacccgcagcaattcagctgtcctctcacgccaaccctgacacacctcccctccccctcccctcccccttccttcccgttagttagttgccgctcgccaccgcaccgcaccccacccaccgcaccgcaagaggaagggcactcgctcgccccggcccgccctcctcaccttgcttccgcagaaagatccatttgcactgcggcggtggttcccctgcacaccgcttgcagcagtaaagccgcgcccttttgtgcgcgcgcttgccttgccgccgcggcatccgtcccgtcccgtcgcgtgcgtagatctgggaggcgcagatctggctgactgaccggtggtattctcctccccgtcggcgagtgcttgttgggcgaggaatttgttgcgggccatggggaagaagggcaagtggctgggcgccgtcaagaaggtgttcagccccgagtccaaggagaaaaaggaggagaaactgaggaagaaattggctgcaagagactccagtccactagatctaacaccttctacttccttggaagtcaatgtttcgatgccgccgccgcctcccgccgttccttctccacaccaaactgaggaggttcaggtccgtgatattgagctggagcaggagcaggagcagagcaagcatgtgaccgtggaggcagcccctgatgctcctgcgcaggcatcgtccgcattgccacctggtgtatcgagggaagagctcgctgcaatcaagatccagaccgcgttcaggggatacctggcaaggagggcactacgagccttgaggggccttgttagattgaagtcattggtcgagggtaattcggttaagcgtcaagctgcaagtactctgcgatgtatgcagacactcgcacgggtgcagtcacagatacgttcaagaaggctgaagatgtctgaggagaaccaagccctccagcgccagctcctgctgaaacaagaattggacagtttgaggatgggggagcactgggacgacaccactcaatccaaggagaagatcgaagcaagtctaataagcaggcaagaggctgcgataagaagagagagagcgcttgcatacgcattttcccatcagtggaagagcagttcaaggtcctccaacccaatgtttgtagacccaaacaacccacactggggctggagctggctggaacgctggatggcagcaaagccttctgaggctggccgcactggaaccggcaaggaaagcaacattgaccagggatcagtgaagagcacgagtttgaaccttggagagggcgagatcactaaagccttcaaccgtaggggctccaagccggacaagtcgtcaccgacgactccaaagctgacccgcccagcttcccggctatccccttctacacccactgccaaagtgacaccaatagtggtgaagaagaaatctgctacaccgaagaacgggatttcacaggtagatgacgatgcaaggagcgtgctcagtgtgcagtccgagcgaccaaggcgacacagcatagccacctcaacggtgcgggatgacgagagcctcgccagctcaccatcagtcccaagctacatggctgccacaaaatctgctagggccaagtcccgcctccaggggtcaccactgatcgatagtgcagagacgacaccagagaaaggaggctctgttagtgttgggtcgagccaagaagaggctcgtccttccca

SEQ ID NO: 1374 - DNA, 2098 bp, Brachypodium distachyon
cccagctgctgccttcctgtcagtccttggctccagctaaaaattctcagctcctccctcctccatccaacctccggcaccaccacctcccacatgattgcatcctccttccctggaacaattcagctgtcctctcaccaccacgccaacctgacaccttcctgaagatccatttggcggtgacttccgcagtaaagttgcctctcttttgtgttctcgtcgcggcatccccgtgggacagatctgggagggcagtttgagccgcagatctgaacggtgaccgtttttcttggccgaggattttggggccatgggcaagaaggggaagtggtttggcgccgtcaagaaggtgttcagccctgtttccaaggagaagaaggaggagaaactcaggaggaaatttgctgcaagcgactcgaatccaccagatctaacaccttcaacttccttggaagtcaatgtctcggcactgcctcctcctcctcctgctgttccatcttctcaccaaactgaggaggttaatgtccctgaagctgagcaggagcaggagcagagcaagcatgttactgtggaggcagcccctgctgcccccgcacagtcatcatcggtattgccacctggggatgagctcgccgcaatcaagatccagaccgccttccgtggttacctggcaaggagggcattacgagccttgcgaggccttgttagattgaagtcattggtcgagggaaattctgttaaacgccaagctgcaagcactctgcggtgtatgcaaactctggcgcgggtgcagtcacagatacgttcaagaaggctgaagatgtcagaggagaaccaggcactccagcgccagctcctgctgaaacaggaattggacagtttgaggatgggggagcactgggatgacagcactcaatccaaggagaagattgaggcaagtctggtaagcaggcaagaggctgcaatcagaagagagagagcgctcgcatatgcattttcccatcagtggaagagcagttcaaggtcctccaacccaatgtttgtagacccaaacaacccacactggggctggagctggttggagcgctggatggcagcaaagccttgggagggtcgcactgggaatgacaaggaaagcaacattgaccgcggatcagtgaagagcataagtttgaaccttggagaaggtgagatcacaaaagccttcaatcgccgaggctcctccaagccagacaagtcatcaccgacgactccaaagctgactcgcccaacctcccggctatccccttcaacaccctctgccaaagtgacaccaataatcgtgaagaagaaatctgccacaccaaagaatgggctttcgcaggtggacgacgacgcgaggagtgtgctcagcgtgcagtccgagcgaccaaggaggcacagcatagccacctctacagtgcgggacgatgagagccttgtaagctccccatcagtcccgagctacatggctgccacacaatctgcaagggccaagtcccgcctccagggctcaccgctgactgaaagtgcagagatcccggagaaagtagtgtctgttgggtcggccaagaagaggctgtcattcccagccggaagtgcgtctcctgcgccaacgaggcggcactccggccctccaaaggtggagaacctggtgaaggacatcgccgagacaccacagccagtggccttggcggtcaacggcggcaacaagtgattcatacaacaagtggcaatccgttatcctctgatagtggaacccggtcgaaagatcgtaaggaaaaaaaatacaacaactggcaagaggagccatggattatgcagatatacatatttcatccatgaacaaagtttggagttacatcagatgtatggattattggcatttattattattttgtcttcatccagttatgtctacattgtttgctgtaggagaagattctcagggccgtttgtcggttcatttcatttatgactcagtgtaaaagcagtttcagtttgtcaccgggacctttggtgcttgtatgtaaacaggtcttctatttatgcgagcaatatatttcttccatgtcttctg

SEQ ID NO: 1375 - DNA, 2109 bp, Brachypodium distachyon
ctcttgtcactcccagctgctgccttcctgtcagtccttggctccagctaaaaattctcagctcctccctcctccatccaacctccggcaccaccacctcccacatgattgcatcctccttccctggaacaattcagctgtcctctcaccaccacgccaacctgacaccttcctgaagatccatttggcggtgacttccgcagtaaagttgcctctcttttgtgttctcgtcgcggcatccccgtgggacagatctgggagggcagtttgagccgcagatctgaacggtgaccgtttttcttggccgaggattttggggccatgggcaagaaggggaagtggtttggcgccgtcaagaaggtgttcagccctgtttccaaggagaagaaggaggagaaactcaggaggaaatttgctgcaagcgactcgaatccaccagatctaacaccttcaacttccttggaagtcaatgtctcggcactgcctcctcctcctcctgctgttccatcttctcaccaaactgaggaggttaatgtccctgaagctgagcaggagcaggagcagagcaagcatgttactgtggaggcagcccctgctgcccccgcacagtcatcatcggtattgccacctggggatgagctcgccgcaatcaagatccagaccgccttccgtggttacctggcaaggagggcattacgagccttgcgaggccttgttagattgaagtcattggtcgagggaaattctgttaaacgccaagctgcaagcactctgcggtgtatgcaaactctggcgcgggtgcagtcacagatacgttcaagaaggctgaagatgtcagaggagaaccaggcactccagcgccagctcctgctgaaacaggaattggacagtttgaggatgggggagcactgggatgacagcactcaatccaaggagaagattgaggcaagtctggtaagcaggcaagaggctgcaatcagaagagagagagcgctcgcatatgcattttcccatcagtggaagagcagttcaaggtcctccaacccaatgtttgtagacccaaacaacccacactggggctggagctggttggagcgctggatggcagcaaagccttgggagggtcgcactgggaatgacaaggaaagcaacattgaccgcggatcagtgaagagcataagtttgaaccttggagaaggtgagatcacaaaagccttcaatcgccgaggctcctccaagccagacaagtcatcaccgacgactccaaagctgactcgcccaacctcccggctatccccttcaacaccctctgccaaagtgacaccaataatcgtgaagaagaaatctgccacaccaaagaatgggctttcgcaggtggacgacgacgcgaggagtgtgctcagcgtgcagtccgagcgaccaaggaggcacagcatagccacctctacagtgcgggacgatgagagccttgtaagctccccatcagtcccgagctacatggctgccacacaatctgcaagggccaagtcccgcctccagggctcaccgctgactgaaagtgcagagatcccggagaaagtagtgtctgttgggtcggccaagaagaggctgtcattcccagccggaagtgcgtctcctgcgccaacgaggcggcactccggccctccaaaggtggagaacctggtgaaggacatcgccgagacaccacagccagtggccttggcggtcaacggcggcaacaagtgattcatacaacaagtggcaatccgttatcctctgatagtggaacccggtcgaaagatcgtaaggaaaaaaaatacaacaactggcaagaggagccatggattatgcagatatacatatttcatccatgaacaaagtttggagttacatcagatgtatggattattggcatttattattattttgtcttcatccagttatgtctacattgtttgctgtaggagaagattctcagggccgtttgtcggttcatttcatttatgactcagtgtaaaagcagtttcagtttgtcaccgggacctttggtgcttgtatgtaaacaggtcttctatttatgcgagcaatatatttcttccatgtcttctg

SEQ ID NO: 1376 - DNA, 1805 bp, Avena sativa
ctatttcctccaccttgcttctgcaggaagatcctggctttggtggttcctgtcctgcggcggcagtaaagaccgctgcatcctcctcctcctcctgctttgttgattgactgtttcttggcggaggactcggggccatggggaagaagggcaagtggctgggcgccgtcaagaaggtcttcagccccgaatccaaggagaagaaggaggagaaactgaggaagaaactggctgcaagcgacccaaacccaacggatctaaccccgtctacttcactggaagtcgatgtctccatgccgccgcctctagctcctcgccaaatcgaggatttcaaggtccctgaacctgagcaggagcagagcaagcatgttactgtcgaggcagccccggattctcctacacagacgtcgtcgatgttgccacctggtgtatcgagggaagaggtcgctgcaatcaagatccagaccgccttccgcggttacctggcaagaagagcattacgagccttacgaggccttgttagattgaagtcattggtcgagggtaattcagttaagcgtcaagctgccagcactctgcgctgtatgcagactctagcgcgggtgcagtcacaaatacgtgcaagaaggctgaaaatgtctgaggagaaccaagccctgcagcgccagctcctgctgaaacaggaattggagagtttgaggatgggggagcactgggatgacagcactcaatccaaggagaagatcgaggcaagtctagtaaacaagcaagaggctgcgattagaagggagagagcactcgcatacgcattttcccatcagtggaagagcagttcgaggtcctccaacccaatgtttgtagacccaaacaacccacactggggctggagctggttggagcgctggatggcagcaaagccttcggaaggtggccgcacagggactaccaaggaaagcaacggtgaccaggtatctgtgaagagcttaagtctgaaccttggagagggtgagatcacaaaagccttcaaaagtcggagcatcaagccagacaagtcgtcgccgacgactccaaagctggcccgcccagcctcccggctatccccatcaacgccctctgccaaagtaacaccaatcgttgtgaagaagaaacccgctacaccaaagaacgggctctcgcaggtggatgacgacgcgaggagtgtgctcagtgtgcagtcagagcgaccaaggcggcacagtatagccacctcaacggtgcgggacgacgagagcctcgcaagctctccatcagtgccaagctacatggctgccacaaaatccgcaagggccaagtcccgcctgcaggggtcgccatcgatcgatgccgcagagacaacaccagagaaagtagcctctgttgggtctgtcaagaagaggctgtctttcccagctggtgcggcgtcgccgatgaggcggcattctggtcctcccaaggtggagattctggtgaaggacattgctgagacaccacagccagaggccctggcgatcagcggttgaaacacgtaactatacaggtggcaacagggggctatggttatgcagatacacaaacttcacccatgaacaaaggttaaagttctatcagatgtatgaatcattggcatttttctctcatccagttatgatggctacattgttggactcattaggagaagattctcagtgtctctacgttcatttcatttgttgcttgtgtaaaactatatgggtttatcatcggaatctttgatgtcgatgtttgtatgtatgaggtcttatatttat

SEQ ID NO: 1377 - DNA, 1629 bp, Avena sativa
caccgcaccggaggagagcctatttcctccacctttgcttctgcaggaagatcctggctttggtggttcctgtcctgctgcgccagtaaagaccgctgcatcctcctcctgctttgttgactgactgtttcttggcggagggctcggggccatggggaagaagggcaagtggctgggcgccgtcaagaaggtcttcagccccgaatccaaggagaagaaggaggagaaactgaggaagaaattggctgcaagcgacccaaacccaacggatctaaccccgtctacttcactggaagtcgatgtctcgattccgccgcctccagctcctcgccaaatcgaggatttcaaggtccctgaacctgagcaggagcagagcaagcatgttactgtcgaggcagccccggattctcctacacatacgtcgtcgatgttgccacctggtgtatcgagggaagaggtcgctgcaatcaagatccagaccgccttccgcggttacctggcaagaagagcattacgagccttgcgaggccttgttagattgaagtcattggttgagggtaattcagttaagcgtcaagctgccagcactctgcgctgtatgcagactctagcgcgggtgcagtcgcagatacgtgcaagaaggctgaaaatgtctgaggagaaccaagccctccagcgccagctcctgctgaaacaggaattggagagtttgaggatgggggagcactgggatgacagcactcaatccaaggagaagattgaggcaagtctagtaagcaagcaagaggctgcgattagaagggagagagcactcgcatatgcattttcccatcagtggaagagcagttcaaggtcctccaacccaatgtttgtagacccaaacaacccacactggggctggagctggttggagcgctggatggcagcaaagccttcggaaggtggccgcacagggactaccaaggaaagcaacggtgaccaggtatctgtgaagagcataagtttgaaccttggagagggtgagatcacaaaagccttcaaaagtcggagcatcaagccagacaagtcgtcgccgacgactccaaagctggcccgcccagcctcccggctatccccatcaacgccctctgccaaagtaacaccaatcgttgtgaagaagaaacccgctacaccaaagaacgggctctcgcaggtggatgacgacacgaggagtgtgctcagtgtgcagtcagagcgaccaaggcggcacagtatagccacctcaactgtgcgggacgacgagagcctcgcaagctctccatcagtgccaagctacatggctgccacaaaatccgcaagggccaagtcccgcctgcaggggtcgccatcgatcgatgccggagagacaacaccagagaaagtagcctctgttggatctgtcaagaagaggctgtcttttccagctggtgcggcgtcgccgatgaggcggcattctggtcctcccaaggtggagattctggtgaaggacattgctgagacaccacagccagaggccctggcgatcagcggttgaaacacgtaactatacaggtggcaacagggggctatggttatgcagatacacaaacttcacccatgaacaaaggttaa

SEQ ID NO: 1378 - DNA, 1873 bp, Avena sativa
tgctgcggcagtaaagactgctgcatcctcctcctcccacttcgtgtatgtatgtgcgcttgccttctcgttgcggcatcctattccgtccgtagatagatctggggagagagttctgtctgggcagcagcagatctgatcggtgtgtgtgtttcttcctcgtcagtgattgactgtttcttggcggaggtctcggggccatggggaagaagggcaagtggctgggcgccgtcaagaaggtcttcagccccgaatccaaggagaagaaggaggagaaactgaggaagaaattggctgcaagcgacccgatcccaacggatctaaccccgtctacttcattggaagtcgatgcctcgattccgccgcctccagctcctcgccaaatcgaggatttcaaggtccctgaacctgagcaggagcagagcaagcatgttactgtcgaggcagccccggattctcctacacatacgtcgtcgatgttgccacctggtgtatcgagggaagaggtcgctgcaatcaagatccagaccgccttccgcggttacctggcaagaagagcattacgagccttgcgaggccttgttagattgaagtcattggtcgagggtaattcagttaagcgtcaagctgccagcactctgcgctgtatgcagactctagcacgggtgcagtcgcagatacgtgcaagacggctgaaaatgtctgaggagaaccaagccctccagcgccagctcctgctgaaacaggaattggagagtttgaggatgggggagcactgggatgacagcactcaatccaaggagaagattgaggcaagtctagtaagcaagcaagaggctgcgattagaagggagagagcactcgcatatgcattttcccatcagtggaagagcagttcgaggtcctccaacccaatgtttgtagacccaaacaacccacactggggctggagctggttggagcgctggatggcagcaaagccttctgaaggtggccgaacagggactgccaaggaaagcaacggtgaccaggtatctgtgaagagcttaagtctgaaccttggagagggtgagatcacaaaagccttcaaaagtcggagcatcaagccggacaagtcatcaccgacgactccgaagctgacccgcccggcctcccggctatccccttcaacgccctctgccaaagtaacaccaatcgttgtgaagaagaaacccgctacaccaaagaacgggctctcgcaggtggatgacgacgcgaggagtgtgctcagtgtgcagtccgagcgaccaaggcggcacagtatagccacctcaacggtgcaggacgacgagagcctcgcaagctctccatcactcccaagctacatggctgccacaaaatctgcaagggccaagtcccgcctgcaggggtctccatcgatcgatgctgcagagacaacaccagagaaagtagccgctgttgggtctgtcaagaagaggctgtccttcccagctggtgtggcgtctccgatgaggcggcattctggtcctcccaaggtggagagtgtggtgaaggacattgctgagacactacagccagaggccctggcgatcagcggttgaaacaagtaactatacaggtggcaacagggggctatggttatgcagatacacaaacttcacccatgagcaaaggttaaagttctatcagatgtatgaatcattggcatttttctctcatccagttatgatggctacattgttggcctcattaggagaagattctcagtgtttgtccgttcattccatttgttgcttgtgaaaactatatatgggttttgtcatcggaacgtttgatgtcgatgtctgtatgtatgaggtcttatatttatgcg

SEQ ID NO: 1379 - DNA, 1439 bp, Avena sativa
caagtggctgggcgccgtcaagaaggtcttcagccccgaatccaaggagaagaaggaggagaaactgaggaagaaattggcggcaagcgacccaaacccaacggatctaaccccgtctacttcattggaagtcgatgcctcgattccgccgcctccagctcctcgccaaatcgaggatttcaaggtccctgaagctgagcaggaacagagcaagcatgttactgttgaggcagcccctgattcccctgcacagatgtcgtcgatgttgccacctggtgtatcgagggaagaggtcgctgcaatcaagatccagaccgccttccgcggttacctggcaagaagagcattacgagccttgcgaggccttgttagattgaagtcattggtcgagggtaattcagttaagcgtcaagctgccagcactctgcgctgtatgcagactctagcacgggtgcagtcgcagatacgttcaagaaggctgaagatgtctgaggagaaccaagccctccagcgccagctcctgctgaaacaggaattggacagtttgaggatgggggagcactgggatgacaccactcaatccaaggagaagattgaggcaagtctagtaagcaggcaagaggctgcgataagaagagagagagcgctcgcatacgcgttttcccatcagtggaagagcagttcaaggtcctccaacccaatgtttgtagacccaaacaacccacactggggctggagctggctggagcgctggatggcagcaaagccttctgaaggtggccgaacagggactgccaaggaaagcaacggtgaccaggtatctgtgaagagcttaagtctgaaccttggagagggtgagatcacaaaagccttcaaaagtcggagcatcaagccagacaagtcgtcaccgacgactccaaagctggcccgcccggcctcccggctatccccttcaatgccctctgccaaagtaacaccgatcgttgtaaagaagaaacccgctacaccaaagaatgggctctcgcaggtggatgacgacgcgaggagtgtgctcagtgtgcagtcagagcgaccaaggcggcacagtatagccacctcaacggtgcaggacgacgagagcctcgcaagctctccatcagtgccaagctacatggctgccacaaaatccgcaagggccaagtcccgcctgcaggggtctccatcgatcgatgctgcagagacaacaccagagaaagtagccgctgttgggtctgtcaagaagaggctgtccttcccagctggtgtggcgtctccgatgaggcggcattctggtcctcccaaggtggagagtgtggtgaaggacattgctgagacactacagccagaggccctggcgatcagcggttgaaacacgtaactatacatgtggcaacagggggctatggttatgcagatacaca

SEQ ID NO: 1380 - DNA, 1809 bp, Festuca arundinacea
tttctttggtgcttcctgcagcagtcgtccatcctcctttgcgcctttcttgattagttttcttggccaagaattcggggccggccatggggaagaagggcaagtggctcggcgccgtcaagaaggtgttcagccctgaatccaaagagaagaaggaggagaaactgaggaagaaattggctgcaagcgacccaactccaacagatctaaccccttctacttccttggaagtcaatgtctcgatgccgccaccgcctcctgctcttccagttcctcgccaaactgaggatttcaaggtccctgaagcggagcaggagcagagcaagcatgttactgttgaggcagcccctgaagctcctgcgcagatgtcgtcggtattgccacctggcgtatcaagcgaagagctctcggcaatcaagatccagaccgccttccgtggttatctggcaagaagagcattacgagccttgcgaggccttgttagattgaggttattggtcgatggtaattcagttaagcgtcaagctgcaagcactctgcgctgtatgcagactctagctcgggtgcagtcacagatacgttcaagaaggctgaagatgtctgaggagaaccaggcccttcagcgccagctcctgctgaaacaggaactggagagtttgaggatggggagcactggaatgacagcacccaatccaaggagaagattgaggcaagtctagtaagcaaacaagaggctgcaattagaagagagagagcactcgcatatgcattttcccatcagtggaagagcacttcaaggtcctccaacccaatgtttgtagacccaaacaacccacactggggctggagctggttggagcgctggatggcagcaaagccttcggacggtggccgcactgggactaacaaggaaagcaacggtgaccaaatatctgtgaagagcataagtttgaaccttggagagggtgagataacaaaagccttcaaaagtcggagcatcaagccagacaagtcatcaccgacgactccaaagctgatccgcccagcctcccggctatccccttcatcaccctctgccaaagtaacacccattgttgagaagaagaaacctgctacaccaaagaacaggcttcagcaggtggatgacgatgcgaggagcgtgctcagtgtgcagtccgagcgaccaaggcggcacagtatagccaccacaacggcacgggacgacgagagcctcgcaagctctccatcagtcccaagctacatggctgccacaaaatccgcaagggccaagtcccgcctgcaagggtcgccactgatcgatgctgcagagacaccagagaaaggaagccctgttgcatctgtcaagaagaggctgtcctacccagctggttcggcgtctccgtcgccaatgaggcggcattctggtcctcccaaggtggagagtgtggtgaaggacattcccgaggcaccacagccagaggccctggcgatcaatggctgaaacaagtaaacacatacaagtggcaagagggttatgcagatatacagattccacccatgaacaaaggtttaaagttcaatcagatgtatggattattggcatttttcttttgtccggttatgatggctgcattgttggcttcattaggagaagattctcggtgtctgtcaattcattccatttgttgcttgtgtaaaactatatgggcttgtcacaggaacctttgatgctgatgtttgatgtaagaggtcttatatttatgcgagcgatatatttcttccatgccttgtaaaaaaaaaaaaaaaaaa

SEQ ID NO: 1381 - DNA, 2183 bp, Oryza sativa
gctgtccacagtcctcttcccactgatgagagagagttgcaagaatttgcaagaagcaccaagaaagtgtacccaaagaagcatcttcagctgctctcaccagtcaccactcccatccaagagatcccagcagcttagagcctctactacaacagcttccaacatccaagaacccatttttttcctttcctcctcctcctcctgctctggctggctctgggctggccgtgccctcctgtcagtcctagctccagctagaatccctccttgttcatccaccaccaccatccacatgattgcatttgtgcagattcctggagaattaagctgtcctctcatgccgatctgacacaccttgttgttgttgttgctgctggttgccgcacaaccgaaaggggggattatttggccctctttctctttcctttcgcaggaagatttggtgattcttcttctgagggctcctctaaggatttgggaggatggggaagaaggggaagtggtttggagctgtcaagaaggtgttcagccctgaatccaaggagaagaaggaggagagactgaggagaaaattagcagctagtaacccgaacccgccagatctaaccccttcggcttctctggaagtcaatgtttcggtgccaccccctccacctcctccacctgttcaacagattgaagaggttaaggtccctgaagttgagcaggagcaaagcaaacatgtcactgtggaggctgtacctgaggctgtccccgtacccgcacagacatcgtcattgccacctggtgtatcaagggaagagcaagctgcaatcaagatccagaccgccttccgaggttacctggcaaggagggcattacgagctctgcggggacttgtcagattgaagtcactggttgagggtaactcggttaagcgtcaagctgcaagcactctgcgttgcatgcagactctagcacgggtgcagtcgcagatacgttcaaggaggctgaaaatgtcagaggagaaccaggccctccagcgccagcttctgctgaaacaggagctggagagtttgaggatgggggagcagtgggatgacagcactcagtctaaggaacaaattgaggcgagtcttataagcaggcaagaggctgcagtaagaagggagagggcgctcgcatatgcattttcacatcagtggaagagcacttcaaggtcagtcaacccaatgtttgtagatcctaacaacccacaatggggatggagctggttggaacgctggatggcagcaaagccttgggaggggcgtgccgggaccgacaaggagagcaaccttgaccgtgcatcagcgaagagtgcaagcttgaatcttggagagggtgagatcacaaaagccttcaaccgtaggggatccaagccagacaagtcatcaccaacaactccaaagctgacccgtccagcctcccgtcaatccccttcaactccctctgctaaagtgtcaccgatctttgcaaagaagaaatccgcgacaccgaagaatgggctctcacaggttgatgacgacgcgaagagtgtgttcagtgtccagtctgaacgaccgaggaggcacagtatagccacgtcaaccgtgcgtgacgacgagagcctcgcaagctccccatctgtgccaagctacatggctcccacaaaatctgcaagagctaagttgcgcctccaaggatctgcagtgaccgatggtgcagagacaccaccggagaaagtagcctctgttggttcagtgaagaagaagctgtccttccaagctggaatggcgccgccttctccgatgaggcggcattcgggccctcccaaggtggaggtggtgaaggacattgctgagccaccacagccagaggccttggtgatcaatggtggaagcaagtgactcatatgacaagtaccaggagggagcaatggattctgcagatatatttcatccaatgaacaaaggtttaagattatatatcagctgtatgagttgccggcattgtttttccagttataaccacattatttgctctagcagattcgcaagtaccctgccagtcgattccatttgttgtttctgtaaaactatatcgatttgtcacttgaaacctttggtgtttgtatgtaaacaagtctcttctatttatgtgagccacatatttctttttgtgaa

SEQ ID NO: 1382 - DNA, 2126 bp, Saccharum officinarum
ctcctccccaacatccactgcgggagaggggggcggagaggagcatcggcggcgcatcgcaacactcacgaaggtgccagggtgactgtttcgaggagcgtggagtggcgccatggggaagaagggcaagtggttcggcgccgtcaagaaggtcttcagccctgaatccaaggagaagaaggaggagagactaaggaggaaatcggcagctagcaacccaacaccgctagatctgaccccatctacctccctggaagtcaatgtttcggtgccaccccctccagctccagctcctcctccagttcttcaccaggccgaggaggtgaggatccctgaagccgagcaggagcagagcaagcatgtcaccgtggaggaggcccctgctgccccagcacaggcgtcggtgctgccacctggtgtgccaaccgaagagctcgctgcaatcaagatccagaccgccttccgaggttacctggcaaggagggcactaagagcactgcgaggccttgttcgattgaagtcattggttgagggtaattcagtcaagcgtcaatctgcaagcactctgcgctgtatgcaaaccctatcacgggtgcagtcacaaatacgttccaggagagcaaagatgtccgaggagaaccaggccctccaacgtcagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacatcaaaatctgtcaacccaatgtttgtagacccaaacaacttgcagtggggctggagctggttggagcgctggatggcagcaaaaccttgggagggccgcaatggggctgacaaggagagcaacattgaccgtggatccgttaagagtatgagcttgaaccttggagagggtgaaatcacaaaagctttcaaccgccgggactcaaagccagaaaaaccatcaccaccaactccaaaaccgacccgtccagcctccaggcaatccccttcgacaccatctgctaaagtggcaccaatacctgccaggaggaaatccgccacgccaaagaatggtctttcacaggtggacgatgacgctaggagtgtgctcagcgtgcagtctgagcgaccaaggaggcacagtatagccacctcgactgtgcgggacgatgaaagcctcgcaagctccccatcactcccaagctacatggttcccacggaatctgcaagagccaaatctcgcctccagggctcagcaatgaccaatggcgcagagacaccggagaaaggaggctctactggaccggtcaagaagaggttgtccttccaaggtggaactgcggctgcctcaccaatgcggcggcattctggtcctcccaaggtggagagtgcagtgaaggacattgttgcgccaccgcagccagaggccttggtagtcaatggtggaagcaagtgactcatatgacaagtaccaggaggggaagcggattatgaagatatgtttcatccgtgaacagaagtttaaaagagatatcagatctatgaatgatttgaattgttttcctgttacgatcacattgtttgctatataagattcacagtgcctgtcagttgattccatttgttgtttctgtaaaacaaatatcaatttgtcactagaatatgtggtgtttgtatgtaaacaggtcctctatttatgtgagccatatacttctttttctgatgcctggggtctacgcaacaaggaaagggtggaccatgcatgcttagtgcaaaaaaaaaaaaaaaaaaagggcggaaggggtggacgatccaaagttaccaacgtctcgatgccgtgaaggtaactatattattctgtcatgtaggatgccgtaagctagcccactgggccgcggtgttaaaacatgagagaatggtagacccgtcgccgcttaacaagttattggcatgcccgactatccccattctgccgtcgagcggaagaggaacaatagcctgcgccgttcgcattatttaaaaattgctgaatggtaaagtgggaa

SEQ ID NO: 1383 - DNA, 995 bp, Pseudoroegneria spicata
ggccgcccccgaaaaggaaagaagaaggcggcggaaggcaaggcagggcagccgagggagataaattactccaccgcggccactcgccccctctccttgccccccggcagcagccagcagtcttctctcccaaatcctcgcggaggaggaggaggccgtcggcggcggccatggaggaggagaaggggttccagccccatctgatgggcggcgggaggatgaggggcgcggcgggggcgatgggcctgcagaagcagaactcgtggtcgcccgacatcgagcgggacgaggcgtgggagcggcggcggcgcgggatactgggcagggggcgccgctcgccgctgcagcgcgcgcagagcgtcacggacgaccagctcgacgagctgcgcggctccctcgatctgggcttccggttcgagccgccctcgcagcgctgcgcggcctgcgacgccgggaggagccgcctcgtcgagacgctcccggcgctcgacctcctctacgccgtcgccgccaacgccaacgccggcgccgggggctgcgcggccagccagtgctcctgcggcgcctcctcggaggcctccgagccgtcgccgatcgggagccccctctccatactctctccagatgacccgccggagacggtgaagatgaggctgaagcagtgggcgcaggtggtggcgctgtccctgcgcagccgttcctgaaccaaccagccatgaaacccggggacgaacgtgaaagctataccgaattcagaggagggacaaccagcgacgcagaagaaaagaatcatccatccctccctgcctcgagaagaaccaaccaatgatgagcaagcaacgagaagagaatctattgtcgtcggacgatcggccagccgccttccacatctgctctcgcatcttggactagctagcttagcctgctactaatcaactttctgtcacatgtttatcgttgagcaattcgaaaagcatactccgtaattcgcgtca

SEQ ID NO: 1384 - DNA, 1220 bp, Triticum aestivum
ggaggaggccggcggccatggaagaggagaggaaggggttccagccccatctgatgggcctgggcggcgggggcaggctgaggggcgcggcgggggcgatgggcctgcagaagcagaactcgtggtcgcccgacatcgagcgcgacgaggcgtgggagcggcggcggcgcgggattctcggccggggccgccgctcgccgctgcagcgcgcgcagagcgtcaccgacgaccagctcgacgagctgcgcggctccctcgatctgggcttccgcttcgacccgccctcgcagcgctgcgccgcctgcgacgccggcaggagccgcctcgtcgagacgctcccggcgctcgacctcctctacgccgtcgccgccaacgccaacgccgggggctgcgctgcgggccagcaccagtgctcctgcggcgcctcctcggaggcctccgagccgtcgcccatcgggagccccctctccatactctccccagatgacccgccggagacggtgaagatgaggctgaagcagtgggcgcaggtggtggcgctgtccatgcgcagccgttcctgaaccaaccagccatgaaacaccaacgtgaaagctataccgaattcagaggagggacaaccagcgacgcagaagaaaagaatcaaccatccctccctgcctcgagatcgaagtaccaatgatgagcaagcaaccaacgagaagagaatctagtgtcgtcggacgatcggccagccgccttccacatctgctctcgcatcgcatcttggactagctatagcttagcctgctgctactaatcgactttctgtcacatgtttatcgttgagcaactcgaaaatcatactccgtaattcgcgttacttctgttaattagtttctcctcccccctaatattcagtcgcggaggcattgcttccgttagtagtcacctcccctgatttcgtagtaataatttcgacatccctgtacattggcgcatcaccaccatcaatcatcagcaggtagattagattaattttaattcgcgttcctggaattgataataaactgttggctggtagcagttgttgttgcttcttcctcttgcaaaataatcgatgggcgatggatgctgccattgggtttgctcaccaaatcaatcccccctcatgtcattggccacccgatcaagcaacaacaatctgaagcagctcgccgatcctttgcctcatctgacga

SEQ ID NO: 1385 - DNA, 1244 bp, Triticum aestivum
cccggccactcgcccccggcagcggccagcggtcctcctcgcccccatccaaatcccacgccgtccccctcgcggaggaggccggcggccatggaggaggagaggaaggggttccagccccacctgatgggcctgggcggcgggagcaggctgaggggcgcggcgggggcgatgggcctgcagaagcagaactcgtggtcgcccgacatcgagcgggacgaggcgtgggagcggcggcggcgcgggattctcggcaggggccgccgctcgccgctgcagcgcgcgcagagcgtcaccgacgaccagctcgacgagctgcgcggctccctcgatctgggcttccgcttcgacccgccctcgcagcgctgcgccgcctgcgacgccggcaggagccgcctcgtcgagacgctcccggcgctcgacctcctctacgccgtcgccgccaacgccaacgccgggggctgcgccggcgcggccagtcaccagtgctcctgcggcgcctcctcggaggcctccgagccgtcgcccatcgggagccccctctccatactctccccagatgacccgccggagacggtgaagatgaggctgaagcagtgggcgcaggtggtggcgctgtccatgcgcagccgctcctgaaccaaaccacccagccatgaaacgccaacgtgaaagccataccgaattcagaggagggacaacaaccagcagacgcagaagaaaagaatcatccccccatccctgcctcgagatcgaagaagcaaccaatgatgatgagcaagcaagcaacgagaagagaatctaccaggtgtcgtcgggcgatcggccggccgccttccacatctgctctcgcatcgcatcttggactagctatagctttagcctgctgctgctaatcgactttgtgtcacatgtttatcgttgagcaattcgaaactatactccgtaatccgcactccccctgttataattagctcctcctcccctcccctccgctgatcttcagccgcggcggcattgcttccgttagtagtcacctcccctgatttcgtagcagtaataatttactttcgacatctctgtacattgcgcatcatcgccaccaatcatcagcaggtagattagattaatttcaattcgcgttcgtggaattgataataaactgttgcctggtagcagttgctgttgcttcttcctcgtgcaaaataatcgatgtgcgattcatgccgccatcgggtttgctc

SEQ ID NO: 1386 - DNA, 1186 bp, Secale cereale
aggccgagggagagataaattactccaccgcggccactgccccctctcctgcccccagcagcagccagcagcctcctcttccgaatcgggggaggccggcggcggccatggaggaggagaaggggttccagccccatctgatgggcggcctgggcggcgggaggatgaggggcgcgcgggggcgatgggcctgcagaagcagaactcgtggtcgcccgacatcgagcgggacgaggcgtgggagcggcggcggcgcgggatactggccaggggccgccgctcgccgctgcagcgcgcgcagagcgtcaccgacgaccagctcgacgagctgcgcggctccctcgatctgggcttccgcttcgagccgccctcgcagcgctgcgccgcctgcgacgccggcaggagccgcctcgtccagacgctcccggcgctcgacctcctctacgccgtctccgccaacgccaacgccaccgccaccgcctccgcggccaaccagtgctcctgcggcgcctcctcggaggcctccgagccgtcgccgatcgggagccccctctccatactctccccagatgacccgccggagacggtgaagatgaggctgaagcagtgggcgcaggtggtggcgctgtcgctgcgcagccgttcctgaaccaaccagccaacgaagaacaacaacccgtggaacgtggacaccataccgaattcggagggagggagggacaaccaatttctccgcacaagaaaagaaccatccatccctccctgcctcgagaagaagaagcaaccagtgattgatgagcaagcaagcaacgagaagagaatccagtgtcgtcgggcgatcggccagccgccttccgcatctggcccgctctcgcatcttggactagcttagctagctactgctgctactaatcgactttctgtcacatgtttatcgttgagcaattcgaaaccatactccgtaattcgcgttgcctctgttataattagtttctcctccccccctcccgtaataatctctagtcgtcgcattgcttccgttagtagtagtcacctcccctgatttcgtagtgataatttcgacatccctgtacattgccgcatcatcaccatcaatcatcagcaggtggtaggttaattccaatttgcgttccggaatagataataaaactgttggctggtagca

SEQ ID NO: 1387 - DNA, 873 bp, Secale cereale
ggcggcggccatggaggaggagaaggggttccagccccaccatctgatgggcggcctgggcggcgcgaggatgaggggcgcggcgggggcgatgggcctgcagaagcagaactcgtggtcgcccgacatcgagcgggacgaggcgtgggagcggcggcggcgcgggatactggccaggggccgccgctcgccgctgcagcgcgcgcagagcgtcaccgacgaccagctcgacgagctgcgcggctccctcgatctgggcttccgcttcgagccgccctcgcagcgctgcgccgcctgcgacgccggcaggagccgcctcgtccagacgctcccggcgctcgacctcctctacgccgtctccgccaacgccaccgccaccgccaacgcctccgcggccagccagtgctcctgcggcgcctcctcggaggcctccgagccgtcgccgatcgggagccccctctccatactctccccagatgacccgccggagacggtgaagatgaggctgaagcagtgggcgcaggtggtggcgctgtcgctgcgcagccgttcctgaaccacccagccaagaacaacaacagcccgtggaacgtggataccataccgaattcggagggagggagggacaaccaatttctccgcacaagaaaagaatcatccctccctccctccctccctgcctcgagaagaagaagcaaccgatgattgatgagcaagcaagcaacgagaagagaatctagtgtcgtcgggcgatcggccagccgccttccgcatctgggccgctctcgcatcttggactagcttagctagctgctgctgctactaatcgactttctgtcacatgtttatcgttgagcaattcgaaaccatact

SEQ ID NO: 1388 - DNA, 1033 bp, Leymus cinereus x Leymus triticoides
gcctccaaatcccccgccccccctcagaagaggaggccggcggcagccatggagaacgggttccagccccatctgatgggcggcggcaagatgaggggcgcggcgggggcgatggggctgcagaagcagaactcgtggtcgcccgacatcgagcgggacgaggcgtgggagcggcggcggcgcgggatgatgcacaggggacgctcgcagctgcagcgcgcgcagagcgtcacggacgaccagctcgacgagctgcgcggctccctcgatctgggcttcaggttcgagccgccctcgcagggctgcgcggcctgcggcgccggcaggagccgcctcgtcgagacgctcccggcgctcgacctcctctacgccgtcgccggcgagggctgcgcggcgaggcagtgctcctgcggcgcctcgtcggaggcctccgagccgtcgccgatcgggagccccctctccatactctctccagatgacccgccggagacggtgaagatgaggctgaagcagtgggcgcaggtggtggcgctgtccctgcgcagccgttcctgaaccaaccaaccatgaacgccaacgtggatgccataccgaattcggaggagggacaaccaaggacgcagaagaaaataatcatccctcgctccctcgagaagaaccaagcaatgatgagcaagaaacgagaaaagaatcagtgtcgtcggatgatcggccagccgccttccacatctgctctcgcatcttggactagctagcttagaggtgctactaatcaactttctgtcacatgtttatcgttgagcaatttcgaaatcatactccgcaattcgcgttacctctgttattactatttagtttctcctccccccctaatctttagtcgtcgcattgcttccgttagttacttcccctaactaatttcgtaatctcgctcgcatccctgtacattgcgcatcaccaatcatcatgatgtagaagattaatttgcgtcccggaataataatgaactgttggctggtagcagttgctgtta

SEQ ID NO: 1389 - DNA, 2420 bp, Brachypodium distachyon
tccctgcttctgctcccatcgctttcccctccgcatccacatcgcctcattccactccagatgcgactccaccaccgcctcctcctcctcctcctcccctagctcgcttgcgccccgccgccaggcggccccctaaatggcgagcgtgtcggaggacgacgccgcctcggagcggtgcagcggcagctacagccccagcgccgacgtcagcggctccgagacctccagcgactgctcagcgcccaccacgacaacccgccgcttccccttctcttcctcctccgcctccgcgtcccgcggcctcgcgtcgtcctccacctccacctcccagctccccaccccctccgctgcattctacctctccaagccggcctccgacctctccgagatcgacatgatgaaggagcgattcgccaagcttctcctcggcgaggacatgtccggcagcggcaagggcgtctgcaccgccctcgccatctccaacgccatcaccaacctctcagcgaccgtgttcggcgagctgtggaggctggagccgctggccccggccaggaaggcaatgtggacgcgggagatggagtggttgctctccgttgccgactccattgtagagctcaccccgtcgatccaggagctccctgacggcggcggacagtttgaggttatggtgccgcggccacggagtgacctctacatgaacctcccggcgcttaagaagcttgatgccatgctcctcgcgatgaccgatgagttcaaggagactgaattctggtatgttgatagggggattgtggttgaggacagtggtggaccgttcccatcatcgtcgtcctcgtcttcttgtgggcggccttcgtcggtgcggcaggaggaaaagtggtggctgccatgcccacgagtgccgcccaaggggctgcctgaggatgccaggaggaagctgcagcagagcagggattgtgcaaaccagatactaaaggcagccatggcgattaacagtgatgtgcttgctgagatggagatcccggaagcatacttggagacattgccaaagagtggtcgatcttgcttgggtgagataatttatcgatacataactgctgaacaattctcacccgaatgcctcctcgattgcttggatctgtcatctgagcaccatacgctcgaagtagcaaacagaatagaggctgcgatccatgtttggagactaaaaggccaaaagaaatcttcacctcaagcaaaatcaaagaaatcttggggtggaaaagtgaagggtcttgttggagatacaaagagtaatgttttgtcccaaagagctgatggtctgttgcagagcttaaggttgcgacaccctggtttgccacaaacttcccttgacatgaacaagatccagtataacaaggatgttggccagtccatacttgaaagttactcaagggttctggagagcttggcatttaacacaatcgcgaggatcgacgatgtgatttatgtggacgatgccacaaagaagtctgctgctgcggagtctgtttcaatcttcaatcgtggcgtaggcatacctgtccagaagaaaatctctccaagcccattctcaattcagcacacaccatatgcctctccttttgctacacccactttctgctcctccactccagttactggcagccccagaagagcacagcctccactaaacaaaatcaatttgcaaggaaaacaggaagttaaagttgagaagctcttttctggtgatctagagaaggtctggacttacgccggaaacctgagcgctaggaaagaggcaggagacgctcctgaaagggattgaagggtactgaagcaagttctgattttcggcatgcctcagcaaagtcaacaggtatcaacagatcctaatctggtcggtagagctagattccccctgtacagaagcaacatcatttttttttgtgcttccttagcctgatccaaggattgtgtaccctactcacaagtaatggagtaacacttatggcatccgaacagctcctagtttcgtctggctgcctctgtcagctgtgttcccttgtccatgtctatactaggatgttgagctcagcagcaagccagcaagtgattgaactccgctgctgctcttttttttgtgtccctgaggaagccaccattggtgttacaatcaactgcgcctgcagtgggatgttgtacggtggccatggattctgatgtctgatagctgtctgtacattcacctaatgaattgatctaacgctagctcttcaagtttttgcctagtattgtcaagtgtgtttatgacaacttatgtactgtcagtggttacttgattcatgcttgacgtactaggacacactccttgtggatcctctatggaaggaaaattataatcaagcgaagtatttagttca

SEQ ID NO: 1390 - DNA, 2419 bp, Brachypodium distachyon
ccctgcttctgctcccatcgctttcccctccgcatccacatcgcctcattccactccagatgcgactccaccaccgcctcctcctcctcctcctcccctagctcgcttgcgccccgccgccaggcggccccctaaatggcgagcgtgtcggaggacgacgccgcctcggagcggtgcagcggcagctacagccccagcgccgacgtcagcggctccgagacctccagcgactgctcagcgcccaccacgacaacccgccgcttccccttctcttcctcctccgcctccgcgtcccgcggcctcgcgtcgtcctccacctccacctcccagctccccaccccctccgctgcattctacctctccaagccggcctccgacctctccgagatcgacatgatgaaggagcgattcgccaagcttctcctcggcgaggacatgtccggcagcggcaagggcgtctgcaccgccctcgccatctccaacgccatcaccaacctctcagcgaccgtgttcggcgagctgtggaggctggagccgctggccccggccaggaaggcaatgtggacgcgggagatggagtggttgctctccgttgccgactccattgtagagctcaccccgtcgatccaggagctccctgacggcggcggacagtttgaggttatggtgccgcggccacggagtgacctctacatgaacctcccggcgcttaagaagcttgatgccatgctcctcgcgatgaccgatgagttcaaggagactgaattctggtatgttgatagggggattgtggttgaggacagtggtggaccgttcccatcatcgtcgtcctcgtcttcttgtgggcggccttcgtcggtgcggcaggaggaaaagtggtggctgccatgcccacgagtgccgcccaaggggctgcctgaggatgccaggaggaagctgcagcagagcagggattgtgcaaaccagatactaaaggcagccatggcgattaacagtgatgtgcttgctgagatggagatcccggaagcatacttggagacattgccaaagagtggtcgatcttgcttgggtgagataatttatcgatacataactgctgaacaattctcacccgaatgcctcctcgattgcttggatctgtcatctgagcaccatacgctcgaagtagcaaacagaatagaggctgcgatccatgtttggagactaaaaggccaaaagaaatcttcacctcaagcaaaatcaaagaaatcttggggtggaaaagtgaagggtcttgttggagatacaaagagtaatgttttgtcccaaagagctgatggtctgttgcagagcttaaggttgcgacaccctggtttgccacaaacttcccttgacatgaacaagatccagtataacaaggatgttggccagtccatacttgaaagttactcaagggttctggagagcttggcatttaacacaatcgcgaggatcgacgatgtgatttatgtggacgatgccacaaagaagtctgctgctgcggagtctgtttcaatcttcaatcgtggcgtaggcatacctgtccagaagaaaatctctccaagcccattctcaattcagcacacaccatatgcctctccttttgctacacccactttctgctcctccactccagttactggcagccccagaagagcacagcctccactaaacaaaatcaatttgcaaggaaaacaggaagttaaagttgagaagctcttttctggtgatctagagaaggtctggacttacgccggaaacctgagcgctaggaaagaggcaggagacgctcctgaaagggattgaagggtactgaagcaagttctgattttcggcatgcctcagcaaagtcaacaggtatcaacagatcctaatctggtcggtagagctagattccccctgtacagaagcaacatcatttttttttgtgcttccttagcctgatccaaggattgtgtaccctactcacaagtaatggagtaacacttatggcatccgaacagctcctagtttcgtctggctgcctctgtcagctgtgttcccttgtccatgtctatactaggatgttgagctcagcagcaagccagcaagtgattgaactccgctgctgctcttttttttgtgtccctgaggaagccaccattggtgttacaatcaactgcgcctgcagtgggatgttgtacggtggccatggattctgatgtctgatagctgtctgtacattcacctaatgaattgatctaacgctagctcttcaagtttttgcctagtattgtcaagtgtgtttatgacaacttatgtactgtcagtggttacttgattcatgcttgacgtactaggacacactccttgtggatcctctatggaaggaaaattataatcaagcgaagtatttagttca

SEQ ID NO: 1391 - DNA, 2256 bp, Setaria italica
agtgagctcgcttcgcttctcctgcagctgtccgctgtgctcccccatcgctttccccttctccctcccccctcacccagatgcgattccgcctccaccaccgccgccgcgcctagccgagccgccgccacccacccccaccccgccgcaatggcgagcgcgtcggaggacgaggccgcctcggaccgctgctgcgggagctacagccccagcgccgacgtcagcgagtccgagacctccagcgactgctccgcgcccactacccgccgcttcgcatcctcctcctccgcatccgccaccgtctcccgcctcgcctcctcgtcctcgtcgctccccacgccggcgtccgccgccgccttctacctctccaagcctgccgccgacctctccgagatcgacatgatgaaggagcggttcgccaagctcctgctcggcgaggacatgtccggcagcggcaagggcgtctgcaccgcgcttgccatctccaacgccatcaccaacctctccgccaccgtgttcggcgagctctggaggctggagccgctcgcgccggcgaggaaggccatgtggacgcgggagatggagtggctgctctccgtcgccgactccatcgtcgagctcaccccctccatccaggagctccctgagggcggcggccagttcgaggtcatggtgccgcgcccgcgcagcgacctctacatgaacctccccgcgctcaagaagctcgacgccatgctcctcgccatgattgacggcttcaaggagacggagttctggtacgttgacagggggattgtggtggaggacagtggggggccgttcccgtcttcctcctcgtcgtcttgcgggcgtccctcggtgcggcaggaggagaagtggtggttgccgtgcccacgagtgccgcccaaagggctgtccgaggatgcgaggaggaagctgcagcagagcagggactgtgcaaaccagatactgaaggcggccatggcgattaacagcgacgtgctcgccgagatggagatcccggaagtatacctggagacattgccaaagagtggtaaatcttgcttgggtgagataatttaccgatatataacagctgaacaattctcaccggaatgcctcctagattgcttggatctgtcatcagagcaccacacactcgaagtagcaaacagaattgaagctgctatccatgtttggagactgaaaggccagaagaagctgacacctcaggcaaaatcgaaaaaatcttggggtggaaaagtcaagggtcttgttggggataaggaaaagagccacttcttatctgaaagggctgatggtttattgcagagtctacgattacgataccctggtcttccacaaacttcccttgacatgaacaagatccaatataataaggatgttggtcagtccattcttgaaagttactcaagggttctggagagcttggcatttaacataattgcaagaatcgatgatgtgatttatgttgatgatgcaacgaagaaatcagctgctgctgagtctgtttctatattcaatcgtggcataggcgtaccagttcagaagagaatctcaccaagcccattctcaatccagaatacaccgtacgcctcgccatttgcaacgcccactttctgctcctccaccccagttacaggcagtcctggaagggcccagcccccattaaacaaaaatagtctaggaaaacaggagatcaaagttgaaaaactattttctggtgatctagagaaggtctggacatatgccggaaacctgagcgctaggaaagacgctggagatgctcccgaaagggactgaaggtgcggcaaaggaaggccgacaggcaacagcagatcctgttatggtcggtagctagatttttcctgtacagaagcagcatgagtcattttttgtgcttttgtagcaagccaatgattgtgtatttctctacttaaaatgaatggatggcatctgatctgaacagaacaacttctagtttcagttgtagtttttttctgggttagctctttgcgttcactcatgtttatattgcaaggcagagttcagcggcaagtgactgaattcctgctcctgctgctagatgctgcctttttgtcgctgaaggtgttgttcaacattaccttcagttgcagtggaatgtaagctgatcttgtattctgatgcctgatactctgctgcctgttagtttttgtaaatgcatctaatgaatttcatctggcccccttcagt

SEQ ID NO: 1392 - DNA, 2243 bp, Setaria italica
cgcttcgcttctcctgcagctgtccgctgtgctcccccatcgctttccccttctccctcccccctcacccagatgcgattccgcctccaccaccgccgccgcgcctagccgagccgccgccacccacccccaccccgccgcaatggcgagcgcgtcggaggacgaggccgcctcggaccgctgctgcgggagctacagccccagcgccgacgtcagcgagtccgagacctccagcgactgctccgcgcccactacccgccgcttcgcatcctcctcctccgcatccgccaccgtctcccgcctcgcctcctcgtcctcgtcgctccccacgccggcgtccgccgccgccttctacctctccaagcctgccgccgacctctccgagatcgacatgatgaaggagcggttcgccaagctcctgctcggcgaggacatgtccggcagcggcaagggcgtctgcaccgcgcttgccatctccaacgccatcaccaacctctccgccaccgtgttcggcgagctctggaggctggagccgctcgcgccggcgaggaaggccatgtggacgcgggagatggagtggctgctctccgtcgccgactccatcgtcgagctcaccccctccatccaggagctccctgagggcggcggccagttcgaggtcatggtgccgcgcccgcgcagcgacctctacatgaacctccccgcgctcaagaagctcgacgccatgctcctcgccatgattgacggcttcaaggagacggagttctggtacgttgacagggggattgtggtggaggacagtggggggccgttcccgtcttcctcctcgtcgtcttgcgggcgtccctcggtgcggcaggaggagaagtggtggttgccgtgcccacgagtgccgcccaaagggctgtccgaggatgcgaggaggaagctgcagcagagcagggactgtgcaaaccagatactgaaggcggccatggcgattaacagcgacgtgctcgccgagatggagatcccggaagtatacctggagacattgccaaagagtggtaaatcttgcttgggtgagataatttaccgatatataacagctgaacaattctcaccggaatgcctcctagattgcttggatctgtcatcagagcaccacacactcgaagtagcaaacagaattgaagctgctatccatgtttggagactgaaaggccagaagaagctgacacctcaggcaaaatcgaaaaaatcttggggtggaaaagtcaagggtcttgttggggataaggaaaagagccacttcttatctgaaagggctgatggtttattgcagagtctacgattacgataccctggtcttccacaaacttcccttgacatgaacaagatccaatataataaggatgttggtcagtccattcttgaaagttactcaagggttctggagagcttggcatttaacataattgcaagaatcgatgatgtgatttatgttgatgatgcaacgaagaaatcagctgctgctgagtctgtttctatattcaatcgtggcataggcgtaccagttcagaagagaatctcaccaagcccattctcaatccagaatacaccgtacgcctcgccatttgcaacgcccactttctgctcctccaccccagttacaggcagtcctggaagggcccagcccccattaaacaaaaatagtctaggaaaacaggagatcaaagttgaaaaactattttctggtgatctagagaaggtctggacatatgccggaaacctgagcgctaggaaagacgctggagatgctcccgaaagggactgaaggtgcggcaaaggaaggccgacaggcaacagcagatcctgttatggtcggtagctagatttttcctgtacagaagcagcatgagtcattttttgtgcttttgtagcaagccaatgattgtgtatttctctacttaaaatgaatggatggcatctgatctgaacagaacaacttctagtttcagttgtagtttttttctgggttagctctttgcgttcactcatgtttatattgcaaggcagagttcagcggcaagtgactgaattcctgctcctgctgctagatgctgcctttttgtcgctgaaggtgttgttcaacattaccttcagttgcagtggaatgtaagctgatcttgtattctgatgcctgatactctgctgcctgttagtttttgtaaatgcatctaatgaatttcatctggccccct

SEQ ID NO: 1393 - DNA, 2460 bp, Panicum virgatum
ctcgacccaattctcgaacacaagttagaatcactactagtgctgacatggctcgacaccaaacaccagatgcctcagcagctgctcaacggagtaccaccactcccacacctgtgcaaaaccgagcagtcacccgtacaaaaaaaagctagacagatgacgtcgcaacacatcgcgcgcgcgacccatgaacagtagcaccagccaccagtacacatgtagcagcgctctgtttgaagcagaagcacaagcatcattggcaccaccgctaatccaccattcaaacgggattaaagaaatggttagggagctcggaaagaataaacaaatagaggaagcagcggagtcgcaggcagtgagctcgcttctcctgcagctgtcccgctgtgctctgctccctcccgtcgctttccccatcccccatcccaccacccagatgcgattccgtccccgccgccgccgctgcgcctagccgagccgagccgagccgcccccgccgccgcaatggctagcgcgtcggaggacgaggccgcctcggagcgctgctgcggcagctacagccccagcgccgacgtcagtgagtccgagacctccagcgactgctccgcgcccaccacccgtcgcttcacctcctcctcctcggcctccgccaccgtctcccgcctcgcctcctcgtcctcgtcgctcccgaccccggcatccgccgccgccttctacctctccaagcccgcgtccgacctctcagagatcgacatgatgaaggagcgcttcgcgaagctcctgctcggcgaggacatgtccggcagcggcaagggcgtctgcaccgcgctcgccatctccaacgccatcaccaacctctccgccaccgtcttcggcgagctgtggaggctggagccgctcgcgccggcgaggaaggccatgtggacgcgggagatggagtggctgctctccgtcgccgactccatcgtcgagctcacaccctccatccaggagctccccgagggcggcggccagttcgaggtcatggtgccgcgcccgcgcagcgacctctacatgaacctccccgcgctcaagaagctcgacgccatgctcctcgccatgattgacggcttcaaggagacggagttctggtacgtcgacagggggattgtggtcgaggacagcgggggcccgttcccgtcgtcctcgtcgtcgtcttgtgggcggccgtcggttcggcaggaggagaagtggtggttgccgtgcccacgggtgccacccaaggggctgtccgaggatgcgaggaggaagctgcagcagagcagggattgtgcgaaccagatactgaaggcggccatggcgattaacagcgatgtgctagccgagatggagatcccagaagtctacctggagacattaccaaagagtggtaaatcttgcttgggtgagataatttaccggtacgtaacagccgagcaattctcaccggaatgcctcctagactgcttggacttgtcatctgagcaccacacgcttgaagtagctaacagaattgaagcagccatccatgtatggagattgaaaggacaaaagaagttgacgcctcaagcgaaatcaaagaaatcttggggtggaaaagtaaagggtcttgttggagataaggaaaagagccacgttttgtccgaaagagctgatggtctattgcagagtttaagattgagataccctggtctgccacaaacttccctcgacatgaacaagatccaatataacaaggatgttggccagtccatacttgaaagttactcgagggttctggagagcttggcatataacataattgcaagaattgacgatgtgatttatgttgacgacgcaacaaagaaatctgccgctgccgagtctgtttctatctttaatcgcggagtaggcgtaccagttcagaagataatctcaccaagtccattctcaatccagaatacaccttatgcctctccatttgcgacgcccactttctgctcctccaccccagttacaggcagccctggaagagtacagccccctttaaacaaaaacagtctaggaaaacaggaaatcaaagttgaaaagctattttctggcgatctagagaaagtatggacatatgccggaaacctgagcactaggaaagatgcaggtgatgctcctgagagggactgaaggggcagcaaaggaagggtcgccaggcatcaagagatgctgttatggtcggtagctagattttccctgtacagaagcagcatgagtcattttttgtgcttttgtagcaagccaatgattgtgtatttttctacttacaatgaatggattggcatctgatctgatctgaacagaacaacttgtagttccagcagttagttttcggggttagttctgtgcgcttgttcatgtttatattgcaaggcagcggcagtgactgaattcctgctcctgccgctgctg

SEQ ID NO: 1394 - DNA, 2367 bp, Oryza sativa
atcagtgtgcttgctctctctcccatcgctttcccctcccctcgcttgccgccgcatccatccaccacctctccccctcgcggatgcgattccctcccgccgccgccgccgccgccgccgccgccgcgactagctagctagctcggaggtcggaggggaggggtggtacgactacaatggcgagcgcgtcggaggacgacgccggctcggagcggtgctgcgggagctacagcccgagcgcggacgtcagcgagtcggagacatccagcgactgctccgcgccgacgaccaccaccaccacccgccgcttcgcctcctcctcctcccgcggcgtcgcctcctcctcctcctcctcgctcctcccgacccctcccccttcctccgccgccgccttcttcctctccgccaagcccgccgccgacctctccgaggtggacatgatgaaggagcgcttcgccaagctgctgctcggcgaggacatgtccgggagcggcaagggcgtctgcaccgcgctcgccatctccaacgccatcaccaacctctccgccactgtgttcggcgagctgtggaggctggagccgatggcttcggcgaggaaggcgatgtggacgagggagatggactggctgctctccgtggccgactccatcgtcgagctcaccccgtcaatccaggagctccccgacggcgggggacagttcgaggtcatggtgccgcgcccccgcagcgacctctacatgaacctcccggcgctcaagaagctcgatgcgatgctcctcgccatgattgacgggttcaaggagaccgagttctggtatgtggatagggggatcgtggttgatgacagcggcgggccgttctcgtcgtcgtcatcctcctgcgggcggccgtcggtgcggcaggaggagaaatggtggctgccatgcccgcgggtgccgcccaaggggttgtcagaggatgcgaggaggaagctgcaacaggacagggattgtgcgaaccagatactgaaggcggccatggcgattaacagcgatgtgctcgcggagatggagatcccggaagtgtacttggagtcactgccaaagagtggtaaatcttgcttgggtgagataatttaccgatatataacagctgaacaattctcaccggagtgcctcctcgattgcttggatctgtcatcagaacaccacacacttgaagtagctaacagaatagaggctgccatccatgtgtggaggttgaagggccaaaagaaatccacgcctcaagcaaaatcaaagaaatcttggggtggaaaagtgaagggacttgttggagatacagaaaagagtcatgttttgtcccaaagagctgatgggttgttgcaaagcttaagattgcgataccctggtttgccacaaacctctctcgacatgaacaagatccagtataacaaggacgttgggcagtccatactagagagttactcaagggttctggagagcttggcatttaacataattgccagaattgatgatgtaatttatgtagatgatgcaacaaagaagtctgccgctgctgactctgtttccatcttcaatcgtggcattggcgtaccagttcagaagaggatctccccaagcccgttctcaattcagcatacaccatatgcctctccatttgctacacccactttctgctcctccactccagttacaggcagccctggaagagtacagcctccattgaacaaagacaacttaccgacaaaacaagaggttaaagttgagaagctgttttctggtgatatcgagaaggtctggacgtatgccgggaaccttagcgcaaggaaagacgcaggagatgcccctgaaagagactgaaaggcagtgaagaaagttcttcagatctttagacgtgtctcagcaaggtcaacaggtttcaacacatcctgttctggtctctagctagattttccctgtacagaagcaacatgattcatttttttgtgctttcttagcgagccaagggtcgtctagccctacttacaacaagtaagggaatgactctttgagtcttgatcgcatctgaacaagtcatagtttcacgtagctgcctctgtcggacatgtactcttcttgttcatgtttatactagctggtttagttagcagcaagtgattgaacttcagatgctgcagttctttttttttttttttgtccctggaggcatcggttccctaataatcaactgcacttgcagtgcaatgtatcatgattttctgatgctgttgtatatggcacctaatggacagatctgacgctcttcagtgactctgaagactttcttatatcaactgtgaatctgtgatcgatcacaactgctgaa

SEQ ID NO: 1395 - DNA, 2385 bp, Sorghum bicolor
caccgctaacccaccatttcaaacgagattagcactaaaaaacaaacgcggagctcggagaaaaaggaataaacaaatagaggaagcagcgcagtcggaggcagtgagctcgccctcgccctcctcctgcacctctgcagccgtgctgtgtgtgctgtgctcccatcgctttcccctcctcccatcccactcccagatgcgattccctctccaccgccacagcgcctagctaccttagcctgcccgccgccggccttcgccgccgccgccgcaatggcgagcgcgtcggaggacgaggccgcctcggaccgctgcagcgggagctacagcccaagcgccgacgtcagcgagtccgagacctccagcgactgctccgcgcccaccacccgccgcttcgcctcttcctcctcggcctccgccaccgtctcccgcctcgcgtcctcctcctcgtcgctccccaccccggcgtcggccaccgccttctacctctcctccaagccggtctccgacctctccgagatcgacatgatgaaggagcgcttcgccaagctcctgctcggcgaggacatgtccggcagcggcaagggcgtctgcaccgcgctcgccatctccaacgccatcaccaacctctccgccaccgtgttcggcgagctgtggaggctggagccgctcgcgacggcgaggaaggcgatgtggacgcgggagatggagtggctgctctccgtcgccgactccatcgtcgagctcaccccctccatccaggagctccccgaaggcggcggccagttcgaggtcatggtcccgcgcccgcgcagcgacctctacatgaatctccccgcgctcaagaagctcgatgccatgctcctcgccatgattgacgggttcaaggggacggagttctggtacgtggacaggggggtgatggtcgaggacagtggggggccgttcccgtcgtcgtcctcctcctcgtcttgtggcaggccgtcggtgcggcaggaggagaagtggtggttgccctgcccacgagtgccgcccaaggggctgtccgaggatgcgaggaggaagctgcagcagagcagggattgtgcaaaccagatactgaaggcggccatggcgattaacagcgacgtgctcgcggagatggaaatccccgatgtgtacctggagacactgcccaagagtggtaaatcttgcttgggtgagataatttaccgatacataacagctgagcagttctcaccagaatgtctcctagattgcttggatctgtcatcggagcaccacacacttgaagtggcaaacagaatagaagctgccatccatgtttggaaactgaaaggccaaaaaaaatcaacacctcaaaccaaatcaaagaaatcttggggtggaaaagtgaagggtcttgttggggataaggaaaagagtcacactttgtctgaaagagctgatggtctattgcagagcttaagattgagatatcctggtctgccacaaacttcccttgacatgaacaagatccagtataacaaggatgttgggcagtcaatacttgaaagttactcaagggttctggagagcttggcatttaacataattgcaagaattgatgatgtgatttatgttgatgatgctacaaagaaatcagctgctgctgagtctgtgtcgatcttcaatcggggcacaggtgtgccagttcagaagaggatctctccaagcccattctctattcagaatacgccatatgcctctccatttgcaacacccactttctgctcctccaccccagttacaggcagccctggaagaggacaacccccactacacaaaaacaatctagggacacaagaaatcaaggtcgaaaagctttttgctggtgatctggagaaggtgtggacatatgctggaaacctaagcgcgaggaaagatgcaggagatgcacctgagagggactgaagggtggtggaggaaggtagacaggtaccgacagtcgacagatcctgtaattgccagtagctagaattttcctgtacagaagaagcatgagtaattttttgtgcttttgtagcaagccgatcattgtgtactctgcttacaatgaatggatgttgcctgatctgaacagagaaacttgtagtttcaactgtagtttttctggattagctattagcagtgtacttgttcgtgtttatactgcaaggcagggttcagcagctaagtgagtgaattcccgctcctgctgctgctgcttttttttgtcgcggaaggtgttggtcaacagcaaacttcggtcacagtggaatgtaagctgttgtattccgatgcctgatcttctgctggctgttagtttttgtatatgcatttaatgaatatgatctgtcctcttta

SEQ ID NO: 1396 - DNA, 2122 bp, Zea mays
tgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccaccccggcatcggccgccgccttctacctctccaagccaacccccgacctctccgagatcgacatgatgaaggagcgcttcgcgaagctcctgctcggcgaggacatgtcgggcagcgggaagggcgtctgcaccgcgctcgccatctccaatgccatcaccaacctctccgccaccgtgttcggcgagctgtggaggctggagccgctcgcgacggcgaggaaggcgatgtggacgcgggagatggagtggctgctctccgtcgctgactccatcgtcgagctcaccccctccatccaggagctccccgaaggcggcggccagttcgaggtcatggtcccgcgcccgcgcagcgatctctacatgaacctccccgcgctcaagaagctcgacgccatgctcctcgcgatgattgacgggttcaaggatacggagttctggtacgtggacagaggggttatggtcgaggatagcgggggtccgttcccgtcctcatcctcgtcgtcttgtggccggccgtcagtgcggcaggaggacaagtggtggttgccctgcccaagagtgccgcccaaggggctgtctgaggacgcgaggaggaagttgcagcaaagcagggattgtgcaaaccagatactcaaggcggccatggcgattaacagcgatgtgctcgccgagatggaaatccccgaagtgtacctggagacactgcccaagaacggtaaatcttgcttgggtgagataatttatcgatacataacagctgagcagttctcaccagaatgtctcctagattgcttggatctatcatccgagcaccacacacttgaagtggcaaacagaatagaaggtgccatccatgtttggaaactgaaaggccaaaaaaagtcgacacctcaagccaaatcaaagatatcttggggtggaaaagtgaagggtcttgttggagataaggagaagagccacactttgtctgaaagagctgatggtctattgcagagcttaagattgagatatccaggcctgccacaaacttcccttgacatgaacaagatacagtataacaaggatgtcgggcagtccatacttgaaagctactcaagggttctggagagcttggcatttaacataattgcaagaattgatgatgtgatctatgttgatgatgctacaaacagatcagctgctgccgagtctgtttcgatcttcaatcgtggcacaggtgtgccagttcagaagaggatctctccaagcccattctctattcagaattcgccgtatggctctccgttcgcaacacccactttctgctcatccaccccagttacaggcagccctggaagggtacagcccccattaaacaaaaacattctaggaactcaagaaatcaaggtcgaaaagctcttttctggtgatctagagaaggtctggacatatgcaggaaacttgagcgctaggaaagacgctggagatgctcctgagagagactgaagggcgatggaggaaggtagacatgtaccgacagccgacagatcctgtaattgctagtagctagatcttcctgtacagaagcagcatgagtatttttttttgttctttttgtagcgagccgatcattgtgtgctctgcttacaatgaatggatgtcacctgatctgaacagagaaacttgtagtttcagctgtagttttttttgtctggattggctatttagcagtgtactttttcgtgtttatactgcaaggctgggttcagcagcaaatgactgaattcctgct

SEQ ID NO: 1397 - DNA, 2465 bp, Zea mays
cagcgcagtcggaggcagtgaggtgagctcgccctcctgctcctgctcctgctcccgcagctgcgctgtgctgccatcgctttcccctcctcccagtcccacccccagattcgcatgcgcgcttccctctccaccgccacaggcacagcgtcagcgcctagcttagccagctcgccgccgcaatggcgaccgcgtcggaggacgaggccgcctcggaccgctgcagcggcagctacagccccagcgccgatgtcagcgagtccgagacctccagcgactgctccgcgcccaccacccgccgcttcgcctcctcttcctccgcctccgcctccgcctccgccaccgtctcccgccgcctcgcgtcctcctcctcgtcgctgcccaccccggcatcggccgccgccttctacctctccaagccaccctcctccgacctctccgagatcgacatgatgaaggagcgcttcgccaaactcctgctcggcgaggacatgtccggcagcggcaagggcgtctgcaccgcgctcgccatctccaacgccatcaccaacctctccgccaccgtgttcggcgagctgtggaggctggagccgctcgcgaaggcgaggaaggcgatgtggacgcgggagatggagtggttgctctccgtctccgactccatcgtcgagctcaccccctccatccaggagctccccgaaggcggcggccagttcgaggtcatggtcccgcgcccgcgcaccgacctctacatgaacctccccgcgctcaagaaactcgacgccatgctcctcgccatgattgacgggttcaaggggacggagttctggtacgtggacaggggggttatggtcgaagacagcggggggccattcccgtcctcctcctcgtcatcgtcttgtggccggccgtcggtgcggcaggaggagaagtggtggttgccctgcccacgagtgccacccaaggggctgtccgaggattcgaggaggaagctgcagcaaagcagggattgtgcaaaccagatactgaaagcagccatggcgattaacagcgatgtgctcgcagagatggaaatccccgaaatgtacctggagacactgcccaagagtggtaaatcttgcttgggtgagataatttaccgatacataacagctgagcagttctcaccagaatgtctactggattgcttggatctatcatcggaacaccacacactcgaagtggcaaacagaatagaagctgccatccatgtttggaaactgaaaggccaaaaaaattcgacacctcaagccagatcaaagaaatcttggggtggaaaagtgaagggtcttgtcggagataaggaaaagagccacactttgtctgaaagagctaatggtctattgcagagcctaagattgagatatcctggtctgccacaaacctcccttgacatgaacaagatccagtataacaaggatgttgggcagtccatacttgaaagttactcaagggttctggagagcttggcatttaacataattgcaagaattgatgatgtgatatatgttgatgatgctacaaagaaatctgctgctgccgagtctgtttcgatcttcaatcgtggcaccggtgtgccaattcagaagaggatctctctaagcccattctctattcagaatacgccatatgcctctccattcgcaacacccactttctgctcctccaccccagttacatgcagccctggaagagtacagcccccgttaaacaaaaccaatctaggaaggccagaaatcaaggtcgagaagcttttttctggtgatctagagaaggtctggacatatgctggaaacctgagcgctaggaaagacgctggcgatgctcccgagagagactgatgggcgatggaggaaggtagacttgttatggaaacattatcgctatttagcagcgtactcgttcgtgtttatactgcgaggctgggttcatcagcaagtgactgaattcctcctgctgctgctgctgctgctgctttttgtcgctgaaggtgttggtctgctgcctgttagtttttgtatatgcatgttaatgaatttgatctggccctctttaatgctcactactattgtactgagagttgctgaccacatctgagcagacccagtttcctccggttcatctgccagtgagctctgcacagcagtcgactgcagaaaggcgatccagatgagatctagatgagaactagatgtgtcaaatgataaaacggtacgacatttgtatattgcgggtaatcaatccaattgacaaatcgtcagatcttttctctctttgctctgtactgtactatgactactatcgagggcttgaatgaacctctagagataattgttaacggctcaaattggctgtagctgttttaaacgccctagctaaattgttagttcgatctatcatctatgaggccattcccaataaaagttgca

SEQ ID NO: 1398 - DNA, 1372 bp, Cajanus cajan
aaacgaaagtgagttgcattcatcatcatctctgttcctagtgaccaatcaacgttgagcgttatgcagacaagggattcgagcatgaggtcagggatggagttcttccaccgggcgaaggcggtgcgtctgcggagccaccacgacaagtacctccacgcggacgacgacgaggagtccgtcacgcaagaccggaacggcacctcccgtaacgccaagtggacggtggagctcatcccggagttcgacagcatcataaggctcaagagctgctacggcaagtacctcacggcgtccaacatgccgttactgctcggcgtcacggggcggaaggtcgtgcagagcgtgccgcgccgcctcgactcctccgtcgagtgggagcccgtccgcgacggcgcccaggtcaagctcaagacgcgctacggcaacttcctccgcgccaatggggggttgccgccgtggagaaactcggtgacccacgatatcccgcataggagcgccacacaggattggatcttgtgggatgttgatgttttggagatccacgttgagtcccctgctcctcctcccattccgcactctgattccctcgattttgactcctctactccttctgctgtttccatcaaatctacgactttctccagacaagagtcgacggattcaaatgtgggttcgccacctaagatggaagggaggactatatactaccatgttgctgaggataatggggatgtggatgatgagaacgtgcagggttattctttgaatttcaaagggaatggggttgagcagttgactcgcaagtttgaggaagagacggggcttgagggtgttattgtgtgtactcgaagtcctttgaatgggagactctaccctcttcgattgcagcttcctccaaacaatgtgaccatgcaggttgttttggttcttccctcgtctaaagtggcaaaagactttaaggagcaaggtttactatgacaagtggaaccttgaatctattgaaatgcagggcctatgtacgttgtgatccaagcgtgtttcaaattttatgtgataacatttaagaatatgttggaaaactccacttattttaagtgagtccattgcatttataaagcagaattcatcaaggtcgaatggaggtaccttaaagttgtcctgaaaaggccatatcagcaatatcctctcctctattaagtggtgaccaacgggttgtagacgattctgatggagatacaagtctttgttgaacatcatatttattagcgctagctttaatcttagcctattcatgtggactcagatatttgttgtttctctctggtaattttctgtttttcatgtttttttttttttttttttccctctt

SEQ ID NO: 1399 - DNA, 1662 bp, Glycine max
cttacatacaaataccccaaaccaaacccaagtcacttgcttactttttaatctctgatccgaacgaagtaacgaaccaacaataagtcaatcaccctgtctctcctaagcccccaaaacacagtcccaaatcgaacaaaatcaactaactaaaccctccaacgttgttattatgcagacaacaacaagttccaacaccgccgccaccacgttccgttccggcatggagctcttccaccgcgcgaaggcggtgcgcctccgcagccaccacgacaagtacctcctggccgacgaggacgaggagtccgtcacgcaggaccgcaacggatcctcccgcaacgccaagtggacggtggagctcattccggagttcgacaacatcatcagactcaagagctgttacggaaaatacctgacggcgtccaaccagccgctgctcctcggcgtcacgggccgcaaggtggtgcagagcgtgcctcggcggctcgactcctccgtcgagtgggagcccgttcgcgacggcgcgcaggtcaagctcaagacccgttacgggaactttctcagagccaacgggggggttccaccttggaggaactccgtgacgcacgatatcccgcataggaccactacacaggattggatcctctgggatgtggatgttctcgagattcatgtggtgttccctgctccgcctccgattccgcattccgattcgcttgattttgagtccaatactccttctgctgttaacatcaaatctaccaccttctccagacaagagtcaacagattcgaatgtgagttcgccgccaaaggtggaggggaggactatatactaccatgttgcagaagataatggggatgtggatgatgagaatgtgcagggttattctttgaatttcaaagggaatggggttgagcagttggctcggaagtttgaggaagaaacgggacttgagggagttattgtgtgcactcgaagtcctttgaatggaaaactctaccctcttcgcttgcagcttcctccaaacaatgtcaccatgcaggttgttttggttcttccctcgtctaaagtggcaagagaatttgaggagcaaggtatactatgacaagttagattattgttggagtcttgaattgaatctactgaaatgcaacttgtgattcaagcgtgtttcgaattttatgtgataacatttaagaatatgttgcaaagttccacctgtttcaagtgatccattgcatttataaggcagaattcatcaaggtccaatggcgataccttaaagtttccctggtaagggtcgtatcagcaatatcctctattaagtggcgttgaagggttgtagatgattctgatggagatggaagtctttgttggacttcctatttattagcgctgtagctttaatcctgtatcatgtggattcagatatttgttgtttcttgctctttttggtatttttctgtttttcatgtttttttaagatgtatcatttgtatagacaacttttatcagaaaagtagaggtatattttttcagtcatatataactttaaggaatttgaagcattttttaatcagatataatttttgcctcattagtttgtatttgctgtttggaatgaaattcatattcaaatgtggaaaaaccgcaagtgac

SEQ ID NO: 1400 - DNA, 2308 bp, Medicago truncatula
cgcaatcttattacttttcatttagttaacacatcccgaaacaacccacttaatttccagacaggttcaaccccaacatcctgttatatccccacaccaaacttaatatattcccccacaacgtatatacaatcattaccaccattatcaccaaccaccaagcaccattcaccaatacaaatatatacaaaaatcaaatatttgcacatattaacatcatctatatactcatcaacaaaatagaaaggtcatcaaaaaaatattagtatcatctacaacacaactagtaaaatggagtatttcaacaaatcaaaggctgtgaaactacgcagccacctagggaagtacctagtagcagatgaagacaacaacaacatccgtcagagcagaaatggaacaaccaaaaaatcactatggtttatcgaaccggtcgaaacaaaacctcaccatatacgcctcaggagccaccatggccgttacctaaccgcgacggacacgccatttctcctcggcatgaccggaaacaaagttgtccaagccgattacgacgcgggtttgggctggaaatatgaatgggaaccaataaaagaagggttcaacgtgaaactgaggagttggtgtggaaaatatttgagaggtaatggtggaacaccaccatggagaaattctattacacatgatgatcctacctctgctacacataattggattctttggggtgtagagtttgtggagttatcattggctaatcaggagaatgttgaattgttgaatcaaattagttttgcttctatttcttcatttgattctcgtgatgaggttaatgattctgaattggtttcttctatgaagtctcgcttcaccatctcatcaatggagcttttccaacgagcaaaagcagttcgactaagaagccaccacgacaaatacctccacgcagaagaagacgaagaatcaacaaaccaagacagaaacggatcatcaaaaaacgctaaatggacagttgaacacatccctgaatacgacaacatcatccgtctcaaaagctgttacaacaaatacttaacagcatcaaatcagcctttacttctcggcgtaacgggtcgaaaagtgattcaaacactgccaaggagactcgattcgtctgttgaatgggaaccggttagagaaggtgcgcaggttaagctgaaaacgagatatgggaattttcttagagctaatggtgggttaccaccttggagaaattcagttacgcatgatattcctcatagaagtgctactcaggattggattctttgggatgttgatgttcttgagattcatgttggaaatccacctcctcctccgattcctcattcggattctcttgattttggatcttctactccttctgctctttccttcaaatctgatcgcttctctagacaagagtcaacagatagcgttggttcgccgccaaagatggaggggagaactatatactaccatgttgctgaggataatggagatgtggatgatgagaatgtgcagggctattccttggtgttcaatgggaatgacgtcgagcagctgactcgtaagttcgtggaagagacaggacttgacggagttattgtgtgtagtcgaagtcctttgaatggaaaactttaccctcttcgtttgcatcttcctccaaacaatgttaccatgcaggttgttttggtccttcctaactcaaaagttgcaaaagaatttgaagaacaaggtttactgtgacagacttgatttatgaagtcttgagtgtattaaactgcaaggccaatgtaacattgtgacccaagtcaagtgggtttcaaattctattttatcacatttatgcaaaactcaaccttgttgttttataaactttttttgttattgtaattttctgccattcattgtattctttagatttatctcttgtataaagatcttctatcagaaagttacagtcatgtatttttttttcaggcagatataaatgtcagaaattagaagcattctttaatcggatagaatttatgcctttatttaggcattattgttcttgtaaaaaaataaaaaaatagaaacaacattctattgatacaataagctttgaaataaaaattgagaaatgatatttgtacaaccattttctaacaacttttgtgacaactttctctctcatactcacattatatttttactttctctctctattactttgatatttgtgccaatacatacttttctttgtaaaaatgtggttgtccatttagttgttaaacaaattgatgttcaaataaca

SEQ ID NO: 1401 - DNA, 1622 bp, Trifolium pratense
tcattatggttaatcgaaatagacaaaacaaaaccaaaccacatacgtctaaaatctcaccacggccgctacttaaccgcaacagacacaccattcctcctcggcatgaccggaaataaagtcgttcaagctgattatgacgcgggcttaagctggaaatatgaatgggaaccaataaaagaaggaatcagcagtgtgaaattgaagagttggtgtgggaaatatttgagaggtaatggtggaacaccaccgtggagaaattctataacacatgatgatgatcctagctctgctacatataattggattatttggggtgtggaggttgtggagtcatcattgcataatgagaataataatgaaatattgaatcaaattagttttgcttcaaattcttcgtttgattcttgtgaagatgttcatgattctcaatcggtttctacttctatgaagaagacttggtctttgtcaaagactcgacagagttcaaaattgcagaaaacttccaataacaacaacaacttcacctcatcaatggaacttttccaacgagcaaaagcagttagactcagaagccatcacgacaaataccttcacgcagaagaagacgaagaatcaataaaccaagacagaaacggatcatcaaaaaacgctaaatggatagtagaacacatccctgaatatgataacatcatccgtctcaaaagttgttatggtaaatacttaactgcatcaaatcagcctttacttctcggcgtaactggtcgaaaagttgttcaaacgcttccaaggcgacttgattcgtctgttgaatgggaaccggttagagaaggtgcacaagttaagctgaaaactagatatggtaattttcttagagctaatggtggattaccaccttggagaaattctgttactcatgatattcctcatagaagttctactcaggattggattctttgggatgttgatattcttgagattcatgttggaaatccacctcctcctcctattcctcattctgattctcttgattttggatcttctacttctttcaaatctgatcgctttgctagacaagagtcaacagatagtgttggttcgccgccgaagttggaggggagaactatatactaccatgttgctgaggataatggagacgtggatgatgagaacgtgcagggctattccttggttttcaatgggaatgatgttgagcaattgactcgtaagtttgtggaagagacgggacttgatggagttattgtgtgtagtcgaagtcctttgaatggaaaactctaccctcttcgtttgcatcttcctccaaacaatgttaccatgcaggttgttttggtccttcccaactcaaaagctgcaaaagattttgaagaacaaggtttactgtgacaagctagatctgtggagtcttgaacctattaaagtgcaaggcaaatgttaaatgtacattgtgacccaactgggtttcaaattctattttataacatttaatttaaaattatgctgcaaaactttaccttgctagtctcttgtagatggtagtctttgttattggcgacctctttattgttaatgctagccttggattcaggtactttgttgatact

SEQ ID NO: 1402 - DNA, 1798 bp, Trifolium pratense
aatcactatggttaatcgaaatcgacaaaacaaaaccaaacctcgtacgtctgagatcacaccacggccgttacttaaccgcaacagacacacctttcctcctcggcatgaccggaaataaagtggttcaagctgattacgacgcaggtttaagctggaaatatgaatgggaaccaataaaagaaggaatgagcagcgtgaaattgaagagttggtgtgggaagtttttgagaggtaatggtggaacaccaccgtggagaaattctgttacacatgatgatcctagctctgctacatataattggattctttggggtgtcgagtttgtggagttatcattgcataataatcagaataatgaattgttcaatcaaactagttttgcttcaaattcttcgtttgattcttgtgaagatattcatgattctcaatcggtttctactacttctatcaacaagacttggtctttgtcaaagactcgtcaaaattctaaattgcagaaaacttccaacaacaacaacagcttcacctcatcaatggaacttttccaacgagcaaaagcagttagactgagaagccaccacgacaagtatctacacgcagaagaagacgaagaatcaatcaaccaagacagaaacggatcatcaaaaaacgctaaatggacagtagaacacatccctgaatatgataacatcatccgtctcaaaagctgttatggtaaatacttaactgcatcaaatcagcctttacttctcggcgtaaccggtcgaaaagttgttcaaacacttccaagacgacttgattcgtctgttgaatgggaacctgttagagaaggtgcacaggttaagttgaaaactagatatggtaattttcttagagctaatggtggattaccaccttggagaaattctgttactcatgatattcctcatagaagttccactcaggattggattctttgggatgttgatattcttgagattcatgttggaaatccacctcctcctcctattcctcattctgattctcttgattttggatcttctacttctttcaaatctgatcgctttgctagacaagagtcaacagatagtgttggttcgccgccaaagttggaggggagaactatatactaccatgttgctgaggataatggagatgtggatgacgagaacgtgcagggctatttgttggtcttcaatgggaatgatgttgagcaattgactcgtaagttttcggaagagacgggacttgatggagttattgtgtgtagtcgaagtcctttgaatggaaaactttatcctcttcgtttgcatcttcctccaaacaatgttaccatgcaggttgttttggtccttcccaattcaaaagctgcaaaagattttgaagaacaaggtttactgtgacaagctagatctgtggagtcttgaacctattaaagtgcaaggcaaatgttaaatgtacattgtgacccaactgggtttcaaattctattttataacatttaatttaaaattatgctgcaaaactgttctttactcgagcgagtctattgtagatggtagtctttgttattggcgacctctatattgttaatgctagcctttgattcaggtactttgttgatactatattcttttgttgtaacttgtaacttcatgtaattcattgtattttttagatgtatctcttgtatggagatcttttatcagaaagctacattcatgtattttttcaggcagatataaatgtcagaaattagaaacatttatttatcagataaaatttcagctttaaa

SEQ ID NO: 1403 - DNA, 1425 bp, Trifolium pratense
atcatcaaaagacaaagtcacttcaattcatctatgtttccgaacacacaccaatcaaaatcaaaatcaaaattacccacccagtctctttgttgaatccaaacatttactaactaacctcaatccaaaatcaaaattaatctcatcactttcaccataaagaaatcagaaatctgaactgtgcagaaaagttggaacaagaagtcaacagcttcaggtgattcatcaatggaacttttccaacgagcaaaagcagttagactgagaagccaccacgacaagtatctacacgcagaagaagacgaagaatcaatcaaccaagacagaaacggatcatcaaaaaacgctaaatggacagtcgaacacatccctgaatacgataacatcatccgtcttaaaagttgttacggaaaatacttaacagcatcaaatcagcctttacttctcggcgtcacgggtcgaaaagttgttcaaactctgccaaggagacttgattcgtctgttgaatgggagcctgttagagatggtgctcaggttaagctgaaaaccagatatggtaattttcttagagctaatggtggattaccaccttggagaaattctgttactcatgatattcctcatagaagttccactcaggattggattctttgggatgttgatgttcttgagattcatgttggaaatcctcctcctcctcctattcctcattctgattctcttgattttggatcttctacttctttcaaatctgatcgctttgctagacaagagtcaacagatagtgttggttcgccgccgaagatggaggggagaactatatactaccatgttgctgaggataatggagatgtggatgatgagaacgtgcagggctattccttggtcttcaatgggaatgatgttgagcagttgactcgtaagttttcggaagagacgggacttgatggagttattgtgtgtagtcgaagtcctttgaatggaaaactttacccacttcgtttgcatcttcctccaaacaatgttaccatgcaggttgttttggtccttcccaactcaaaagctgcaaaagaatttgaagaacaaggtttactgtgacaagctagatcaagtacaaggcaaatgtacattgtgacccaactgggtttgaaattctattttataacatttaatttaaaattatgctgcaaaactgttctttactcgagcgagtctattgtagatggtagtctttgttattggcgacctctatattgttaatgctagcctttgattcaggtactttgttgatactatattcttttgttgtaacttgtaacttcatgtaattcattgtattttttagatgtatctcttgtatgaagatcttttatcagaagctacattcatgtattttttcaggcagatataaatgtcagaaattag

SEQ ID NO: 1404 - DNA, 1802 bp, Cicer arietinum
attgtcaattacaattaaaaaaagcagacataataaatttaatattaattccaagtaattttagaaaaaagtagttgctttttatttaatttatttattacctagtatttacttccatccataaaaacaagaacacgaaagtcaaatgaattaatctctgtttaccaatactcgaaaccaaacagacaaatttcaaccccgttctctactctctcttcattcttcttcaactcaaacctcatcccaaatctcaactaactaacaaaccattgactctgtctctgtgtgcagacaagttccatcaacagcttcagtttaccgatggagtttttccaacgagcaaaagcagttcgtctccgaagccaccacgacaaatacctccacgcagaagatgacgaagaatccgtcaaccaagaaagaaacggatcatccaaaaatgcaaaatggatcgtcgaactcatacccgaatacgacaacataatccgactcaaaagctgttacaacaaatacttaacggcgtcaaaccaaccgttacttctaggcgtcacgggccgtaaggttgttcaaacgatgccacgtagactcgattcttctgttgagtgggaacctataagagacggtgcgcaggttaagcttaaaactagatacggtaattttcttagagctaatggtggtttaccaccttggagaaatagtgtgactcatgatattcctcataggagttctactcaggattggattctttgggatgttgatgttcttgagattcagattggaaatcctactcctcctcctattcctcactctgattctcttgattttgaatcttctactccttcttctccttcactccattctcatcgcttttctagacaagagtcaacggatagtgttggttcaccgccgaagatggaggggagaactatatactatcatgttgctgaggataatggagatgtggatgatgagaatgtgcagggatattccttggtctttaatggcaatgacgttgagcagttgactcgtaagtttgcggaagaaacaggactcgatggagttattgtgtgtagtcgaagtcctttgaatggaaaactttaccctcttcgcttgcatcttcctccaaacaatgtgaccatgcaggttgttttggtccttccctcctcaaaagttgcaaaagaatttgaagaacaaggtttactgtgacaagctagatctgcggagtcttgaacctattaaagtggaacaccaatgtacattgttacccaattgggtttcaaattctattttataacatttgaatatatgttgcaaaactccaccttgctggggaccgagtcagttggagatggtagtctttgttattggctgcctctttatttttaatgctagctttggatttgggtcccgtattgtttctataacttgtaatcttttttgtagttttctgtttttcattatatttttaggtatatctcttgtttggagaactagagatcttttatgagaaaactagtccatgtattttttcagtcagataaaaatatcagaaattaggtaacttttttttaattagaaataatttctgccttatttgtgtatgtttcatgtttggaataaaatgtgattcaaaaggaggatcactgccaatcaaaaaaaaaaggaggataactgttgagcctgtgatagaatagaggtaagatagaattagatgaagaaaattattgtattaacagatatgaaaacataaaatgattccagagctaatgctcctcagttaaataaaacaattctctcactgccca

SEQ ID NO: 1405 - DNA, 964 bp, Lotus japonicus
aacaaattagtcgctctattcttacattcaaccaacccaagtcaagtcactttcatacacatcgttcatctttggtccgaacctcggggtttgagagatggagttgttccagcgagcgaaggcggtgcggctgcgcagccaccacgacaagtacctacaggcggaggaggacgaggagtcggtgagccaagaccggaacggctcctccaagaacgccaagtggatcgtggagcacgtgccggagtacgacaacatcatccgcctcaagagctgctacggcaagtatctcacggcgtccaaccagcctctcctgctcggcgtcactggccgcaaagtggttcagagcttgccgcggaggctcgattcctccgtcgagtgggagcctctccgggatggtgctcaggtgaagctcaagacccgctacgggaacttcctcagggctaatggtggattgccaccgtggaggaactctgttactcacgatatcccccataggagctccacacaggattggatcctctgggatgttgatgtcttggagatccatgttcacgcgcctcctcctccgcctcttcctcactctgattctcttgatttcgactccagtaccccttctgctgctaattcattcaaatcaaccaacttctccaggcaacagtcgacagattcgagtgtgggttcgccgccgaagatggaggggagaactatatactacaatgttgctgaggatactggggaggtggatgatgagaacgtgcagggatattcgttgaacttcaatggaaatggggttcagcaactaactcgtaagtttgaggaagagacggggcttgagggagttattgtgtgtactcgaagtcctttgaatggaaaactttatcctcttcgcttgcagcttcctccgaacaatgtgaccatgcaggttgttttggttcttccttcctcaaaaggtaaatttcccctt

SEQ ID NO: 1406 - DNA, 1050 bp, Trifolium pratense
aacaacaacagcttcacctcatcaatggaacttttccaacgagcaaaagcagttagactcagaagccatcacgacaaataccttcacgcagaagaagacgaagaatcaataaaccaagacagaaacggatcatcaaaaaacgctaaatggatagtagaacacatccctgaatatgataacatcatccgtctcaaaagctgttatggaaaatacttaactgcatcaaatcagcctttacttctcggcgtaaccggtcgaaaagttgttcaaacgcttccaaggcgacttgattcgtctgttgaatgggaacctgttagagaaggtgcacaggttaagctgaaaactagatatggtaattttcttagagctaatggtggattaccaccttggagaaattctgttactcatgatattcctcatagaagttctactcaggattggattctttgggatgttgatattcttgagattcatgttggaaatccacctcctcctcctattcctcattctgattctcttgattttggatcttctacttctttcaaatctgatcgctttgctagacaagagtcaacagatagtgttggttcgccgccaaagttggaggggagaactatatactaccatgttgctgaggataatggagacgtggatgatgagaacgtgcagggctattccttggtcttcaatgggaatgatgttgagcaattgactcgtaagtttgtggaagagacgggacttgatggagttattgtgtgtagtcgaagtcctttgaatggaaaactctaccctcttcgtttgcatcttcctccaaacaatgttaccatgcaggttgttttggtccttcccaattgaagaacaaggtttactgtgacaagctagatctgtggagtctttaacctcttaaagtgcaaggcaaatgttaaatgtacattgtgacccaatttaaaattatgctgcaaaactttaccttgctagtgtcttgtagatggtagtctttgttattggcaacctttttattgttaatgctagccttggattcaggtactt

SEQ ID NO: 1407 - DNA, 4317 bp, Cajanus cajan
cctcagtcctcaacgtttgaaatggacaacctcagcgaagaagaagaagaactcggaactgagcaactcagaagcaccaccttccaacgattaaagtcgttctccttgcaccttctcgaccttttgcagaaccctcacattgagaatcagaagcactcttctgtcaccgtaatcccccaactccttcgtttccttcgcaattcttcgccctctactttgcaacctttcttcgactacactctgtttccgttgcttctgctcctcgatggagcgattcagtgcagaacaacgcagaaacttgaatctgaggaaaagtatactatgcctgatgttccgaaaacacctgttcaagtgagtgatggcgttgctgaaggagtggttaattgtttggaggagcttctgaggaagtgtcatttgagttctgttgatcagatggttgtgctgctaaaaaagttaacatacggagccatgttatcacccactgaggcttcagaggagtttcgtgaaggaattttattgtgtgtcaaggcactatttttgagtttatatccctgttctgacgtgtcttgcttgtgtaaaaaaatatctggtttgcctgcactttcggatggaatttataataataggcttcataaaactttcaagaatgattcggaatcagaagaatgtttacttgcatatctccagtctcaatttgcgttagctgctgttggacactggctatcacttcttctcaaaactgcagatacagaggcagctaggggacaacggggttctgcaagaattcgaattgaagcattcaaaactctgagggtgcttgttgcaaaggttggttctgcagatgcattagccttctttttacctggcattgttagtcagttagctaaagttttgcacaatacaaaaacaatgataagtggggctgctggtaatgtggaatctattgaccatgcaatcagagctttggcagagtttcttatgatagtcctccaggatgatgctaatgcacctgccctggatattgaagcatcttcagactttgattcaaatgagtgtaattctacactttctcttttggaggagcttcgtcacttgcaggttaaaaattttgataaaacaaaggcttctgaatatatagatgttgagtcagaaaaaatctctggttcccaaactcaactccaagaaatagggaatactgatcctgacagagagaacttgtcattctatgtgaatcgaacaaaaggttggatgcagaggacgtcagcacatgtaaataagttgttgagtgcaacatttccacatatctgtattcacccttcatcaaaggtgagaaaaggacttgttgatgccgtaaaaggactcttgtcagagtgcttctatatcctgggggaaagtagactgatgcttttggagtgcttatgcgccttggttgttgatgcatctaatgatgtttcttcaactgcacaagatttccttgagtgcttgttctcacaaaatttgaaacatgttgtcaaacgcaatgctgctgagatatttatcaggcaccttgaaaagcttcctagagtggtgcttggccatgaggagtcacttgctgtattacatgctcagcaactactaacaataatattttattccggtcctcgtctattagtggatcatcttcagtctcctgttgaagctgctagattcctggatttgtttgcttcatgtctaagccataattcagtgttttctggttcgcttgaaaaaatcacttcaacagatcgagcatcaaccctgggatatcttccctccatagctgagttgaaatctggagctaatttcttgaatcatggcttccctcttataaattatagtttatgtgatgttcctaagcacaggcttattgaggaaaaaagtatagaagaacctgtaaaaactgctcaaaataactatgaggttcctcgcatgcccccttggtttaattatgttggtagtcataagttataccagcctcttgcaaggattcttcgatttgtgggtttatctttagtggcagatcatataagtgaagggcttctgtcgcatgtgattgagacccttcttggttacttccgtaaattggtttccgagcttcgtttaaaagaatacaataaagaaagctggcagtcttggtatgacaggaatggttctggacagttattgcggcaagctagcacagctgcatgcatgctaaatgaaatgatatttggtctatcagatcaagcaactaatgattttgctggaatatttcatagttctagtgtaagcagaggagttcgggttgagtctaacaaacatgattgtgcatttcaaccatctttctggaagatgcccaatgataaaggtgtaaagagttatttagttgagtgcattggtgggatcttacacgagtatttatctgctgaggtttggaatgttccaattgatcgcagaattgctgacttgcagcttattgctgcagttgaagaagatattagtctatactttttccaagatgctgcaatgctacgtgaggttattattgatggagtaggaatctttaatctatgccttggaagagattttgtttcaagtggatttcttcattcttcactttatttattgctggagaatcttagttcttcaaattaccgagttagaaaagcagcagattctgtcttgcatatactttccactacatctggctgcccaacagttggacagttagttttggaaaatgcagactatgtgattgattcaatatgtcggcaattacgtcatttggaccttaatcatcatgtgccaaatgtgctagcatccatgctctcctacattggagtggctcacaagatattgcctctacttgaggaaccgatgcgatctgtgtcagcggaacttgaaatactgggtagacatcaacatcctgatctaacagttccattcttaaaggcagtagcagaaattgtgaaggcatcaaaacatgaagctttcctgttgccccagcaggctgagtcgtttaccagagatgtcaggtctataatctccaattcggaagaaacaacacaagaccagtgggaggacattttattcatgttaaatgattctagaagatatagacgaacagttggttctattgctggttcatgtattactgctgcaattccacttctagcatcattcaagcaagagatatgtttggctgccctggatataattgagagtggcacgttggcattggcaaaagtagaatcagcttataaacatgaaagagaaattaaggaagcaacagaagaagtgctgcaatcactatcattgtatcagctgaaggatactttggatgttaatgaagaaggggctgatgagaacaggctgcttccggcaatgaataaaatatggccattcctggttacttgtattcagaacaggaacccagtggctatccggagatgtttgaatgtgatcagcaatgtagtgccagtttgtggaggagatttcttcacacgtcgtttccacactgatggaacacacttttggaaacttctgaccacgtccccatttcataaaatgtcatatttcaaagatgagaaggcccctttacaactaccttacagacgcagtcccgtgagttcagaggattcattggcagagacgtcctatcttaaggttcagattgcagtgctaaacatgattgctgatttatgccgtaataagagcagtgcctctgcattagaacttgttctgaagaaggtaagtggtctggttgtggggatagcttgtagcagtgttgttggacttcgagatgcttctctgaatgccctccatggacttgcatctattgatcctgatcttgtgtggcttctcttagctgatatatactacactaagaagatagaaacttcgcctccacctacaccagagttaccagaaatctctgaaattctccctcctcccatatcacccaaagaacatctatatgtgcagtatggaggacagagttatggttttgacatagatttggcttctttggatattgttttcacaaaaattgactctcaatatcagatgtatagctaatatctgaattagcttatataaaattatttgtagcttttctatcccatttacacatcaacctctgatctgcccccacccaactccgcacacaaacccttctccctcttaccatctcacgctgacgagtcattgcgaccattcatttgattactgagacaggtaaaggattggatcatgtacagaacatctggttcacctttaactatgttggtttagggttgattttaaacgatttctttcaac

SEQ ID NO: 1408 - DNA, 596 bp, Theobroma cacao
acagttgcaaaaggtaaagaccgagctctctcaatctgcaacgatcaaacctttgacatcttttgcagaaaatgggcttgtggacgattttggaagggtttttgcttcttgcaaatgctttggcaatattaaatgaggaccgttttcttgcacccagaggatggagtttcacggaattctccgcagggcggacgaagtcatttaaagggcagcttattggtctcatttacgctacacaatacatgagagttcctctgatattactcaatgcaatttgcattgttgtaaagttagtttctggttgatgctattctagaattcatgatgttgaaccagaaaaagagaatttgcagaaggttctgtgaaagacaaaagcattcagtttagaaattagctgatacatctttttgtataatcagttgttctaaaggtcgttatccccattttttaaaatcgaactttaggtttcgtgatgggattgttgggattgtatcgaactcaggaatgttacggctcaagcattttgttatattgggacagcttctgtaccctgtcattttgatatatattgtggctgttattggtatcgccttgca

SEQ ID NO: 1409 - DNA, 611 bp, Gossypium hirsutum
ggaaccagctctctcaatctgcagcgcccatatcttcacttcttttgcataaaatgggcttgtggacgatattagaaggatttttacttcttgcaaatgctttggcaatattaaatgaggatcgttttcttgctcccagaggatggagtttctcggaattctctgcggggcgtacaaagtcatttaaagggcaacttattggtctcatttacgccactcaatacatgagagttcctctcatactactcaatgcaatctgcatttttgttaagctagtttctggttgatgctgctctagaatgcatcaagtcgaatatggagcataggaatttgccgaaggttgtgtaagacagaagcagtcagttcaaaaattaggtgatgtatctgttttacacttaagtttgtatcccccctccttttaaaatagaatttgaggtttcatgatgggattttatcgaacctggaaatgtgataacttgatagctctagcatttgtataatttggagactttacgctgtcattttgaaatatacagtttattgtgcctggaatttctattaattgctgctgtatgaacatgatatttgaaaatggagttcaagtttggggg

SEQ ID NO: 1410 - DNA, 642 bp, Gossypium raimondii
gttgcaaagaaggaaccagctctctcaatctgcagcgcccatatcttcacttcttttgcataaaatgggcttgtggacgatattagaaggatttttgcttcttgcaaatgctttggcaatattaaatgaggatcgttttcttgctcccagaggatggagtttctcggaattctctgcggggcgtacaaagtcatttaaagggcaacttattggtctcatttacgccactcaatacatgagagttcctctcatactactcaatgcaatctgcatttttgttaagctagtttctggttgatgctgctctagaatgcatcaagtcgaatatggagcataggaatttgccgaaggttgtgtaagacagaagcagtcagttcaaaaattaggtgatgtatctgttttacacttaagtttgtatcccccctccttttaaaatagaatttgaggtttcatgatgggattttatcgaacctggaaatgtgataacttgatagctctagcatttgtataatttggagactttacgctgtcattttgaaatatacagtttattgtgcctggaatttctattaattgctgctgtatgaacatgatatttgaaaatggagttcaagtttgggggtggggtggtttgatttctgg

SEQ ID NO: 1411 - DNA, 640 bp, Gossypium raimondii
tctcaatctgcagcgcccatatcttcacttcttttgcataaaatgggcttgtggacgatattagaaggatttttgcttcttgcaaatgctttggcaatattaaatgaggatcgttttcttgctcccagaggatggagtttctcggaattctctgcggggcgtacaaagtcatttaaagggcaacttattggtctcatttacgccactcaatacatgagagttcctctcatactactcaatgcaatctgcatttttgttaagctagtttctggttgatgctgctctaggtaagatgtttatgtctatggctgatgattggttgaatttgtattaggttctcaaacagatgccccttgttttttttgcattcaagaacttgtttattagttgtgatgaccattttagtcggttttgtttctgatttctaaaaattacatggatttaaaatggtgtgatcaataggtgtctgtgaaacttaagctgaatgattagtagttatttctaaacctattaattggttgactatattgtgaaaagggaaacttagtcttagattaatttttctgattaccattgttgaattacacacccgaaacttatgaagtttgaataagatctttttaacactgcaagttctata

SEQ ID NO: 1412 - DNA, 2940 bp, Triticum aestivum
ctccaccaccgccgctcgccgccaactccgccgcagcaggggctgctgcatgacgcctcggccccaccgagagtcggcgacgtccgcgcctgtcgccgccgcggccgagatggtggtcgccgtggcgaatggggcgaagagggaggcagccgccgccgccaacaccaccgccgccgccgacgccgacgcagattctcccatctccgtcctggaggaagagaaaatggccggatccaaggacgggaaagcgggcgagctcaaggccaacggcggtgaggcgcaccccattgcggaggcgctgaaggctgaagaacagctactgaactccgtcaaagacgagacatcggttgagccgctggatgcgacttctcctctgcctatcgacctcgcggccaagaacggcgacacgtctttaatcacagaggtgatgacgaaggaggaagaggagatgtatcaggcccggattaagctagaggaagaagaggaggccagaaagagagaggaggccgcgaggcaggcctttgacccgaaggcaaagttcagcaaactggatgagctgctgacacagacacagctctattctgaatttctacttgagaagatggagcagatcacagatgttaagccgactgctgttgaaattaaagatgaagaggaacccgtggaagagcaaaagaaaggacgtggcaggaagaggaaagcggcgaacaagccacagtacaatgacaagaaggctaaaaccgcagtggcagccatgctttcaagatctcgcgaagatcgctctgctgatgatggcactctcacggaagaagaaaagtgggaaagagagcaagccaatcttgttccattgttgactgggggaaagttgaaatcttaccagataaagggtgttaagtggctaatatcactgtggcaaaatgggcttaatgggatactggctgatcaaatgggccttggtaaaacaatccagacaattgcatttcttgctcatcttaaagggaatggtctgcatggcccatacatggttattgctcccctttccaccctgtcaaactggttgaacgagctaacgaggtttgctccatctataaatggtctgatttatcatggagataaagtggctcggacagagctaaggagaaaacacatgcccaaaactgttggtcctgattttccgataataatcacttcatatgagatggccatgtttgatgcaaagtttcttgctaattataagtggaagtatgttgttgtagatgaggggcatcgtttgaaaaatacgaagtgcaaattactgagggagttgaggcgcatcccaatggataacaagctccttttgactggaacacctcttcagaataatctagcagagctgtggtctctattgaacttcattttgcctgatatattctcatcccatgaggaatttgagtcatggtttgatttttctgggaaggctgatgaggaactagaggaagaaactgatgaaaagaaaagagtccttgttgtctcaaagcttcatgccattttgcgcccattccttttaaggcggatgaaggaggatgtagaacacatgcttccacgaaagaaagagataatcatatatgctaacatgactgaacatcagaagcaaatccagaatcacttgattgagcagacatttgatgactacttgcatgagagcgcagatattgttttgcggaggcccggcatcaagacaaagctaaataatctactcattcagctgagaaaaaattgtggccaccctgatcttttccattctgcttttgactcaaacagtctctatccacctgttgataagcttctggaacagtgtggcaaatttcagctgttggacaggttactgaatgctctcatcaaacgaaatcacaaggtcctaatattttctcaatggacaaagattttggacatccttgactattatttgtctgagaaaggcctgaaggtttgccgaattgatggtaatgttaagttggaagacaggaggaaccagatagcagcgtttaatgacttaaacagtggtatgaatgtcttcattctcagcacacgtgctggtgggcttggtatcaaccttacttctgctgatacttgtatcctgtatgatagtgactggaatcctcagatggatttgcaggccatggatcggtgccaccgtattggtcaaacacagccagttcatgtttatcggttggccacatccaattctgttgagggacggatcatcaagaaagcttttggaaagttgaagctagagcacgttgtgatagggaagggacagttccagcaagacgccgccaagcctaacgccttagatgagggagagctgctggcgcttctgagggacgagcaggccgaagaagacaggatgatccagacggacatcagcgacgaggacctcctgaaggtgatggaccggagcgacctcaccggcgcgcgtgcagcggcagatgctgccccgcacttccccctgaaaggacctggctgggaggtcgtggtggctgccgggggcggtatgctctcagcgctcaccagctgagccccgggcccgctccagtgaccggcctgtcaacggcgaccgacgccttggtattctggtgcttcggctttgttcgtcgcctgtgttaaggccgatgtttttgtgaacatgatgtggacatgacaacggcatcctaccccccctaagtaattatggacgaccgaggcgttgcagtgtgtactgtactgcaccccctagattaggagctgatcgatcctttggcgagctgtgttgtgatgtaactcgagctcgtgccttcatccaaggcaaccgacgacctagtagctatgtaagactcttatggtagtagtctgtgctgaattagtcttgagatgagactgctaccccagtatgcattgctgtgctaatttctggtgtttttc

SEQ ID NO: 1413 - DNA, 3813 bp, Volvox carteri
cgcctgtcttcaaatacttcttcattcctctggcagtcggaattccaccgttttgttgtgtttatacagcgcttatcccgaacttttcggaattaaggcttggatattaaggaggctagtaacgtgagatagctcttcagcgaacctctgagcttctatcctcaaaagttcgtggaaatggatccgtctaaggttcgcccgagctcggcctacaactcgccatactggacgacaaacagcggagcgcccgtatggaacaacaacaactcgatgaccgtggggcctcggggacccatcctgctggaggactaccacctcatcgagaagctggcccagtttgaccgggagcgcatcccagagcgcgtcgtacacgcccggggcgctgcggctaagggcttcttcgaggtgacccacaatgtgtctcacctgaccgcggcagacttcctgcgcgcgcccggcgtccagacgcccgtcatcgtgcgcttctccactgtggtgcacgaacggggttcaccggagacgctgcgtgatccccgcggttttgcggtcaagttttatacccgcgaggggaactacgacatggtcggaaacaacatgccggtgttctttattcgcgacggcatgaagttccccgacatggtccacgccttcaagcctaaccccaagtctcacatccaggaggcctggcgcatcatggacttcctgtctcaccaccccgagtcggcccacatgctgacattcctgctggacgacgctggcattccgctcaactaccgccacatgcccgggttcggtgtccacacattcaagctcatcaacagggcgggcaaggagacgtacgtcaagtttcactggattcccaagtgcggcgagaagtacctgctggacgacgaggcagtgctggtgggcggggctaaccacagccacgccaccaaggatctctacgacgctatcgcggcaggtgactacccggagtggactttgatgattcagacgatggatcctgccgacgaggacaagtttgattttgacccgcttgatgtgacgaagacgtggcccgagtccctgtttccattgcagcctgttggccgcatggtcctcaaccgcaacgtggataactttttcaacgacaacgagcaggtggccttttgccccgccatcattgtgccaggcattggctacacggatgacaagctgctgcagacgcgcatcttctcgtacgcggacactcagcggcaccgcctcggccccaactacctgctgctgccggtgaatgcgccgcgatgcccccaccataacaaccaccatgagggcttcatgaatatcatgcaccgggacgaggagatcaactatttcccgtcaaggttcgaccctgttcgcaacgccgagcgcgtggctgccgtgtcgactgcgccgctgtctggacgccgcgagaaggtggttattgccaaggagaacaacttcgcgcaggctggtgcccgatggcggtcattcgaccctgctcgtcaggagcgccttgtggtgcgggtggcagatatgctggccgatccacgctgcacgcaggagattcggcgcatctgggtgggctactggtcccaggcggatccgcagctgggctcccgtattgctgccaagctgcaggggcgcggctgcctgtgagatgctatgagctctcggttcctcgggataacgggcacggcgacgcaggcaccgaacggtgttggccaatcgcttttgtgatgtcaactgtcacgtcattggctggtttgtcggtggctgtgatgtgctttgtagttactggtattgttgtggtgcaaaggggctccggcttcgtcaacattgacgggtcttttgacacagcgcagtgcaaggcgccatagcgcaacgccgttgcatgccgcctctcatgcatctcttcagtgcggatgggacaaagtgatacggcgtctgtcagcttgcgggacatataagctactcgccgcttggcccgaggcgacgttcatggcgctcgttgcctaaaaggtcctagttttgggtatccgcaatgtactaagatgcgaggttgcggatggttctgtccattgcatgccgtgttgagcttgcagggcaaggcaataacgtgttgccatttcatcgctgaattaggcttgaattaattttggcgcttacggcataatcgcgcgtgcgcctcttgtgggtgaaccgactgtgtcccgtttgtggagtgtgcatccggggtacccagcggcattaattcttgttcgcattctttttttagtcggatagcggcatcctctgtaatttaagcacaccggtatgtctggcgtagtaccctgcgtctgacagtgggacccgaataaacatccaaaacgtgctagatcgaagccaaatcctgtattatggttccaggagcaagagggcatttttgagtgagttctgggcggggcatctcaatgactcaattctacttgccttcagcgcccttataaaccttagcatctccacagcaaccgcccggcatgaccccaaagaccccaatccccactgtcatatgagatgtatcgtccgaagatgcgattactcgtacatgatgtatagcttacgaagcatctccgctcctgctcgggtactttgtctaccacggcgaaccagccagacatacagtgaacggcgtcacagcgacaatgacagctgtggagaatctgtcaaggcgaggacgtcagcgaacacacactctactaatcgaccgctggtcagggagtctgccgcactctacacatagtacgtcacatgactcaccgaaattctcacattcgacggcggcgagggattcgatgtacattgaccacatcgtcgtgaaaacggaccgacgtaagaacatacgatgtgtgaaacaggggtcatatcttcactcgtggcagctaccctgcgaaatcctgccttccccggtatttccctcatccagtcaccctagtcaacttctcagtggatcgctcaggttccgcacccaccaccagcatccaacggaatctgccgggtcgacagcggcccaactccattcctggtcggctcgcaggtcaacttaatcccaggtcaccaccgtccatcaactaggggcgcaataccttccaccattggaaggattttcgaccctgacgggtctcgattacgggatctcccgggggcaatggtcgcatattatcaatagtgcctaaccctagtatagaacacatggcagtttaaacgtactacgctcctaagcgatgttagcagaatgatccgcaaccatctcccactgcggaacaaacgaatttccagtacacctctccagcaccgccgccgtaccaaccatcctctgccccaaaggggtttcggtgttttgttcccgttcgactccttctggccatcgtggtacagccccgcccccgccccgttgcaactctccccatggaacggatctcacaacacctctccacccaagacatccagaacacacacgcacacacccctacaaggttgcccggcacagcgcagcacagcaaataaaaagacattacaacacgtgacaccaccgcataccacggtgccagcacagcacagcacagcacagcacaacccagattacatatcctaacccttgcctatgtttttcatattgccacgctcaccagcgtcaatacgatgtaactgctgctgccaccgcgcccctgcttctcccacatcccccccccttctctatccacgggtaaagggaatcctcgaatgcagccaggccatgatggtattccaagcatcagagcgaactgggaaacg

SEQ ID NO: 1414 - DNA, 2599 bp, Volvox carteri
tagacatactcacataaagctgttgatagcacattcctagccttcagcgtgaactccgtagcaagggagccagatcgctcttggatacttgctctccggagcgttgtcctccacacacagctgtaccagatctgatctgggataacaagcaagagataatggcgggattccggccgctcaaccttgtgcggcccttcctctcggtgctgccagatgtgcagcaagccgacaggcgcgtcccgttcagggagaagttcctttacacggcggtaacgctgttcatcttcctcgtctgctcccagctacccctctatggcatcaagacgaactctagctctgacccgttctactgggtgcgagtcatcatggcgtccaaccgcggaacttgtatggagctgggcatcagcccaattgtgacgtccggccttgttatgcaattacttgcgggctctaaaatcattgatgtcgacaacagcgttaaggcggaccgtgagctgctcaacggggcgcagaagctattgggcgtgttgatcaccatcggcgaagcggttgcctatgtcgtctccggcatgtacggcgatgttcgtgagcttggacccctaaatgctatccttattatcacacagctgttctttgccggcattatcgtcatttgccttgacgagctcctccagaagggttacggcctggggtccggcatctccctgttcattgccacgaatatctgcgagtccatcatctggaaggccttcagcccctacaccatccagagtgcccgtggtgctgagtttgagggcgccattatcgccatgttccacctcatcatcacccggacagacaaggttcgggcactgaaggaggctttctaccggactaacctgcccaacatgacgaacctgctcgccactattgcagtcttccttgtggtcatttatttccagggcttccgcgtggacctgccagtccgcaataagcgcgcgcgggggcagcagggtaactatcccatcaagctgttctacacgtccaacatgccaatcattctgcagtccgccctggtgtcaaacctgtacttcatttcccagctgctgtacaagaggtacggtggcaacttcctggtgcagctgctgggacgttggcagcagaccgagtacggtagtggccagatgattccagtcggcggtttggtgtactacatttcaccaccgagcagcctagcggaagttgcagcgaacccgctgcacgcgttgttctacgtgacgttcatgctcaccgcgtgtgcgctattctccaagacatggattgaggtttcgggcagcagcgctagcgatgttgccaagcagcttaaggagcagcagatgttcattcagggtcaccgtgacacgacagcctcgctaaagaaggagctcaatcggtacatccctattgcggctgctttcggtggcatgtgcattggcgcgttgacgatcgtggcggacttcatgggagcaatcggctcgggaactggtatccttctggcggttacgatcatttaccaatacttcgagacgtacgaaaaggagaaggcgcaggcgccaggggctctgttctaaagtagtgcttaagttggacactccttatataggttcaggtatagcgaggtgcctctttacgaggcatgatgcaggggcatgacataaagtacggtgctgggattgcgctgtcatgaccacgtccatggtgggagccccaaatgtcgtaatgcggcagcgtttaagcgggcaagctgtcgactagcccttgtgaagccattgtacattcgggctgtaatgaatgtacccgcggggacttgtgtgtttgacgtgcacactcgcggtcttaaggttgttgcggactaattaacctttgcccatgactttcacgttgaccttcaaatcatctgacgagagcagcttacgcaggaaattctgctgctgcagaatgcggtttaaacgcattgacgaatctaaccttatggaatgcttagacgcggggcgtgtgcaagcttgagtggaccttttgccttcgggtttttttttgtgggaccacagctcttgatagactcgatgcatcagttgggtcatggggtaacaatttaccgccgcggctgggtgttgggtctgcgtccttgtagtgttcgtgggcgggatgtctcttgacaacacttggtggtccttctgtgccggagttcaaagagtatcctgttaagggctggcgtgcacatggtggatacaaggtctcaaatctcttcatgacctgtgacatcctcctaaaggagtctctcgcgtcacacatgaccgtataaggtgcagggctgacagatattaaaactaagctctgcattgtcgtgagtaatatgagtaatatgacaaagcgtcgaatacggtggctctccgatgcatcactccatacaaggaaacttgttagatgaattgtatattgtttcaatatcatgccataagccagacctcaaattcttccttagaaacttggcgtcccgcgtcagtaaaaaagcatcagagtaatcacgacgccaccttgaaaatgaaaacatgtcctaatgtataacgaatattcctcaccg

SEQ ID NO: 1415 - DNA, 1656 bp, Gnetum gnemon
agctgctggtaggttttgtgaaaatgccgagcgagggtttcgcgttctgcatctggtgcggccgttcttgtcaatcttgccggaggtgcagacggcggacaggaaggtgccgttcagggaaaaggtgttgtatacggtgatttcgcttttcatctttctggtttgcagtcaactgccgctttatggaatccattctgccaccggcgccgatccattctactggatgcgtgtgattctggcgtccaatcgtggaactgttatggagctcggaattactccgattgttacttcggggcttgtcatgcagctgctcgccggatctaagataattgaggtcgataacagcgttcgcgaggatcgcgctcttctgaatggagctcagaagctgttaggagttctcataacaattggtgaggctgttgcatatgtgctttctggaatgtatggggatatccgtgagctcggagctggcaatgcgattcttattattctgcaattgttttttgcgggtatcattgtcatttgtttggacgagttgcttcagaaaggctatggattgggatcgggaatctctctgtttattgctactaatatctgtgagagcatcatctggaaagcatttagcccaacaacaattaatactggtagaggtgctgaatttgaaggagctgttattgcattgttccatttactgattacaaggactgacaaggttcgggctcttcgggaggcattttaccggcaaaatttgcccaatgtaaccaatttactggccacagtattagtattccttgttgtgatttactttcaaggatttagagttgttttacccgtgagatcaaggaatgcacggggtcaacaaggatcttaccctatcaaactattttatacttcaaacatgcccatcattttgcagtctgctctggtttcaaacctctactttatctctcagttactttacaggagatacagtggtaactttcttgtcaatctgttgggaaagtggaaggaatccgagtactcatcaggtggtcagtctattccagtgggcggtcttgtttactacatcacacccccttcaagtttggctgatatggcggccaatcctttccatgctttgttttacttaacgttcatgttgacggcatgtgctcttttctcgaaaacatggattgaagtatcaggctcttctgcaagagatgttgcgaagcaactcaaggagcaacaaatggtgatgccgggtcatagagaatccaatttacaaaaagagttgaatcgatacattcccactgccgcagcctttggagggatgtgcattggtgctcttactgtcatggctgatttcatgggtgctattggatcaggaacgggaattcttctagcagtgacaattatctatcaatactttgagacatttgaaaaagagagggccagtgagttgggtttctttggcttttaaagtttatttgactgatgtgttttgacaacgctgttctaagtgaacttctgaaagagtttgcattggtgggcaagtagcctttgtgctgttgaagcggctttaaaattttgcagctctgcaagagtgccttaaatgcaagaaaaatagtaatggatgtgagcatgtgagggaagccccaattgttataccgatgttta

SEQ ID NO: 1416 - DNA, 1934 bp, Abies balsamea
gattcctaacctctcggcctttttgtccatgtttggcttcaatccatgcttctgctctcaacgtcaaagggttttaaagggttttatgcttaattcttaacgcataagggttttaagaggtttttacacttaaaatcaaggcgagatcgtgcagatcggcggtctcctgcagcagatctggagttttccactgctaaatttgtatgtttagtattttgggtttcgcttccgagaagtaaaaatgccaagtggtggtgggtttcgggtgctgcatcttgtgaggccgtttctttcaatcttgcctgaggttcagacagctgaaaggaaagtgcccttcagggagaaggttctttacactgtaatttcgcttttcatctttttagtatgcagtcagttgcccttatatggcatacattcagcaaccggtgcggatccattctattggatgcgtgtaatactggcttctaatcgcggaactgttatggagctcggtattaccccaattgttacttcgggcctagtaatgcagcttctggcaggatccaagataatcgaggtggataatagtgttcgtgaagatcgggcactccttaatggggctcagaagttactcggtgtcctcatcacaataggtgaggcagttgcatatgtgctgtctggaatgtatggtgacatccgggaccttggagctggcaatgccatccttattatcgtccagctcttctttgctgggataattgtgatatgtttggacgagttactccagaaaggttatggattggggtctggcatttcattattcattgctactaatatatgtgagagcatcatatggaaggcatttagtcccactacaatcaatagtggacgaggtgcagagtttgagggagctgttattgcattgttccatttgttgataaccagaacagacaaggtcagggcgctccgggaagctttctaccggcaaaatcttccaaatgtcaccaacctgctagccactgttctggtttttcttgttgtcatatacttccagggttttcgtgttgttttgcctgtgaggtcaaagaatgcacgtgggcagcagggatcatatcctatcaagttattctatacttcaaacatgccaattattctacagtcagctcttgtgtcaaacttgtattttatttcccagttgctttaccgaaagtacagtggaaacttccttgtaaatttgttggggaagtggaaggagtctgaatactcatcaagtggtcagtttgttcctgtgggtggtcttgtttattacatcactccaccttccagcttggcagatatggcagcaaatcctttccacgcccttttctatttgacatttatgctgacagcctgtgcgcttttctcaaagacctggattgaagtgtctggttcctctgcaagagatgtggcaaaacagcttaaggaacaacaaatggttatgccaggccatagagaatctaatcttcaaaaagagctaaatcgttacataccaacagctgcagcttttggtggcatgtgcattggtgcccttactgtcatggctgattttatgggggctattggttccgggacaggaatacttcttgcagtgacaattatttatcagtacttcgagacattcgagaaggaacgggccagtgaactaggcttctttggtttttaatgcagtcattgtatttgataattttagaagttaaatttcagattaaactttaagttgtgctaattcgacggcgcttgaagcatgtcaatgctggggattttgatacccctttgtagttttacagccatcttttgctatagatattaaatagaattcacaaaagtcaaaactggcaggcagaaaagttctgtgtgctgtaccgacattgagatgtttagggcagtttcaataatttcatggtttttggaacaaa

SEQ ID NO: 1417 - DNA, 1822 bp, Cedrus atlantica
aatcgtgcagatcggccatctcctgcagcagatctggaaatttctgtggctaaatttgtaagtttgatattgtggccttcccttctgagaagaaaaaatgccaagtggtggtgggtttcgggtgctgcatcttgtgaggccgtttctttcaatcttgcctgaggtccagacagctgaaagaaaagtgccctttagagagaaggttctttacactgtaatctcgcttttcatctttttagtatgcagtcagttgcccctatatggtatacattcagcaactggtgcggatccattctattggatgcgtgtaattctggcctcaaatcgtggaactgttatggagcttggtattaccccaattgttacttcgggcctagtaatgcagcttttggccggatccaagataattgaggtggataatagtgttcgtgaagatcgggcacttcttaacggggctcagaagttactcggtgtcctcatcacaataggcgaggcagttgcatatgtgctgtctggaatgtatggtgacatccgggaccttggagctggcaatgccatccttattattgttcagctctttttcgctgggataattgtcatatgtttggacgagttactccagaaaggttatggattggggtctggcatttcgttatttattgctactaatatatgtgagagcatcatatggaaggcgtttagtcccactacaatcaatagtggacgaggtgcagagttcgagggagctgttattgcattgttccatttgttgataaccagaacagacaaggtccgggcattgcgggaagctttctaccggcagaatcttccaaatgttaccaacctgcttgccacagttctggtttttcttgttgtcatatacttccagggttttcgtgtggttttgccggtgaggtcaaagaatgcacgcgggcagcagggatcatatcctatcaagttattctatacctctaacatgccaattattctacagtcagcccttgtttcaaacttgtattttatttcccagttgctttaccgaaagtacagtggaaacttcctcgtaaatttgttgggcaagtggaaggagtctgaatactcatcaagtggtcagtttgttcccgtgggtggtcttgtttattacatcactccaccttccagcttggcagatatggcagcaaatcctttccatgctcttttctatttgacttttatgctgacagcctgtgcgctgttctcaaagacctggattgaagtatctggttcctctgcaagagatgtggcaaaacagcttaaggaacaacaaatggttatgccaggccacagagaatctaatcttcagaaagagctaaatcggtacataccgacagctgcagcttttggtggcatgtgcattggtgcccttactgtcatggccgattttatgggggctattggttctgggacaggaatccttctcgcggtgacaattatttatcagtactttgagacatttgagaaggaaagggcaagtgaactaggtttctttggtttttaattcagtcatttgtatttgataattttagaggttacattttagattaaactttaagttgggctaattctatggcgcttgaagcatgtgaatgcgctggggattttgatacccctttgtagttttgcagccatcttttgatttagatattaaatagaagtcacaaaagtcaaaactggcaggcagaaaagtcctgtgtgctgtaccgatattgagatgtctaggatagtttgaaataacttattggttttgtgaacaaaagcaattttgtatagtagaaaaggccat

SEQ ID NO: 1418 - DNA, 2048 bp, Pinus pinaster
ccaaaactaaatgtccaacccatggagcggaaatcttaatttttattacttggcggaaggcaggacagacagaattctctgcatctgggctccctacaggtcggaaacccttggcctgcgcatccatgtttggtttcgatccatggttctgcccttaacatttcaggtttttaaggggtttcacgcttaattctgaacgtataggggttttaggagtgtttacgcttaattttaaggcgaaatcggtgcagatcggcgatctccggcagcagatctggagttttttggagctatatttgtaagcttgatatcttgggtttctcttccgagaaggaaaaatgccaagtggtggcgggtttcgggtgcttcatctagtgaggccatttctgtcaatcttgcccgaggtccagacagctgaaagaaaagtgcccttcagagagaaggttctgtacactgtaatctcgctttttatctttttagtatgcagtcagttgcccctatatggcatacattcagcaactggggcggatccattctactggatgcgtgtaattctggcttctaatcgtggaactgttatggagcttggtattaccccaatcgttacttcgggcctagtaatgcagcttttggcaggatccaagataattgaggtggataacagtgttcgtgaagatcgggctcttcttaatggggctcagaagttactcggtgtcctcatcacaataggtgaggcagttgcatacgtgctgtctggaatgtatggtgacatccgggacctcggagctggcaatgccatcctcattattgtccagctctttttcgctggtataattgtgatatgtttggacgagctactccagaaaggttatggattgggatctggcatttcattattcattgctactaatatatgcgagagcattatatggaaggcctttagtcccactacaatcaatagtggacgaggtgcagagttcgagggagctgttattgcattgttccatttgttgataaccagaacagacaaggtccgggcactgcgggaagctttctaccggcagaatcttccaaatgttaccaacctgcttgctacagttctggtttttctcgttgtcatatacttccagggttttcgtgttgttttaccagtgaggtcaaagaatgcccgtgggcaacagggatcatatcctatcaagttattctatacctcaaacatgccaattattctacagtcagctcttgtttcaaacttgtattttatttcccagttgctttaccggaagtacagtggaaactttcttgttaatctgttgggcaagtggaaggagtctgaatattcatcaagtggtcaatttgttcctgtaggtggtcttgtttattacatcactccaccttccagcttggcggatatggcagcaaatccttttcatgcactgttctatttaacttttatgctgacagcctgtgctctattctcaaagacatggattgaggtatctggctcctctgcaagagatgtggcaaaacagctgaaggaacaacaaatggttatgccaggccacagagaatctaatcttcagaaagagctaaatcgttacataccaacagctgcggcatttggtggcatgtgcattggtgcccttactgtcatggctgattttatgggggccattggttctgggacaggaattcttcttgcagtgactattatttatcagtactttgagacattcgagaaggaaagggccagtgaactaggtttctttggtttttaatgcagtcatttgtatttgacaattttagaggttaggatgcagactaaactttagttgggctaatgctatggcccttgaagcatgtgaatgctggggattttgatgccccttcgaagttttgcagccatcttttgatttagatattaaatagaattcacagaagtcaaaactggcaggcagaaaagtcctgtgtgctgtactgacattgagatgtttagggcactttgaaataacttcttggtttttgggacaaaagcaattgtatagttg

SEQ ID NO: 1419 - DNA, 2259 bp, Pinus taeda
cctgccccgaggatgcttagcccgattcaaaatagataaatagtatttttcaaattaccatggcggatacgccatgtggcgggttaccattggttccatgacgtgtcgaggttgccatggaggtaggtgatacacaaatatatcagcaagccaaaactaaatgtccaacccatggagcggaaatcttaatttttattacttgcggaaggccggacagaattctgtgcatctgggctccctacaggtcgtaaacccttggcctgcgcatccatgtttggtttcgatccatggttctgcccttaacatttcaggtttttaaggtgtttcacgcttaattctgaacgtataagggttttaggagtgtttacgcttaattttaaggcgaaatcggtgcagatcggcgatctccggcagcagatctggagttttctgtagctatatttgtaagcttgatatctggggtttctctaccgagaagaaaaaatgccaagtggtggcgggtttcgggtgcttcatctagtgaggccatttctgtcaatcttgcccgaggtccagacagctgaaagaaaagtgcccttcagagagaaggttctgtatactgtaatctcgctttttatctttttagtatgcagtcagttacccctatatggcatacattcagcaactggggcggatccattctactggatgcgtgtaattctggcctctaatcgtggaactgttatggagcttggtattaccccaatcgttacttcgggcctagtaatgcagcttttggcaggatccaagataattgaggtggataacagtgttcgtgaagatcgggctcttcttaatggggctcagaagttactcggtgtcctcatcacaataggtgaggcagttgcatacgtgctgtctggaatgtatggtgacatccgggacctcggagctggcaatgccatcctcattattgtccagctctttttcgctggtataattgtgatatgtttggacgagttactccagaaaggttatggattgggatctggcatttcattattcattgctactaatatatgcgagagcattatatggaaggcctttagtcccactacaatcaatagtggacgaggtgcagagtttgagggagctgttattgcattgttccatttgttgataaccagaacagacaaggtccgggcactgcgggaagctttctaccggcagaatcttccaaatgttaccaacctgcttgctacagttctggtttttctcgttgtcatatacttccagggttttcgtgtcgttttaccagtgaggtcaaagaatgcccgtgggcaacagggatcatatcctatcaagttattctatacctcaaacatgcctattattctacagtcagctcttgtttcaaacttgtattttatttcccagttgctttaccggaagtacagtggaaactttcttgttaatctgttgggcaagtggaaggagtctgaatattcatcaagtggtcaatttgttcctgtgggtggtcttgtttattacatcactccaccttccagcttggcggatatggcagcaaatccttttcatgctctgttctatttaacttttatgctgacagcctgtgctctattctcaaagacatggattgaggtatctggctcctctgcaagagatgtggcaaaacagctgaaggaacaacaaatggttatgccaggccacagagaatctaatcttcagaaagagctaaatcgttacataccaacagctgcggcctttggtggcatgtgcattggtgcccttactgtcatggctgattttatgggggccattggttctgggacaggaattcttctcgcagtgactattatctatcagtactttgagacattcgagaaggaaagggccagtgaactaggtttctttggtttttaatgcagtcatttgtatttgacaattttagaggttaggattcagactaaactttagttgggctaatgctatggcccttgaagcatgtgaatgctggggattttgatgcccctttgaagttttgcagccatcttttgatttagatattaaatagaattcacagaagtcaaaactggcaggcagaaaagtcctgtgtgctgtactgacattgagatgtttagggcactttgaaataacttcttggttttttggacagaagcaattgtatagttgaaaggccatgtatttgtggtatttgcagttctttgtttagttacgtgaaatctttaaatgcaaaat

SEQ ID NO: 1420 - DNA, 2109 bp, Picea glauca
ttaattaaattaatcccccccccccccgatcactgggaagaaagatagcacagatttctattcatctgggctccccacgggctcgtaaaccctcggccttgtcatccatgttcggcttcgatccatgcttctgtcttaacgtttcagggttttgaggggtttcaggcttaattcttaacttataagggttttaagagtttttacgcttaattttaaggcgaaatctgtgcagatcggcgatctccggcagcagatctggagttttctggagctattttgttaagtttgagattttgggcttctctttgaagacgaaaaaatgccaagtggtggtgggtttcgggtgctgcatcttgtgaggccgtttctttcaatcttgcccgaggtccagacagctgaaagaaaagtgcccttcagggagaaggttctttacactgtaatctcgcttttcatctttttagtatgcagtcagttgcccctatatggcatacattcagcaactggtgcggatccattctattggatgcgtgtaattctggcttccaatcgtggaactgttatggagcttggtattaccccaattgtaacttcgggcctagtaatgcagcttttggcaggatccaagataattgaggtggataatagtgttcgtgaagatcgggcacttcttaatggggctcagaagttactcggtgtcctcatcacaataggtgaggcagttgcatatgtgctgtctggaatgtatggtgatatccgggaccttggagctggcaatgccatccttatcattgtccagctctttttcgctggtataattgtgatatgtttggacgagttactccagaaaggttatggattggggtctggcatttcattattcattgctaccaatatatgtgagagcatcatatggaaagcgtttagtcccactacaatcaatagtggacgaggtgcagagttcgaaggagctgttattgcattgttccatttgttaataaccagaacagacaaggtccgggcactgcgggaagctttctaccggcagaatcttccaaatgtcaccaacctgcttgccacagttctggtttttctcgttgtcatatacttccagggttttcgtgttgttttacctgtgaggtcaaagaatgcacgtgggcaacaaggatcatatcctatcaagttattctatacatcgaacatgccaattattctacagtcagctcttgtttcaaacttgtattttatttcccagttgctttaccgaaagtacagtggaaactttcttgttaatttgttgggcaagtggaaggagtctgaatactcatcaagtggtcaagttgttcctgtgggtggtcttgtttattacatcactccaccttccagcttggcagatatggcagcaaatcctttccatgctcttttctatttgacttttatgctgacagcctgtgcgctgttctcaaagacctggattgaagtatctggttcctctgcaagagatgtggcaaagcagcttaaggaacaacaaatggttatgccaggccacagagaatctaatcttcagaaagagctaaatcgttacataccgacagctgcagcttttggtggcatgtgcattggtgcccttactgtcatggccgattttatgggggctattggttctgggacaggaatccttctcgcagtgactattatttatcagtactttgagacatttgagaaggaaagggccagtgaactaggtttctttggtttttaatgcagtcatctgtatttgataatttagaggttagatttcagactaaactttagttgggctaattctatggcccttgaagcatgtgaatgctggggattttgatgcccctttgaagttttgcagccatcttttgatttagatattaaatagaattcacagaagtcaaaactggcaggcagaaaaagtcctgtgtgctgtactgacattgagatgtttagggtagcttgaaataacttcttggattttgaacaaaagcaattgtatagtagaaaggccatgtatttgtggtatttgcagttctttgtttagttttgtgaaatctttaaatgcaaaataaatattggttaatt

SEQ ID NO: 1421 - DNA, 2138 bp, Abies balsamea
taacattggggagagcgaggccgacttgaagggcaagcaaagcaatttctaatcaataagcaaaaccaggagctgcttcaaagatgaatttgtaattgtctgagcgttagtttctacgcttaattcattggagggtatggagaagctagaataggcagctgctactttaaaggcagaggcgagtctattgtagatcgggaatcccctgcagcggatcggaagttttacgggcccaaatttgtaagtttgataatttggactgcactccagagaagaaaaaatgccgagcggtgggtttcgagtgctgcatcttgtgagaccatttctttcaatcttgcctgaggtccagacagctgaaagaaaagtgccctttagggagaaggttctttacactgtaatctcccttttcatctttttagtatgcagtcagttgcctctatatggaatacattcagcaaccggtgcggatccattctattggatgcgtgtaattctggcttctaatcggggaactgttatggaacttggtattactccaattgttacttcgggcctagtaatgcaacttttggcaggatccaagataattgaggtggataatagtgttcgtgaagatcgggcacttcttaatggggctcagaagttacttggtgtcctcatcacaataggtgaggcagttgcatatgtactgtctggaatgtatggtgacatcgcagaccttggagctggcaatgccatccttattattgtccagctcttttttgctggtataattgtgatatgtttggacgagttactccagaaaggttatggattggggtctggcatttcgttattcattgctactaatatatgtgagagcatcatatggaaggcatttagtccaacaacaataaatagtggacgaggtgcagagtttgagggagctgtcattgcattgttccatttgttgataaccagaactgacaaggtccgggctctgcgggaagctttttaccggcagaatctaccaaatgtcaccaacctgcttgccacagttttggtttttcttgttgtcatatacttccaaggttttcgtgttgttctgcctgtgaggtcaaagaatgcgcgtgggcaacaagggtcataccctatcaagttattctatacctcaaacatgccaattattctgcagtcagctcttgtttcaaatttgtattttatttcacagctgctatacagaaagtacagtggaaacttccttgttaatatgttgggcaagtggaaggagtctgaatactcatcaagtggtcagtctgttcctgtgggtggtcttgtttattacatcactccaccatccagcttggcagagatggcagcaaatccttttcatgctcttttctatttgacttttatgctgacagcatgtgcgctgttctcaaaaacatggattgaagtatccggttcctctgccagagatgtggcaaaacagcttaaggagcaacaaatggttatgccaggccacagagaatccaatcttcagaaagagctaaatcgttacataccaacagctgcagcctttggtggcatgtgcatcggtgctcttactgtcatggctgattttatgggggctatcggttctggtacaggaatccttcttgcagtgactattatttaccagtactttgagacatttgagaaggaaagggccagtgaactaggtttctttggtttttaatgcattcatttgcatttgatatttttataaattacatttcagattaaagtttgagttgggctaatgctctggccattagagcatttgaatgctggggattttacacccctttgaagttttgcagccatattttcattagatcttaaatctaagagctcacaaaaatcaaaactggcaggcagaaaagttctgcgtctgtactgacaatgagatgtcttaggtagtttaaaaaacttattgggtttttgaacaaaggctactgtacactaaaaaggtcattcatttatggtttttggtggtatttgcagtgctttgtttagttacttgaagtctttagatgcaaaataagtaattgttaatttcattaaaaaacaatctgcagatttgtaaacagaagtatatgtgcatgaatacagtagag

SEQ ID NO: 1422 - DNA, 1947 bp, Cedrus atlantica
acgactcagcaaagcaatttcgtaatgaataagcaaaaccaggaggttgcttcccgagatgatttgtaatcgtttaagggtagctttacgcttaattcattggagggtacggaggcgctcgaataggcagctgctgcttcaaaagcataggccaatctgttgcagatcggtaatccctacagcggatcgggagttttccgtgtccaaatttgtcagttagataatttggactgttctccagagaggaaaaatgccgagcggtgggtttcgagtgctccatcttgtgagaccatttctttcaatcttgcctgaggtccagacagctgaaagaaaagtgccttttagggagaaggttctttacactgtaatctcccttttcatctttttagtctgcagtcagttgcctctatatggaatacattcagcaaccggtgcagatccattctattggatgcgtgtaattctggcttccaatcggggaactgttatggaacttggtattaccccaattgttacgtcgggcctagtaatgcaacttttggcaggatccaagataattgaggtggataatagtgttcgtgaagatcgggcacttcttaatggggctcagaagttacttggtgtcctcatcacaataggtgaggcagttgcatatgtgctgtctggaatgtatggtgacatcgcagaccttggagctggcaatgccatccttattattgtccagctcttttttgctggaataattgtgatatgcttggatgagttactccagaaaggttatggattggggtctggcatatcattattcattgctaccaatatatgtgagagcatcatatggaaggcgtttagtccaacaacaattaatagtggacgaggtgcagagtttgagggagctgtcattgcattgttccatttgttgataaccagaactgacaaggtccgagctctgcgggaagctttttacaggcagaatctaccaaatgtcaccaacctgcttgccacagttttggtttttcttgttgtcatatacttccaaggttttcgtgttgttttgcctgtgaggtcaaagaatgcacgtgggcaacagggctcatatcctatcaagttattctatacctcaaacatgccaattattctgcagtcagctcttgtttcaaatttgtattttatttcccagctgctttatagaaagtacagtggaaacttccttgttaatatgttgggcaagtggaaggagtctgaatactcatcaagtggtcagtctgttccagtaggtggtcttgtttattacatcactccaccttcaagcttggcggagatggcagcaaatcctttccatgctcttttctatttgacttttatgctgacagcatgtgcgctgttctcaaagacatggattgaagtatctggttcctctgccagagatgtggcaaaacagcttaaggagcaacaaatggttatgccaggccacagagaatccaatcttcagaaagagctaaatcgttacataccaacagctgcagcttttggaggcatgtgcatcggtgctcttactgtcatggctgattttatgggggctattggttctggtacaggaatccttcttgcagtaactattatttaccaatacttcgagacatttgagaaggaaagggccagtgaactaggtttctttggtttttaatgcattcatttgcattttatatttttacaaatcacatttcagcttaaactttgagttgggccaatgctctggccattacagcatttgaatgctctggggattttacacccctttgaagttttgcagccatctttgattagattttaaacagaagaattcacaaaagtcaaaactggcaggcagaaaagtcctgcgtgctgtactgacaatgagttgtccatgttagtttaaaaatacttcttggtttttgaacaggggct

SEQ ID NO: 1423 - DNA, 2122 bp, Pinus taeda
gatgacatgaatggccattaaagccatttgctgtgaataagcagagccaggcagtgctgcaaaggcgagtttgtcatcgactaagggttagtaagcacccttaattcattagagggcatggaggtgctaggttaggcagctggtgtttcgaaggcagaggcgcatctattgcagatcgttaatcccctgcagcggatcagtagttttccgggctcaaatttgtaagtttgttaatctggactgttcttcggagaaggaaaaatgccaagcggtgggtttcgtgtgctgcatcttgtgagaccatttctttcaatcttaccagaagtccagacagctgaaagaaaagtaccctttagggagaaggttctttacactgtaatctcccttttcatctttctcgtatgcagtcagttgcctctatatggaatacattcagcaaccggtgcggatccattctattggatgcgtgtaattctggcttctaatcggggaactgttatggaacttggtatcaccccaattgttacctcgggcctagtaatgcaacttttggcaggatccaagataatcgaggtggataatagtgttcgtgaagatcgggcactgctcaatggtgctcagaagttacttggagttctcatcacaataggtgaggcagttgcatatgtgctgtctggaatgtatggtgacatcgcagaccttggagctggcaatgccatccttattattgtccagctcttttttgctggtataattgtgatatgtttggatgagttactccagaaagggtatggattggggtctggcatttcgttgttcattgctactaatatatgtgagagcataatatggaaggcatttagtcctacaacaattaatagtggacgaggtgcagagtttgagggagctgtcattgcattgttccatttgttgataaccagaactgacaaggtccgggctctgcgagaagctttttataggcagaatctaccaaatgtcaccaaccttcttgccacagttttggtttttctcgttgtaatatacttccaaggttttcgtgttgttttgcctgtgaggtcaaagaatgcacgtgggcagcagggatcatatcctatcaagttattctatacctcaaacatgccaattattctgcagtcagctcttgtttcaaatttgtattttatttcccagttgctttatagaaagtacagtggaaacttccttgttaatatgttgggaaagtggaaggagtctgaatactcagcaagtggtcagtcagttcctgtaggtggtcttgtttattacattactccaccttcgagcttggcagagatggcagcaaatcccttccatgctcttttctatttgacttttatgctgacagcatgtgcactgttttcaaagacatggattgaagtatctggttcctctgccagagatgtggcaaaacaactaaaggagcaacaaatggttatgccaggtcacagagaatctaatcttcagaaagagctaaatcgttacataccaacagctgcagcttttggtggcatgtgcattggtgctcttactgtcatggctgattttatgggggctattggttccggtacaggaatccttcttgcagtaactattatttaccagtactttgagacatttgagaaggaaagggccagtgaactaggtttctttggtttttagtgcatttgtttgcattttatatttgtagagattacatctcagattaaactttgagttgtgctcatgctctggccatcaaagcatttgaatgctgggggttttacacccctttaaagttttgcagcgatattttgattagatcttcaatgtaagacttcacggaagtcaaaaactggcaggcagaaaaagtcctacatgctgtactgacaatgagatgtctagggtagtttaaaataacttcttgttctttttgaataaatcttgttgtaaaagtagaggccactcagttttggtgatattttcagtgctttgtttagttatgtgaattcattagatgcaaaacaagtattggttaatttcatgaaaaccaatctgcagaattggaaatgtaagcatatgtgcatgaatgtagtagagaaagggg

SEQ ID NO: 1424 - DNA, 2001 bp, Podocarpus macrophillus
tattgttgcagatcgagactttaagaagcagatcgaaacccatttcctaatttcaaagttcaacaatttgaggttcctttccatacaggaaaaatgccttctggtggatttagggtgttgcaccttgtgagaccatttctctcagttttgcccgaggttcaaacagctgaaaggaaagtgccttttagggagaaggttctttacactgtaatctcccttttcattttcttggtatgcagtcagttgcctttgtatgggatacattcagctacaggcgcagatccattctattggatgcgtgtcattctggcctctaatcgtggaactgtcatggaacttggtataaccccaatagttacttcaggccttgttatgcagctcttggcaggttcaaagataattgaagtggacaatagtgttcgagaagatcgtgcactcttgaatggggcccaaaagttacttggtgttcttatcacaatcggtgaagcagttgcatatgtgctttcgggaatgtatggtgacattagggatcttggggccggcaatgcaatccttattattgtgcagctcttttttgctggtataattgtgatttgtttggatgagctactccagaaaggttatgggctgggctctggcatatcgttattcattgccactaacatatgtgagagtatcatatggaaggcatttagtcccacaaccatcaacagtggacgaggtgcagagtttgagggagctgtcattgcattgttccatttgttgattaccagaacagacaaggttcgagcacttagagaggctttttataggcaaaaccttccgaatgtgaccaacttacttgcaacagttctggttttccttattgtaatatacttccaaggttttcgtgttgttttacctgtgagatccaagaacgcacgtgggcaacaaggttcttatcctatcaagctattttacacatctaacatgccaattattctacaatcagctcttgtttcaaacttgtatttcatttctcagttgctctatagaaggtacagtggaaacatcttggttaatttgttaggaaaatggaaggagtccgagtattcatcgagtggccagtttgtccctgttggtggccttgtctattacatcactccaccttccagtttggcagagatggcagcaaatccgtttcatgcacttttctatctaactttcatgctaacagcgtgtgcactcttttcaaagacatggattgaagtatctggttcctctgccagagatgtagctaaacaacttaaggagcaacaaatggtcatgcctggtcacagagagtctaatctccagaaagagctaaaccgatacataccaactgctgcagcttttggtggcatgtgcattggtgctctgactgttatggctgattttatgggtgcaattggttctgggacaggaattcttcttgctgtaactattatctaccaatactttgaaacctttgagaaggaaagagccagtgaattgggtttctttggtttttaaccatagtttgctgaactccataattttagaaattacgtttctaatgagacttttaattgggctaattctccggccactgaaggatgttagtgtggggttcttacctcgtcattgcaattttgcagtcatctcaggtttaaatgtcaaatggaaagaatccacagaagtaaaatcaatcctgcaggcagaacagccctgtgttttattgacattgagttgagtcttaagagtagtttaaatttccttaaaaaatgcatttgtatactgaaaaaggccatggatttgtgagatttggtggtgtagagtctttttaaagagaaaggatatctttcagagtaccacctcgacagcagacgacaattaccctaacaagaatgggagagattttccaatggcaaccgaagtcatccaagactttcacgaatgtgaatgtgattttcggctaatagaaccccactcttgaatgtattg

SEQ ID NO: 1425 - DNA, 1969 bp, Pseudotsuga menziesii
ggaatgtatagccagaaccaggaggtgcttcaaaggcgagtttctacgcttaattaatcggagggcatggaggcgctaaaataggcagctgctgcttcaaaggcagaggcaattctatctcagatcggcaatcccctccagcggatcgggagttttccgggctcaaatttgtaagtttgatattttggactgctcttcagtgaataaaaaatgccgagcggtgggtttcgagtgctacatcttgtgagaccatttctttcaatattgcctgaggtccagacagctgaaagaaaagtgccctttagagagaaagttctttacactgtcatctcccttttcatcttcttagtatgcagtcagttgcctctatatgggatacattcagcaaccggtgcagatccattctattggatgcgtgtaattctggcttctaaccggggaactgttatggaacttggtattaccccaattgttacctcggggttagtaatgcaacttttggcaggatccaaaataattgaggtggataatagtgttcgtgaagatcgggcactgcttaatggggctcagaagttactgggtgttctcatcacaataggtgaggcagttgcatatgtgctgtctggaatgtatggtgacatctcagatcttggagctggcaatgccatcctcattattgtccagctcttttttgctggtataatagtgatatgtttggacgagctactccagaaaggttatggattggggtctggcatttcgttatttattgctactaatatatgcgagagcatcatatggaaggcatttagtcctacaacaattaatagtgggcgaggggcagagttcgagggagctgtcattgcattgttccatttgttgataaccagaactgacaaggtccgggctctgcgggaagctttttaccggcagaatctaccaaatgtcaccaacctgcttgccacagttttggtttttctggttgtcatatacttccaaggttttcgcgttgttttgcctgtgaggtcaaagaatgcacgtggtcagcaggggtcatatcctatcaagttattctatacctcaaacatgccaattattctgcagtcagctcttgtttcaaatttgtattttatttcccagcttctttacagaaagtacagtggaaacttccttgtcaatatgttgggcaagtggaaagaatctgaatactcatcaagtggtcagtctgttcctgtgggtggtcttgtttattacatcactccaccttccagcttggcagagatggcagcaaatcctttccatgctcttttttatttgacttttatgctgacagcatgtgcactgttctcgaagacatggattgaagtatctggttcctctgcaagagatgtggcaaaacagcttaaggagcaacaaatggttatgccaggccacagagaatctaatttacagaaagaactaaatcgttacataccaacagctgcagcttttggtggcatgtgcattggtgctcttactgtcatggctgattttatgggagctattggttctggtactggaatccttcttgcagtaactattatttaccagtactttgagacatttgagaaggaaagggcgagtgaactaggcttctttggtttttaatgcattcatttgcatttgatatttttataaattacatttcatattaaactttgagttgggttaatgctttggccgttgaagcatttgaatgctggggattttacacccctttgaagttttgcagccatcttttgattagagcttaaatatgagaattcacaaaagtcaaaactggcaggcagaaaagtcctgcgtgctgtactgacaatgagatgtcatagggtagtttaaaggaacttcttggttttttgaacaaaggctattgtatactagaaaggccattcatttgttgtttttgctggtatttgcagcgttttgttta

SEQ ID NO: 1426 - DNA, 2103 bp, Pseudotsuga menziesii
agacagatagcacatgattctattcatctgtgctctgtacaggttcggaaaccctcggccttgtcatccatgtttggcttcgatccatgcttatggccgtgccatttaagggttttaaggggtttctcgcctaaaatttaagcgtttaagtgttttaaggagtatttacgcttaattttaaggccaagcggtgtagatcggcgatctcctgcaacagatctggagctttctgcggtcatatttgcaagttttgaaattttgggtttctcttccgagaacaaaaaatgccgagtggtggcgggtttcgggtgctgcatcttgtgaggccgtttctttcaatcttgcctgaggtccagaccgctgaaagaaaagtgccctttagggagaaggttctttacaccgtaatctcgcttttcatctttttagtatgcagtcagttgcccctgtacggcatacattcagcaaccggtgcggatccattttattggatgcgtgtaattctggcttctaatcgtggaactgttatggagcttggtatcacgccaattgttacttcgggcttagtaatgcagcttttggcaggatccaagataattgaggtggataatagtgttcgtgaagatcgggcgcttcttaatggggctcagaagttactcggtgtcctcatcacaataggtgaggcagttgcgtatgtgctgtctggaatgtatggtgacatccgggaccttggagctggcaatgccatccttattattgtccagctctttttcgctggtataattgtgatatgtttggacgagttactccagaaaggttatggactggggtctggcatttcgttattcattgctactaatatatgtgagagcatcatatggaaggcgtttagtcccactacaatcaacactggacgaggtgcagagtttgagggagctgtcattgcattgttccatttgttgataaccagaacagacaaggtccgggcactgcgggaagctttctacaggcaaaatcttccaaatgttaccaacttacttgccacggttttggtttttctcgttgtcatatacttccagggtttccgtgttgttttacctgtgaggtcaaagaatgcacgcgggcagcagggatcatatcctatcaagttattctatacctcaaacatgccaattattcttcagtcggctcttgtttcaaacttgtattttatttcccagttgctttaccgaaagtacagtgggaactttcttgttaatatgttgggcaagtggaaggagtctgaatactcatcaagtggtcagtttgttcctgttggtggtcttgtttattacattactccaccttccagcttggcagctatggcagcaaatcctttccatgctcttttctatttgacttttatgctgacagcctgtgcgctgttctcaaagacctggattgaagtatctggttcctctgcaagagatgtggcaaaacagcttaaggaacaacaaatggttatgccaggccacagagaatctaatcttcaaaaagagctaaatcgttacataccgacagctgcagcttttggtggcatgtgcattggcgcccttactgtcatggctgattttatgggggctattggttctgggacaggaatccttcttgcagtgactattatttatcagtactttgagacatttgagaaggaaagggccagtgaactaggtttctttggattttaatgcagtcatttgtatttgctaattttagaggttacatttcagactaaactttcgtcgggctaattctatggcccttgaagcatgtgaatgcctggggattttgatgcccctttgaagttttgcagccatcttttgatttagatattaaatagaattcacaaaagtcaaaactggcaggaagaaaaagtcctgtgtgctgtactgacattgagatgtctagggtagtttgaaataacttagttttttgaacaaaagcaattgtatagtagaaaggccatgtatttgtggtatttgcagttctttgtttagttatgtgaaatctttaaatgaaaaataaaaatgggttgatttcatgactgttgcagcaggtgtacatatt

SEQ ID NO: 1427 - DNA, 2174 bp, Ceratodon purpureus
cgatcgatttcggctcgacttggagtgcgcgtcgcctcggcggggagtcaaggaagcctgcattgtgcacatcaagcgccggatcggggttctcgtttttacgtggtatccgagcatttgtggttttaaccataagagatatagtggtgtcttgaaggatcaagcggtgacctcaggagcaggagctttagtagctcgggtcttgggcttgtagacagcgtttggagtttggtttagaagaccggttaaaatggggggcggttttcgagttttacatctggttcggcctttcttatcggtgttgccggaggtccaaaccgcggagaggagggttccgtttagggagaaggttatgtacactgtagtttcgcttttcatctttctggtttgcagtcagttgcctctttatggaattcactccgcgaccgggtcagatcctttctattggatgagggtgatccttgcgtctaaccgaggtacggtgatggagctgggaattactcccatcgttacttcagggcttgttatgcagctattggctgggtcgaagctcattgaggttgacaacagtgtgagggaggacagggctcttcttaatggtgcccagaagctcctcggtgtcttgatcaccattggagaggcagtcgcatatgtgctgtccggcatgtacggagacgttcgcgaccttggtgctggcaatgcgattcttatcatcattcagctctttttcgccggaatcattgttatctgtctcgatgagttgttgcagaagggctacgggcttgggtctggaatttctctgttcattgcaaccaatatctgtgagaacatcatctggaaggcgttcagcccgaccaccatcaatagtggccgtggagcagagttcgagggagcagtgattgctctcttccatctcctgttcacgagatcagacaaagtcagagctctgaaggaggcattctaccgacaaaatcttcccaacgttaccaatctgttggcaactgttgttgtattcctcattgtcatctacttccaagggttcagggtagttctcccagtccgttccaagagcgcacgtggtcaacaaggatcgtacccaattaagctgttctatacgtctaacatgcccatcattctccagagtgccctcgtctccaacttgtatttcatttcacagcttttgttcaagagatacagcaacaactttgtcgtgaatctacttggcaagtggaaggagtcagaatactcacagagcggtcaactcattcctgttggagggcttgtttactacataactcctcctacaagcctcggagacatcgttgcaaaccctttccacgccgttttctacttgacctttatgctgacggcttgtgcgctcttctccaagacatggattgaagtgtcaggatcatctgctcgagatgtcgccaagcagctcaaggagcaacaaatgttcatgcctgggcatcgtgaatccaaccttcaaagggagttgaaccgctacattcccacagctgccgcttttggagggatgtgcattggagctttgacggttgttgctgacttcatgggcgctattggttccggaactggtatccttctcgcagtcacgatcatttaccagtatttcgaaaccttcgacaaggagcgggctagtgaacttggattcttcggattttagttccaaagaagctctaatgcaagatatcattccctgtaacctgaggcttttcgtttccaggttattgagattgtaagctgtattggtaccttctgttttatcagaagcactgaagaggatcatgtgtttagttacaatcaggtccgaatgaggggtcgttacgtggctatggaaaactattgaggatgagggtggcacaccccttgtagccgctctgccaaattttgcagttagtctttgtctagtaatcgcaattggtcctatcctctgaccctatgatttggaggtcaaccctcgcttgttgaattagcccactcttctgtgagtttaggggcgatttgtaacctatacctcatgacctcatatcagctgcaatgaaagttttcatcacgaaatatgtctcttatgatcagaccataagcagtaagtattatgttcctgttatcttagaattgacacttaggatttgactcaatttctttctattgag

SEQ ID NO: 1428 - DNA, 2165 bp, Ceratodon purpureus
cacagcgatcgatttcggctcgatttggagtgcgcgttgcttcggcggggattcaaggaagcctgcattgtgcacatcaagcgccggatcggggttctcgcttttacgtggtatccgagcacttgtggttttgaccataagagatatagtggtgttgagaaggatcaagcggtgacgtcaggagcaggagcataagtagctcgggtttttgggcttgtagacagcgtctgggtcttggtttagaagaccggttaaaaatggggggcggttttcgagttttacatctggttcggcctttcttatcggtgttgccggaggtccaaactgcggagaggagagttccgtttagggagaaggttatgtacactgtagtttcgcttttcatatttctggtttgcagtcagttgcctctgtatggaattcactccgcgaccgggtcagatcctttctactggatgagggtgatccttgcgtctaaccgaggtacagtgatggagctgggcattactcccatcgttacttcggggcttgtcatgcagctattggctgggtcgaagctcattgaggttgacaacagtgtgagggaggacagggctcttcttaatggtgcccagaagctcctcggtgtcttgatcaccatcggagaggcagtggcgtatgtgctgtccggcatgtatggagacgttcgcgaccttggtgctggcaatgcgattctcatcatcattcagctctttttcgccggaatcattgttatctgtctcgatgagttgttgcagaagggctacgggcttgggtctggcatttctctgttcattgcaaccaatatctgtgagaacatcatctggaaggcgttcagcccgaccaccatcaatagtggccgtggagcagagttcgagggagcagtgatcgctctcttccacctcctgttcacgagatcagacaaagtcagagctctgaaggaggcattctaccgacaaaatcttcctaacgttaccaatctgttggcaactgtcgttgtattcctcattgtcatctacttccaggggtttagggtagttctcccagtccgttccaagagcgcacgtggccaacaaggatcgtacccaatcaagctgttctatacgtctaacatgcccatcattctccagagtgccctcgtctccaacttgtatttcatttcacagcttttgttcaagagatacagcaacaactttgtggtgaatctacttggcaagtggaaggagtcagaatactcacagagcggtcaactcattcctgttggagggcttgtttactacataactcctcctacgagcctcggagacatcgttgcaaaccctttccacgccgttttctacttgacctttatgctgacggcttgtgcgctcttctccaagacatggattgaagtgtcaggatcatctgctcgggatgtcgccaagcagctgaaggagcaacaaatgttcatgcctgggcatcgtgaatccaaccttcaaagggagttgaaccgctacattcccacagctgccgcttttggaggcatgtgcatcggagctttgacggttgttgccgacttcatgggcgctattggttccggaactggtatccttctcgcggtcactatcatttaccagtacttcgaaacctttgacaaggagcgagctagtgagcttggattcttcggattttagttccaaagaagctctttagatccaagatatcattctctgtaacctgaaactttttgtttcgaggttattgggattgtgagctgtattggtaacttctgttttatcagaagcactgatgaggatcaagtgtttagttacaatcaggtccgaatgaggggtcgttacgtggctaggaaaactattgaggatgaggatgagggtggcacacccctgtagccgctctgccaaattttgcagttagtcaatgtctagtaatcacaattggtcctatcctctgaccctatgatttggaagtcaaccctcactggttgaatttgcccactcttctgtgagttcacgggcgatttgtaatctatacctcatggcctcatattagctgcaatgaaagttttcatcacgaaatatgtctcttttgatcagacgataagcagtaagatgtagcatgttcttgttatcgaatagttgacacttagc

SEQ ID NO: 1429 - DNA, 1997 bp, Cephalotaxus harringtonia
tgcgatgcagtttcccccgaggtgaagcggatgagtgttattcgcgagcattatttacggcccagatttacatcaccaattttgagattcgggttcgcactgcaaatttgttgcagatcggggctcgtcggcatcagatcgcttcaattcaaagtttaatatattggttttcccttccaagaaaaaatgcccagtggcggatttagggttctacaccttgtgaggccgttcctttcaattttgcccgaggttcagacagctgaaagaaaagttcccttcagggagaaggttctttacactgtaatctcccttttcatatttctggtatgcagtcagttgcctctgtatggcatacattcagctacaggtgcagatccattctattggatgcgtgtaatcctggcctccaatcgtggaactgtcatggaacttggtattacacccattgttacttcaggcttggtgatgcagcttttggcagggtcaaagataattgaggtggacaatagtgttagagaagatcgtgcactcttgaatggggcccaaaagttactgggtgtccttatcacaattggtgaagcagttgcatacgtgctttcaggaatgtatggtgacatcagggaccttggggctggcaatgccattcttattattgtacaactcttttttgctggtataattgtgatatgtttggatgagttgctacagaaaggctatggattgggctccggcatttccttattcattgcaactaacatatgtgagagtatcatatggaaggcatttagtcccacaacaattaatagtggacgaggtgctgagtttgaaggagctgtcattgcattgttccatttgttaataacccgaacagacaaggttcgtgccctcagagaagctttttacaggcagaaccttccaaatgtgaccaacctgcttgcaacggttttggtttttctcattgtgatatacttccaaggcttccgggttgttttgcctgtgagatcaaagaatgcacgtgggcagcaaggatcatatcctattaagctattttatacatctaacatgccaatcattctgcagtcagctctggtttcgaacttgtatttcatttctcagttgctctacagaaggtacagtgggaacgtcctcattaatttgctaggaaagtggaaagaatctgaatattcatcaagtggtcagtttattcctgtgggcggtcttgtctattacatcactccaccttccagcttggcggagatggcagcaaaccctttccatgctcttttctatttgacttttatgctgacagcatgtgcactcttctcaaagacatggattgaagtatcaggttcctctgctagagatgtggcaaaacagctaaaggagcaacaaatggttatgccgggccacagagaatctaatcttcagaaggagctgaaccgttacataccaactgctgcagcttttggtggcatgtgcattggggctcttactgtcatggctgactttatgggtgctattggttctgggacgggaattcttcttgctgtaaccattatctaccagtactttgagacctttgagaaggaaagggccagtgaattaggtttctttggtttttaaatgacatcccattgaacttgatatttttagaaattatgtttcagatgagactttaaatttggctaattctctggccgttgaaggatgtgagtgtaggggatttgttcccaattgaagttttgcagccatcttctgatatagattacaaatgcaagaatgatttacacagaataaaaagctggcaggcagaaaggttctgtgtgttttactgacattgagatgttttagaataactaattcttatttgagcaaaagcacatgtacactataagaggcgatgaacttgtagctagtgtatacattgcttattttaaaaaatacgtgcagtcttcaaatgcaaagagatacttggtaatttgatgaaaaaatattag

SEQ ID NO: 1430 - DNA, 1789 bp, Pinus pinaster
atgacatgaacggcgactaaagccatttgctgtgaataagcagagccaggcagtgcttcaaaggcgagtttgtcatcgactaagggttagtaatcacccttaattcattagagggcatggaggtgctaggttaggcagctggtatttcgaaggcagaggcgcatctattgcagatcgttaatcccctgcagcggatcagtagttttccaggcccaaatttgtaagtttgttaatttggactgttctttggagaaggaaaaatgccaagcggtgggtttcgtgtgctgcatcttgtgagaccatttctttcaatcttaccagaagtccagacggctgaaagaaaagtaccctttagggagaaggttctttacactgtaatctcccttttcatctttctcgtatgcagtcagttgcctctatatggaatacattcagcaaccggtgcggatccattctattggatgcgtgtaattctggcttctaatcggggaactgtcatggaacttggtatcaccccaattgttacctcgggcctagtaatgcaacttttggcaggatccaagataatcgaggtggataatagtgttcgtgaagatcgggcactgctcaatggtgctcagaagttacttggagttctcatcacaataggtgaggcagttgcatatgtgctgtctggaatgtatggtgacatcgcagaccttggagctggcaatgccatccttattattgtccagctcttttttgctggtataattgtgatatgtttggatgagttactccagaaagggtatggattggggtctggcatttcgttgttcattgctactaatatatgtgagagcataatatggaaggcatttagtcctacaacaattaatagtggacgaggtgcagagtttgagggagctgtcattgcattgttccatttgttgataaccagaactgacaaggtccgggctctgcgagaagctttttataggcagaatctaccaaatgtcaccaacctgcttgccacagttttggtttttctcgttgtaatatacttccaaggttttcgtgttgttttacctgtgaggtcaaagaatgcacgtgggcagcaggggtcatatcctatcaagttattctatacctcaaacatgccaattattctgcagtcagctcttgtttcaaatttgtattttatttcccagctgctttatcgaaagtacagtggaaacttccttgttaatatgttgggaaagtggaaggagtctgaatactcagcaagcgggcagtcagttcctgtaggtggtcttgtttattacattactccaccttccagcttggcagagatggcagcaaatcccttccatgctcttttctatttgacttttatgctgaccgcatgtgcactgttttcaaagacatggattgaagtatctggttcctctgccagagatgtggcaaaacaactaaaggagcaacaaatggttatgccaggccacagagaatctaatcttcagaaagagctaaatcgttacataccaacagctgcagcttttggtggcatgtgcattggtgctcttactgtcatggctgattttatgggggctattggttccggtacagggatccttcttgcagtaactattatttaccagtactttgagacatttgagaaggaaagggccagtgaactaggtttctttggttttagtgcatttgtttgcattttatatttgtagagattacatctcagattaaactttgagttgggctcatgctctggccatcaaagcatttgaatgct

SEQ ID NO: 1431 - DNA, 1476 bp, Distylium racemosum
agagtcggagtttttagtggttgtatgtgaagtttgatatttttgtttactataaagaagttacaatgccgagcggtggatttagggtgttgcaccttgtgcggcctttcctttctattttgcctgaggttcagacagctgaaagaaaagttcctttcagggagaaggttctttacactgtaatctcccttttcatatttttggtatgcagtcagttacctctgtatggcatacattcagcaactggtgcagatccattctattggatgcgtgtaattctggcctcaaatcgtggcactgtgatggaacttggcatcactcctattgtcacttcaggccttgtaatgcagcttttggcaggatcaaagataattgaggtcgacaatagtgttcgagaagatcgtgcactgttgaatggagctcaaaagttactgggtgttcttatcacaattggtgaagcagttgcatatgtgctttcagggatgtatggtgacatcagggatctgggtgctggaaatgccatccttattattgtccagctcttttttgctggtataattgtgatatgtttggacgagttactccagaaaggctatgggttgggctctggcatttcgttgttcattgccactaacatatgtgagagtatcatatggaaggcatttagtcccacaacaatcaacagtggacgaggtgctgagtttgagggagctgtcattgcgttgttccatttgctgataacccgaacagacaaggttcgggctctgagagaggctttttaccggcagaaccttccaaatgtaacgaacctgcttgcgactgttttggtttttcttattgtgatatacttccaaggatttcgtgtcgtcttgcctgtgagatcaaagaatgcccgaggacagcaaggatcatatcctattaagctattttatacgtctaacatgccaatcattctacagtcggctcttgtttcaaatttgtatttcatttcccagttgctctacagaaggtacagtgggaacttcttggttaatatgttaggaaagtggaaggagtctgaatattcatcaagtggtcagtttgttcctgtgggtggtcttgtctattacataactccaccttccagcctggcagagatggcagcaaatcctttccatgctcttttctatttgacttttatgcttacagcatgtgcactgttttcaaagacatggattgaagtatctggttcttctgctagagatgtggcaaaacagctgaaggagcaacaaatggttatgccaggccacagagagtcaaatctccaaaaggagctgaatcggtacataccaactgctgcagcttttggtggcatgtgcattggagctcttactgttatggctgattttatgggtgctattggatctgggacaggaattcttctagctgtaaccattatctaccagtactttgagacatttgagaaggaaagggcaa

SEQ ID NO: 1432 - DNA, 1554 bp, Distylium racemosum
attttgatgtccgttgagggcaaaattgctgcagatccgagctcggccttagcagatctgaagtttccaaagtttctggtggttgaatttagaggttgatatcctgtttttctctttcaaaaagtaaaaatgccgagtggtggatttagggtgctgcaccttgtgcgacctttcctctcaattttgcctgaagttcagacagcagaaagaaaagttcctttcagggaaaaggttctttacactgtaatctcgcttttcatatttttggtatgcagtcaattgcctttgtatggcatacattcagctacgggtgcagatcctttctattggatgcgtgtaattctggcctcaaatcgtgggactgtgatggaacttggtatcactcctattgttacatcaggcctggtgatgcagctcttagcaggatcaaagataattgaggtggacaatagtgttcgagaagatcgtgcactcgtgaacggagctcaaaagttactgggtgttcttatcacaattggtgaagcagttgcatatgtgctttcggggatgtatggtgacatcagggatcttggtgctggaaatgccatactaattattgtccaactcttttttgctggtataattgttatatgtttggatgagttactccaaaaaggctatggcttgggctctggcatttctttgttcattgccactaacatatgtgagagtatcatatggaaggcatttagtcccacaacaatcaacagtggacgaggtgctgagtttgagggagctgtcattgcattgttccatttgttaataacccgaacagacaaggtccgagcactaagagaggccttttaccggcagaaccttccaaatgtgaccaacctgcttgcaactgttttggtttttctcatcgtgatatacttccaaggttttcgtgttgttttgcctgtgagatcaaagaatgcgcgtgggcagcaaggatcatatcctattaagctattttatacatctaatatgccaatcattctacagtctgcccttgtttcaaatttgtatttcatttctcagttgctttacagaaggtacagtgggaacttcttggttaatatgttgggaaagtggaaggagtctgaatattcatcaagtggtcagtctgttcctgtgggtggtctcgtctattacatcactccaccttccagcttggcagagatggcagcaaatcctttccatgctcttttctatttaacttttatgcttacagcgtgtgcactgttttcaaagacatggattgaagtttctggttcctccgccagagatgtggcaaaacagcttaaggagcaacaaatggttatgccaggccacagagagtcaaatctccagaaggagctaaatcggtacataccaactgctgcagcttttggtggaatgtgcattggagctcttactgttatggctgattttatgggtgccattggatctgggacgggaattcttctggctgtaaccattatctaccagtattttgagacatttgagaaggaaagggcaagcgaattaggtttc

SEQ ID NO: 1433 - DNA, 1943 bp, Podocarpus macrophillus
gatgtaagtgggttgtttctcgcagtgtcgtagggggatgaagaggtgaagatgaggtttgaagtgtttttttgattatagtcggcgtttccgaggggttttgagttgaggtaggtttgtacaagtaactattgttgcagatcgagactttcacaagcagatctccactcatttcataaattcaaagttcatcaacaatttgggtttcctttccaagtaggaaaaatgcctagtggtggatttagggtgctgcaccttgtgaggccatttctctcaattttgcctgaggtgcaaacagctgaaaggaaagtgccgtttagggagaaggttctttacactgtaatcgcccttttcatttttctggtatgcagtcagttgcctttgtatgggatacattcagctacaggtgcagatccgttctattggatgcgtgtcattctggcctctaatcgtggaactgtcatggaacttggtataaccccaatagttacttcaggccttgtcatgcagcttttggcaggttcaaagataatcgaagtggacaatagtgtccgagaagaccgtgcacttttgaatggggcccaaaagttacttggtgttcttatcacaattggtgaagcagttgcatatgtgctttcgggaatgtatggtgacatcagggatcttggggctggcaatgcaatccttattattgtgcagctcttttttgctggtataattgtgatatgtttggatgagctacttcagaaaggctacgggcttggctctggcatttcgttattcattgccactaacatatgtgagagtatcatatggaaggcttttagccccacaaccatcaacagtggacgaggtgcagagtttgagggagctgtcattgcgttgttccatttgttgattaccagaacagacaaggttcgggcacttagagaggctttttataggcagaaccttccgaatgtgacaaacttacttgcaacagtgctagttttccttattgtcatatacttccaaggttttcgtgttgttttacctgtgagatcaaagaatgcacgtgggcaacaaggatcttatcccatcaagctattttacacgtctaacatgccaattattctacaatcagctcttgtttcaaacttgtatttcatttctcagttgctacatagaaggtacagtggaaacttgttggttaacttgttaggaaagtggaaagagtccgagtattcatcaagtggccagtctatccctgttggtggccttgtctattacatcactccaccttccagtttggcggagatggcagcaaatccattccatgcacttttctatctaactttcatgctaacagcatgtgcactcttttcaaagacatggattgaagtatctggttcctctgctagagatgtagctaaacaacttaaggagcaacaaatggtcatgccaggccacagagaatctaatctccagaaagagctaaaccgatacataccaactgctgcagcttttggtggcatatgcattggtgctctgactgttatggctgattttatgggtgcaattggttctgggacaggaattcttcttgctgtaactattatctaccagtactttgaaacctttgagaaggaaagagccagtgaattgggtttctttggattttaaccatattttgctgaactccataatttttaggaattatgtttctaatgagacttttaattgggctaattatcccgccactgaaggatgttagtgtggggttcttacctcgccattgaaattttgtagccatctcaggtttgaatgttaaatggaaagaatccacaaaagtagaagtcagaacagtcctgggttttactgacatcgagttcatccttaagaagtttgaatttccttaaaaaatacatttgtatactagaaaaggccatgggtttgtgagattt

SEQ ID NO: 1434 - DNA, 1754 bp, Sciadopitys verticillata
tgccaagcggtggatttagggtgctacaccttgtacgaccatttctttcaattttgcctgaggttcagacagctgaaagaaaagttcccttcagggagaaggttctttacactgtgatatcccttttcatatttctggtatgcagtcagttgcctctgtatggcatacatacagctacaggtgcagatccattctattggatgcgtgtaattctggcctcgaatcgtggaactgttatggaacttggtattacacctattgttacttcaggcctagtcatgcaacttttggctggatcaaagataattgaggtggacaatagtgttcgagaagatcgcgcacttttgaatggggctcaaaagttgctaggtgtccttatcacaattggtgaagcagttgcgtatgtgctttcgggaatgtacggtgacatcagggaccttggagctggcaatgcgatccttattattgttcagctcttttttgctggtataattgtgatatgcttggatgagttactccagaaaggctatggattggggtctggcatttctttgttcattgccactaatatatgtgagagtatcatatggaaggcatttagtcccacaacaatcaatagtggacgaggtgcggagtttgagggagctgttattgcactgttccatttgttgataacccgaacagacaaggtccgggcacttagagaggcgttttaccggcagaatcttccaaatgtgaccaatctgcttgcaacagttttggttttcctcattgtgatatacttccaaggtttccgtgttgttttacctgtgagatcaaagaatgcacgtgggcagcaaggatcatatcctattaagttattttatacatctaacatgccaatcattctgcagtcagctcttgtgtcaaacctgtatttcatttctcagttgctttacagaaagtacagtgggaacttcttaatcaatatgttaggaaagtggaaggaatctgaatattcatcaagtggtcagtatgttcctgtgggtggtcttgtctattacatcactccaccttcgagcttggcagagatggcatcaaatcccttccatgctcttttctatttgacatttatgttgactgcatgtgcactgttttcaaagacatggattgaagtatcgggttcctctgctagagatgtggctaaacagctcaaggagcaacaaatggttatgccaggccacagagagtcaaatctccagaaagagctaaatcgttacataccaactgctgcagcttttggtggcatgtgcattggggctcttactgtcatggctgattttatgggtgctattggttctgggacaggaattcttcttgccgtaactattatctaccagtacttcgagacatttgagaaggaaagggccagcgagttaggcttctttggtttttaatcattatttccttgaacttgctattgttagaatatatatttcagacgagactttaatttgggctgattctctggcctttgaaagatgtgagtgtagggattttgatgtccctattgaagttttgcagccatcttctgatctagatgtcaaatgcaagaacgaaaccacagaagtaaaagctggcaggcagaaaagtcctgtgtgttttactgacattgagttgtttcagaataacttcttgtttttagaacaaaagcagatgtatactattaagaagccatgcacttgtaggagttggtgtagtatacattgtctttt

SEQ ID NO: 1435 - DNA, 1927 bp, Sequoia sempervirens
taagaaactaccgacgtgctgctcataacctagactagataaatcaagggaagagatctaaatatacgcgttgctacatgtaattcagaatttaaaaaacaatggcgtaaggagagatctgttgctatttctccctcgcttttaccgtcagctccaattcgatcgattgcatctactgagcgccatataatttgattactttgtttgattgggttgaccgattgaaaatcagttgaatatttcagctttacctacaagaaaaaatgccgagcggtggatttagggttttacaccttgtgaggccatttctctcaattttgcctgaggttcagacagcagaaagaaaagttcccttcagggagaaggttctttacactgtaatctcccttttcatatttctggtatgcagtcagttgcccctatatggtatacattcagctacgggtgcagatccattctattggatgcgtgtaatcctggcatccaatcgtggaactgttatggagcttggcattacccctattgttacttcaggtctagtgatgcagcttttggcaggatcaaagataattgaagtggacaatagtgttcgagaagatcgtgcacttttgaatggagcccaaaagttacttggtgttctgatcacgattggtgaagcagttgcatacgtgctttcaggaatgtatggtgacatcagggaccttggagctggcaatgccatccttattattgtccaactcttttttgctggtatcattgtgatatgtttggacgaactacttcagaaaggctatgggttgggctcaggcatttcgttattcatcgcaactaatatatgtgagagtatcatatggaaggcatttagtcccacaacaattaatagtggacgtggtgctgagtttgagggagctgtgattgcattgttccatttgttgataacacgaacagacaaggtccgagcactcagagaggctttttacaggcagaatcttccaaatgtgaccaatctgcttgcaacagttttggtttttctcattgtgatatacttccaaggcttccgggttgttttgcctgtgaggtcaaagaatgcacgtgggcagcagggatcatatcctattaaattattttatacatctaacatgccaatcattctgcagtcagctctggtttcaaatttgtatttcatttctcagttgcttcacaggaggtacagtggaaacttccttattaatttgttaggaaggtggaaagaatctgaatattcttcaagtggtcagtctgttcctgtgggtggtcttgtctattacatcactccaccttcgagcttggcagagatggcagcaaatcctttccatgctcttttctatttgacttttatgctgacagcgtgtgcactcttttcaaagacatggattgaagtatcaggttcctctgctagagatgtagcaaaacagctcaaggagcaacaaatggttatgccaggccacagagagtctaatctccagaaggagctgaatcgatacataccaactgccgcagctttcggtggcatgtgcattggtgctcttaccgtcatggctgattttatgggtgctattggttctgggacaggaattcttcttgctgtaactattatctaccagtattttgagacctttgagaaggaaagggctagtgaattaggattctttggtttttaaagggtatccaattgaacttgaaatttttagaaatgtttcatatcagactttaagtttggctggttctatagccatttaaagatgtgattgtcgggggattttatgccccagtttaagttttgcagccatcttctaatgtaaacagaagtaaaagctagcaggcagaaaggtcctgagtgttttactaacgttgagatgttttagattaacttttatttgaacacagc

SEQ ID NO: 1436 - DNA, 1850 bp, Sequoia sempervirens
aaaatgccgagcggtggatttagggtgctacaccttgtgaggccatttctctcaattttgcctgaggttcagacagcagagagaaaagttccctttagggagaaggttctttacactgtaatctcccttttcatatttctggtatgcagtcagttgcctctgtatggtatacattcagctacaggtgcagatccattctattggatgcgtgtaattctggcctccaatcgtggaactgttatggagcttggtattacccctattgtcacttcaggcctagtgatgcagcttttggcaggatctaagataattgaggtggacaatagtgttcgagaagatcgtgcactgttgaatggggctcagaagttacttggtgtccttatcacaattggtgaagcagttgcatatgtgctttcaggaatgtatggtgacatcagggaccttggagctggcaatgccatccttattattgtccaactcttttttgctggtataattgtgatatgtttggacgagttgctccagaaaggctatggcttgggatctggcatttccttatttattgcaactaacatatgtgagagtatcatatggaaggcatttagtcccacaacaattaatagtggacgaggtgctgagtttgagggagctgtcatcgcattgttccatttgttgataacccgaacagacaaggtccgagcactcagagaggctttttaccggcagaatcttccaaatgtgaccaatctgcttgcgacagttttggtttttctcattgtgatatatttccaaggctttcgggttgttttgcctgtaagatcaaagaatgcacgtgggcagcaaggatcatatcctattaagttattttacacatctaacatgccaatcattctgcagtcagctctggtttcaaatttgtatttcatttcacagttgctctacagaaggtacagtggaaacttccttattaatttgcttggaaagtggaaagaatctgagtattcttcaagtggtcagtttgttcccgttggtggccttgtctattacatcactccaccttccagcttggcagagatggcagcaaatcctttccatgctcttttctatttgacttttatgctgacagcatgtgcactcttttcaaagacatggattgaagtatcaggttcctctgccagagatgtggcaaaacagcttaaggagcaacaaatggttatgccaggccacagagagtctaatctccagaaggagctgaatcgttacataccaacagcagcagcttttggtggcatgtgcatcggtgctcttactgtcatggccgattttatgggtgctattggttctgggacaggaattcttcttgctgtaaccattatctaccagtattttgagacattcgagaaggaaagggccagtgaattaggattttttggtttttaaaggatataccactgtacttgactttttaagaaattatgcttcagatcagacttgttggtctaattctctgaccattgaaggatgttagttaaggggatttgatgccctagttgaagttttgcagccatcttccaatgtacgcaatggtagtagccgagaggcggaaaggtcctgtgtgttttactgatgttgagatgttttagaattaactttttgtctgaacaaagcaattgtatacaataggaggccatggtcttgtagtattagtgtatacattgctcgttttctagttaatgcagtcttaaaatgcagagagagacctgttaacttggtgtcaaatacgtggcctcattagttttaataagcataacccctgaatcaaatacgaggcatggaaatgtatgcatagg

SEQ ID NO: 1437 - DNA, 2132 bp, Picea glauca
attcaaatatctccattgtctctcacaaattaatcaagtgccaaaaaaattacaaaacaatataaatacaatcaaaaaaaattgaagagccagccagccagacatggagggcaagcattgccatttgtaatgaataagtagaaccaggcggtgcttcaaacgcgaatttgtcatcgtctaaggatcagtttctacgcttaattcattggaaggcatggaggcgctagattaggcaggtgctgcttcaaagccagaggcgcatctattgcagatcggtaatcccctgcagcggatcgggagttttccgggctcaaatttgtaagtttgataatttggactgttcttcggagaaagaaaaatgccaagcggtgggtttcgtgtgctgcatcttgttagaccatttctttcaatcttacctgaggtccagacagctgatagaaaagtaccctttagggagaaggttctttacactgtaatctcccttttcatctttctagtatgcagtcagttgcctctatatggaatacattcagcaaccggtgcggatccattctattggatgcgtgtaattctggcttctaatcggggaactgttatggaacttggtatcaccccacttgttacctcgggcctagtaatgcaacttttggcaggatccaagataattgaggtggataatagtgttcgtgaagatcgggaactgcttaatggggctcagaagttacttggtgttctcatcacaataggtgaggcagttgcatatgtgctgtctggaatgtatggtgacatcacagaccttggagctggcaatgccatccttattattgtccaactctttttcgctggtataattgtgatatgtttggatgagttactccagaaaggttatggattggggtctggcatttcgttattcattgctactaatatatgtgagagcataatatggaaggcatttagtccgacaacaattaatagtggacgaggtgcagagtttgagggagctgtcattgcattgttccatttgttgataaccagaactgacaaggtgcgagctctgcgggaggccttttataggcagaatctaccaaatgtcaccaaccttcttgcaacagttttggttttcctcattgtcatatacttccaaggttttcgtgttgttttgcctgtgaggtcaaagaatgcacgtgggcagcaggggtcatatcctatcaagttattctatacctcaaacatgccaattattctgcagtctgctcttgtttcaaatttgtattttatttcccagctgctttacagaaagtacagtggaaatttccttgttaatatgttgggcaagtggaaggagtctgaatactcatcaagtggtcagagtattcccgtgggtggtcttgtttattacatcactccaccttccagcttggcagagatggcagcaaatcctttccatgctcttttctatttgacttttatgctgacagcatgtgcactgttttcaaagacatggattgaagtatctggttcctctgccagagatgtggcaaaacagcttaaggagcaacaaatggttatgccaggccacagagaatctaatcttcagaaagagctaaatcgttacataccaacagctgcagcttttggtggcatgtgcattggtgctcttactgtcatggctgattttatgggggctattgggtctggtacaggaatccttcttgcagtaactattatttaccagtactttgagacatttgagaaggaaagggcaagtgaactaggtttctttggtttttaatgcattcatttgcatttgatatttgtagaaattacatttcagattaaactttgagttgggctaatgctctggccactgaagcatttgaatgctggggattttacacccctttgaagttttgcagccaacttttgattagatcttaaatataagaatccacgaagtcaaaaactggcaggcagaaaagtcctgcgtgctgtactaacattgagatgtttaaaataacttcttggttttttgaacaaaggctattgtatactagaaaggccattcatttgtggttttggtggtattgtggtgctttgtttagttatgtctttagatgcaaataagtatt

SEQ ID NO: 1438 - DNA, 2029 bp, Taxus baccata
tgccgagtggtggatttagggtgctacatcttgtgaggccatttctttctattttgcccgaagttcagacagctgaaagaaaagttcccttcagggagaaggttctttacaccgtaatctcccttttcatatttctggtatgcagtcagttgcctctgtatggcatacattcagctacaggtgcagatccattctattggatgcgtgttatcctggcctccaatcgtggaactgtcatggaacttggtattacccctattgttacttcaggccttgtgatgcagcttttggcaggatcgaagataattgaggttgacaatagtgttcgagaagatcgtgcactcctgaatggggcccaaaagctacttggtgtcctcatcacaatcggcgaagcagttgcttatgtgctttcaggaatgtatggtgacatcagggaccttggagctggcaatgccatccttattattgtccaactcttttttgctggtataattgtgatatgtttggatgagttgcttcagaaaggctatgggttgggctctggcatttccttattcattgcaactaacatatgtgaaagtattatatggaaggcatttagtcctacaacaattaatagtggacgaggtgctgagtttgagggagctgtcattgcactgttccatttgttgataactaggacagacaaggtccgtgcacttagagaggctttttacaggcagaaccttccaaatgtgaccaatctgcttgcaacagttttggtttttctcattgtgatatacttccaaggctttcgggttgttttgcctgtgagatcaaagaatgcacgtgggcagcaaggatcatatcctattaagttattttatacatctaacatgccaatcattctgcagtcagcgcttgtttcaaatttgtatttcatttctcagttgctgtacagaaggtatagtggcaacttcctcattaatatgttagggaagtggaaagaatctgaatattcttcaagtggtcagtttgttcctgtgggtggtcttgtctattacatcactcctccttccagtttggcggagatggcagcaaatcctttccatgctcttttctatttgacttttatgctgacagcgtgtgcactcttttcaaagacatggattgaagtatcaggttcttctgctagagacgtggcaaaacaacttaaggagcaacaaatggttatgccaggccacagagagtctaatcttcagaaggagttgaatcgttacataccaactgctgcagcttttggtggcatgtgcatcggtgcccttactgtcatggctgattttatgggtgctattggttctgggacaggaattcttcttgctgtaaccattatctaccagtactttgaaacctttgagaaggaaagggccagcgaattaggtttctttggtttttaaatgatgtaccattgaacttgataattttaaaaattatgtttcagatgagactcaagttgggctacttctctgcccgttgaaggatgtgagtgtagtaggggatttgatgccccaattgaagttttgcagccatcttctgatatatatttcaagttcaagaatgagtacacagaattaaaagctgcaggcagaagatcctgtctgtttttctgacattgagatgttttagaataacttctttttatttgaagaaaagcagtctgtatactacgagaggccatgaacttgtggctaggagtagtttatacatttgcaatttttttttcaagttacatcaactccaagttacatcatcaacatcaagttacatttggatacctagtaatttggtgacaaacattgcaatatgcggccccttttttgtgtttttggtgtaagcggcaacacatgattatgaagtagaaaacatggaagtgttattggatatgtattggatcgtttcgtgcaaatgatcatgtgcacaaatacactgctttctatccaatggtgagcaattggatggattggtgctttattttgtgttgtaagagaga

SEQ ID NO: 1439 - DNA, 4379 bp, Volvox carteri
ccttggttcaactgtaaacgtcaccgattgttagatcggacagcatgaggcgtgcagctcggttgctgcggggcgttggccaagctgctcagagccggtctggcgctgtgcatgaagcagtgaagctcttcgacatcaacaacgcacgcttgcttagcacacagtcaacttgcttgcttggtgctctgagccatgcaagcacgatcttgccgagcagctttgctgcaagcggtgttcggtttatcgcggtggacgcccttttgccaagcgacgacttcaagcctcgccacaacagtggcagcccagcggaaatcgatgcgatggttaacatgacgggcttctcgtctctcgatgcgctaatcgacgcgacggtgcccaaggccatcgtccggaaggacggcatggacctgggcaagtaccacgagggcatgacggagagccagttcctctcttacttcaagtccatggccggcaagaacaaggtgctcaagagcttcctgggcatgggctactacgacgtacacgtgccgccggttatcttgcgcaacgtgctggagaaccctggatggtacacgcagtacacgccgtaccaagcggaaatcgcgcagggcaggttggagtccctgctcaacttccagaccatggtgtgcgacctgactggcatgtccatcagcaacgcttccctgctggatgaggccactgcggctgcggaggccatgaccatgtgctctgcggtggcccgaggcaagaagcccaagttcctcgtgtcgagcaagtgtcacccgcagaccattgcggtgtgtcagacgcgcgctgagggacttggcctggaggcggtggtggcggacgaggataagttcgtgtacggcaaggacgtgtgcggcgtgttggtgcagtaccccgcgacggatggcactgtgtcggactacaaggccctggtggccgcagcccatgctgccaacgtcaaggtttgcgtgtccacggacctgttggcgctgaccatgctcactccgccgggcgaatggggtgccgacatcgtggtgggctcggcgcagcggttcggtgtgcccatgggctatggcggcccccacgccgccttcctggcctgccatgacgagtacaagcgcctcatgccgggtcgcatcatcggcatgtccatcgatgcgcagggcaagccggctctgcgtatggccatgcagacccgcgagcagcacatccgtcgtgacaaggccacgtccaacatctgcacggcgcaggcgctccttgccaacatggcggcgctctacgcggtgtaccacggccccgagggcctcaagaccattgcgcgccgcgtcaacggtttggcctccgtgctggctgccggagcgtccaagctcggccacggtgtgccctcggcgcccttcttcgacaccgtcacggtgacgctcaaggacggcgacgcggacaagtacgttaagcttgcgctgaacgagaagatgaacatccgcaagattgcgcccaacgccatcagcatcgccttcgacgagaccagcaccctggctgacgtcgatgcgctgctgcgggtgctcaacaacggccaggacgcgccattcaacgccgccgcgctggcgccagcagtggagggcggcgtggggccctttgctcgccagtcacctttcctgcagcagcccatcttcaacacataccacaacgagcacgacatgctgcgctacctcaagcgcctcgagaacaaggacctgagtctggctcatagcatgatcccgctgggctcctgcaccatgaagctcaatgccacttcggagatgatgccggtcacctggcctgagctggccaacctgcacccgtactgcccgcccgatcaggcggagggctacaatgagatgttccgggacctggctgcccagttgtgctccatcacgggtttcgatgcggtgtcgctgcagcccaacagcggagccagtggggagtatgcgggccttatggccatccggtcctatcacctcgcccgtggcgacgcccaccgcaacatctgcatcatcccggtctccgcgcacggcaccaaccccgcctccgctgtcatggcgggcatgaagatcgtcaccgtgtccacggacgcccatggtaatgtgaacatcgcggagctcaagcagaaggccgagcagcacagcaagaacttggcggcgttgatgatcacgtacccttctacgcacggcgtgtacgaggagggcgtggacgaaatttgccgtattattcatcagcacggcggccaggtgtacatggacggggcaaacatgaatgcgcaggtcggcctcacagcccccggcatcatcggcgctgacgtctgccaccttaacctgcacaagacattctgcatcccccacggtggcggcgggcccggcatgggtcccatcggcgtcaaggcccacctggctccctacctgcccacgcaccctgtcatacccaccggcgcgctgcctgtacggcccgccgctccacagcccttcggcaccatggcggcggcgccgtatggctcttcgctcatcttgcccatctcctttgcctacatctccatgatgggatcggggggtctaacgatggcctccaagctcgccatcctgaaggccaactacatggccaagcgtcttgccggccactaccccgtgctgttcaccgggcctaacggtacctgcgcgcatgagttcatcctggacttgcgaccactcaaggagactgctggcattgaggctgaggatgtggccaagcgcctgatggactacggcttccacgctcccaccatgtcctggccggtaccgggcacgctcatgattgagcccacggagtccgagtccaaggacgagctggatcgcttctgcgaggccatgatttctatccgggaggagattcgcgagatcgagcagggcagggctgaccgcgagaacaacgtcctcaagcatgcgccgcatgcgccgtcggtggttcttgtggacacctgggaccggccatacacccgcgaacgcgccgcctaccctgcgccgtgggtctggcaggccaagttctggccgaccgtcagtcgcgtcgacaacgtgtacggcgaccgcaacctcgtcactcggtgggcgtccgccgaggcggcggagccagtggctgctaccgcataaaacgaatgttacaataaattttagcagagagcgatacgctgccatagggcctgtgccggcggccctaacgcggtggttgctggcacattggttttgtttttttagtgatgttgtgtcgttattgcgtggtgatggagtttggcgcagcgggtctgccacgaggatcgctgcgcagtctagggtggtgctctttcggtgctgatgatcggtgctttggttctggtgcaaaagcgcggccgaccgttatgttgtcttgatgcggtggttcgtgatggttgcggcttgatgggttggtctccatgggcggctggacatgactggatgaaaagaacatgcgtttcgccctcctgcttttctctgtgtgtcagctccccatgagagcgttttgtccgcctgttaggtttttgttaatcaacctttcgcgaagccgcggcagctggagagggagcgagggcgggagcgaggtgaagtgatgcggcagtgtgtgaggtccaattttggggcatcggcatcgcaggcaaatacgcggtgctgctttttgccctccgtgagtaagtcctcgctgtcgtcattcgcaagtttggtacgtgtttggtgacttagagtttagggtgaaatgaatcatttggtggccttgcgggttggcctttattccatgggctcctcctttcatccatttgaggcaaatggtgaactatcagcaacggtcggacccagtttcatgggtggggcacgtctggagataggagagagggatgcggatggggcaggttacatagcttctaggatttgacttacggctgactgggcgatgtgttggggcggggtcggtggcaacataggtctagagatgaaggcatcaccagggggcgaaagcgcgatggtacctgacatacatcgtgcagccggtctcgccatgcagcagaatcctagttagcacctgccgtctgtctaggatgaggctgtcagggattgccgggttgacctcccgaagatgaacgaacgttgaaacatgtacgacttgattgggcgtgtgtaggtagctggatccttcacgtcgctgtcatcaccatgtacatagtgaatggggggatactatctaagagactagtatgttttggatgtgatggttggagttcttgagcaacgcaatatttggtttgacgcgtatgttcactatcaagcgtgttgtggtatgtatgtaagcagaaccggtctttc

SEQ ID NO: 1440 - DNA, 1612 bp, Gossypium raimondii
atttaaaagcctttctttttactcagaaaagaaataatttaatgaaatgagaaaaaataaataaaaaaaagctagaagtgtttgcactaaatgcacgtgttagaatcgaattggcataaatgataaaccccaactagcttgcaattgcaagaagcacttcaaacccaaccttttgttttttttctcataaaacctccccactactgatttctctatatattctaatgttctcccgttgtttcagccgtctttaacacttttcaatggcttcctcttctgttattgcttggggctcaggtgaagatggtcaattgggtatcggaaacaatgaagaaagagaatgggtttgcgttgttcaagctcttgagcctcacaatgttcgctccgtcgtcgctggcagccgtaattctctcgctatttgtgatgatggcaagttgtttacttggggatggaaccagagaggaaccctagggcaccctcccgagaccaaaactgagaatattccaagtcaggttaaggctcttgctaatgttaaaattgttcaggcggctattggtgggtggcattgtttggctgttgatgatgaaggcagagcttatgcctggggtgggaacgaatatgggcagtgtggtgaagagcctgagcggaaagatgatactggtaggcctttgagaagggacattgtgattcctcagcgctgtgcgccaaagcttgtagttcgccaggtagctgctgggggtacccattctgtagtgctgacacgtgaaggatatgtttggacctggggtcaaccttggccacccggagacataaaacaaatatctgttcctgtgagagtacaaggtctcgaaaatgtgaggcttatcacagtgggagcatttcataatttggctctccaggaggatgggactttatgggcatggggtaataacgaatacggacaacttggaactggggacactcagccaagatcacaacctatacctgtccaaggattatctggtctcactttggttgatattgctgctggtggatggcattccactgcattgactgatgatggagaggtgtatggttggggaagaggagaacatgggaggctcgggtttggagataacgataagagcagtaaaatggtgccgcaaagggttcaacttttagctggggaagatattgttcaggtatcttgtggtggaacacattcggttgcattgacacgtgatgggcgcatgttttcgtttggacgaggtgaccatggacgactaggttatgggcggaaggcaacaacaggtcaacccatggaagtcccgatcaatctgccagctccaaaaagtgttagcggaagtggtgctgaaggatattggatctctaaacttgttgcatgcggaggccgccatacgcttgctatagtagaatggaagaccgatgaatctaagccataactgaagaatgtaatgttctcatatatataaatataaaacttgatgactgaagaacagcaaaacaaggttccatttaaaaagcatgatgaggaatagctgaataaatgaacttactgttcacttaaatgggtcttttactgatagattggaagttcagtacttactaataa

SEQ ID NO: 1441 - DNA, 1487 bp, Theobroma cacao
aaaaactgtgtgtccttatccttttccataatgcatgtgttggaatcgaatttgcacacatccaacaatcctagctgtcgcattttgcaggaagcactaactgtctttcctcttccatggcttccatttcctccgtcattgcttggggctcaggtgaggatggtcaattgggaattggaaataatgaagaaaaagaatgggtttgcgttgttaaggctcttgagcctcacaacgtccgctccgtcgttgctggcagccgtaactccctcgctatttgtgatgatggcaagttgtttacatggggatggaaccagagaggaaccttagggcaccctccagagaccaaaactgagaatattccaagcccggttaaggctcttgctaatgttaatattgttcaggcagctattggtgggtggcattgtttggccgttgatgataaggggagagcttacgcttggggtgggaatgaatatggccagtgtggtgaagaacccgagcggaaagatggcactggtaggcctttgagaagggacattgtgaatcctcaacgctgtgccccaaagcttgtagttcgccaggtagctgctgggggtactcactctgtagtgcttactcgtgagggacatgtgtggacctggggtcagccttggcctcctggagacataacacaaatatctgttcctgtgagagtacaaggtcttgaaaatgtgagacttattgcagtgggagcatttcataatttggctctccaggaggatgggactttgtgggcatggggtaataatgaatatggacaacttggaactggggatactcaaccaagatcgcaacctatacttgtccaagggctatctggtctcactttggttgatattgccgctggtggatggcattctactgcattgactgatgatggagaggtgtatggttggggaagaggggaacatgggaggcttgggtttggggataatgacaagagcagtaaaatggtgccacagagggttcatcttttagccagcgaagacattgtacaggtgtcctgtggtggaactcactcggttgcattgacacgtgatgggtgcatgttttcgtttggacgaggtgaccatggacgccttggatatgggaggaaggtaacaacaggtcaaccaatggaggtgcctgtcaatctgccggctcccaaaaatgttaatggcagtggagctgaaggacactggatctctaaacttgttgcttgtggagggcgccatactcttgccatagtagaatggaagactcatgaatctaagccatagctagagaatggtatattcacaaaacgttcatcatgaagcttagtagttcatgagattcagatgtttgagtaggagatgtatacacttaagattgagtcatactgagtgcaaaaagaaaagtcacaacttttaatttcaaatgataaacgtgacttatttgcattgaacaagtaaatgtgagtttggaaa

SEQ ID NO: 1442 - DNA, 1585 bp, Citrus clementina
atggcttctactacgtccattattgcttggggctcgggggaagatgggcaattgggaataggaaacaacgaagagagagaatgggtttgcgttgtcaaagctctcgagccttacaaagtccgctcagttgttgctggtagccgtaactccctcgccatttgcgacgatggcaagttgtttacttgggggtggaatcagagagggacattaggtcacccaccagagaccaaaactgaaaacgttcctagtcaggttaacgctttatctaataccaaaattgttcaggctgctattggtggatggcattgtttggctgttgatgatcaaggccgtgcctacgcctggggtggtaatgagtatggacagtgtggggaagaaccagagcggaaagacgatactggtaggattttgaggagggatattgtaattcctcagcgctgtgctccaaaacttatagttcgccaggtggcagcagggggcactcattctgtggtgctcacacgcgaaggacatgtatggacctggggtcaaccatggcctcctggtgacataaagcaaatatcagttcctgtacgagtacaaggtcttgaacaggtgaagcttattgcagttggggcatttcacaatttggctctccaagaggatggagcattgtgggcatggggtaataatgaatatggacaacttggaacaggggatacccaaccaagatcacaacctattcctgtccaagggctctcgggtcttactttggttgatattgctgctggaggttggcattctactgcattaactgatgacggagaggtttatggttggggaagaggggagcacgggaggcttggatttggggataatgacaagagtagtaaaatggtgccccaaaaggttaatcttttagctggcgaggacattgttcaggtgtcttgtggtgggacccactcggttgctttgacacgtgatgggcacatattttcatttggacgaggtgaccacggacgtcttggatatggaaggaaagtgacaactggtcagccaatggaagtgccaataaatattccagcaccaagaaatgctggtgatggagtcgacggacgctggatagctaaacttgttgcttgcgggggacgccatactctggcaatagtagaatggcaaactgaggaatccaagtagttactgtatgaaaatctcaataacaagaagagagctctttgaaactaaataaatccatttatactcttgatatcaatatagcgaggacaattttgattcacttgtgggcgaatacttgagtcaccgactttgtttcccatgttatgcatgtcacaagttctatgatgagttgcatttggtatttatggtatcatgttggggttttccgaagatgatacattttgagcatggagattgtaattattgtggtttaggaaacaaatatctataaacacatagaaacttgtaattgggttcgtagcctaatagtggattggcgctttcaaaatgagtgtatgagagccacttccagctctcatagagtctcttcccctttttcccaaaccaaataatagagggattttttttt

SEQ ID NO: 1443 - DNA, 1279 bp, Citrus sinensis
atggcttctactacgtccattattgcttggggctcgggggaagatgggcaattgggaataggaaacaacgaagagagagaatgggtttgcgttgtcaaagctctcgagccttacaaagtccgctcagttgttgctggtagccgtaactccctcgccatttgcgacgatggcaagttgtttacttgggggtggaatcagagagggacattaggtcacccgccagagaccaaaactgaaaacattcctagtcaggttaacgctttatctaataccaaaattgttcaggctgctattggtggatggcattgtttggctgttgatgatcaaggccgtgcctacgcctggggtggtaatgagtatggacagtgtggggaagaaccagagcggaaagacgatactggtaggattttgaggagggatattgtaattcctcagcgctgtgctccaaaacttatagttcgccaggtggcagcagggggcactcattctgtggtgctcacacgcgaaggacatgtatggacctggggtcaaccatggcctcctggtgacataaagcaaatatcagttcctgtacgagtacaaggtcttgaacaggtgaagcttattgcagttggggcatttcacaatttggctctccaagaggatggagcattgtgggcatggggtaataatgaatatggacaacttggaacaggggatacccaaccaagatcacaacctattcctgtccaagggctctcgggtcttactttggttgatattgctgctggaggttggcattctactgcattaactgatgacggagaggtttatggttggggaagaggggagcacgggaggcttggatttggggataatgacaagagtagtaaaatggtgccccaaaaggttaatcttttagctggcgaggacattgttcaggtgtcttgtggtgggacccactcggttgctttgacacgtgatgggcacatattttcatttggacgaggtgaccacggacgtcttggatatggaaggaaagtgacaactggtcagccaatggaagtgccaataaatattccagcaccaagaaatgctggcgatggagtcgaccgacgctggatagctaaacttgttgcttgcgggggacgccatactctggcaatagtagaatggcaaactgaggaatccaagtagttactgtatgaaaatctcaataacaagaagagagctctttgaaactaaataaatccatttatactcttgatatcaatatagcgaggacaattttgattcactt

SEQ ID NO: 1444 - DNA, 1510 bp, Populus trichocarpa
aacaagagagccttcactaactttctcaagttttttagtacagggggtaagacaccccaagcttctccatttctaatggcaactgagtcctctgtgattgcctggggatcaggtgaggatggacaactagggataggaaataacgaagaaaaagaatgggtttgcattgtcaaagctcttgagccttacaaagttcgctctgttgttgctggaagccgcaactctcttgccatttgtgatgacggcaagttgtttacttggggttggaaccaaagagggacattagggcatccaccggagaccaagactgagaacattcctagccaggtcaaggctcttgctaatgtcaacattgttcaggcggctattggtggatggcattgtttggctgttgatgatcaaggacgtgcttatgcttggggtggaaatgaatatggccagtgtggtgaagaacccgagaggaaagatgacactgggaggcctttgagaagggatatagtcattccccaacgttgtgcatcaaaacttgtagttcgccaggtagctgctgggggtactcactctgtggttctcacacgtgaagggcatgtatggagctggggtcaaccatggcctcctggagacataaagcagatatctgtccctgtgcgtgtacaaggccttgaaagagtgaggctcattgcagttggagcatttcataatttagctcttcaagaagatggaactttatgggcttggggtaataatgaatatggacagcttggaaccggtgatacccagccaagatctcaacctattactgtccaaggactttctggtctcactttggttgatattgctgctggtggatggcattctactgcattgactgatgatggggaggtgtatggctggggaagaggtgaacatggaaggttgggttttggagataatgacaagagcagtaaaatggttccccaaagggttaatcttttagtaggggaggacattgttcaggtatcttgtggcgggactcattcagttgcattgacacgtgatggacggatgtatacatttggtcgaggtgaccatggacgacttggatatgggaggaaggtgactacaggccaaccaatggaagtgccaatagacatcccacctcctaaaaatcttactgacagtggagatgcgggacgctggattgctaaacttgttgctagtggaggtcgccataccctggccattgtggaatggcacactggtgattctaaatagatatgacatgattgtgtctaaaagtctgaactagacaatgcaagaccaacgcagagaacattaacgtaggataattgtctgtattacttcctggtgattgggatggtattcgactttgccacattacttacaggaagagctgttcaattttcatgtcagggccatggatttcaagcattctggtgactggtaagtgataactattaattgaatactgtccttgtaatgatgaaatcttcaacctagctttcggcgc

SEQ ID NO: 1445 - DNA, 1634 bp, Ricinus communis
ggcaaaatgagcttttgtaagaaaaataataaaagaaaagaaaacaataaaagagccttacgattaatccctctcccccacacaccaaaaaccccccacagttgttctaacactaaaatcttgttcgctgctcatctctctttaaatatatataaaaatattatacttaaaagcaaaatccacttcctataatctccgtttcttcttctttctttcaaaaggaatggctactcacacttcccttattgcttggggggcaggtgaagatgggcaattaggaattgggattaatgaagagaaagaatgggtttgtgttgttaatgctcttgagccttataaagttcgctctgttgttgctggtagtcgtaactctcttgctatttgtgatgatgggaagttgtttacttggggttggaaccaaagagggacacttggacacccagctgaaaccaagactgagaatattcctagccaggttaaggctcttaacaatgtcaacattgttcaggctgctattggtgggtggcattgtttggctgttgatgatcaaggccgtgcatacgcttggggtgggaatgagtatgggcagtgtggcgaagaacctgaacggaaggatgacactgggaagactttgagacgggatatagtgattcctcagcgttgtgctccaaagcttgtggttcgccaggtagctgctggaggtactcactctgtagtgcttacacgtgaaggacatgtgtggacttggggccaaccatggcctcctggagacataaagcagatttctgttcctgtgcgggtccaaggccttgaaaaggtgaagctcattgcggttggggcatttcataatttagctcttcaagaagatggaactttgtgggcatggggtaacaatgaatatggacaacttgggactggggatacgcaacctagatcacaacctattcctgtacaagggctctctggtctcactttggttgatattgctgctggcggatggcattctactgcattaactgatgacggagaggtatatggatggggtagaggagaacatggcaggcttggatttggagataatgacaagagcagtaaaatggtgcctcaaaaggttaatcttttagctggggaagacattgttcagttatcttgtggcgggacgcattcagtggcattgacacaagatggacgaatgttttcatttgggcggggtgaccatggacgtcttggatatggaaagaaagtgacaaccggtcaaccagtggaagtgccaactgacatccctcctcctaagagtcttagtggcactgaagaagccgagggacattggattgctaaactggtcgcttgcggcggacggcatactctagcaatagtagagtggaaggttgacgaatcaaaataattatgcaatagacttaatgctctgttgtataatgtaaaactagacaatacaagataaaaaaataaatcatagaaacattattatacagctaactatttggcagctttatggcctgggcaactcagatggtattgactctgcatcaacttagatggtaacttattgctgaaaactatcgccttcctgttctagctctggtgttcttttgttttatggatggaaatttttg

SEQ ID NO: 1446 - DNA, 1754 bp, Ricinus communis
gatcgttgacagtttggcactggctacaagatttagtgggcaaaatgagcttttgtaagaaaaataataaaagaaaagaaaacaataaaagagccttacgattaatccctctcccccacacaccaaaaaccccccacagttgttctaacactaaaatcttgttcgctgctcatctctctttaaatatatataaaaatattatacttaaaagcaaaatccacttcctataatctccgtttcttcttctttctttcaaaaggaatggctactcacacttcccttattgcttggggggcaggtgaagatgggcaattaggaattgggattaatgaagagaaagaatgggtttgtgttgttaatgctcttgagccttataaagttcgctctgttgttgctggtagtcgtaactctcttgctatttgtgatgatgggaagttgtttacttggggttggaaccaaagagggacacttggacacccagctgaaaccaagactgagaatattcctagccaggttaaggctcttaacaatgtcaacattgttcaggctgctattggtgggtggcattgtttggctgttgatgatcaaggccgtgcatacgcttggggtgggaatgagtatgggcagtgtggcgaagaacctgaacggaaggatgacactgggaagactttgagacgggatatagtgattcctcagcgttgtgctccaaagcttgtggttcgccaggtagctgctggaggtactcactctgtagtgcttacacgtgaaggacatgtgtggacttggggccaaccatggcctcctggagacataaagcagatttctgttcctgtgcgggtccaaggccttgaaaaggtgaagctcattgcggttggggcatttcataatttagctcttcaagaagatggaactttgtgggcatggggtaacaatgaatatggacaacttgggactggggatacgcaacctagatcacaacctattcctgtacaagggctctctggtctcactttggttgatattgctgctggcggatggcattctactgcattaactgatgacggagaggtatatggatggggtagaggagaacatggcaggcttggatttggagataatgacaagagcagtaaaatggtgcctcaaaaggttaatcttttagctggggaagacattgttcagttatcttgtggcgggacgcattcagtggcattgacacaagatggacgaatgttttcatttgggcggggtgaccatggacgtcttggatatggaaagaaagtgacaaccggtcaaccagtggaagtgccaactgacatccctcctcctaagagtcttagtggcactgaagaagccgagggacattggattgctaaactggtcgcttgcggcggacggcatactctagcaatagtagagtggaaggttgacgaatcaaaataattatgcaatagacttaatgctctgttgtataatgtaaaactagacaatacaagataaaaaaataaatcatagaaacattattatacagctaactatttggcagctttatggcctgggcaactcagatggtattgactctgcatcaacttagatggtaacttattgctgaaaactatcgccttcctgttctagctctggtgttcttttgttttatggatggaaatttttggtggtgtcattctctcactgtataattaggcaactaaattattagttaataatataatattaaaaatataattaaaatgtta

SEQ ID NO: 1447 - DNA, 1796 bp, Arachis hypogaea
tgatagagcgcagtggtatcaacgcagagtacaagggggttttgcaatttctgctaatttgtgcaaatgtttgattaaaccctactactactcactactcagcaccgaagactgaagagtcaacattccatttcctgcttcaacatcaagcactccaatggattccaattcccacatcattgcttggggctctggagaagacggtcaattaggaatcggcaacaacgaggagaaggagtgggtctgcgtcgtcaaagccctcgaccaccaacgagtccgctccgtcgtcgccggcagcagaaactccctcgccatctgcgacgacggcaagttgttcacatggggttggaaccaaaggggaacacttggacaccctcctgagaccaagaccgagaacattcctagccaggtcaaggcactcgccaatgttaaaattgttcaggctgctattggtggatggcactgtttggctgttgatgatcaaggcagagcttatgcatggggtggaaatgaatatggacagtgtggtgaagaacctgagcgcaaggatgacactggtagacctttgaggagagatatagtgatcccccaacgttgtgctcataagcttgttgttcgccaggttgctgcaggaggaactcactcagtggtacttacacgtgaaggtcatgtttggacatggggtcaaccatggcctcctggtgacataaaacagatctcagtccctgttcgggtacaaggtctagaaaatgtgaggcacattgcggtcggggcatttcataatctagctcttcaagaggatggaactttatgggcatggggtaataatgaatatggacaacttggaactggagatacccagccaaggtcacaacctattcctgtccaggggctttctggacttaatctggtagatattgcagctggtggatggcattctactgcattgacagatgagggagaggtatatggctggggaaggggggaacatggcaggcttggatttggtgatagtgacaagagcagtaaaatgctaccccagaaggttcaacttttagccggggaagatataattcaggtgtcctgtggaggtactcattcggttgcattaactcgggatggacgcatattttcgtttggtagaggtgaccacggccgccttggatatgggaggaaagttactaccggtcagccaatggaggtacctatcaacatccctcctcctcagagttccaatgacaatgtgactgagggacaatggattgcgaaactcgttgcttgtggtggccgccatactttggcaatagtggattgggaagtagatgaatctagagactgatttataaataaaatggaaaaaaggttaggctactggctgatttgaaattcaggctttggttttcatacacacagaatgaacaacaaatggaaagtcttggcataagctaattgaaccaagtttggcacactatgcaatcgctgtttcctcactctaatgttgcaaataaaatgtttcaaggcttaagtactgatctagtctctaatgtttggggcgagtgtcaatttcttctcaaaaagttttaagtggattcatgttgttttattgttaaattttggagagttttcttcaaagttcaggacaaaattgacatttgtctcaaactttaagggaaaaaagagtactttacccattgttttctgtttaagacatacaaaggaatcccaagtttattgcaaaagtggagccacatcaatagtgaatcatgtggatagcaagaagtatgacattcaaaaca

SEQ ID NO: 1448 - DNA, 1418 bp, Quercus alba
acagagacacagacaagtagacaacacagcccctcgccgcccaccctcacacttgagtcttgagtacctgcttcaacttcaagcactcttcccctcaaatggcctccaacacctccgctatcatcgcttgggggtcaggagaggatgggcaattgggaatagggaacaacgaagagaaagaatgggcgtatcccatcaaagccctcgattcctactccgtccgctccgtcgttgccggcagccgcaactccctcgccatttgcgacgacggaaagttgttcacgtgggggtggaaccaaagagggacattggggcacccaccagagaccaagactgagaacattccaagccaggttaaggcactagccaatgttaaaattgttcaggcagccattggtgggtggcactgtttggctgtggatgaacaaggccgagcttatgcctggggtggaaatgagtatgggcaatgtggggaagaaccagagaggaaagatgacactggtaggcctttgcgaagggatatagtgattcctaagatttgtgcaccaaagcttgtagttcgtcaggtagctgcaggaggtactcactctgtagtactcacacgtgatgggaatgtatggacatggggtcagccatggcctcctggagacataaaacagatctctgttcctgttcgagtacaaggtcttgaaagtgtgaggctcattgcagttggagcatttcataacctggctctccaagaagatggaactttatgggcatggggtaataatgaatatggacaacttggaaccggagatactcaaccaagatcacaacctattcctgttaatgggctttctggacttactttggttgatattgctgctggaggctggcattctactgcattgacggatgatggagaggtgtatggatggggaagaggtgaacatgggaggctgggatttggagataatgacaagagcagtaaaatggtgcctcagagggttaatttactagctggagaggacattgttcaggtgtcttgtggaggcacgcattcggttgcacttacgcgtgatgggcgcatattctcatttggtagaggtgaccatggacgtcttggatatggtcgaaaggtgactactggtcaaccattggaagtgcccataaacatcccacctccaagaaatcttggtgatgctgcagctgagggtcgttggattgctaaactcgttgcttgtgggggacgccatactctagctattgttgaatggaaggatactgatgaatctaaacagtgatgtgattaaatgatgatgccaaatttctaaaaacaagcatcataaattttaggctgtataacttataacttaagggacacttattaacaaagcaacatagacggaacagtttgatctgataaataatttggt

SEQ ID NO: 1449 - DNA, 1480 bp, Manihot esculenta
gcggggccttttgttccaagtggctccgccactgtcgacagtctttctggaatctaattcgcatgataaaccctttcgcagtgacgccattgcttctgctagtctcccactaaaagtccccagtttttcagaagaagacgctaaaaccttcatttcatggctactcatacctctcttattgcctggggctcaggtgaagatgggcaattaggaataggaaataatgaggagaaagaatgggtctgcgttgtcaaagctcttgagccctataaagtccgctccgttgttgctggcagtcgcaactctcttgctatttgcgacgacgggaagctgtttacgtggggttggaatcagagagggacgctagggcacccacctgagaccaagactgagaacgttcctagccaagtcaaggctcttgccaatgctaacattgttcaggccgctattgggggctggcattgcttggctgttgatgatcaaggccgtgcctacgcctggggtggaaatgagtatgggcaatgcggtgaagaacctgaaaggaaagatggcactgggaggccattgagacgggatatagtgattcctcagcgctgtgcacctaagcttgttgttcgccaggtagctgctgggggtactcattctgtggtgcttacacgtgaaggttatgtatggacctggggtcaaccatggcctcctggagacataaaacagatatctgtccctgtgcgggtgcaaggccttgaaagggtgaagctcattgcagtgggggcatttcataatttagctcttcaaggagatggaactttgtgggcatggggtaataatgaatatggacaacttggaacaggggatacccagcccagatcacaacctattccagtccaagggctctctgatctcactttggttgatattgctgctggtggatggcattctactgcactaactgatgatggagaggtttatgggtggggcagaggggaacatgggagacttggatttggagataatgacaagagcagtaaaatggtgcctcaaaaagttcatcttctagctgggaaaaaaattgttcaggtatcctgcggtgggactcattcagttgcgttgactcatgatggacaaatattttcatttggtcgaggtgaccatggacggcttggatatgggaggaaggtgacaacaggtcaaccaatggaagtgccaattgatatcccccctcccagtaatcttagcggcagtgaagctgagggacattggaaagctaaacttgttgcttgtgggggacgccatactctagcaatagtggagtggcaacagactgatggatcaaaataattataaaatatttttattaccttaccttttgttaatgtctgattttgtacaactagacagttgagataaacttgtaacaacattactatacggaaaacaatttctcttcgtttttctagtgataccctttgtttgaagtatg

SEQ ID NO: 1450 - DNA, 1809 bp, Prunus mume
atattgataaacacggtcacagtgctccgctctctccctctctctctctctctctctccctgtccctgctagctttatgggttctttctagtttatagttttattagtttataaacgtctccctgcttcaattcaagcactgtttcaggttcaaatggcatccgatgctgccattgtcacttggggctcgggtgaagatggacaattgggaatcgggaacaacgaggagaaggagtgggtatgtgttgtcgaagccctccagtcacggactgtccggtctgttgtcgctggtagccgaaactctcttgccatttgcgatgatggcaagttgtttacatggggttggaaccaaagaggaaccttggggcaccctccagagaccaaaaccgagaacattcctagccaagttaaagctcttgccaatgttaaaattgttcaggctgctattggtggatggcattgtttggctgttgatgatcaaggccgtgcttatgcctggggtggaaatgagtatggacagtgtagtgaagaacctgagcggaaagatgacactggtagacctttgagaagggatatagtgattcctcagcgctgtgcaccgaagcttgtagttcgccaggtagctgctgggggtactcactctgtggtacttacacgtgatgggcaagtatggacttggggtcagccgtggcctccgggagacataaaacaaatttcaacacctgtgcgagtacaaggtcttgatgcagtgaagctcattgcagttggggcatttcataatttggctcttcaagaggatggtactttatgggcatggggtaacaatgaatatggacagcttggaactggagatacccagcctagatcacaacctattcctgtccagggtctttctggtcttactttggtggatattgctgctggaggatggcattctactgcactcacagatgatggagaggtgtatggttggggacgaggggaacacggaaggcttggatttggcgataatgataaaagcagtaaaatggtgccccaaagggttcatcttttagctggggaggatattgttcaggtgtcttgtggaggcactcactcggttgcattaacacgtgatgggcgcatgttttcgtttggtcgaggtgaccatggacgtcttggatatggaaggaaggtgacaaccggtcaaccaatggaagtgcccatcaacatccctcccagaaatggcactgaagacaatggacactggattgccaaacttgttgcttgtgggggacgccatactctggcgatagtagtttggaaagctgatgaagcagaagaatcataaaactgatgaacttgtttcagaaaattttccggtagctcgaataaccactaccattgttggttctgtataacagtattatttaagatcaaccagtaacatatctatataggaggaagaactagtttccttatggagttgattaagatttcataagaagtgggttctgcaagcttttttctttggttttttgagttgggtggattgactggcaaaattcacaatgaacactcatgcaagttccttgcgtacaaaaactgatacaaacacaaagtgtgtcatttaatctaccccttctgatatgaacagaagtctcagataacagttgtcgtgcctgtggttcgggggtgatgacccatggcaattccacctgatctatatctgctcttaaacatcccagcatgcagaagcaccaggtacatcaattgacttagtagtgatattgcaatcatagcttccaatgtttgctgaaaaaccagtca

SEQ ID NO: 1451 - DNA, 1426 bp, Prunus persica
ctctctctctctctctctctctgctagctttatggtttctttctagtttatagttttattagtttataaacgtctccctgcttcaattcaagcactgtttcaggttcaaatggcatccgatgctgccattgttacttggggctcgggtgaagatggacaattgggaatcgggaacaacgaggagatggagtgggtatgtgttgtcgaagccctccagtcacggactgtccggtctgttgtcgctggtagccgaaactctcttgccatttgcgatgatggcaagttgtttacatggggttggaaccaaagaggaaccttggggcaccctccagagaccaaaactgagaacattcctagccaagttaaagctcttgccaatgctaaaattgttcaggctgctattggtggatggcattgtttggctgttgatgatcaaggccgtgcttacgcctggggtggaaatgagtatggacagtgtagtgaagaacctgagcggaaagatgatactggtagacctttgagaagggatatagtgatccctcagcgctgtgcaccgaagcttgtagtccgccaggtagctgctgggggtactcactctgtggtacttacacgtgatgggcaagtatggacttggggtcagccgtggcctccgggagacataaaacaaatttcaacacctgtgcgagtacaaggtcttgatgcagtgaagctcattgcagttggggcatttcataatttggctcttcaagaggatggtactttatgggcatggggtaacaatgaatatggacagcttggaactggagatacccagcctagatcacaacctattcctgtccagggtctttctggtcttactttggtggatattgctgctggaggatggcattctacttcactcacagatgatggagaggtgtatggttggggacgaggggaacacggaaggcttggatttggcgataatgataaaagcagtaaaatggtgccccaaagggttcatcttttagctggggaggatattgttcaggtgtcttgtggaggcactcactcggttgcattaacacgtgatgggcgcatgttttcgtttggtcgaggtgaccatggacgtcttggatatggaaggaaggtgacaaccggtcaaccaatggaagtgcccatcaacatccctcccagaaatggcactgaagacaatggacactggattgccaaacttgttgcttgtgggggacgccatactctggcgatagtagattggaaagccgatgaagcagaagaatcgtaaaactgatgaacttgtttcagaaaattttccggtagctcgaataaccactaccgttgttggttctgtctaacagtattatttaagatcaaccagtaacatatctatataggaggaagaactagtttccttatggagttcatt

SEQ ID NO: 1452 - DNA, 1551 bp, Cicer arietinum
gtttgatttgagtgtagggagagtagagtgagtgagtgcgtcaactcaacctgacctctttcaaattcaatctttgtctctctgtctgtcgttttcatcctcatggattccaattcccatatcattacttggggatcaggcgaagatggacaactaggaatcggtagcaacgatgataaagaatgggtttgtgccgtcaaagctctttcttctcaatctgttcgctctgtagtcgctggtagtagaaactcactcgccatttgtaatgatggcaagttgtttacatggggttggaatcaaaggggaacacttggacacccaccagagaccaagactgaaaatattcccagccaagtcaaagcacttgcacatgttcaaattgttcaggcggctattggtggttggcattgtttggctgttgatgatcacggaagagcttatgcttggggtggaaatgaatatgggcagtgtggcgaagaacctgagcgcaaggacgacactggtagacctttgaggagagatataatgatccctcaacgttgtgctcccaagcttgttgttcggcaggttgctgcgggaggaactcactcagttgtacttacacgtgaaggacatgtttggacatggggtcagccgtggcctcccggtgatattaaacagatttcagtcccggttcgggtgcaaggtcttgagaatgtgaggcttatagcagtaggggcatttcataatttggctctccaagaggatggaacgttgtgggcgtggggtaataatgaatatggacaacttggaactggagatacacaaccaagatcacaacctattcctgtgcaagggctttctggacttactttggtagatattgcagctggtggatggcactctactgctttgacagatgaaggagaggtatatggttggggaaggggagaacatggtaggcttggatttggtgatagtgataaaagcagtaaaatgttacctcagagggttcaacttttaaccggcgaagaaattgttcaggtgtcttgtggaggtactcattcagttgcattatctcgagatgggcgcatattttcttttggtagaggtgatcatggacgtcttggatatgggaggaaagtcactactggtcaaccaatggaggtacctatagacatttctcctccacagaattttagtggtagcgaagccgcgggacgttggatagccaaactcgttgcttgtggcggccgccatactttggcaatagtagaatggaaagaagatgatgaatctaaagattgaatctgatcataaataaaatggaatttgggaagtagattaggctaatcactgatttggaattcaatccatgtgatagaattctcgtgttgtgtgcggtgtgatatgaggtgtacttgaataaacaatttaaataagtgcttattcaataaagttttgtcacataagaaagcatggataatggataagttgtttctcacgttgaagagtttttgaagatagatttcacaaagctctaatatactatctatttatgaaaattatttt

SEQ ID NO: 1453 - DNA, 1614 bp, Populus trichocarpa
ctacaaatccacaaaaaaggaacctcaaggttgtccatttccactaaactgcgattctggctaaagctttttagaccactgtccgaatccaattcacctcgcataatcaaggcgataggcagggaaaaagggaaaacccccactgccaccactaaccccaaaaaccctttaaaaaacctcctctttataaatacacccacgtacttatttctttgtcgctttctctccaatggcaaccgagtcctctgtgattgcctggggatcgggcgaggatggccaactagggatagggaacaacgaagacaaagaatgggtttgcgttgtcaaagctctcgagccttacaaagttcgctctgttgttgctggaagtcgcaactctcttgccatttgtgatgatggcaagttgtttacttggggttggaaccaaagagggacattaggacatccaccagagaccaaaaccgagaacattcctagccaggtcaaggctcttgctaatgtcaacattgttcaggctgctattggtggctggcattgtttggctgttgatgatcaaggacgtgcttattcttggggtgggaacgaatatggccagtgtggtgaagaacctgagaggaaaaatgacactgggaggcctttgagaagggatatagtcatcccccaacgctgtgcatcaaaccttgtagttcgccaggtagctgctgggggtactcactctgtggttctcacacgtgaagggcatgtatggacctggggtcaaccatggcctcctggagacataaagcagatatctgtccctgtgcgggtacaaggtcttgaaagagtgaggctcattgctgttggggcatttcataatttagctcttcaagaagatggaactttatgggcgtggggtaataatgaatatggacagctcggaactggtgatactcagccaagatcacaacctattcttgtccaaggactttctggtctcaatttggttgatattgctgctggtggatggcattctactgcattgactgatgatggggaggtgtatggttggggaagaggtgaacacggaagaatgggatttggagataatgacaagagcagtaaaatggtcccccaaaaggttaatcttttagcaggggaggacattattcaggtatcttgtggcgggactcattcagttgcgttgacacgtgatgggcagatgttttcctttggtcgaggtgaccatggacggcttggatatgggaggaatgtgactacaggtcaaccaatggaagtgccaatagacatcccgcctcctaaaaaacttcgtgacagtggagacgagggacactggattgctaaacttgttggttgcggaggtcgccatactttggcgatcgtggaagtggcagagacttgaatctaaatagatttgacatgatgtctaaaagtctgattttgtattacgagacaatgcaagaccaactcagagaacattaacactggataattttataaattactggatggtattcacttttccattttacttacgggaagagttcaatttccatgtcatgggatatggtttttgatgatgtttcaaaaaattcaagtagtttggggccaagttta

SEQ ID NO: 1454 - DNA, 1649 bp, Cajanus cajan
gcgttttggattcaaaaaatggtaagaagcactcactcgtgaatcccacgcaatcctcttgttttcttctgcactcactcactcactctctcagctcactctcaaaccttgatggattcccattcccacatcattgcatggggttccggcgaagacggtcaactaggaatcggcaacaacgaagagaaggaatgggtctccgtcgtcaaagccctccagccccaccgtctccgctccgtcgtcgccggcagcagaaactccctcgccatcgctgacgacggcaaactgttcacttgggggtggaaccaaaggggcacgcttggctacttgtctgagactgagaccaagactgagaacattcccggccagctcaaggctctttccggtgttaaaattcttcaggcggctattggggggtggcactgtttggctgttgatgatcaaggcagagcttatgcctggggtgggaatgaatatgggcagtgtggtgaagaacccaaggatgacactggtagacttttaaggagagatatagtgatccctcagcgctgtgccccaaagcttgttgttcgccaggttgctgcaggaggaactcactcagtggtacttacacgtgaagggcatgtttggacatggggtcagccatggcctcctggtgacataaaacagatttcagtccctgttcgggttcaaggtcttgaaaatgtgaggctcattgctgttggggcatttcataatttggctcttcaagaggatggaactttatgggcatggggtaataatgaatatgggcaacttggaactggagatactcaaccaagatcacagcctattcctgttcaaggactttctgatcttactctggtggatattgctgctggtggatggcattctactgcattgacagatgaaggagaggtttatggctggggaaggggtgaacatggcaggcttggattcggtgatagtgacaagagtagtaaaatggtaccgcagaaggttcagcttttagctggtgaagatattgttcaggtgtcatgtggaggtactcattcagttgctttaacccgggatggacgcatgttttcttttggtagaggtgaccatggtcgtcttggatatggaaggaaagtgaccactggtcagccaatggaggtacctataaacatccctcctccacagaatctcagtgacagtgcagctgagggacattggatagctaaacttgttgcttgtggtggccgccatacgttggcaatagtagaatggaaaccaaatgaatcttaagattgactcatgaatcataaataaaacgcaaactggaaagtagatgagcctaatgactcatttggaactcagttgaggtgctacaatttctgttggaactcaaatcatatatagcacacacgttcatcaatatagtcatgggagttggttttgaatggtcttaatttccgtatttatttaggagatgtttggttaggtgaattttatctagaaatcatgattttcgataattatatcgtggctattgtttttggagatgatttagttttatttgattaaatataactattttagggaatgattacattttttttttgaatcaaagatttttatatttggtttttatagaattttattggata

SEQ ID NO: 1455 - DNA, 2743 bp, Cannabis sativa
aaactcaaaaaacgttttaaaaatttaaaagattttatcatttaataaacaataaataaaattgggttttgtacccatgcccactaaatggctgacgcattgccgcatcgggttcgctgtgtccgagtttgaataccatactcactactcttttacttgtgcttgtgcttgggttgggctgctctttttcttactctctccttcacacctctctctttcaacctctcatggcttcggattctgccattatagcctggggctcaggagaagatgggcaattaggattggggagtaatgaagataaagaatgggtttccgttgttaaagctcttgagtctcaaaacgttcgttctgtagttgccggtagccgaaattccctcgccatttgcgaggatggcaagttgtttacatggggatggaatcaaagaggaacacttggacaccctcctgaaactaaaactgaaaatattccaagccaggttaaggctctggctaatgtcaagattgtcgaggctgctattggtggttggcattgtttggctgttgatgatcaaggccgggcttatgcttggggtggaaatgagtatggccagtgtggtgaagaacctgagagaaaggatgacactggtagacctctaagaagggatatagtgattcctcagcggtgtgcgccgaagcttgtagtccgccaggttgctgctgggggtactcattctgtggtacttactcgggaagggcaagtatggacatggggtcagccatggcctcctggtgatataaaacagatttctattcctgtccgagtgcaaggccttgaagctgtcagagtgattgctgttggggcattccataatttggctctccaagaggacggtactttatgggcatggggtaataatgaatatgggcaactgggaactggagatacccaacccagatcccaaccaattcctgttcaagggctttctggtcttactctggttgatattgctgctggtggttggcattctaccgcacttacagatgaaggagaggtatatggttggggacgaggggaacatggaagacttggatttggagataatgacaaaagcagtaaaatggtgccccagaaagtgaatcttttggctggggaagatattgttcaggtatcctgcggaggcactcactcggttgcgttaacccgtgatggtcgcatattttcgtttggtcggggagaccatggacggcttggatatgggaggaaggtgacgaccggacaaccgatggaggttcccatagacctatctcctcctacagagaatactacaactgatgacgaagaaggtgaggaacgttggatagctaagcttgttgcttgtggaggtcgccatactctggccattgtccaatggcagattcatgatgaatcaaaccagtgatcaaatcaaatcaaacccttttctttagtggagaatttgttcaatttaactactaataaccgcagtaaatgttggtcaaatgggttttagaagaatatactataactctagtgaacacttcagtatggaaaagaggatgcaatcataataatattcttgggactatttttaagcatgcaaaacttgtacagttggtttgttcctctgccatatactcgtactaagcaaaatgtatatgtatgcgatataacagtatatagttttcttctaacaacatatataaaaacatacaacgaaaaaaacatcaaatatcagctgatgtggcaggtttctgggggtcattgcgataccctggaccataagtactactgtacaccccaccgtggagaagcaccacataaagtatctgactcagcagtgatatcactatgaaagcctccaatgtttgctgcaaagaagaagaagaagaattaagaaccaagatccttttttccactcagaatttggttcaaaaaatactgttacatctttaccaagcgttttcctctgcgtcctcctagtatcatttccttacacacaagtctgcaacaagagaatttatttggctgtaacttctcatgaactaatgtatgcatgtaatgtatgtatgtatatatatacgagtacccaaaagcaagagctgttagagcccaagcgatgagagctaaggaagaagcagcagccaaactgtcactacgccaagtacgcagatggatgagccctgaaatgagagagcaagcacccactaccccacctaccagagcaaacaccaacatgaatctagttgatggattcccacctaaatctgccattatcaacacaagatataaaataaaacacccgtttctcaaatataaccaaatatatacacataaatttagagagagaagagagtgagtgtacggggatggttttcctctccatcgatgtatttgtcaatatacacataaatttagagagagaagagagtgagcgtacggggatggttttcctctccatcgatgtatttgtcaagagaccatccagcgagtccaagcacaattagatgaactaccaagttagcaacaataagaggacctaataagtctctaacacctctcccactcgtcataatcacccacaacccacaataagctcaacccaacatagaatgagcagcacaaataaatggatctatgtatatataggctatatatggatagtttctgaggttggttgatgctctcaaaaagagttattcaaagaaaaagaaagaagtagaagaaaagcttttgctttagttt

SEQ ID NO: 1456 - DNA, 1604 bp, Glycine max
gtagtatttaaagtgcagtagtgggtttagttgagtttttcgcatccttaaaaatgaaaagaagcactcactcgtgaaccccacgcagtgttcgataatcaaatcttctttctttttcttccgcagtcccaaccttcatggattctcactcacacatcattgcttggggctctggtgaagatggtcagctaggaatcggaagcaacgaagagaaagaatgggtctgcctcgtcaaagccctccagccccaccgtattcgctccgtcgtcgccggcagcagaaactccctcgccatcgctgacgacggcaaattgttcacttggggttggaaccaaagggccacacttgggcaccctgctgagaccaagtctgagaacaagactgagaacactcccagccaggtcaaggctctttccagtgttaaaattgttcaggcggctattggggggtggcactgtttggccgttgatgatcagggcagagcttatgcttggggtggaaatgaatacgggcagtgtggcgaagaacccgagcgcaaggatggcactggtagacctttaaggagagatatagagatccctcagcgctgtgctcctaagcttgttgttcggcaggttgctgcaggaggaactcactcagtggtacttacacgagaagggcatgtttggacatggggtcagccatggccgcctggtgacataaaacagatttcagtccctgttcgggttcaaggtcttgaaaatgtgaggctcattgctgttggagcatttcataatttggctcttcaagaggatggaactttatgggcatggggtaataatgaatatggacaacttggaactggagatactcagcctagatcacaacctattcgtgttcaaggactttctgatcttaccttggtagatattgcagctggtggatggcattctactgcattgacagatgaaggagaggtatatggctggggaaggggggagcatggcaggcttggatttggtgatagtgacaagagcagtaaaatggtaccccagaaggttcaacttttagctggagaagatattgttcaggtgtcctgtggaggtactcactcagttgcattaacccgggacgggcacatgttttcttttggtagaggtgaccatggacgtcttggatatggtaggaaagtcaccactggtcaaccaatggaggtacctatagacctccctcccccacaggatcccagtggcactgcaactgagggacattggatagctaaactagttgcttgtggtggccggcataccctggcaatagtagaatggaaatcaaatgaatcttaaaattgactcaaattctaaataaaacagaaactggaaagtggatgaggctaatgactgatttggaactcaattcaggtgctggaatttcactcgttctgcatgatatgatcttgcctttgtataatcatgcatatggcacaagcataaaattcatcaatatagtaacggggtttggttttggatggtcttaatttgcatattcatgcaggcgatttttttttttattcgtaggaattgaagactgttaaaaaaatttacaataattcacgtattttgttc

SEQ ID NO: 1457 - DNA, 1594 bp, Trigonella foenum-graecum
gttttcaaatatcctctcaatccaaactcaactcaacctgactgactgacctttgtctccgtcagtcattctcatctcatccattctcatggcttcccacatcattgcttggggttcaggtgaagatggtcaattaggaattggtacaaacgatgataaggaacgagtttgtgccgttaatgctcttccttctcaacgtgttcgttctgttgttgctggtagtagaaactcactcgccatttctgatgatggcaagttgtttacatggggttggaatcaaaggggaactcttggacacccagctgagacgaagactgaaaacattcccagccaagtcaaagcactttcccacgttcacattgttcaggcggctattggtgggtggcactgtttggctgttgatgatcacggaagagcttatgcttggggtggaaatgaatacggtcagtgtggtgaagaacctgagcgcaaggatgacaatggtagacctttgaggagagatatagtgatcccccagccttgtgctcccaagctttctgttcgacaggttgctgctggaggaactcactcagtggtacttacacgtgaagggcacgtttggacatggggtcagccgtggcctcctggtgatattaaacagatttcagtcccggttcgggtacaaggtcttgacaatataaggcttatagcagtaggtgcatttcataatttggctctccaagaagatggaactttgtgggcttggggtaataatgaatatggacaacttggaactggagatacacaaccaagatcacaacctattcatgtgcaagggctttctggtcttactgtggtagatattgcagctggtggatggcactctactgcattgacagatgaaggagaggtatatggctggggaaggggagaacatggtaggcttggattcggtgatagtgataagagcagtaaaatgttacctcagagggttcaacttttagccggtgaagatattattcaggtgtcttgtggaggtactcattcagttgcattaacccgagatggacgcatattttcttttggtagaggggatcatggacgtcttggatatgggaggaaagtcactaccggtcaaccaatggaggtacctataaacatccctcctccacagaatctcgacgacagtgaagctgagggaaattggatagccaaactcgttgcttgtggtggccgccatactttggcaatagtagaatggaaagaagatgaatctaaagattgaatctagtcataattaaaatggaaactggtaagtaaattaggttaatgactgatttggaacttggtccatgtgtgatatgaggtgtgtttggataaacaacttaaataagtgtttattgaatagacatttatcgcataagagctcatgtataagttttttcaaggattgaagagcttttgaagctaaattttactcaagatctgataagctacttctatgagctagtataaggagtttatgaaaataagatttatatgctataaccttaaataaactcaatatgttcttccaaacacaattcatgatatattagtctttctataatctacg

SEQ ID NO: 1458 - DNA, 1459 bp, Castanea mollissima
cagccgccactcgccgcccaccctcacagttgagtttgagtacctgcttcaacttctcttgccctcaaactcaatggcctccaacacctccgctatcatcacttgggggtcaggagaggatgggcaattgggaatagggaacaacgaagagaaagactgggcgtatcccatcaaagccctcgattcctactctgtccgctccgtcgttgccggcagccgcaactccctcgccatttgcgacgacggaaagttgttcacgtgggggtggaaccaaagagggacattggggcacccaccagagaccaagactgagaacattccgagccaggttaaggcactagccaatgttaaaattgttcaggcggccattggtgggtggcactgtttggctgtggatgaacaaggccgagcttatgcctggggtggaaatgagtacgggcaatgtggggaagaaccagagaggaaagatgacactggtaggactttacgaagggatatagtgattccaaagatttgtgcaccaaagcttgtagttcgtcaggtagctgcaggaggtactcactctgtagtactcacacgtgatgggaatgtatggacatggggtcagccatggcctcctggagacataaaacagatctctgttcctgttcgagtacaaggtcttgaaagtgtgaggctcattgcagttggagcatttcataacctggctctccaagaagaaggaactttatgggcatggggtaataatgaatatggacaacttggaaccggagatactcaaccaagatcacaacctattcgtgttaatgggctttctggacttactttggttgatattgctgctggaggctggcattctactgcattgacggataatggagaggtgtatggatggggaagaggtgaacacgggaggctgggatttggagataatgacaagagcagtaaaatggtgcctcagagggttaatttactagctggagaggacattgttcaggtgtcttgtggaggcacgcattcagttgcacttacacgtgatgggcgcatattctcatttggtagaggtgaccatggacgtcttggatatggtcgaaagattactaatggtcaaccattagaagtgcccataaatatcccacctccaagaaatcttggtgacgctgcagctgagggtcgttggatggctaaacttgttgcttgtgggggacgccatactctagctattgttgaatggaaggatactgatgaatctaaacagtgatgtgattaagtgatgatgccaaatttctaaatacaagcatcataaatttttgtctttataacttattacaacttaagggacacttattaacaaagcaacatagacggaacaatttgatctgataaataatttggtgattagattgtttttatttattttagggaaaccgtaatacttattacaacatacgaagacaaa

SEQ ID NO: 1459 - DNA, 1642 bp, Trifolium pratense
caaccctttgtctctgtctgtcgttctcatcctctcctctcatggtttcctccaattcccatatcattgcctggggatcaggtgaagatggacaattaggaattggtacaaacgaagataaagaatgggtttgtactgtcaaagctcttccttctcaacgtgttcgctctgttgttgctggtagcagaaactccctcgccatttgtcatgatggcaagttgtttacttggggttggaatcaaaggggaacacttggacacccagctgagaccaagactgaaaacattcctagccaagtcaaagcactttcccatgttcacattgttcaggcggctattggtgggtggcattgtttggctgttgatgatcacggcagagcttatgcgtggggtggaaatgaatatggtcagtgtggtgaggaacccgagcgcaaggatgacaatggtcgacctttgaggagagatatagtcatccctcagccttgtgctcctaagctttctgttcgacaggttgctgctggaggaactcactcagttgtacttacacgtgaagggcatgtttggacatggggtcagccgtggccgcctggtgatattaaacagatttcagtcccagttcgggtgcaaggtcttgagaatataaggcttatagcagtaggtgcatttcataatttggctctccaagaagatggaactttgtgggcatggggtaataatgaatatggacaactcggaactggagatacacaaccaagatcacaacctattcatgtgcaagggctttcgggacttaatttggtagatattgcagctggtggatggcactctactgcattgacagacgacggagaggtatatggctggggaaggggagaacatggtaggcttggatttggtgatagtgataagagcagtaaaatgttacctcagagggttcaacttttagccggcgaagatattgttcaggtgtcttgtggaggtactcattcagttgcattaactcgagatggacgcatattttcttttggtagaggtgatcatggacgtcttggatatgggaggaaagtcactactggtcaaccagtggaggtacctatagagatccctcctccacagaatctcagtgacggtgatgccgagggaacttggatagccaaactcgtcgcatgtggtggccgccatactttggcaatagtagaatggaaagaagacgaatctaaagattgattctaattataaataaaacggaaactcggaaatagattaggctaatgacttatttggaactcaattcaggttgatatgagctgtgtttggataaacaacttaaacaagcgattattgaataaacgactatcacatatgagcttatgtataattggcttttaggattgaagagcttttgaaatttgaagctcaatttcacacaaactctgataagccatttctaaaagctagcataagagtttataaaaatgagctattgtaagttatttttgttaaggtctctctaatagacaaacacgtacataagtacttatatgctataagcttaagtaaactcaaaataagctcttccaaacaaaactcatgatacattagttttcctatgatctaatgatggcacatacatgttattcatc

SEQ ID NO: 1460 - DNA, 1369 bp, Fagus grandifolia
acacaaaaagtaaaacagactcgccgcccacccctcactctcttctgcttcaacctcaagtactctccctctcatggcctccaactccaacaaccccgccatcatcgcttggggctcaggagaggacggccaattgggtatcggcaataacgaagagaaagaatgggcctgcatcatcaaatccctccaatcctactctgtccgctccgtcgtagccggtagccgcaattccctcgccatttgcgacgacggaaagttgtttacgtgggggtggaaccagagagggacattggggcacccaccagagaccaagaccgagaatattcccagccaggttaaggcgcttgccaatgttaacattgttcaggctgccattggtgggtggcactgtttggctgtcgatgatcaaggccgagcttatgcctggggtggaaatgagtatgggcaatgtggggaagaaccagagaggaaagatgacactggtaggcctttgagaagggatatagtgattcctcaacgttgtgcgccaaagcttgtagttcgtcaggtagctgcaggaggtactcactctgtagtacttacacgtgatgggcatgtatggacatggggtcagccatggcctcctggagacataaaacagatctctgttcctgttcgagtactaggtcttgaaagtgtgaggctcatcgcagttggagcgtttcataatttggctctccaagaggatggaattttatgggcatggggtaataatgaatatggccaacttggaaccggagatacccaaccaagatcacaacctattcctgttcatgggctttctggtcttactttggttgatattgctgctgggggttgcattctaccgtattgacggatgaaggagaggtgtatggatggggaagaggtgaacatgggaggctgggatttggagataatgacaagagcagtaaaatggtgcctcagaaagttcttcttctagctggagaggacattgttcaggtgtcttgtggaggcacgcactcagttgcacttacccgtgatgggcgcatgttctcatttggtagaggtgaccatggacgtcttggatatggtcggaaggtgaccactggtcaaccattggaagtgcccataaacattccacctccaagaaatcttggtgacactgcagttgaagagcgttggtttgctaaacttgttgcctgtgggggacgccatactctagctatggtagaatggaagggtactgatgaatctaaacagtaataaaataatattgatgccaaatttctagagacaagcatcgtgaattttagtctttattacttacaacctaagctacacttattaacaaatcaatatagaaaga

SEQ ID NO: 1461 - DNA, 1413 bp, Castanea mollissima
gccgccactcgccgcccaccctcacagttgagtttgagtacctgcttcaacttctcttgccctcaaactcaatggcctccaacacctccgctatcatcacttgggggtcaggagaggatgggcaattgggaatagggaacaacgaagagaaagactgggcgtatcccatcaaagccctcgattcctactctgtccgctccgtcgttgccggcagccgcaactccctcgccatttgcgacgacggaaagttgttcacgtgggggtggaaccaaagagggacattggggcacccaccagagaccaagactgagaacattccgagccaggttaaggcactagccaatgttaaaattgttcaggcggccattggtgggtggcactgtttggctgtggatgaacaaggccgagcttatgcctggggtggaaatgagtacgggcaatgtggggaagaaccagagaggaaagatgacactggtaggactttacgaagggatatagtgattccaaagatttgtgcaccaaagcttgtagttcgtcaggtagctgcaggaggtactcactctgtagtactcacacgtgatgggaatgtatggacatggggtcagccatggcctcctggagacataaaacagatctctgttcctgttcgagtacaaggtcttgaaagtgtgaggctcattgcagttggagcatttcataacctggctctccaagaagaaggaactttatgggcatggggtaataatgaatatggacaacttggaaccggagatactcaaccaagatcacaacctattcgtgttaatgggctttctggacttactttggttgatattgctgctggaggctggcattctactgcattgacggataatggagaggtgtatggatggggaagaggtgaacacgggaggctgggatttggagataatgacaagagcagtaaaatggtgcctcagagggttaatttactagctggagaggacattgttcaggtgtcttgtggaggcacgcattcagttgcacttacacgtgatgggcgcatattctcatttggtagaggtgaccatggacgtcttggatatggtcgaaagattactaatggtcaaccattagaagtgcccataaatatcccacctccaagaaatcttggtgacgctgcagctgagggtcgttggatggctaaacttgttgcttgtgggggacgccatactctagctattgttaaatggaaggatactgatgaatctaaacagtgatgtgattaagtgatgatgccaaatttctaaatacaagcatcataaattttagtctttataacttattacaacttaagggacacttattaacaaagcaacatagacggaacaatttgatctgataaataatttggtgattagattgtttttattt

SEQ ID NO: 1462 - DNA, 1571 bp, Humulus lupulus
ggtttaggtcttgttgcttccgtccgggtgctttgtcccacctagatggctgacgcatcgccgcatcgggttcgctgtgtccgcattttgagtactactgtactgctactgctactgctgctcctacacttctacttgtttattattattgttgggttgggccgctcttctcaattctcattctcactctcacctcctcctcctcttctctgcaactactcacacctcggtctcaacctctcacggcttccaataccgccattattgcttggggctcaggagaagatgggcaattaggattgggagtaatgaagataaggagtgggtttccgttgttaaagctctggagtctcaaaaagttcgctctgtagttgccggtagccgaaattccctcgccatttgcgaagatggcaagttgtttacatggggctggaatcaaagaggaacgcttgggcaccctcctgaaactaaaactgaaaatatcccaagccaggttaaagctctggctaatgtcaagattgtcgaggctgctattggtgggtggcattgtttggctgttgatgatcaaggccaggcttatgcttggggtggaaatgagtatggtcagtgtggtgaagaacctgagagaaaggacgacactggtagacctctgagaagggatatagtgattcctcagcggtgtgcgccaaagcttgtagtccgccaggtagctgctggaggtactcattctgtggtacttacactggaggggcaagtatggacatggggtcaaccatggccccctggtgatataaagcagatttctattccagtccgagtccaaggtcttgaagccgtcagattgattgcagttggggcatttcataatttggctctccaagaggatggtactttatgggcatggggtaataatgaatatggacaactgggaactggagatacccaacccagatcacaaccaattcctgttcaagggctttctggtcttactctggttgatatagctgctggaggatggcattctactgcacttacagatgaaggagaggtgtatggttggggacgaggggaacatggaagacttggatttggagataatgacaaaagcagtaaaatggtgccccagaaggtgaatcttttagctggggaggatattgttcaggtatcttgcggaggcactcactcagttgcattaacccgtgacggtcgcatattttcgtttggtcggggagaccatggacggcttggatatgggaggaaggtgacgaccggacaaccaatggaggttcccataaacctatctcctcctacagagaatacaaccgatgatgaaggtgaggaacgttggatagctaagcttgttgcttccggaggtcgccatactatggccattgtgcaatggcagactcatgatgagtcaaagcagtgatcaaatcaaatcaaatccttttcttttgtggagaactttgttcaacttaagtactaataaccgcagtaaatgttggtttttcagaagaccataccataactcgaatgaacaacttttccacttcaatatagaaaagacaagc

SEQ ID NO: 1463 - DNA, 1356 bp, Tropaeolum majus
gggggctacttccactttctactgtttttgtttgcattcattctctctaatggcttcccctacttccattattgtttggggctcaggagaagacgggcagctcggaatcggaaacaacgttgaaaaagagttggttacggtcgtaaaagctgtagaaccctataatgttcgctctgttgtagccggtagccgcaactctctcgccatttgtgacgacggcaagttgtttacatggggttggaaccagaggggtactttagggcacccatctgagacgaaaactgagaacgttcctagtcaggttaaggctctcgccaatgttaaaatcgtccaggcggctattggtggctggcattgtttggctgttgatgatcaaggtcgagcttatgcttggggtgggaatgagtatggccagtgcggtgaagaactggaacggaaagatgatgctggaagacctttaagaagggacattgtaattcctcagcgttgtgcctcgaagcttgtagttaaacaggtagcagccggtggtactcattccgtggtgctcacacgtgaagggcacgtatggacctggggtcagccatggcctcctggagacataaaacaaatatctgtccctgtgcgagtgcaaggtctggaaggagtaaaggtcatttcagttggagcatttcataatttggctctccaggatgatgagactgtgtgggcttggggtaataatgagtatggacaacttggaactggggatacacaacctagatctcagcccattcctgttcaagggctctccggcctcactttggttgatattgctgctggaggatggcattcaactgctttgactgatgaaggagaggtgtatggttggggaagaggggagcatggcaggcttgggttcggggataacgacaagagcagtaaaatgttgcctcaaaaggttaatctcttagcaggggaggacataatccaggtatcatgtggcgggactcactcagttgctttgacacgcgatggtcatatgttttcttttggccggggcgaccatgggcggcttggatacgggaggaaagttacgacaggtcaaccgatggaagtacccataaatataccacctccgagagagagtggagaaaaagcagagggaaactggtttgctaaagtggttgcttgtggaggacgccacactctagccattgtagaatggaaaactgaatagtctaaaagggtgtttcttaaaatcactgtattaaattatctggtagcccacccaaagatgttttggttatgctgtttgattaagtagtgataaactcacacaaaattatataataataaatgggacatcttatcgtctgt

SEQ ID NO: 1464 - DNA, 1352 bp, Vigna unguiculata
cttcatggattcccattcatgtattattgcatggggctctggtgaagatggtcaactaggaatcggcaacaacgaagagaaagaatgggtctgtctcgtcgaagctctccaacctcaccgtttccgctccgtcgtcgccggcagcagaaattccctcgccatcggtgaggacggcaagttgttcacttggggttggaaccaaaggagcacacttgggcatccagctgagagtaagtctgagaacaagattgagaacattcccagccaggtgaaggctctttccagtgttaagattgtccaggcggctattggggggtggcactgtttggctgttgatgatcagggcagagcttatgcctggggtggaaatgaatatgggcagtgtggtgaagaacctgagcgcaaggatgatactggcagaccattaaggagagatatagacatccctcaacgctgtgctcctaagctcgttgttcgacaggttgctgcaggaggaactcactcagtggtacttacacgtgaaggccatgtttggacatggggtcagccatggcctcctggtgacataaaacagatttcagttcctgttcgggttcaaggtcttgaaagtgtaaggctcattgctgttggagcatttcataatttggctcttcaagaggatggaactttatgggcatggggaaataatgaatatggacaacttggaactggagatactcaaccaagatcacaacccattcctgtccaaggactttctgatcttactctggttgatattgcagctggtggatggcattctactgcattgactgatgaaggagaggtatatggctggggaaggggggaacatggcaggcttgggttgggtgatagtgacaagagcagtaaaatggtaccccagaaggttcaactgttagctggagaagatattgtgcaggtatcctgtggaggtacccactcagtggcattaacccgcgatggccgcatgttttcttttggtagaggtgaccatggacgtcttggatatggtaggaaagtgacgactggtcaaccaatggaggtacctataaaccttcctcctccacacaacctcactgccactgaagctgagggacattggatagctaaacttgttgcctgtggtggcagacataccttggcaatagtacaatggaataacagatcatcttaactcattcataaatcataaacacaaaccaaaaatgaaacactagattataaggctaatcactcactcatgtcaaactctgctgtgttcagtttggtatgatcttcttttactaataacttcaatagatatactattttaaaactttcttgtgtcatttctt

SEQ ID NO: 1465 - DNA, 1496 bp, Trifolium pratense
tgtgtcctgttgttttcaaacatcatcgtcatcatcatcctcacttcaactcaaccctttgtctctttctgtcgttctcatcatcctctcatggattccaccaattctcacatcattgcctggggatcaggtgaagatggacaattaggaattggtacaaacgaagataaagaatgggtttgtactgtcaaagctcttccttctcaacgtgttcgctctgttgttgctggtagcagaaactccctcgccatttgtcatgatggcaagttgtttacttggggttggaatcaaaggggaacacttggacacccagctgagaccaagactgaaaacattcctagccaggtcaaagcactttcccatgttcacattgttcaggcggctattggtgggtggcattgtttggctgttgatgatcacggcagagcttatgcgtggggtggtaatgaatatggtcagtgtggtgaagaacccgagcgcaaggatgacaatggccgacctttgaggagagatatagtcatccctcagccttgtgctcctaagctttctgttcgacaggttgctgctggaggaactcactcagttgtacttacacgtgaaggacatgtttggacatggggtcagccgtggcctcctggtgatattaaacagatttcagtcccagttcgggtgcaaggtcttgagaatataaggcttatagcagtaggtgcatttcataatttggctctccaagaagatggaactttgtgggcatggggtaataatgaatatggacaactcggaactggagatacacaaccaagatcacaacctattcatgtgcaagggctttctggacttaatttggtagatattgcagctggtggatggcactctactgcattgacagacgacggagaggtatatggctggggaaggggagaacatggtaggcttggatttggtgatagtgataagagcagtaaaatgttacctcagagggttcaacttttagccggcgaagatattgttcaggtgtcttgtggaggtactcattcagttgcattaagtcgagatggtcacatattctcttttggtagaggtgatcatggacgtcttggatatgggaggaaagttactactggtcaaccagtcgaggtacctatagagatccctcctccacagaatctcaatgacggcgaagccgagggaacttggatagccaaactcgtcgcttgtggtggccgccatactttggcaatagtagaatggaaagaagacgaatctaaagattgaatttaattataaataaattcgaaactcggaagtagattaggctaatgacatatttggaactcaatctaggttgatatgaggtgtgtttggaatttggataaacaacttaaacaagcgattattgaataaacgactatcacatatgagcttatgtataattggcttttaggattgaagagcttttgaaatttgaagctcaatttcacacaaactctgataag

SEQ ID NO: 1466 - DNA, 1398 bp, Amsonia hubrichtii
gcctaagtagaacactcactccaccattgatacatatcccctacaatccagctcttttcttgagagccaacagtgcagtaggcatcgcctctatggccgcatccaagacagccgttatcgcatggggttcgggagaagatgggcagttgggaattggtaataatgaggagaaagaatgggtttgcgtcatcaaagctctggaggcgtacaacgtttgctctgtcgtcgctggtagtcgaaactctcttgctatttgcgacgacggcaagttattcacttggggctggaaccaaagagggactttgggccatccgcctgagaccaaaacagagaacattcctagtcaagtgaaagctctggctaacgttaagattgttcaggcagctattggtgggtggcattgtttggctgttgatgatcaaggccgagcctatgcttggggtggaaatgaatatggccagtgtggtgaagagcctgaacggaaagatgacaatggtaagcctgtaaggagggatattgtaattccacagcgatgcgtgccaaagcttactgttcggcaggtagctgctggaggcacacattcagttgttctaacacgagaaggacatgtatggacatggggtcaaccgtggcctcctggggacataaagcaaatttcaactcctgttcgagtacaaggtcttgaaagtgtgagattgatcgctgttggagcttttcacaatttggctcttcttgatgatggaatactaatggcatggggcaataacgagtatggacaactaggaactggtgatactcaaccaagatcacaacctattcctgttcaagggctgtctggctttactttggtcgatattgctgctggagggtggcactcaactgcattaacagatgaaggagaggtatatggctggggaagaggggagcacggaagacttggttttggagatgacaaaagcagtaaaatggttccccaaaaggttcagcttctagttggagaggatattgtgcaggtatcatgtggaggcacccattctgtttctctaacaagtgatgggcgcatgttttcttttgggcgaggagaccatggccgtcttgggtatgggagaaaggtaacaacaggtcatccatcagaagttccgataaacgtttctccacccagagatcttagcggtgaggaagctgaaggccgttggtgtgctaagtatgttgcttgtggtggccgtcatacactggcaatagtggagtggcacactcgtgtatcagagcagtaggctgcctttgttaacagatatgtattactttactcctgtacaattagaagaattttgtgcgatgctagaaatataatgggaaatctaggttgcaactgatcccctcaatagcagttataacatt

SEQ ID NO: 1467 - DNA, 1510 bp, Phaseolus vulgaris
atggaatttgtagagtgattgcattttgaaaaggtgttcagaaacactaactcgtaagctccacgcacgcaaagtgtttgtgataatcttcctttcattttcttcggcactctctgttgtctctctcactctgctctcttactctactctaaccttcatggattcccattcccgcattattgcatggggctctggtgaagatggtcaactaggaatcggcaacaacgaagagaaagaatgggtctctctcgtcgaagctctcgaacctcaacgtttccgctccatcgtcgccggcagcagaaactccctcgccatcggtgacgacggcaaattgttcacttggggttggaaccaaaggggcacacttgggcacccagctgagaacaagtccgagaacaagattgagaacattcccagccaagtcaaggatctttccagtgttaagattgtccaggcggctattggggggtggcactgcttggctgttgatgatcagggcagagcttatgcctggggtggaaatgaatatgggcagtgtggtgaagaacctgagcgcaaggatagacctttaaggagagatatagagatccctcaacgctgtgctcctaagcttgttgttcggcaggttgctgcaggaggaactcactcagtagtacttacacgtgaaggtcatgtttggacatggggtcagccatggccgcctggtgacataaaacagatttcagttcctgttcgggttcaaggtcttgaaagtgtgaggctcattgctgttggagcatttcataatttggcttttcaagaggatggaactttatgggcatggggaaataatgaatatggacaacttggaactggagatactcagccaagatcacaacccattcctgtccaaggactttctgatcttactctggttgatattgcagctggtggatggcattctactgcattgaccgatgaaggagaggtatatggctggggaaggggagaacatggcaggcttgggtttggtgatagtgacaagagcagtaaaatggtaccccagaaggttcaacttttagctggagaagatattgtgcaggtatcctgtggaggtactcactcagtggcattaacccgtgatggccgcatgttttcttttggtagaggtgaccatggacgtcttggatatggtaggaaagtgacgactggtcaaccaatggaggtacctataaaccttcctcctcctcacaatctcactgccactgaagctgagggacattggtttgctaaacttgttgcctgtggtggcagacataccttggcaatagtagaatggaaaacagatcatcttaattgattcataaatcataaaaataaagcaaaaactgaaaaactagatcatcaccctaatcacactcatttcaaattcagttgaggtgctaaactttatctgttgtatttagcttgatataatcttcttttggtaataacttaaatagatataacattttaaaactttattatgtta

SEQ ID NO: 1468 - DNA, 1460 bp, Catharanthus roseus
caagtaaagggactccaatggtacactggccctataatccagctctttcagtagcagacaccgcttctatggccgcctccgagaccaagactgccgttatctcatggggttcaggagaagatgggcaattaggaattggtaataacgaagaaaaagaatgggtttgcaaaatcaaagctctggagccgtacaatgtttgctccgttgtcgctggtagtcgaaactctcttgctatttgcgacgatggcaagttatttacttggggttggaaccaaagagggactttggggcatccaccagagaccaaaactgagaatgttcctagtcaagtgaaagctcttgctaacgttaagattgttcaggcagctattggaggttggcattgtttggctgttgatgatcaaggccgagcttatgcttggggtggaaatgagtatggccagtgcggtgaggagcctgaacggaaagatgacactggtaagcccgtgagaagggatattgtcattccacagcgatgtgtgccaaagctaactgttcgccaggtagctgccggtggcacacattcagttgtactaacacgggagggacatgtatggacatggggccaaccatggcctcctggggacataaaacaaatttctactcctgttcgagtacaaggccttgaaagtgtgagagtgattgctgttggagcttttcataatttggctctcctcaatgatgggattttaatggcatggggcaataacgagtatgggcagctaggaactggtgatactcaaccaagatcgcagcctattccagttcaagggctgtctggccttactgtggttgacattgcagctggaggatggcattcaactgcattaacagatgaaggagaggtatatggttggggaagaggagagcatgggagactcggctttggagatgacaaaagcagtaaaatggttccccaaagggttcagcttctagttggggaggatattgtgcaggtctcatgtggaggcacccattctgttgctttaacacgtgatggccggatgttttcttttgggcgaggtgaccatggccgtcttgggtatggaagaaaggtgacaacaggccatccctcagaagttcccataaatattcctcctcctgaacatctcagtagcagtgaagctgaaggccgttggtgtgcaaagtatgtcgcttgtggtggccgtcatacactggcaatagtcgagtggcagaatcgtgtatcagagcagtaggctgccttagttaaatagggttactattacttcactgctgtacaactagaagaatcttgtactatgctacatggtaaatctaggatataacaaatcccagtaatagcattttgtaacattatataaatgcggaattttatattgaacatcaaagaaatccaagattccaaggttacatttttctataataaactcgtgtatatg

SEQ ID NO: 1469 - DNA, 1421 bp, Vitis vinifera
ggcagaatcagcttccaattccccaacttgcgtcaccaagcactcagccactcaccgcaatagcagcatacataacagaggcaaggcaaacttgaagccttccacttttgagtcccagaaatggcctccaaacccaaagccataatctcatggggctccggcgaagacggccagttgggaatcgggaacaacgaagagaaggagtgggtttgcgccgtcaaagctctcgcagcccagaatgtttgctccgttgtcgccggcagtcgcaactctctcgccatttgcgaagacggcaagttgtttacatggggatggaaccaaagaggaactctgggacatccgccggagactaagactgagaacattcccagtcaggttaaggctcttgccaatgctaagattgttcaggcggctattggtggttggcactgtttggcggttgatgatcaaggccgggcttacgcttggggtgggaatgagtatggtcaatgtggtgaagaacccgaaaggaaagatgacactggcaggcctttgaggagagatattaccattcctcagcgttgtgcatcaaaactttcagtccgccaggtagctgctgggggtactcattcagtggtgctcacgcgcgaaggacatgtatggacatggggacaaccatggccccctggtgacataaaacaaatttcaactcctgtgcgagtacaaggccttgaaaaagtgaggctaattgcagttggggcatttcataatctggctctcttggaggatggaatcttatgggcatggggtaacaacgaatatggacaacttggaactggtgatactcaaccaagatcacaacccattgctgttcaagggctatctgatcttactttggttgatattgctgcgggaggatggcattctacagcattgacagatgacggaggggtgtatggttggggtagaggagaacatggaaggcttggatttggagatgacaagagcagtaaaatggtgccccaaaaggttcagcttctagtcgaggagaacatagttcagatatcttgtgggggcactcactctgttgcattaacacgcgatggacgaatgttttcatttgggcgaggggaccatgggcgccttggctatgggaggaaggtgaccactggccatccgatggaagtacctataaacctcccaccagcaactaatctcagtggcagtggagctggaggacattggtgctccaaacttgttgcttgtggtggtcgtcatactttggcaatagtagaatggctggcccatgaacctgaacagttgatatgaaagaactgtatcgcgaggtctagtctacctacaagccaaacttttatatgacacacatacagtcaaagagattaaactcaaaataaagtgatataagaaaggacattttcata

SEQ ID NO: 1470 - DNA, 1668 bp, Trifolium pratense
catcatcatcctcacttcaactcaaccctttgtctctttctgtcgttctcatcatcctctcatggattccaccaattctcacatcattgcctggggatcaggtgaagatggtcaattaggaattggtacaaacgaagataaagaatgggtttgtactgtcaaagctcttccttctcaacgtgttcgttctgttgttgctggtagcagaaactccctcgccatttgtcatgatggcaagctgtttacttggggttggaatcaaaggggaacacttggacaccctgctgagaccaagactgaaaacattcctagccaggtcaaagcactttcccatgttcacatcgttcaggcagctattggtgggtggcattgtttggctgttgatgatcacggcaaagcttatgcttggggtggaaatgaatatggtcagtgtggtgaagaacccgagcgcaaggatgacaatggccgacctttgaggagagatatagtcatccctcagccttgtgctcctaagcttgttgttcgacaggttgctgctggaggaactcactcagtggtacttacacgtgaaggacatgtttggacatggggtcagccgtggcctcctggtgatattaaacagatttcagtcccagttcgggtgcaaggtcttgagaatataaggcttatagcagtaggtgcatttcataatttggctctccaagaagatggaactttgtgggcatggggtaataatgaatatggacaactcggaactggagatacacaaccaagagcacagcctattcatgtgcaagggctttctggacttaatttggtagatattgcagctggtggatggcactctactgcattgacagacgacggagaggtatatggctggggaaggggagaacatggtaggcttggatttggtgatagtgataagagcagtaaaatgttacctcagagggttcaacttttagccggcgaagatattgttcaggtgtcttgtggaggtactcattcagttgcattaagtcgagatggtcacatattctcttttggtagaggtgatcatggacgtcttggatatgggaggaaagttactactggtcaaccagtcgaggtacctatagagatccctcctccacagaatctcaatgacggcgaagccgagggaacttggatagccaaactcgtcgcttgtggtggccgccatactttggcaatagtagaatggaaagaagacgaatctaaagattgaatttaattataaataaattcgaaactcggaagtagattaggctaatgacatatttggaactcaatctaggttgatatgaggtgtgtttggaatttggataaacaacttaaacaagcggttattgaataaacgactattgcataagaggttgtgtataattggcttctaggattgaagagcttatgaaatttgaagctaaatttcacacaaactctgataagccatttctaaaagctatcataagagtttatgaaaatgagctattgtaagttatttttgtaagctccctctaacagacaaactcatacataagtacttataagccataagcttaagtaaactcaaattaagctcttccaaacaaaactcatgatacattagttttcctatgatctaatgatggcacatacatgttattcatc

SEQ ID NO: 1471 - DNA, 1589 bp, Eucalyptus grandis
cacgctcgctgccgcggcactaccttcacgcctacactcccgaggctcctccttttcttgctgtcttcttccacacaacccctccttggctccccccctaaaaccccatttgctcgccgctcatgtctaccctcagtgccgtcatcgcttggggctcaggcgaagatgggcagcttgggctcggagacaacgaggagaaggactgtgtctgcgacatcagcgctctctaccctcacgaagttcgctccgtcgtcgccgggagccgaaactctctcgccatttgcgaggatggccagttgtttacatggggttggaaccagagagggactcttgggcatccgccagaaaccaagactgagaataccccaagccaggttaaagctcttgccaatgtcaagattgttcaggcggctattggtggttggcattgtcttgctgttgatgatcaaggtcgtgcttacgcatggggtgggaatgagtatggacagtgtggtgaagaacctgggaggaaagatgacactgggaagcccttgagaagggatattgtgattccccaacgctgtgcttcccaactcatagttcgccaggtggccgctggaggtacccactctgtggtacttacacacgatggacaagtatggacgtggggtcaaccatggccaccaggtgacataaaacagatttctgttccagtgcgagtacaaggtcttgaaaaggtaaggcttatttcagttggtgcatttcacaatatggcccttcaagaagatggaactttgttggcatggggtaataatgagtatggacaacttggcactggtgacactcaacctagatctcagcctgtcattgttcatgggctcgctggtcttactctggttgatattgctgctggaggatggcattctacagcgttgacagatgatggagaggtatatggatggggaagaggtgaacacgggaggcttggttttggagataatgataagagcagtaagatggtaccccagaaggtccatctcctgactggggaagacattattcaggtgtcttgtgggggcacacattcagtcgcattaacacgtgatgggcgtatgttttcgtttggtcgaggtgaccatgggcgccttgggtatggaaggaaagtgacgacaggccagccaggggaggtgccgataaatctgccccctccgggaaatctcaatgggactgaagctgaagggagttgggttgccaagcttgttgcctgcggaggacggcataccctggcgattgtggagtggcagactcacgaaaccaagtaatatgcatattccagggttacctagtcatctgtagaaatcgggaaacaaagatgattcccagattaatactgaaaatgccgacgtgtaagatacacaaaacatgttcctcccccagtcttgatatcaaggatattaagggtgtgattttcaaataatatgtcgtggtggcggtggtgatggtgctctaggcgtgttttttctctgaatgatttgaatttatacactagttttgttcatgatgaagtgatcgtattctagttaccacaatatgctcaaccgaggctgcct

SEQ ID NO: 1472 - DNA, 1566 bp, Panax ginseng
cagtggtatcaacgcagagtacatggggctctttctttctttctcctcctcctatggcttccaatacctccgttatcgcatggggttcgggggaagatgggcagctaggaatcgggaataacgaggaaaaagaatgggtttgctctattaaatctcttcactcccaaaatgtccgctccgtcgtcgccggtagtcgcaactctctcgccatttgccatgatggcaagttgtttacttggggttggaatcaaagaggaactttgggtcatcctcctgagaccaaaactgagaacattcctagtcaagttaaagctctttccactgtcaaaattgttcaggcagctattggtgggtggcattgtttggctgttgatgatcaaggccgcgcttatgcgtggggtggaaatgagtatggacagtgtggtgaagaacctgaaaggaaagatgacactgctaagcccttgaggagggacattgtgattcctcaacgatgtgcaccaaaactttctgttcgccaggtggctgctggaggtacacactccgttgtgcttacacgtgaaggacatgtatggacatggggtcaaccatggcctcctggggacataaagaaaatttccacccctgtaagagtacaaggtcttgaaagggtgaagctaattgcagttggggcttttcataatttggctctactcgaggatggaagcttatgggcatggggaaataatgaatatgggcagcttggaactggagatacccaaccaagatcacaacctattcctgtccatggtttatccgatcttactttggttgatattgctgctggaggatggcattctacagcaataacaggtgaaggagaggtatatggttggggaagaggggaacatgggagacttggatttggagatgacaagagcagcaaaatggttccccaaagggttcaacttctagttggggaggaaattgttcaggtgtcatgtgggggcactcattcagttgcattaacacgggatgggcgcatgttttcttttgggcgtggtgatcatggacgactaggatatgggaggaaagtgacaactggtcatccctcagaagtgcccataaacctgccacgtccaaatcccagagacgcagaagcggaaggacattggagtgcaaaacttgttgcttgtggtggccggcatactctggcgatatcagaatggtgccctgatgacatttaagaggttgcgttcaggtaatggttttaaaagaaatccacaaacgtaacttgaaatttgtatcatgctgccaggtgttataagatatataactggaggtgtgatacccgtgttctgcaatccacatgcttactcttttggttggtaatggtatgattcaatgcaccaagtattaaacaatggtactgtgttttgacaaaccatcttttgatggctacgtattgagtgcagttcagctgattataatggttcccataaagtaaaagttctgcagtctgttgatcagaaacgctgtttcatgttttagcaaattaactttcaatttaggacaataatgatatttttt

SEQ ID NO: 1473 - DNA, 1802 bp, Lupinus angustifolius
agtacatgggggtgatgtaagtgacataattaagaaactcactctcactttcaacctcaaaccctttctgcctctttctctctctctcttcataacacaacaacaatggatgattccaattccactatcattgcttggggctctggtgaagatgggcaactaggaattggtatgaatgaagagaaagaatgggtttgtctcatcaaatcacttcaaccctatcgtcttctttctatcgttgctggaagcagaaactctctctctatttctcatgatggcaaattgttcacatggggttggaaccaaagaggaacacttggtcacccacctgaaaccaaaactgaaaacattcctagtcaagtcaaggcacttgatagtgttaaaattgttcaggcggctattggtgggtggcactgtttggctgttgatgatcaaggaagagcttatgcctggggtgggaacgaatatgggcagtgtggtgaagaacctgagcgcaaggatgacactggtagacctttgaggagagatatagtgatccctcaacgttgtgctccgaagcttgttgttcgccaggtggctgcaggtggaactcactcagtggtacttacacgtgaagggcatgtttggacatggggtcaaccgtggcctcccggtgacataaagcagatttcagtccctgttcgagtacagggtcttgataacgtgaaggtcattgcagttggagcattccataatttggctcttcaagaggatgggactttatgggcatggggtaataatgagtatggacaactcggaaccggagatacccagccaagatcacaacctattcgtgtccaaggactttctggacttacactggtagatatagccgctggtggctggcattctactgcgttgacagaagatggagaggtatatggctggggaaggggtgaacatggcaggcttggatttggtgatagcgacaagagcagtaaaatgttaccccaaaaggttcaacttttagccggagaagatattgttcaggtgtcttgtggaggtactcattctgttgcattaacccgggatgggcgtatgttttcgtttggtagaggggatcacggtcgtcttggatatgggaggaaagtcactactggtcaaccaatggaggtacctatagacatccctcctccacaaaatctcagtggcagtgcagccgagggacattggatatcgaaactcgttgcttgtggtggccgccatactttggatgaaccaaacgagaccgattcatagataaaatagaaaccggaaagtagatggggcaatgactgatttggaactaagtacttgtgttagagtttgtgttatgtccagtatgatttgtaaagtcatacttatggcacaaacacattaattatggtgctagaacaatggcatttggtttttagtggtcatggtaaaatcatgcataggacacaaataaattataaaatgaccatgtttggcatatgatgtggactcattcttcattgtttgcttattgctatgatgcacatttttaatgcaaaattgtgagctcactagtctactagtttcactttataatcttgcaaataaaatgtacataaacataatactgctgagttttgttgttctttggtaaaagattaaataggaggaaaaaagctatgactccagctactatttaaacattcaacaaagtgataatggaagataatatttttctacatgttataattatttagtgaatccccatgagattccaatagaagcacattcatcttttaatttcttat

SEQ ID NO: 1474 - DNA, 1802 bp, Medicago truncatula
aagaaaattagtgtaccaaaaaaaaaacataagaaaattacactgatagtaataggttttggagagtgtcctgttgttttcaaacaacatccgttaatccaaactcaactctcaacctgattgactgactgacctctttcaattcaatctttgtctgtcattctcatggcttccaacatcattgcctggggttcaggtgaagatggtcaattaggaattggtacaaacgaagataaggaatgggtttgttctgttaaagctcttccttctcaacatgttcgttctgttgttgctggtagtagaaattcactcgccattttgaatgatggcaagttgtttacatggggttggaatcaaaggggaactcttggacacccagctgagaccaagactgaaaacattcccagccaagtcaaagcactttcccatgctcacattgttcaggcggctattggtggttggcactgtttggctgttgatgatcacggaaaagcttatgcttggggtggaaatgaatatggtcagtgtggtgaagaacctgagcgcaaggatgacaatggtagacctttgaggagagatattgtgatccctcagccttgtgctcctaagctttctgttcgacaggttgctgctggaggaactcactcagtggtacttacacgtgaagggcatgtttggacatggggtcagccatggcctcctggtgacattaaacagatttcagtcccggttcgggtgcaaggtcttgataatataaagcttatagcagtaggtgcatttcataatttggcactccaagaagatggaactctgtgggcttggggtaataatgaatatggacaacttggaactggagatacgcaaccaaggtcacaacctgttcctgtgcaaggactctctggacttaccgtggtagatattgcagctggtggatggcactctactgcattgacagatgacggagaggtatatggctggggaaggggagaacatggtaggctgggatttggtgatagtgataagagcagtaaaatgttacctcagagggttcaacttttagccggcgaagatattgtgcaggtgtcttgtggaggtactcattctgttgcattaacccgagatgggcgcatattttcttttggtagaggtgatcatggacggcttggatatgggaggaaagtcactactggtcaaccaatggaggtacctatagacatccctcctccacagaatctcggtgacgctgacggtgaagctgagggaaattggatagccaaactcgtcgcttgtggtggccgtcatactttggcaatagtagaatggaaagatgatgaatctaaagctgaatctattcatgattaaaatggaaactagtaagtagattaggctaatgactgatttggaactcagtccatgtgtgatatgaggtgtgtttcggcaaacaacttaaataagcgtttattgaaccgacatttattgcgtaagagctcatgtataagtcgtttctaggattgaagagcttttgaagccgaatttcgcacaagctctgataagcagtatctatgagctagtataaggagtttatgtaaacaagatttatatgctataagcttaaataaactcaaaataagttcttccaaacacaactcatgatatattattcatcaatttactattcagtgtttagtgtccttttgcatatttattttaagtacaggagacattatatgtttggcacataatatggaatcatataatctgtttattagtactgattcatatactttggtgcaaaatcttta

SEQ ID NO: 1475 - DNA, 1350 bp, Fragaria vesca
cttcttcttcttccatggcatccgataccgccattatcgcctggggctccggagaagacgggcagttgggaatagggtgcaacgacgacaaggaactagtctgcgttgtcaccgccttagagtcacagaccgttcgctctgtcgtcgctggcagccgaaactctctcgctatttgtgatgatggcaagctgtttacatggggttggaatcagagagggactttggggcatccacccgagagcaaaaccgagaacgttcccagccaagttgaagctctgtccaatgttaaaatcgttcaggctgctattggtggatggcattgtttggctgttgatgatcaaggccgtgcctatgcctggggtggaaatgagtatggacagtgcggtgaagaacctgagcgcgacactggtaaacctttgaagagggacatagtgattcctcagcgatgtgcgcccaaacttgtggttcgccaggtagctgctgggggtactcactctgtggtgcttacacgtgaagggcatgtatggacatggggtcaaccatggcctccaggagacataaaacaaatttccacacctgtacgagtacaaggtcttgataaggtgaagctcattgcagtaggggcatttcataatttggctctccaagaggatggcactttatgggcatggggtaacaacgaatacggacagcttggaacaggggatacgcagccgagatcacaacccattcctgtcaatggactttctggtcttactttggtggatattgctgctggaggatggcattctactgcactaacagatgatggagaggtctatggatggggccgaggggagcatggtagacttggttttggtgacaatgataagagtagtaaaatggtcccccaaaaggttcatcttttagctggggaggacattgttcaggtgtcttgtggaggcactcactctgcggcattaacacgtgatggtcgcattttctcgtttggtcgaggtgaccatggacgtctcgggtatggaaggaaggtgacaactggtcacccgatggaagtccccatcgaactcccacctaaaaatgtcactgacggtgaagcccatggccattggattgccaaacttattgcctctggaggacgccatactctagcaatagtcgaatggaaatcagatgaaacaactgaaaacggtgacgcttaatttttcagtaacaagaataattgatgtttggttctgcgtaactgtactgttaagatgaaatagtaaacacagcaccatatgaggcatgataaaattactagatctctaagagagcgagtagatttgatcagtctccaattttacagtgaaa

SEQ ID NO: 1476 - DNA, 1343 bp, Malus domestica
attgtattgtattgataaacacagtcactctcctctcctctgtgctagctttttagctcatagtccatatcttcaattcaagctctgattcaggctcaaatggtatccgataccaccattgtcacttggggctccggggaagacggccaattaggaatcgggaataacgaggagaaggaatgggtgtgcgccgtcaaagccctcgagtcgcagactgtccgctctgttgtcgctggcagccgaaactccctcgccatttgcgatgatggcaagttgtttacatggggttggaaccagagaggaaccctggggcatcctcctgagaccaaatctgagaacattccaagccagagcaaaaccgagaacattccaagccaggttaaagctctggccaatgtcaaaattgttcaggctgctattggtggatggcattgtttggctgttgatgatcaaggccgcgcttatgcctggggtggaaacgagtatggacagtgtggcgaggaaccagagcggaaagatgaaactagtagacccttgagaagggatatagtgattcctcaacgctgtgcaccgaaacttaaagttcgccaggtagctgctgggggtactcactctgtggtacttacacgcgacgggcaagtctggacgtggggtcagccatggcctccgggagacataaaacaaatttcaacacctgtgcgagtacaaggtcttgatgcagtgaggcttatcgcagttggggcatttcataatttggctctgcaagaggatggtgctttatgggcttggggtaacaacgaatatggacaacttggaacaggggatactcagccgagatcacaacctattcctgtccaagggctttctggtcttactttggtggatattgctgctggaggatggcattctactgcactaacagaagatggagaggtgtatggttggggacgaggagaacatgggaggcttgggtttggcgataatgataaaagcagcaaaatggtgccgcaaaaggttcatcttttagccggcgaggatattgttcaggtgtcttgtggaggcactcactctgttgcattaactcgtgatgggcgaatgtattcgtttggccgaggcgaccacggacgccttggatatggaaggaaggtgacgactggtcagccgatggaagttcccatcagcatccctcccagacatggcaccgcagacaatggacattggattgccaaactggttgcttgcggaggacgccataccttggcaatcgtagaatggaaagctgatgatgaatcagaatcatagaagttatgtcggaaaattttccggtaactcgaataattgat

SEQ ID NO: 1477 - DNA, 1434 bp, Triphysaria pusilla
atatatatcacttttttgtgataggtataggtataatagaactttgcactagcagcaccgtggcatcactctcttacacactactatggccaccaaatccgccgttatagcatggggttctggggaagacggtcagttgggaataggaaacaatgaagagaaagaatgggtttgcaccatcaccgcccttcgccctcacaacgtctcatcagtcgttgctggtagtcgcaactctctcgccatttgtgatgacggagagttgttcacttggggttggaaccaaagggggacgctagggcatccgccggaaaccaaaactgagaatgttccttgtcaagttaaggcgcttgccaatgtcaaaatcgttcaggctgctattggtggttggcattgcttggccgtggatgatcaaggccgagcctatgcttggggtggtaatgagtatgggcagtgtggtgaagaacctgagcgcaaagatgacacaggcagacctgttagaagagatattgtcattccacagagatgtgtgccaaagctttcagttcgtcaggtagctgctggtggcacacactcagctgttttaacaagagaagggcacgtatggacgtggggccagccatggccccccggcgatataaaacaaatttcaaccccagttcgagtgcagggtcttgatagcgtgaaagtgattgcagttggagcttttcataacttagctctccttaatgatggaactgtaatggcgtgggggaataatgagtatggccaacttggtactggtgatacacagcctagatcacaacctattgctgtgcaggggctctctgctcttaatttggttgatattgctgcaggaggatggcattctacggcgttgactgatgatggagaggtgtatggctggggcagaggggaacatgggaggcttggattcggggatgacaagagcagtaaaatggttcctcaaagggttcaacttctagtaggcgagaacattgtgcaggtttcctgtggaggcacacattctgttgcattaacacgggatggccgcatgtacatttttggacgaggggaccatggacgtttgggatatggacggaagttgactaccgggcatccagcagaggttccgataaacatccctgctcccaaggatctcagcgggactgatgctgaaggtcgttggtgcgctacacttgttgcttgtgggggccgccatacattagcagttgtagaatggcgcgatcatgaatccgaacagttgctctgatgctttatgggcagacgggaacctattagatatatatgtttccttgtacgatacacagttggataaagctaagacaactgagtaagaattatttgcacccaaaaatttgagtttctgatatgttttttacaactgaaatgaattataatgtttatgaactgggt

SEQ ID NO: 1478 - DNA, 1424 bp, Citrullus lanatus
gcagattatactcagatttgtttagctcaaattcctgatttaggacgccagccactgctcgagctttgtatctcgcttttcaatggctgccgatactgccattattgcttggggttcaggagaagatgggcaattgggattggggaacaatgaagaaagggaatgggtttgcgccattaaagcccttgagtctcaaaatgtttgttctgttgttgctggtagccggaactcccttgccatatgtgaagatgggaagctgtttacatggggttggaatcagagaggaacccttgggcacccagctggaaccaaagctgagaacgttccgagccaggtgaaagctcttgctaatgttaagattgtacaggcggcgattggtggatggcactgtcttgctgtggatgatcaaggccgagcttatgcctggggtggtaatgaatatggtcagtgtggtgaagaacccgagaagaaagatgacactggtaggccaccgagaagagatatagcaattcctcaacgatgtgctccaaagctaatagttcgtcaggttgctgcaggaggtacacactctgtggtacttacacgtgaaggacatgtatggacatggggccaaccatggccacctggagatataaagcaaatttctgttcctgtacgagttcaaggtctcgatatggtgaggcttattgcagttggggcatttcataatttagctctccaagaagatggaactttatgggcatggggtaacaatgaatatggacaacttggaactggtgacacacaaccaagatcacagccaattcctgtccaagggctttctggtcttactttggttgacattgcagctggaggatggcattcaactgcattgacagatagcggagaggtttatggatgggggcgaggagaacatgggaggcttgggtttggagataatgacaagagcagcaaaatggttccccagaaggttcaacttctgtctggagaggacattgttcaggtatcgtgtggaggcacacattcagttgcactaaccagtgacggccgcatgttttcgtttgggcgaggcgaccatgggcggctcggatatggaaggaaggtaacaaccgggcaaccggaggaagttcctattgacattgcacctcctcttagggctgagcatggccgttggattgccaaacttgttgcctgtggtggccgccatacattagctctggtacaatggaaacctgaggattaagcaaaatagttaatggttgttagattcttaagatgatcatcttcttctcctttctataataattatgggacaagacaacatggatttgcagctcaggtttttgtcaagtctggaagaatgaattgtgcattgttgattgttctatctactctctgtagtaaacttcccatgcatcactttt

SEQ ID NO: 1479 - DNA, 1574 bp, Sesamum indicum
tcccatctttatctccacctatcaaacactagtacatgtgtatatatctccacgtttttagtgagtgaataagtataaacttgcactagcagcagagtggcagcgtcattcctttactgttatggcctccaaaaccgccgttattgcatggggttcgggagaagacgggcagttaggaatcgggactaacgaggagaaagaatgggtttgcaccgtcactgcccttcgctccgagaaggtctgctctgtcgttgctggcagccgcaattcccttgccatttgtgaaaacggaaagctgttcacttgggggtggaaccaaagagggacacttgggcacccaccggaaaccaaaactgaaaatgttcccagtcaagttaaggctctttccagtgtcaaaattgtccaggctgccattggtggttggcattgcttggcagttgatgatcaaggccgagcttacgcgtggggtggtaatgagtatgggcagtgtggtgaagaacctgagcgtaaagatgatacaggcagacctgttagaagagatattgtcattccacagagatgtgtgccgaaactttcagttcgtcaggtggctgctggtggtactcattcagtagttctaacacgggaaggacatgtatggacatggggtcaaccatggcctcccggagacataaaacaaatatccaccccagttcgagtacaaggtctagatagcgtaaaggtgattgcagtcggagcttttcacaacctggcccttcttgatgatggaactttaatggcatggggcaataatgagtacggccagcttggaactggtgatacccagcctagatcacaacctattgccgtccagggactctctgatcttaacttggttgatattgctgcaggaggatggcactcaactgcattgacggatgatggagaggtgtatggctggggcagaggggaacatgggaggcttggtttcggagatgacaagagcagcaaaatggttcctcaaagggttcaacttcttgtaggcgaggacattgttcaggtttcttgtggaggcactcactctgttgcattaacacgagatggccgcatgtattcgttcgggcggggagatcacggacgtttgggatatggaagaaaggtgactactggtcatccagcagaagtacccataaacattccaccacccaaggatttgaacggggccaatgctgaaggccgatggtgcgcaaaacttgttgcttgtggaggtcgccatacattggcaattgtagaatggcgtgatcatgaacccgagcagctgcactgaagctttgtagatctacaaggatcctaatagttctgctttctgcaattgcaactctgggtaaagaaaggaaatagcactgaggtgagaaaaatatgcaccaaggtaagatttgggtaatgttacattatgaagtaagtttcgggcatgtgtcttgcaggcatttgatgctcttgtaacttagcgtattactatctgtgaactggatgttaaaatattaaagtagattaaatatggcatttgctgctcctctatgtctgaaaggctggca

SEQ ID NO: 1480 - DNA, 1450 bp, Cucumis melo
gcagatcattatactcggatttgtttagctcaaattcctaatttagcacgccacccactgctggaggctttgtatcttgcttttcaatggctgccggtactgccatcattgcttggggttctggagaagatgggcaactggggttggggaataacgaagaaagggaatgggtttgcgccattaaagcccttgagtctcagaatgtttgttctgttgtcgctggtagtcggaattctctcgccatatgcgaagatgggaagctgtttacatggggttggaatcagagaggaactcttggtcatccagcaggaaccaaatctgagaacgttcccagccaagtgaaagctctttctaatgttaagattgtacaggcagcgattggtggatggcactgtctggctgtggatgatcaaggccgagcttatgcatggggtggtaatgaatatggtcagtgtggtgaagaacctgagaagaaagatgacactggtaggccaccgagaagagatatagcaattcctcaacgatgtgctccaaagctaatagttcgtcaggttgctgcaggaggtacacattctgtggtacttacacgtgaaggacatgtatggacatggggccaaccttggccacctggagatatcacgcaaatttctgttcctgtacgggttcaaggtctcgatatggtgaggcttattgcagttggggcatttcataatttagctctccaagaagatggaactttatgggcatggggaaataatgaatacggacagcttggaactggtgacacacaaccaagatcacagccaattcctgttcaagggctttctggtcttactttggttgacattgcagctggaggatggcattcaactgcattgacagatagcggagaggtctatggatggggacgaggagaacacgggaggcttgggtttggagacaatgacaagagcagcaaaatggttcctcagaaggttcaacttctctctggagaggaaattgttcaggtatcatgtggaggcacacactcagttgcagtaaccagtgacggccgcatgttttcgtttgggcgaggcgaccatgggaggcttggatatggaaggaaggtaacaactgggcaaccagaggaagttccgattgacatcccacctcctcgggggaggactgagaatggccgttggattgccaagcttgttgcctgcggtggccgccatacattagctctggtacaatggaaacctgaggattaagctaaataactaatggtggttagattcttcagatgaccatcttctttctttctataataattatgggattagactacctcgattagcagctctggaagaatggattgtgcattgttgattgtttttatctattctgtgtagtaaaaacttgcatgcatcaattttacgtaataaaagaccagtttagtagcaaaaaaaaa

SEQ ID NO: 1481 - DNA, 1601 bp, Solanum lycopersicum
taataatttatatattaggggcgcctccactgtcctctccactcaaccagtccacaatatacagattacagaagaagccaccatttttaccgattcttgaaaagacgggaagctctaaaatattcagaattagctctttagcaaacagaaaactgaaagcagtcagccataagtatatatggcttctagaaacgccgtcatcgcttggggctctggagaagatggtcaattgggtattggaaacaatgaagagaaagagtgggtttgttcaattaaagctctagaatctgaaaaagtttcgtctgttgttgctggaagtagaaactctcttgccatttgtgaagatggccgattgtttacgtggggttggaatcaaagagggacattgggacacccacctgagacaaaaactgagaacattcctagtcaggttaaagctcttgccaatgtgaaaattgttcaggcggcaattggtggctggcattgtttggctgttgatgatcaaggcaaggcttatgcttggggtggtaatgaatacggacaatgtggtgaagaaccagaaaggaaagatgacactggaaggcctgtaaagagagatattgtgatccctaagcgttgtgcctctaagctttctgttcgtcaggtagctgctggtggtacacactctgttgttcttacaagggaaggacaagtatggacatggggtcaaccatggcctcctggtgacataaagcaaatttctactcctgtccgtgtacaaggtcttgcaagtgtgaggttgattgcagtaggggcctttcataacttggctcttcttgatgacggagttctaatggcatggggtaataatgagtatgggcaacttggaactggggatacccagccaagatcacaacccattgccattcaagggttatctggtctcactttggttgatatcgctgctggaggatggcattctgcagctttgacaaatgagggggaggtttatggctggggaagaggagaacatggtagacttggatttggggatgacaagagtagtaaaatggtgccgcaaaaggttcaacttttagctggggagaacattgttcaggtttcatgtgggggaacacactctgttgcattagcgcatgatggtcgaatgttttcttttgggcggggagaccatggacgactaggatatggtagaaagtcgacgactggtcatccatcggaagttccaataaatattccggctccaagtgatgtcagcagcgcagaaggagggcgttggtgcgctaaactggtcgcttgtggtggccgccatactttggcgagtattgagtggcagacatttgagtctgagtagttgcactttttaagtctcttctgattcagcggcgtcactgttgtatgaggtgattaacttttgtattactattactcattgagcagtctatgcaactgaggtggaaaatccagaattttctttttctggttgggttagagatttactatctgcttctgtttatctactggcactacgttgtgaatagcctaattatgccgccttctttgttgcttatttccagtgccagtagcaccaaacacacttccga

SEQ ID NO: 1482 - DNA, 1382 bp, Capsicum annuum
aataattagagaatgcataatatgcagtgtatgtattaggggcgcctccactgtccagtgtccaacccattcataattagtgaggagtccaccatttgtatgcacacacccaataccgattcttgaaaatcagagtttgaaaaaacatacagaaaacagagagcaggcagccacaagtataaatggctaccagaaccgccgtcatcgcttggggctctggagaagatggtcaattgggtattggaaacaatgaagagagagagtgggtttgttcaattgaagctttaaattcagaaaatgtttcttccgttgttgctggtagtagaaactctcttgctatttgtgaagatggaaaattatttacatggggttggaatcagagagggaccttgggacatccacctgagactaaaactgagaatattcctagtcaggttaaagctcttgccaatgtgaaaattgttcaggcggcgattggtggttggcattgtttggctgtagatgatcaaggcaaggcttatgcttggggtggtaatgagtacgggcaatgtggtgaagaaccagaaaggaaagatgacactggaaggcctataaagagagatattgtgatccctaaacgttgtgctgctaagctttctgttcgtcaggtagctgctggtggtacacactcggttgttcttacaagggaaggacaagtatggacatggggtcaaccatggcctcctggtgacataaagcaaatttctactcctgtccgtgtacaaggtcttgcaagtgtgaggttgattgcagtaggggcttttcataacttggctcttcttgatgacggagttctaatggcatggggtaataatgagtatgggcaacttggaactggggatacccagccaagatcacaaccaattgctgttcaagggctatctggtctcactttggttgatattactgctggaggatggcattctgcagctttgacagacgagggagaggttcatggctggggaagaggagaacatggtagacttggatttggagatgacaagagtagtaaaatggtgccacaaaaggttcaacttttagctggggagaacattgtccaggtttcatgtgggggcacacactctgttgcattaacgcatgatggtcgaatattttcttttgggcggggagaccatggacgattaggatatggtagaaaggtgacaactggtcatccatcggaagttccagtaaatattccgcctccaagtgatgtcagcagtgctgaaggaggacgttggtgtgctaaactcgttgcttgtggtggccgccatactatggcgagtgtagagtggctgacatttgagtctgagtagtcgctttagaagtgtcaagttttaagt

SEQ ID NO: 1483 - DNA, 1456 bp, Tabernaemontana elegans
ggggttcaggagaagatggtcagttgggaattggtgataatgaagagaaagtatgggtgtgcacaatcaaagctctcgaggcgcacaacgtttgctctgtagttgctggtagtcgaaactctcttgccatttgcgacgacggcaagttatttacttggggttggaaccaaagagggactttggggcatccacctgagaccaaaacggagaacattcctagtcaagtgaaagctctcgctaacgttaagattgttcaggcagctattggtgggtggcattgtttggctgttgataatcaaggccgagcctatgcctggggtggaaatgaatatggccagtgtggtgaagagcctgaacggaaagatgacactggtaagcctgtgaggagggatattgtaattccacagcgatgtgttccaaagcttactgttcggcaggtagctgctggaggcacgcattcagtcgtcctaacacgggaaggacatgtatggacatggggtcaaccatggcctcctggggatataaagcaaatttctacgtctgttcgagtacaaggtcttgaaagtgtgagagtgattgctgtcggagcttttcacaatttggctctccttgatgatggagtactaatggcatggggtaataatgagtatggacaactaggaactggtgatactcaaccaagatcacagcctattcctgttcaagggctgtctggccttaccttggttgatattgcagctggagggtggcactcaactgcattaacatatgaaggagaggtatatggctggggaagaggggaacatggaagacttggttttggagatgacaaaagcagtaaaatggttccccaaatggttcagcttctaggcggagaggatatcgtgcaggtatcatgtggaggcacccattctgtggctttaacgcgtgatgggcgtatgttttcttttggacgaggagaccatggccgtcttggatatggaagaaaggtgacaacaggtcacccatcagaagttcccataaacgttccaccaccctccaatcttagtggcaatgaaggccgttgggttgccaagtatgttgcttgtggtggccgtcacacgctggcaatagtagagtggcaccctcgtttatcagaacagtaggctgcagcctttgttttaacagatagtgcattactgctgtacaattagaagaatcttgtgtattgccatataattacagtgggaaacctaggattcaatggattccatcactgtagcacatataatattacagatgttacagatgttggtatttacaagtatttctatatcgaaggaagccaagatgccgaggttctggtcgccttcacacgtgattcaccagtcaccaccattttggggagtggttatctaggtcattgtcttgtggagcaggcggcctccctcaaatcttgccctccttggctactact

SEQ ID NO: 1484 - DNA, 1457 bp, Valeriana officinalis
atttctcatcctctctcaaacacaattcatgtcttcttctcaaactgctgttatcgcctggggctccggtgaagatggacagttaggtataggcaataatgatgaacaggaatggacttttccgatcaaagctctggattcttatcatgttcgttctgtcgtcgccggtagccggaactcactcgccatttgcgacgacggcaagatgtttacttggggttggaatcaaagaggaactttagggcatccacctgagactaaaactgaaaatattcctactcaggttaaagctcttgctaatgtcaaaattgttcaggctgctattgatggttggcattgtttggctgtcgatgatcaaggccgagcttatgcttggggtggtaatgagtatgggcaatgtggtgaagaaccggaaaggaaagatgacacaggtagacctttaaaaagggatatagttattcctcagcgatgtgcgtcaaaactatcagtacgccaggtagcttcaggaggcacacactccgtggtgctcacacgcgaaggtcacgtttggacatggggtcaaccatggcctcctggagacatcaaacaaatatcaacaccagtgagagttcaaggtctagaaagagtgagggtgattgcagttggagcttttcataatctagctctaatggaagatggaaatttatgggcatggggaaataatgaatacggtcagcttggtactggtgatactcaacccagatctcaacctattcctgttcaaggcctctctgatcttactttggttgatattgctgctggaggatggcattctactgcactgacagatgaaggagaggtatatggttggggtagaggtgaacatggaagattagggtttggcgacgacaagagcagtaaaatggtgcctcaaaaagttcaacttttagtcggcgaagatattgttcaggtttcatgtggaggaacacattcagtcgcattaacaagggacggtcgtatgttctcgtttgggcgaggcgatcacggacggctaggatacggacggaaagtcacaacaggtcatccgtcagaagtgccgataaatctgccaccccctaaaaacgtgactgctagcggcgaagcccagggccggtggtgcgctaaactcgtagcctgcggcggccgccacacactcgccgtagttgaatggtcaaccaccgagtcaaccactgccgatgattctcaaaataacaccgactaatcaaaccagttttcaaagtactcattgtgatgatgatgacgtgacgctgagacggctgattgtaccttgtgcggaacattccggaatgtagaagcaaaatatatagcaactggctcactcccgatattgttatgaatgcttcgagcgtttgctgcaaaagtcaactgtatgtttgtcagactgtcattcacttctttaatgagttagttacgtaaaa

SEQ ID NO: 1485 - DNA, 1860 bp, Mimulus guttatus
tttttttccgactgattaaataaaattgcagtagcagcaaaaacagtggcggcagaatcattcattcccccctactactgttgagtgttaatggcctccaagaccgccgttattgcatggggttcaggggaagatgggcaactagggattgggaacaatgaagagagagaatgggtctgcacaatcaccgccctccgctctgaaaacgtccgttccgtcgtcgccggcagccgcaattccctcgccatttgtgatgacggcaagctgtttacatggggatggaatcaaagagggacactagggcacccgccggaaaccaaaaccgaaaatgttcctagtcaagttaaggctcttgccaatgtcaaaattgtccaggctgcaattggtggttggcattgcttggctgttgatgatcaaggccgtgcctatgcgtggggtggaaatgagtatgggcagtgcggcgaagagcctgagcgtaaagatgattcaagcagaccggttagaagagatattgccattccacagagatgtgtgccaaaacttacagttcgtcaggtagctgctggtggcacacactcggttgttctaacgcgggaaggacatgtttggacatggggtcaaccatggccacctggagacataaagcaaatttcaactccagttcgagtgcaaggtcttgatagggtaaaagtgattgcagttggagcttttcacaatttggcacttctcgatgatggaactgttatggcatggggaagcaacgagtatggccaacttggaaccggtgatacacagcctcgctcacaacctattgctgttcaggggctttctgatcttaatttggttgatattgctgcaggaggatggcattctactgctctgactgatgacggggaggtgtatggctggggcagaggtgagcatggcaggcttggatttggagacgacaagagcagcaaaatggttcctcaaagggttcaacttcttgtaggcgaggaaatcgtgcaggtttcttgtggaggcactcactccgttgcattaacacgagatggccgcatatactcgtttggaagaggggaccatggtcgtttagggtatggaagaaagcagacgacaggtcatccagcagaagtgcccataaacatcccacctccaaaggattttactgaaagcagcgctgcagaagggcgttggtgctctacgctcgttgcgtgtgggggccgccatacattggcggttatggaatggcgtggtcatgaatcggagcagctcttataaactttggacaacgaaagcagccctctagaaaaatcaaaggttggagggacttggattcattttgcaagtagttagcttatgttgtttatgttctcttgcaagagtctgtctgaatgttaatttagacaaagcaaactgaggattgcagtttgtaactttcgaacttttattacgttaaattttcgaacttttagtaaaatcttatccacttcatcaacacacacacatgtatatcgtttcgagaaatcatttggagcatgtgacagaatcgacattcatgactttatagctaggcagcaaaatatcctcgattttttttgtttttgagaagtggtccttgaattcacacacgcaaaaagtgccaatttcaccgagtatatatattatgacttgagccacaaaagaaaaagaaaaagaaaaaacccgaaaaaagaaaaagaaaattaagtttgacaagtgattgtctagtttgaaatgctactagccattataagttggtccgtatctgctgctaaaaatgccggcgtgcagaagcagcaaatacaacagctggctcactcccgatattgcgataaatgcctc

SEQ ID NO: 1486 - DNA, 1519 bp, Amaranthus tuberculatus
cctcaactttggcactgctacagcctacaaaatatcctatgtcttccgccgtcatcgcttggggttctggagaagatgggcaattaggaattggtaataatgaagataaagaatgggtttgtcaagttaaagctcttgaaaattactctgtttcttctgttgttgctggaagtcgcaattctcttgctctttgtcaagatgggaagttgtttacatggggttggaaccaaagagggactttggggcatccacctgagactaagactgaaaatattccaagtcaggttaaagctctagctaatgtgaaaattgtacaggctgccattggtggatggcattgcttagctgttgatgatcaaggctgcacttatgcttggggtggtaacgagtatgggcagtgtggcgaagatcccgagaaggatgacacaggtagacttttgagaagggatattgtgatacctcagcgatgtgcaactcagttgacagtgcgccaggtggctgctggtggcacacattcagtggttcttacacgtgacggacacgtatggacttggggtcagccatggccgcctggagatataaagcaaattttcgtcccagttcgagtacaaggacttgaaaaggtgcggttaatcgcagcaggtgcatttcataatttggctcttgaagaagatggaaccttgtgggcatggggtaataacgagtacgggcaacttggaaccggagatactcaaccaagatcacaacctattcgtgtacaagggctctctggtcttacattggttgatatcgctgctggtggttggcattcgacggctttgacgaacgaaggagaggtgtatggttggggcagaggagaacatgggcggcttggattcggagatgacaagagcagtaaaatgttgccccaacaggtgcaacttttagctggagaagatgtaattcaggtgtcatgtggaggaactcattcggttgcactaacacgagatggacgcatgttttcttttgggcgaggcgaccatgggcgtttaggattcggaaggaaggtgacaactggtaatccaatggaggtacctataaacctcccacctccaaacaatattagtgaggaggataaagccgaagggtgttggcgggctaacctcattgcttgcggtggtcggcatactctggctattgttgaatggcaacctaatgaccctgaataatagaaccaaaatgctggtatatctaccatagtgcaaatatacggtcgcggtatcggtgatgatacggatttcgtggtcaatgcagcctatgtttcggtcatctcctttatgataggtgatgagttattatttttgcactatgaagtatctactaaatgaaaaactaatgatgtaaacatagaccatatatcttccaacttatggtgaatgctaatttatgtgccaaaagttctatttttgcatctagactttggtatttacttctatttctgtacccattttcaccaaaaaagatttgttgatgaatttgg

SEQ ID NO: 1487 - DNA, 1467 bp, Daucus carota
aacaagttcaattgtgttgtatccctttttctttccctcttcaatggcttccgacaccatagttatcgcatggggttcaggagaagatgggcagctaggaattagtaataacgaggaaaaagaatgggtttgctcaatcgaatctctcaactctagaaatgttcgctctgttgttgctggtagtcgtaactctcttgctatttgtcaagatggcaagttgttcacttggggttggaatcaaagaggcacattaggtcacccccctgatactaaaactgagaacatacctagtcaagtcaaagctctttccactgtcaaaattgtgcaggcagctattggtggatggcattgtctggctgttgacgatcaaggccgtgcttatgcttggggtggaaatgagtatgggcaatgtggtgaagaaccagagaggaaagacgactcatctaagcctttaaggagggatattgtcattcctcagcgatgtgctcccaagctttcagttcggcaggttgctgctggaggtacacactcagtggtccttacacacgaaggacatgtatggacatggggccagccatggcctcctggggacataaagcaaatttccactcctgtaagagtacaaggtcttgaaagagtgaagctaattgcagttggggcttttcataatttggctctgcttgaggatggaagtttatgggcatggggtaataatgaatatgggcagcttggaactggagacacacagccaagatcgcaacccattcctgttcaaggcttatctgatcttattttggttgatattgctgctggaggatggcattctacagcaataacggataaaggagaggtatatggttggggaagaggtgaacatgggaggcttggatttggagatgacaagagcagcaaaatggttccccaaaaagttcagcttctagttgaggagaatatcgttcaggtgtcatgtgggggcacccactctgttgcattaacgaaggatggccgcatgttttcttttgggcgtggtgatcatggtcggcttggatatggaagaaaagtaacaacaggtcatccttccgaagttcccataaatctcccccctccaaattccgacgacgcagaagctgagggacattggagtgccagacttgttgcttgtggtggccgtcatactttggcaatagcagaatggtgttctgatgttgtttaagagattaatatgaagccacggttttataactactctaaaagtaaactagaaatattgtatcttttcagttagagaacaatgcacaactatgaatatctttagtggtgggagtgtacccctgcactcaacttcagatggttcccatcgttacagcagcgtgggtccttcaccctttgagcattacataatagagttactacaagaaacatcttttgaataaatgcagactttttcggatcaaaaaaaaaaaaaaa

SEQ ID NO: 1488 - DNA, 1367 bp, Cucumis sativus
attttgcttttcaatggctgccggtactgccatcattgcttggggttctggagaagatgggcaactggggttggggaataacgaagaaagggaatgggtttgcgccattaaagcccttgagtctcagaatgtttgttctgttgttgctggtagtcggaattctctcgccataaccgaagatgggaagctctttacatggggttggaatcagagaggaactcttggtcatccagcaggaaccaaatctgagaacgttccgagccaagtgaaagctctttctaatgttaagattgtacaggcagcgattggtggatggcactgtctggctgtggatgatcaaggccgagcttatgcatggggtggtaatgaatatggtcagtgtggtgaagaacctgagaagaaagataacactggtaggccaccgagaagagatatagcaattcctcaacgatgtgctccaaagctaatagtccgtcaggttgctgcaggaggtacacactctgtggtacttacacgtgaaggacatgtatggacatggggccaaccatggccacctggagatatcacgcaaatttctgttcctgtacgggttcaaggtctcgatatggtgaggcttattgcagttggggcatttcataatttagctctccaagaagatggaactttatgggcatggggaaataatgaatatggacagcttggaactggtgacacacaaccaagatcacagccaattcctgtccaagggctttctggtcttactttggttgacattgcagctggaggatggcattcaactgcattgacagataacggagaggtctatggatggggacgaggagaacatgggaggcttgggtttggagacaatgacaagagcagcaaaatggttcctcagaaggttcaactgctgtctggagaggaaatagttcagatatcatgtggaggcacacattcagttgcagtaaccagtgacggccgcatgttttcgtttgggcgaggcgaccatgggaggcttggatatggaaggaaggtaaccactggtcaaccagaggaagttccaattgacatcccacctcctcgtgggaggactgagaatggccattggattgccaaacttgttgcctgcggtggccgccatacattagctctggtacaatggaaatctgaggattaagctaaataattaatggtggttagattcttcagatgaccatctttctttctataataattatgggattcgacaacctcgattagcagctctggaaagaatggatcgtgcattgttgattgtttttatctattctgtgtagtaaaaacttccatgcatcaattctacgtaataaaagaccagtttagtagca

SEQ ID NO: 1489 - DNA, 1647 bp, Solanum tuberosum
ctccactgtccactccactcaaccagtccacaatatacagattacagaagaagccaccatttttaccgattcttgaaaatcagactgaaagctctaaagtattcagacttagctctgcaagaaacagaaaactgaaagcagccagccacaagtatatatgacttccagaaacgccgtcatcgcttggggctctggagaagatggtcaattgggtattggaaacaatgaagagaaagagtgggcttgttcaattaaagctctaaaatctgaaaaagtttcttctgttgttgccggaagtagaaactctcttgccatttgtgaagatggcaaattatttacgtggggttggaatcaaagaggaaccttgggacacccacctgagacaaaaacagagaacattcctagtcaggttaaagctcttgccaatgtgaaaattgttcaggcggcaattggtggctggcattgtttggctgtagatgatcaaggcaaggcttatgcttggggtggtaatgagtacggacaatgtggggaagaaccagaaaggaaagatgacactggaacgcccgtaaagagagatattgtgatccctaagcgttgtgcctctaagctttctgttcgtcaggtagctgctggtggtacacactctgttgttcttacaagggaaggacaagtatggacatggggtcaaccatggcctcctggtgacataaagcaaatttctactcctgtccgtgtacaaggtcttgcaagtgtgaggttgattgcagtaggggcctttcataacttggctcttcttgatgatggagttctaatggcatggggtaataatgagtatgggcaacttggaactggggatacccagccaagatcacaacccattgccattcaagggctatctggtctcactttggttgatatcgctgctggaggatggcattctgcagctttgacaaatgagggagaggtttatggctggggaagaggggaacatggtagacttggatttggggatgacaagagtagtaaaatggtgccgcaaaaggttcaacttttagctggggagaacattgttcaggtttcatgtgggggaacacactctgttgcattaacgcatgatggtcgaatgttttcttttgggcggggagaccatggacgactaggatatggtagaaagtcgacaactggtcatccatcggaagttccaataaatattccgcctccaagtggtgatgtcagcagcacagaaggagagcgttggtgcgctaaacttgtcgcttgtggtggccgccatactttggcgaatgtagagtggcagacatttgagtctgagtagtcactttaaaagtgtcatttttaagtctgaattcaggtaggtatctgattcagcggcgtcactgttgtatgaggtggttgtacttttgtattattattgaggcaactgaggtggagaattcagaattttctttttctggttgggttggcgattactggtacgcttctgggaacttagttagtactatctgcttctgtttatctactggtactatattgtgaataacctaattctgccttcttcattgttgcttatattggaattccagtgccagtagcaccgttctcccggacacaaaatagagaaaaaaaaaa

SEQ ID NO: 1490 - DNA, 1640 bp, Nicotiana tabacum
gggaaagcagcaataattagagaacgcagccctcccctgtccactccgatattagagaagccaccatttttatgcacacagccaagggcgattcttgaatcagattcccaccataccaagtacagtacatagtaaaactccaatatttccactcttagcagtaaaagcgcacacactactggtgaacaaacccgagaagcagaaaactgagagcagctgccacaaatatctatggcttccagaaccgccgtcatcgcttggggctctggagaagatggtcaattgggtattggaaataatgaagagaaagaatgggtttgtactattaaagctcttaagtactctgagaaagtttcttctattgttgctggcagtagaaactctcttgctatttgtgaagatggcaaattgtttacatggggttggaatcaaagagggaccttgggacacccacctgagaccaaaactgagaacattcctagtcaggttaaagctctttccaatgtcaaaattgttcaggcggcgattggtggctggcattgtttggctgtggatgatcaaggcagggcttatgcttggggtggtaatgagtatggacaatgtggtgaagaaccggaaaggaaagatgacactggaaggcctattaagagagatatcatcatccctaagcgttgtgcctctaagctatctgttcgtcaggtagctgctggtggtacacactctgttgttcttacaaaggagggacaagtatggacatggggtcaaccatggcctcctggtgacataaagcaaatttctacccctgtccgtgtccaaggccttgcaagtgtgagattgattgccgtaggagcctttcataacttggcacttcttgatgatggagttttaatggcatggggtaataacgagtatgggcaacttggaactggtgatacccagccaagatcacaacccattgctgttcaagggctatctggtctcactttggttgatattgctgctggaggatggcattctgcagctttgacagatgagggagaggtttatggctggggaagaggggaacatggtagacttggatttggcgatgacaagagtagtaaaatggtgccgcagaaggttcaccttttagctggggagaacattgttcagatatcatgtggtggcacacactctgttgcattaacacatgatggtcgtatgttttctttcgggcggggagaccatggacgactaggatatggtagaaaggtgacaactggccacccatcagaagttcccataaatattccacctccaagtgatgtcagcagcactgaaggagggcgttggtgtgctaaactcgttgcttgtggtggccgccatactctggcgattgtagagtggcaggcagaatccgaatagtcggtatgaaaccgtcagatgtaaatctgaattcagggtcactgttgtataaggtggttgcacttgtaatatgaagattatgagctgtgcatgtgactcaagtggaaaatccagttttaagatgggatagagaggcactggatattataaagaggcagaaatatgtaggattaatagaatatgctctattggtactatattcagaataagggaattttcctttcttagcggccgca

SEQ ID NO: 1491 - DNA, 1366 bp, Chelidonium majus
attattattatgtctccagctctcaccctacagtcttcagttcaaatggcttccaaaaaccccattatcttagcatggggttcaggagaagatgggcagttgggtattggagacaatgaggagaaagaatgggtttgctctgtcaaagctcttaaatctgagaaagtctcttcagttgttgctggaagtagaaactcacttgctatctgtgaagatggaaagttatttacatggggatggaaccaaagaggaactttgggccacccaccagaaaccaaactgaaaatactcctagccaggttaaagctcttgcaaatgtgaagattgttcaggcagcaattggtgggtggcattgtttagctgttgacgatcaaggccgagcttatgcatggggtggcaatgagtatggtcagtgtggtgaagaacctgagaaaaaggatgatagtggtagagctttaagaagggatattgtgattcctcagcggtgtgctccgaagcttaaagttcgccaggtagctgctggcggtactcactctgtggtgcttacacaagatgggcatgtgtggacatggggtcagccatggcctcctggagatataaaacagatttccactcctgtacgggtacaagggcttgaaaaggtgaagcttatagcagttggagcattccataacttggccctcctagaagatggtatattatgggcatggggcaataatgagtatggacaactcggaactggcgatacacaaccaagatcacaacccattcctgttcaagggctttctggtcttaccttggttgatattgctgctggaggatggcattctactgcattgacagctgaaggagaggtgtatggttggggaagaggagagcatgggaggcttgggtttggagatgacaaaagcagtaaaatggtgccccaaagggttcaactccttgttggggaggaaataattcaggtttcttgtggaggcacacactctgtcgcattaacacgtgatggccgaattttttcttttgggcgtggagatcatggacgtcttggatacgggaggaaagtgacaactggacaccccatggaagtacccataaacctaccaaagccaggggatctaattggcagtgatgataccacggaagaaatttggtgtgctaagcttgtcgcctgcggtggacgtcacactctagcaatagcagtgctgcaagctgatgaagaatcataaaagtttgctatataaattttgatacttagctctaacccagaactgttgggcatacaaactttgtagtgcaaaacatgtatgaactatatcagagtacagcctaaaaagaagttttaagaagttttatgtattagaat

SEQ ID NO: 1492 - DNA, 1356 bp, Aquilegia formosa
catacactctctttttccgtctctcttcataccattcacaccttttctttcttcaactcagtttcaactttcaatctctctctctgtctatcacagcagccagccatggcagacataaaccccattatcttagcatggggatcaggagaagatgggcaattgggtattggagataatgaagataaagaatgggtttgcagtattaagtcttttgagtctcagaaagtttcttctgttgttgctggaagtagaaactctcttgctatctgtgaagatggaaagttattcacatggggatggaatcaaagaggaactttaggtcatccaccagaaaccaaaactgaaaatattccaagtcaagttaaagctcttgccaatgtcaagattgttcaggcagctattggtggctggcattgcttggctgtagacgatcaaggccgtgcttatgcctggggtggaaatgagtatggtcaatgtggtgaggaaccagaacggaaagatgatatcactagagcagtgaggagggatattgtaattcctcaacggtgtgctccaaaactctcagttcgccaggtagctgctggaggcactcactcagtagtgcttacacatgaggggcatgtatggacatggggacagccctggccacctggagatataaaacagatttctactcccgtacgagttcagggtcttgaaaaggtgaagcttatagctgtcggtgccttccataatctggcactcatagaggatgggattttatgggcatggggtaataatgagtatggacaacttggaactggggatacccaaccaagatcacaaccgattcccgttcaagggctttctggtctgactttggttgatattgcagctggaggatggcattctactgcattgacagatgaaggagaagtatatggctggggaagaggtgaacatgggagacttggatttggggatgacaagagcagtaaaatggtgcctcagagggttcaacttctagtaggggaggatatagtgcaggtgtcttgtggaggaactcattcagttgcattatcgcgtgatggacggatattttcttttggtcgtggagaccatggacgtcttgggtatgggagaaaagtgacaactggtcaccccatggatgttcccatcaacattccacaacctataagcaatgttgggacaggacactggtgcgcaaagcttgttgcttgcggaggtcgtcatactcttgctatagctacatggcaaaatgatgaatcagaacaatcacaatgagtgataaattttgtatggcaaaaactctgagttatgagatctgtgaacatatatattaatttaataaattta

SEQ ID NO: 1493 - DNA, 1430 bp, Cleome spinosa
atggctgcttctactactgttatagcctggggctctggcgaagatgggcagttaggacttgggaccaacgacgagaaggaatgggtttgcgtagttgaggccctcgagccttacgctgttcgctcggtcgtctccggtagtcgcaattcgctcgccatttgcgacgatggcacgctgtttacatggggttggaatcaaaggggtacattaggacacccgccagagaccaagacggagaacatcccaagtcaagttaaggctcttgccaatgtcaagatcgttcaggcggctattggtggttggcactgtttggctgttgatgatcaaggccgagcttatgcctggggtggtaatgaatacggacaatgcggcgaagagcctggcaaagatgaaatggaaaggcctttgcggagagatattgtcatccccaaacgttgtgccccaaaactagtagtccgacaggtagctgcagggggtacccattctgtggttctcactcgtgaaggacatgtgtggagttggggtcagccatggcctcctggtgacataaaacaaatatctattcctgtacgagttcagggtcttgaaaatgtgcgtctcattgctgttggagcatttcataatctggctcttgaagaaaacgggacattgtgggcatggggcaataacgaatatggacaacttggaacgggagacacccaaccaagatcccagccaattccagtccaaggccttgacagtctcactttggttgacattgctgctggaggatggcactcaacagctttaaccgataaaggggaggtgtatggttgggggagaggggaacatgggaggctcgggtttggggacaatgacaagagcagtaagatgttacctcagaaagttaatcttctagccggggaagacatcattcaggtctcttgtggtggcactcattcggttgcattgacacgagatggccgtatcttctcttttggtcggggagaccatggtagacttgggtgtgggagaaaagtgacgacgggacagccattggatgttccggtaaagatccctccaccagagggacagttcaatgacgctgcagaggatgacgacggtaaatgggttgccaaggtcgttgcttgcggtggccgccacactctagccattgtggaatggaagtccgccgcaatttgaccacactctccggccaccaaaagccatggaatgtgaaaatacatcaatgaagattcttttgctgagcatagtcttattacttggaactggttatagccctgaatcagaatctctcttttcatcccatgggcatgatacatcatatatctcagagtttttcagttgcgttccagagaagttggactacgtttgatgctgaaccaagttcggttttggtgatttcaataagattttctttcttagcttgg

SEQ ID NO: 1494 - DNA, 1411 bp, Silene vulgaris
ccccctttctcctttcagtctcttctatgtcttctccttctacttctgtcattgcttggggttcaggcgaagatgggcaactgggtataggaaacaatgaagatagagatactgtctgtcaagttaaagcacttcaatcttatcatcctgtttctgttgttgctggtagtagaaactctcttgctatttgtcatgatggcaagttgtttacatggggatggaaccaaagagggactttaggacacccggctggaacaaagaccgagaatgttcctactcaagttaaagctcttgccaatgtgaagattgtacaggcagcaattggtgggtggcattgcctagcagtcgatgatcaaggccgtgcttatgcttggggtggtaatgagtatggacaatgtggtgaagtgcctgaaaagaaagatgatgctggtaggccattgagaagagatattgtgataccacaacgctgtgcgcctaagctaactgttcggcaggtggctgccggaggtacacattcagtggttctcacacgtgaaggacatgtgtggacctggggtcagccatggccgcctggagacataaagcaaatatttgtccctgtcagagtccagggacttgaaagggtgcgacttattgcagtgggtgcctttcataatttggcccttgcagaagatggtactttatgggcatggggtaacaatgagtatggacagcttggaactggagatactcaaccgagatcacagcctattcttgtgcagggactttctgggcttacattggttgacattgctgctggtgggtggcactcaacgacactaactagtgaaggagaggtgtacggttggggcagaggagaacatggaaggcttggatttggcgatgacaagagcagtaaaatgttgccacagaaagtgcaacttttagctggagaagatatagttcaggtgtcttgtggaggaactcattcagttgcattgacaagagatggacgcattttctcttatggccgtggagatcatggtcgcctaggatatggcaggaaggtgacaaccggtcatccaatggaagtcccaataaatctcccatctcccaacaacacaggtgatgatgaggaagccgaagggcactggcaggctaaacttgttggctcgggtggtcgacatacttcagcgattgttcaatggcaacccgatgaaggtgaataaatctcttgacatgaaaataattgtgctttgcataaacctatttatggtataaatccacaaatagagaggggagagggaaatacacgaaaagttgtactactattacgtatactaattctctgatgagactgtctcatgagtcgtgatctcttattttgattacggagcactatatttattagaaacttgttttaatttaatac

SEQ ID NO: 1495 - DNA, 1427 bp, Chenopodium quinoa
aaaaaaccccgttactctcgctgttctcttcatttctctctcctcaactctatgccttcagataccgccgttatcgcttggggttcaggcgaagatggacaattaggtataggcaacaatgaagataaagaatgggtttgccaagttaaagctcttcaaaattacactgtttcctctgttgttgctggtagtcgcaactctcttgctctttgtgaagatggcaagttatttacatggggatggaatcaaagagggactttagggcaaccacctgagactaaggctgagaatgtgcctactcaggttaaagctcttgccaatgtgaaaattgtacaggcggccattggcgggtggcattgcttggctgttgatgatcaaggccgtgcttatgcttggggtggtaatgagtatgggcaatgtggtgaagatcccgaaaaggatgaaactggcaggcttttgcgaagggatattgtgattcctcaacgctgtgcacctaagcttaaagttcgccaggtggctgctggaggaacgcattcagtggtacttacacgtgaaggacatgtatggacttggggtcagccatggccacctggagatataaagcaaatttttgttccagttagagtacaaggacctgaaaaggtgcgattgattgcagtgggagcatttcataatttggctcttgaagaagatgggaccttatgggcatggggtaataacgagtatgggcagcttggaactggagatactcaacctaggtcacagcctattcgtgtacaggggctttctggtcttacactggttgatattgctgctggtggttggcattctactgctctgacgagtgctggagaggtgtacgggtggggtagaggagagcatggacggcttggatttggagatgacaagagcagtaaaatgttgccacagaaggtgcagcttttagccaatgaagatatagttcaggtatcttgtggaggaactcattcagttacaatgacacgagatggacgaatatttactttcgggcgaggtgaccatggccgtttaggatatggacggaaggtcacaaccggtcatcctatggaagtaccaataaatctcccacctccaaaaagtgtcggtgaggaggagaaagccgaagcgcgttggcgggctaaccttatagcttgtggtggtcgacatactttggctattgttaaatggcaagctgatgatgatgagttataagctatatatgaaaccaatgttcttatcacggaccttttattgtcaattgtaataatctaaaactccataaataataaacagtggttttgttctcggcttcccgctgccctgacctctgtttatgtttggttaaggagatgaaacagttatgtgtttaaacacgaataaaataagatgaaacatattgtttttattca

SEQ ID NO: 1496 - DNA, 1394 bp, Arabidopsis thaliana
tttgtaattgtatctctcacttttgtttcaatggcttcagctacttccgtcatagcctggggttctggagaagatgggcaactaggacttggaaccgatgaagaaaaggaattggcttccgtcgtcgacgctcttgagcctttcaacgttcgctccgtcgtcggtggtagccgcaattccctcgccatttgcgatgatggcaagctgtttacatggggttggaatcaaaggggtacattaggacacccacctgagacaaaaacagaaagcaccccaagtctagttaagtctcttgccaacgtcaagattgttcaggcagctattggtggctggcattgtttagctgtcgatgatcaaggccgagcatatgcttggggtggaaatgaatatggacagtgtggtgaagagccttccaaggatgagacaggtaggcctgtgcggagggatattgtaatacctaagcgttgtgcccagcaacttacagtccgacaggtagctgcagggggtactcactctgtggttctaacccgtgaaggttatgtatggacttggggtcaaccgtggcctcccggtgacataaaacaaatttctgttcctgtaagagttcagggtcttgaaaacgttcgtctgattgctgtgggagcatttcataacttggctctgaaagaagatgggactttgtgggcttggggtaataatgaatatggacaacttggaactggagacacacaaccgagatcgtatcctattcctgtccaaggccttgacgatctcactttggttgatatcgctgcgggtggatggcattcaacagctttaaccaatgaaggagaggtttatggttggggaagaggagagcatggaaggctcgggtttggtgacaatgataagagcagtaaaatgcttccgcagaaagttaatctcttagctggagaagacatcattcaggtctcttgtggcggaactcattcagtcgctttgacaagagacggtaggatcttctcgtttggtcggggagaccacggtagactcgggtatggaagaaaagtaactacgggacaaccattggagcttcctatacacattccaccaccagaaggacggttcaaccacaccgatgaagaagacgatggaaaatggatagctaaacatgtagcttgtggtggccgacacactctagcaattgtggaatggaagtatgatcaggaggaaacagaataaccatgaagaagatagagcgagcaaaaaaacaaaaacacaagagggactctagagataagcatttgttatagagaaaaggggagcaaaagcatatggttaagcttttgacactcccatgaatgatgaatctatatgaaagaggaagaactaaatataatatcatcatgattttg

SEQ ID NO: 1497 - DNA, 1599 bp, Eutrema parvulum
tctctctcacattcggctcccatggcttcagctacttccgtcatagtttggggctctggagaagatgggcaactaggacttggaacagatgaagaaaaagaatgggcttgcgtcgtcgaggctcttgagccttttaccgttcgctccgtcgtcggaggtagccgtaattccctcgccatttgtgatgatggcaagctgttcacatggggttggaatcaaaggggtacattaggacacccaccagagacaaaaacagaaagcatccctagtctagttaagtctcttgccaatgtcaacattacacaggcagctattggtggttggcattgtttagctgtcgatgatcaaggccgagcatatgcttgggggggaaacgaatatgggcaatgtggtgaagagccttccaaggatgagacaggtaggcctgtgcggagagatattgtaatccctaagcgttgtgccccaaaactgacagtccgacaggtagctgcagggggtactcactctgtggttctaacccgtgaaggttctgtatggacttggggtcaaccttggcctcccggtgacataaaacagatatctgttcctgtaagagttcagggtcttgaaaacgttcgtctgattgctgttggagcatttcataatttggctttgaaagaagatggaactttgtgggcttggggaaataatgaatatggacaacttggaaccggagatacccaaccgagatcttatcctattccagttcaaggcctcgatgatcttactttggttgatatcgcagcgggtggatggcattcaacagctttaaccgatgaaggagaggtgtatggttggggaagaggagaacatggaaggctcgggtttggtgacaatgacaagagcagcaaaatggttccacagaaagttaacttattatctggagaagacatcattcaggtgtcttgtggcggaactcattcagtcgctttaacaagagatggtaggatcttctcgtttggtcggggagaccacggtagactcgggtatggaagaaaagtgacgacgggacaaccattggagcttcctataaacattccaccaccagaaggacggtttaaccatgccgatgaagaagacgatagaaaatggatagccaagtttgtggcctgtggcggccgacacactctagctattatggaatggcagttggatcaggaggagacagaataaccatggagaagaaagagagcaaaaaaaccaaaacacaaatgggactctggagagaagtatttgttatagagaaaaggggagcaaaagaattgttaagcttttgacattcccatgaatgatgaatctatatgaagaggaataatatatataataatatcatcatgattatggaaaataggtggtgagagagaaaacaaagaagaaaaaacggagaaccttgcaaacacttttagttctttcttgttgtttgttgaatctctcgagttttctggtttaaagtttttcaacaacctttgacaagatgaggaacacaaatcgggaagatgtactttgattttcttgcttgactttgtcttgatctcacccatgagaagcatccacttcctc

SEQ ID NO: 1498 - DNA, 1384 bp, Eutrema halophilum
tctctcattgtctctctcgttttcgtctccatggcttcagctacttccgtcatagcttggggctctggagaagatgggcaacttggacttggaacagatgaagataaggaatgggcttccgtcgtcgaggctcttgaaccttttagcgttcgctccgtcgtcggaggcagccgcaattccctcgccatttgcgatgatggcaagctgtttacatggggttggaatcaaaggggtacactaggacacccagcagagacaaaaacagaaagcatccctagtctagttgagtctcttgccaatgtcaagattgttcaggctgctattggtggttggcattgtttagctgttgatgatcaaggccgagcatatgcttgggggggaaatgaatatggtcagtgtggtgaagagccttccaaagatgagacaggtaggcctgtgcggagggatattgtgatccctaagcgttgtgccccaaaacttacagtccgacaggtagctgcagggggtactcactctgtggttttaacccgtgaaggttatgtatggacttggggtcaaccgtggcctcccggtgacataaaacagatatctgttcctgtaagagttcagggtcttgaaaacgttcgcctgattgctgttggagcatttcataatttggctctgaaagaagatgggactttgtgggcttggggtaataatgaatatggacaacttggaaccggagatacacaaccaaggtctcatcctattccagtacaaggcttcgatgatctcactttggttgatatcgctgcaggtggatggcattcaacagctttaaccgacgaaggagaggtgtatggttggggaagaggagaacatggacggctcgggtttggtgacaatgacaagagcagcaaaatggttccacagaaagttaacttattatctggagaagacatcattcaggtgtcttgtggcggaactcattcagtcgctttaacaagagatggtaggatcttctcgtttggtcggggagaccacggtagactcggatatggaagaaaagtgactacgggacaaccattagagcttcctataaacattccaccaccagaaggacggtttaaccacgccgatgaagaggaagatggaaaatggttagctaagtttgtggcttgtggcggccgacacactctagctattatggaatggaagttggatcacgaggaaaactgaataaccatgaagaagaaagagaaagcaaaatccacgacacacataacacaaaggggacttcagagaggagcatttgttatagagaaaataattgttaggcttttgattttcccatgaatgatgaatctatatgaagactgaagaggaaggactaatataaaatttc

SEQ ID NO: 1499 - DNA, 1423 bp, Brassica juncea
ctctctctctcgcattcgtctcaagatggcttcagctacttccgtcatagcttggggctctggagaagatgggcaactgggacttggaacttacgaagaaaaggaatgggcttgcgttgttgacgctcttcacccttttaccgttcgctccgtcgtcggtggtagccgcaactccctcgccatttgcgatgatggcaagctgtttacatggggttggaatcaaagggggacattaggacacccaccagagaagaaaacagaaagcatccctagtcttgttaagtctctcgccaatgtcaagattacacaggcagctattggtggttggcattgtttagctgttgatgatcaaggccgagcttatgcttggggtggaaacgaatatgggcagtgtggtgaagagccttccaaggatgagacaggtaggcctgtgcgtagagatattgtaatccctaagcgttgtgcccctaaacttacagtccgtcaggtagctgcaggaggtactcactctgtggttcttacccgtgaaggttctgtatggacttggggtcaaccctggcctcccggtgacataaaacagatatctgttccggtaagagttcagggtcttgaaaacgttcgtctgattgctgttggagcatttcataacttggctctcaaagaagatgggactttgtgggcttggggtaataatgaatatggacaacttggtaccggagatacccaaccgagatctcatcctattccagttcaaggcctcgatgatctcactttggttgatatagctgctggaggatggcattcaacagctttaaccgaagaaggagaggtgtatggttggggaagaggagaacatggaaggctcgggtttggtgacaatgacaagagcagcaaaatggttccacagaaagttaatctcttagctggagaagacatcattcaggtctcatgtggcggaactcattcagttgctttgacaagagatggtcggatcttctcgtttggtcggggagaccatggtagactcgggtatggaagaaaagtgacgacgggacaaccattagagcttcctatagacattccaccacctgaaggacagtttaaccacgctgatgaagaagaggatggcacgtggatagctaagtttgtggcatgtgggggtcgacacactctagccattatggaatggaaggctgatcaggaggaggaggaaacagaataatcatgaagtaagagaaagcaaaacacagatgggactctagagagagaagcattttgttatagagaaaaatggggagagcaaaagaactgttaagcttttgacatttcccatgaatgatgaatatctaaatgaagaggaaggagtaaggactagtactatataataatgataataataatctcattaagaagttcttgcttg

SEQ ID NO: 1500 - DNA, 1493 bp, Ocimum basilicum
tcccactattccttcaactttctcaatccacatttttgttgcgggcgataggaatattacaagttccaaatcgctgcatcgatattctccactgttatggcctccaaaaccgctgtcattgcatggggttcgggagaagacggccagttaggaatcgggaacaatgaagaaaaagaatgggtttgcaccatcgacgcccttagctccgaacaagtatgctccgtcgtcgccggcagccgcaactccctcgctatttgtgatgacggcaagctgtttacttggggttggaatcaaagaggaaccttagggcacccatccgaaagcaaatctgaaagtgttcctagtcaagttatggctcttgcaaacgtcaaaattgttcaggctgctattggtggttggcattgcttagctgttgatgatcaaggacaagcctatgcctggggtggtaatgagtatgggcaatgtggtgaagagcctgagcgcaaagatgatacggccagacctctccgaagagatattgtgattccacagagatgtgtgccaaaactttcagttcgccaggtagctgctgggggaacgcactcagtagttctaacacgggaaggacatgtgtggacatggggccagccatggccccctggagatataaaacaaatttcaaccccagttcgagtgcaaggacttgatagtgtgagagtgatagcagttggagcatttcataacttggcccttcttgatgatggaactgtaatggcatggggcaataatgagtatgggcagcttggaactggtgacacccagcctagatcacaaccaattgccgtccaaggactctctgatctcaatttggttgatattgctgcaggaggttggcattctactgcactgactgatgatggagaagtgtacgggtggggaagaggagagcatgggaggctaggttttggagacgacaagagcagcaaaatggttccgcaaagggttcaactcctagtaggggaggaaattgtgcagatttcgtgtggaggtactcattcagtggcattaacacgggatggtcgcatgttctcgtttggacgaggagaccatggacgattaggttatgggagaaagctgactactggccatcctgctgaagtacctataaacattccccctagtgaagaggaaggccgttggtgtgcgactcttgttgcctgtggtggccgccatacattggctcttgtgcaatggcagcactaagctactactacttatttaactaccctcataaatcaaaactttgttgttttcccaattcctgagctttgtattgtaacctaatatttgatccatttgcttactttacacattcacaaataccataggtgcagccagaaccctgtttcaattgcatcattgggtgtaaacctgaagaaatgaagccataggggatgccctactctacttacattacgtgtgatcatcacactaataattaaatgtatgtctca

SEQ ID NO: 1501 - DNA, 1630 bp, Nicotiana benthamiana
aaagcagcaataattagaggggcgcctccactgtcctctccgctcaatattagagaagccaccactttaacttttatgcacacagccaacagcgattcttgaatcagaatcagattcccaccataccaagcagtacacagtaaaaaagtgaaagctccaatatttccactcttagcagtaaaagcacacactactgttgaataaacccgagaagcagaaaactgagagcagctgccacaaatatctatggcttgcagaaccgccgtcatcgcttggggctctggagaagatggtcaattgggtattggaaacaatgaagagaaagaatgggtttgtactattaaagctcttaagtcctctgagaaagtttcttctattgttgctggcagtagaaactctcttgctatttgtgaagatggcaaattgtttacatggggttggaatcaaagagggaccttgggacatccacctgagaccaaaactgagaacattcctagtcaggttaaagctctttccgacgtcaaaattgttcaggcggcgattggtggctggcattgtttggctgtggatgatcaaggcagggcttatgcttggggtggtaatgagtatggacaatgtggtgaagaaccggaaaggaaagatgacactggaaggcctattaagagagatatcatcatccctaagcgttgtgcctctaagctatctgttcgtcaggtagctgctggtggtacacactctgttgttcttacaaaggagggacaagtatggacatggggtcaaccatggcctcctggtgacataaagcaaatttctactcctgtccgtgtgcaaggtcttgcaagtgtgagattgattgcagtaggagcctttcataacttggcgcttcttgatgatggagttttaatggcatggggtaataacgagtatgggcaacttggaactggtgatacccagccaagatcacaacccattgctgttcaagggctatctggtctcactttggttgatattgctgctggaggatggcattctgcagctttgacagatgagggagaggtttatggctggggaagaggggaacatggtagacttggatttggagatgacaagagcagtaaaatggtgccgcagaaggttcaacttttagctggggagaacattgttcaggtatcatgtgggggcacccactctgttgcattaacacatgacggtcgtatgttttcttttgggcggggagaccatggacgactaggatatggtagaaaggtgacaactggccacccatcagaagttccgaaaaatattccacctccaagtgatgtcagcagcactgaaggagggcgttggtgcactaaactcgttgcttgtggtggccgccatactctggcgattgtggagtggcaggcagaatccgaatactctgtatgaaagtgtcagatgtaaatctgaattcagatatctgattcaatgtcactgttgtataaggtggttgcacttgtaatatgaagattatgagctgtccatgtgactgaagtggaaaatccagttttaatatggggtagagaggcactgatattataaagaggcagaaatatgtaggattaatagaatatactaggatattatgttc

SEQ ID NO: 1502 - DNA, 1436 bp, Arabidopsis lyrata
ctcactttcttcatatctctcttttctctctcattgtatctctcactttgggttccatggcttcagctacttccgtcatagcctggggctctggagaagacgggcaactaggacttggaaccgatgaagaaaaggaattggcttccgtcgtcgaagctcttgagcctttcaacgttcgctccgtcgtcggtggtagccgcaattccctcgccatttgcgatgatggcaagctgtttacatggggttggaatcaaaggggtacattaggacaccctccagagacaaaaacagaaagcacccctagtctagttaagtctctagccagcgtcaagattgttcaggcagctattggtggttggcattgtttagctgttgatgatcaaggccgagcatatgcttggggtggaaatgaatatggacagtgtggtgaagagccttccaaggatgagacaggtaggcctgtgcggagggatattgtaatccctaagcgttgtgccccacaacttactgtccgacaggtagctgcagggggtactcactctgtggttctaacccgtgaaggttatgtatggacttggggtcaaccgtggcctcccggtgacataaaacaaatatctattcctgtcagagttcagggtcttgaaaatgttcgtctgattgctgttggagcatttcataatttggctctgaaagaagatgggactttgtgggcttggggcaataatgaatatggacaacttggaactggagatacacaaccaagatcttttccgattccagtccaaggccttgatgatctcactttggttgatatcgctgcgggtggatggcattcaacagctttaaccaatgaaggagaggtgtatggttggggaagaggagaacatggaaggctcggatttggtgacaatgacaagagcagtaaaatgcttccgcagaaagttaatctcttagctggagaagacatcattcaggtctcttgtggcggaactcattcagtcgctttgacaagagacggtaggatcttctcgtttggtcggggagaccacggtagactcgggtatggaagaaaagtgactacgggacaaccattggagcttcctatagacattccacccctagaaggacggttcaatcacaccgatgaagaagacgatggaaaatggatagctaaacatgtagcttgtggtggccgacacactctagcaattgtggaatggaagtttgatcaagagggaacagaataaccatgaagaagatagagagagcaaaaaaaaaaattacacaagagggactctggagataagcatttgttatagagaaaaggggagcaaaagcatatggttaagcttttgacactcccatgaatgatgaatctatatcaaaaagaggaagaactaatatataatatcatcatgattttgtttttgattata

SEQ ID NO: 1503 - DNA, 3980 bp, Brassica rapa
gcataaccctcgaattgaagaatcacaccgagcgagtgccctctgctttttcctcggttttccactcactttctctctctctctctctttcgcaagcagatggcttcagctacttccgtcatagcttggggctctggagaagatgggcagctaggacttggaacttacgaagaaaaggaatgggcttgcgtcgttgaggctcttgacccttttgccgttcgctccgtcgtcggaggtagccgcaactccctcgccatttgcgatgatggcaagttgtttacatggggttggaatcaaagggggacattaggacacccaccagagaagaaaacagaaagcgtacctagtcttgttaagtctctcgccaatgtcaagattacacaggcagctattggtggttggcattgtttagctgttgatgatcaaggccgagcttatgcctggggtggaaacgaatatgggcagtgtggtgaagagccttccaaggatgattcaggtaggcctgtgcgtagagatattgtaatccctaagcgttgtgcccctaaacttacagtccgtcaggtagctgcaggaggtactcactctgtggttctaacccgtgaaggttctgtctggacctggggtcagccttggcctcccggtgacataaaacagatatctgtgcctgtaagagttcagggtcttgaaaacgttcgtctgattgctgttggagcatttcataacttggctctcaaagaagatggaactttgtgggcttggggtaataatgaatatggacaacttggaaccggagatacccaaccgagatctcatcctattccggttcaaggcctcgatgatctcactttggttgatatagctgctggaggatggcattcaacagctttaaccgaagaaggagaggtatatgcttgggggagaggggaacatggtaggcttgggtttggtgacaatgacaagagcagcaaaatggttccacagaaagttaatctcttagctggagaagacatcattcaggtctcatgtggcggaactcattcagttgctttgacaagagacggcaggatcttctcgtttggtcgaggagaccacggtagactcgggtatggaagaaaagtgacgacgggacagccattggagcttcctatagacattccaccacctgaaggacagtttaaccacgctgatgaagaagaggatggaaagtggatagctaagtttgtggcatgtggtggtcgacacactctagctattatggaatggaaggctgatcaggaggaggaaacagaataatcatgaagtaagagaaagcacaacagagatgggactctagagacgagcattatgttatagagagaaaagggatagcaaaagaactgttaagcttttgacatttcccatgaatgatgaatatctaaatgaagaggaaggactaatactatataataatgatactaataatctcattaagaagttccttgttgttttttgaagaatctcttgggttgtaaggttgttttcaacaacctttgacaagatgaggaacacaaatagggaagatgtattttgattttctagcttgtctttgtcttgatcttctccatgagaagcatccacttcctcctcgcttcttctgcttcttcatttcttcttcttcttcttcttcttcatcactcatctcttgcttctcttctccttctccttctttaatactcctcatctcttgcttctcttctgtttcttctccttctgtattactcacctcttgcttctctactgcttcttctttactcatctcttgcttgtctccttctttctctttgtcttccaacttcaaatccttatagaattacatattatcaacatataattttatatattaagaaaactatacgtacgttggaacctaaaatgtggtattttccttatagtttaggaaagttttggccgtttggacaataattttatagttatttaaaaaaaaagaattttatagtttcagcctttcaagtccaaaccgtaaaatagtaaatcaaattttgttttactgtagtcaaaagtgtaaacttggggattgattttgaataataactagtgccaaatgagactgaatctatgagtccgagcctatgtgtctatgactataaatgtatagatacataaatgcatgcaccgcacataccaatgtatagggaatatagatggtatcacgtgagttggatacaaaatcttgaaatggggtctaaatctaatgaaagatttttttcatgaaagagtgatatcatatgatttatacatttttgtatgtgtttctctgattgatattcatgtgtactatgtttcttatcttatatgaaagaatcttaatcataaaatgaattctcaacgcatgtacaaaaacactaacgtagaagagttttatcattgtctctttctatgattgaaaaacattggtgccattaaatgtttggtgcgttacttatcttgcgaatgaatctaattattgatgcacgagcaactcaaaatgtttgtgcaagtattaacttccgtaccatttcatcgacctcatggtagggaacatatgtatcttgaatactttacatgaaaataaaattgcctttttattccaaaacaacacacaaatgaatttttttttaaattacattaattaaaattattcaacattttatttatatttagatttggatttagtgattagggtttagaatttagtatttaaagattatggttaggagtcatttattcattttatcttttacctaatgtaattgtagaatttttttacttgtttactatttttgttataatttttttttggtagtacctcttgttgaccttctagtttgagattaaattccactggcgaatcattagcttccacgtgtcgtttcagtgaccgttccatgatcggaggcgtctttgccggactagggctaccggagctaagatccaccgacgtactctgaatgcccacatcccgtttcagatcaggagcataaagatcctcgtgaatgactttaacgttagaattatcattgggtttgttttgaccaatattattcatcaatggattgggatcagggtagtgaagaggagcagacatggtggtggtcaagtttctaaaagatcttgcacttaatgtcttagaagacaaacactccattggaacttctccagacactggattacatatatatttctctgcttcgttccatttcgaattcaatgcaaacccttcttgtgttaaccattctctgttattgaacattgtctttgcttgtaacgctgcaaaccaaaaaaaaaaacagaacacatatttgaacattcctcgtttgttttctatgttcttttgatttatattaacattttgattactcttgagaaacttacccttgagtgcgttggtgaaggaatatgttgatgggtcaatctcgtctgttataacgatttgaagtttaaaaattatcagacaattaaattcataacacacaaataagagacaaaaagggtggaagatgtttagccacctttgagggtgtagccaggagaagaggcagtgctagagatgctatttaagtatgttcttgaagaagacttgtgatgatcttctctaaagcttccaacgtatgaagcagagaaccttcttgaagtagggttttctcggatcaatcgagctcttcgatcccattctcttaggttcataaactcatgctcatctcctcgcagagccattggaaacgaaatatttcttttactttttgttttgttttgtaaacgagcaaaaaacttgtgaagtaaggagggagaatgacgcaactaggcagcacttataatttttctcttattctcagtggattattttagtcccttattttataaaaatcatattgggtatattaatgtttaaattctttcgtatctttagacagatagaaaaatatttgaaattttaaataaac

SEQ ID NO: 1504 - DNA, 1566 bp, Petunia hybrida
atgcacacagccaatcacctattcttgaaatcagattcccaccatattagaaaaaagttaaagctccaatatttatccacttacttagcagtgaaaatacacacactactttgaaaaagctccacaagtatggcttcaagaactgccgtcatcacttggggctcaggagaagatggtcaattgggtattggaaacaatgaagagaaagaatgggtttgtactataaaagctcttaaatcagagaaagtttcttctgttgttgctggcagtaaaaactctcttgctatttgtgaagatggcaaattatgtacatggggtcggaatcagagagggactgtgggacatccacctgaactaaaactgagaatatccctagtcaagtcaaagctcttgccaatgtgaaaatagttcaggcggcgatgggtggctggcatcgtttagcagtggatgatcaaagcaaggcttatgcttgcggtggtaatgagtacggacaatgtggtgaagaaccggaaaggaaagatgacactggtaggcctataaagagagatatcgtgatccctaagcgctgtgcccctaaactttctgttcgtcaggtagctgctggcggtacacactctgttgttcttacaagggaaggacaagtatggacatggggtcaaccatggcctcctggtgacataaagcaaatttctactcccgtccgtgtacaaggtcttgcaagtgtgaggttgattgctgtaggagcctttcataacctggctcttcttgatgatggtgttttaatggcatggggcaataacgagtatgggcaacttggaacaggggatacccaaccaagatcacaacccatcgctgttcaaggactatctggtctaactttggtcgatattgctgctggaggatggcattctgctgctttgacagatgagggagaggtttttggctggggaagaggggaacatggtagacttggatttggagatgacaagagcagtaaaatggtgccacagaaggttcaacttttagctggggagaacattgttcaggtatcatgtgggggcacacactctgttacattaacacatgatggtcgaatgttttcttttgggcggggtgaccatggaagactaggatatggaagaaagatgacgaccggccatccatcagaagttccaataaatattccacctcctagtgatgtcagcagcgctgaaggagggtgttggtgcgctaaactggttgcttgtggtggccgccatactctggcggttgtagagtggacactcgagtctgaatagtcagctataaaggcatcagttttaagtctgaattcagatagatatctgaaaaaatggcactgttgtatgaagttgttgcacttgtacatgagacactgagcagtctatatactgagtgaacctttccggactaggttcactattactgtttcccttatgggaacttattagaatatgctctactgctgctatattgtgaatagggtaatgcactggatacaataagagtcagtagtttatgggattaatagaatatgctctacaggta

SEQ ID NO: 1505 - DNA, 1482 bp, Beta vulgaris
agttaaaccaaaaccaacacgttaaactcatctcattttttccacttcacaagtcacaacccacaactcacacataactccgtcactctagccgtcttctcctcctgtttttctcacctgaactttatgtcttcagacaccgccgtcatagcttggggttcaggggaagatggtcaattaggaataggcaacaatgaggagagagaaagggtttgccaaattaaagctcttgaaaactacactgtttcctctgttgttggtggtagtcgttactctcttgctctttgtgaagatggcaagttgtttacatggggatggaaccaaagaggtactttggggaaaccacctgagaccaagagtgagaatgttcctagtcaggttaaagctcttgccaaggtgaaaattgcacaggccgcgattggtgggtggcattgcttagctgttgatgatcaaggccgcgcttatgcttggggtggtaatgagtatgggcagtgtggtgaagatcctgagaaggatgaaactggtagacttttgagaagggacattgtaataccacaacgttgtgcacccaagctgaaagttcgccaggtggctgctgggggtacacattcagtggtccttacacgtgaaggacacgtatggacgtggggtcagccatggccacctggagatattaagcaaataaatgtccctgttcgagtacaaggacccgaaaaggtgcaattgattgcagcaggagcatttcataatttggctcttgaagaagatggaaccttatgggcatggggaaataatgaatatggacagcttggaactggagatactcaaccaagatcacagcctattcgtgtacaagggctttctggtcttaaactggtcgacattgctgctggtgggtggcattcgactgcgttgacgaatgaaggagaggtgtatggttggggtagaggagaacatgggcggcttggatttggagatgacaagagcagtaaaatgttgccacaaaaggttcaacttctggccggagaagatataattcaggtgtcttgcggaggaacgcattcagttgcactgacacgagatggacgaatatattcttttggacgaggcgatcatggccgtttaggatatgggagaaaggtcactactggtcatccgatggaggtccccattaatctcccatctccgaaaagcgttagtgaggaggatagacccgaagggcgctggcgagctaacctcatagcttgcggtggtcgacatactttggctatagttaaatggcaacctaatgataatgaataataataagctgtttatatgtgaaactactcaatgtttaagcatggaccttgtattgccactttgtaacagaaaaagttacataaatacacttgcaacatatttctgtattggaaacgatagtctttcgctcttctgaataagcacaaagcaccatcatattggccaacttgtgatatcaat

SEQ ID NO: 1506 - DNA, 1273 bp, Brassica oleracea
gctttttcctcggttttccactcactttctctctctctctctctctctttcgcaagcagatggcttcagctacttccgtcatagcttggggctctggagaagatgggcagctaggacttggaacttacgaagaaaaggaatgggcttgcgtcgttgaggctcttgacccttttgccgttcgctccgtcgtcggaggtagccgcaactccctcgccatttgcgatgatggcaagctgtttacatggggttggaatcaaagggggacattaggacacccaccagagaagaaaacagaaagcgtccctagtcttgttaagtctctcgccaatgtcaagattacacaggcagctattggtggttggcattgtttagctgttgatgatcaaggccgagcttatgcctggggtggaaacgaatatgggcagtgtggtgaagagccttccaaggacgagtcaggtaggcctgtgcgtagagatattgtaatccctaagcgttgtgcccctaaacttacagtccgtcaggtagctgcaggaggtactcactctgtggttctaacccgtgaaggttctgtctggacctggggtcagccttggcctcccggtgacataaaacagatatctgtgcctgtaagagttcagggtcttgaaaacgttcgtctgattgctgttggagcatttcataacttggctctcaaagaagatgggactttgtgggcttggggtaataatgaatatggacaacttggtaccggagatacccaacctagatctcatcctattccagttcaaggccttgatgatctcactttggttgatatagctgctggaggatggcattcaacagctttaaccgaagaaggagaggtgtatgcttgggggagaggggaacatggaaggcttgggtttggtgacaatgacaagagcagcaaaatggttccacagaaagttaatctcttagctggagaagacatcattcaggtctcatgtggcggaactcattcagttgctttgacaagagacggtaggatcttctcgtttggtcgaggagaccacggtagactcgggtatggaagaaaagtgacgacgggacagccattagagcttcctatagacattccaccacctgaaggacagtttaaccacgctgatgaagaagaggatggaaagtggatagctaagtttgtggcatgtggtggtcgacacactctagctattatggaatggaaggctgatcaagaggaggaggaaacagaataatcatgaagcattttgtt

SEQ ID NO: 1507 - DNA, 1195 bp, Cucurbita pepo
ggggttcaggagaagatgggcaattgggattggggaacgaccaagagagggagtgggtttgcgccattaaagcccttgggtctcagaaagtctgttctgtgttgccggtagccgaaactccctcgccatctgcgaagatggcaagctgtttacatggggttggaatcagagaggcactcttgggcacccagcagaaacaaaagctgagaacattccgagccaggttaaagctcttgctaatgttaagattgtgcaggcggctattggtgggtggcactgtctggctgtggatgatcaaggccgagcatatgcctggggtggtaatgaatatggtcagtgtggcgaagaacccgagaagaaagatgacagtggtagaccacctccgagacgagatatagcaattcctcaacgatgtgcaccaaagctaatagttcgtcaggttgctgctggaggtacacactctgtggtacttacacgtggaggacaagtatggacatggggccaaccatggccacctggagatataacgcaaatttctgttcctgtacgagttcaaggtcttgatatggtgaagcttattgcggttggggctttccataatttggctctccaagaagatgggactttatgggcatggggtaataatgaatacggacagcttggaactggtgacacgcagccaagatcacagccaattcctgtccaagggctttctggccttactctggttgacattgcagctggaggatggcattcaactgcgttgacagatagcggagaggtttatggatgggggcgaggagaacatgggaggcttggatttggagataatgataagagcagcaaaatggttccccagaaggttcaacttttgtctggcgaggacatcgttcaggtatcctgtggaggcacacactcagttgcagtaaccagtgatggccgcatgttttcgtttgggcgaggtgaccatgggcggcttggatatggaaggaaggtcacaactgggcaaccagaggaagtgcccattgacattccccctcctcgtgggactgagaatggccgttggattgccaaacttgttgcctgcggtggccgccatacattagctctggtacaatggaagcctgaagattaagtaaaataattcatggttgttagattcttaatattatgaactttttctttgaaataataa

SEQ ID NO: 1508 - DNA, 1228 bp, Euphorbia peplus
gtctgcgtcgttaaagctctcgaaccatacaaagtccggtccgttgttggtggtagtcgtaactctcttgctatttgtgatgatggcaagttgtttacatgggggtggaaccagagagggactttagggcatccggctgagactaagactgagaatgttcctagccaagttaaggctcttagtaatgttaacattgttcaggctgctattggtggatggcattgcttagctgttgatgatcaaggtcgcgcttacgcttggggtggaaatgagtatggtcagtgtggtgaagaacctgagcggaaggatgacaccggtaagccattgagacgagatatagtcattcctcagcgttgtgcaccgaagctcactgtacgccaggttgctgctgggggtactcactccgtggtgcttacacgtgaagggcaagtatggacatggggccaaccatggcctcctggcgacataaaacagatatctgttcctgtgcgggtgcaaggcctggaaagggttagactcattgcagtgggtgcatttcataatttagctcttcaagaggatggaacgttgtgggcgtggggtaataatgaatatggacagcttggaactggggatacccagcccagatcgcaacctattcccgtccaagggctttctggtcttactttggttgatattgctgcgggtggatggcattctactgcactgactgatgatggagaggtgtacgggtggggaagaggggaacatggacgacttggatttggagataatgacaagagcagtaaaatggtgcctcaaagggtcaatctcttggccggggaggacattgttcagatatcttgtggtgggactcattcagttgcaatgacgcgaagcggacgaatattttcttttggtagaggagatcacggtagacttggaaatgggaggaaagtgacaacgggacaaccaattgaagtgccaatcgagattcctcctcctaatcatcatagtgaaagtgaagctgaagccgaagccgatgagggatattcttggattgctaaacttgttgcttgcgggggccgacatactcttgcaattgtagagtggcaaactgattcgtcctaatagtcaagtaggaaactttgttgtcttattatgtatgatacttagaattgacaattgatcccaaaaaaaccaagtttacgcctgaatcttgttccaaactaactcgaattacataatt

SEQ ID NO: 1509 - DNA, 1470 bp, Echinacea purpurea
gccggggggaaacacacactaaaaatattaaagtttatcatcccgaaacagtccggcagcaaatcaccacttccgtatacactttttcaaaactctttccaatggccgtcaatcatcacgccgtcatcgcctggggttctggagaagacggacagctaggactaggtgacaacgaagagaaagaatggatctctcccgtcacatctctctcttcagtctccgttcgctccgtcgtcgccggtagccgtaactctctcgccgtttgccatgacggcaagttgtttatgtggggttggaatcaaagaggaactttggggcacccaccatcaagtaaaactgagaatatcccgagtcaggttaaagctcttgacaatgtaaagattgttcaggcagcgattggtggttggcattgtttggctgttgatgatcaagggcgtgcttatgcttggggtggaaacgagtatgggcagtgtggtgaagagcctgagaagaaagatgattctggtaggactttaaggagagatatagtgattcctcaaagatgtgcaccaaagctttctgttcgccaggtagctgctggtggcacccattcagtagtgctgacacgcgaaggacatgtttggacatggggtcaaccctggccccctggagacataaaacaaatatcaacacctgtgagagtacaaggtcttgagaaggttaagctgattgcagtcggcgctttccacaatttggctcttcttgaggatggaaatctttgggtttggggcaataatgaatatggacagctaggaactggggatacccagcccagatcacaaccagttcctgttcaaggattatccggcctcaaattggttgatgttgctgctggaggttggcattccaccgctctaacagatgaaggagaggtatacggatggggtagaggggaacatgggagacttggatttggagacgacaaaagcagtaaaatggtaccgcagcaagtacagcttctagctggggaggatatcatccaggtttcatgtggtggaactcattctgttgctttgactcgtgatggtcgtatgttttcttttgggcgtggggaccatggaagattaggatatggtaggaaggttacaactggtcatccatcagaagtacctattgacctaccgtcaccaaaagatgatgaactagggcggtggtgtgctaaatatgtagcgtgtggtggccgccatacacttgccattgtagaatggcgagccgcagaggcagatggtttgatctgatcaagtttttattggaacatcttgagaattgtattatctaaatatatatggatttattcaagttgagaatgtcctgtgactttaaaagttttgggtaacaagtggtcgatgcaatgcaggtgttacatgttatctaatatctatcagttcttttttcatcatattatgtaacgagttatgcctgatttttgcc

SEQ ID NO: 1510 - DNA, 1445 bp, Chenopodium quinoa
aacaacctcactactcaattactcgtttcataccttcctcacataaaaaccccgttactctcgccgttctatacatttttctctcctcaactcttctactctatgccttcagacaccggcgtcatcgcttggggttcaggagaagatggacaattaggtataggcaacaatgaagataaagaatgggtctgccaagttaaagctcttcaaaattacagtgtttcctctgttgttgctggtagtcgcaactctctcgctctttgtgaagatggcaagttgtttacatggggatggaatcaaagagggactttagggcaaccacctgagactaaggctgagaatgtgcctactcaggttaaagctcttgccaatgtgaaaattgtacaggcggccattggcgggtggcattgtttggctgttgatgatcaaggccgtgcttatgcttggggtggtaatgagtatgggcaatgtggtgaagatcccgagaaggatgaaactggcaggcttttgcgaagggatattgtaattcctcaacgttgtgcacctaagcttaaagttcgccaggtggctgctggagggacacattcagtggtccttacacgtgaaggacatgtatggacttggggtcagccatggccacctggagatataaagcaaatttttgttccagttcgagtacaaggaccggaaaaagtgcgattgattgcagtgggagcatttcataacttggctcttgaagaagatgggacgttatgggcatggggtaataatgagtatgggcagcttggaactggagatactcaacctagatcacagcctattcgtgtacaggggctttctggtcttacactggttgatattgctgctggtgggtggcattctactgctctgacgagtgcaggagaggtttatggttggggtagaggagagcatggacggcttggatttggagatgacaagagcagtaaaatgttgccacagaaggtgcagcttttagccaatgaagatatagttcaggtatcttgtggaggaactcattcagttacaatgacacgagacggacgaatatttacattcgggcgaggtgaccatggccgtttaggatacggacggaaggtcacaaccggtcatccgatggaagtaccaataaatctcccacctccaagaaatgatggtgaggaggagaaagctgaagcgcgttggcgggctaaccttatagcttgtggtggtcgacatactttggctattgtttaatggcaagctgatgatgatgaattgtaagctatatatgaaaccaatattcttatcacggaccttttattgccaattataataatctaaaactccatgaattataatcggtggttttgttctcggcttctcgctgccctgacctctgtttatgtttggttgaaggagatgaaacagttatgtatttaaacacg

SEQ ID NO: 1511 - DNA, 1309 bp, Ambrosia trifida
ggaataataataaaataagtttatctatcacccccacccaaaacactcctacagcaaaatccctccattagtaaacaccttttccaaactctttccaatggctgtcaataacaccgccgtcatcacctggggttcaggagaagacggacaactaggactaggcgacaccgaagaaaagaatgggtttcccccatcacctctctttcttccgtcaccgttcgctccgtcgtcgccggtagccgtaactccctcgccgtttgcgatgacggcaagttgtttatgtggggttggaatcaaagaggaactttggggcaccagccaacgactaaaactgagaatataccgagtcaggttaaagctattgacaatgtaaagattgttcaggcagctattggtggttggcattgtttagctgtcgatgatcaaggccgtgcttatgcttggggtggaaacgagtatgggcaatgtggtgaagagcctgagaagaaggatgattctggtaggactttaaggagagatatttcgactcctcaaagatgtgcaccaaagctttcagttcgacaggtagctgctggcggcacccattcagtagtgctgacacgcgaaggacatgtttggacatggggtcaaccatggcctcctggagacataaaacaaatttcaacacctgtgagagtacaaggtcttgagaaggttaagttgattgcagtcggggctttccacaatttggcccttcttgaggatggaaatctttgggtttggggcaataatgaatatggacagctaggaacaggggatacccagcccagatcacaaccagttcctgttcaaggattatccgacgtcaaattggttgatgttgctgccggcggttggcattctaccgctttaacagatgaaggagaggtatacgggtggggtagaggggaacatggaagacttggattcggagatgacaaaagcagtaaaatggtacctcaacaagtacagcttcttgctggggaggatattatccaggtctcatgtggtggaactcattctgttgctttgacccgtgatggtcgtatgttttcttttggccgtggggaccatggaagattaggatatgggagaaaggtgactactggtcatccatcagaagtacctattgacctaccaccacctaaaaatgttaatggcagtggcctagggcagtggtgtgctaaatacgtggcttgtggtggccgccatacactcgccattgtagaatggcgagctacagaagcagacgggttgatctgatcaaggttttatagaacaatctagatga

SEQ ID NO: 1512 - DNA, 1319 bp, Flaveria ramosissima
ccttttctaaactctttccaatggctgtcaataccaccgccgtcatcgtctggggctccggagaagacggacaactggggttaggagacgacgaagagaaagaatgggtctccaccgtcacagctctcagttcagtcaccgtgaaatccgtcgtcgccggcagccggaactctctcgccgtttgtgacgacggcaagttgtttatgtggggttggaatcaaagaggaactttggggcaccaaccaacaacaaaaactgagaatatacctagtcaggttaaagctcttgacaatgttaagattgttcaggcagctattggtggttggcattgtcttgctgttgatgatcaaggccgtgcttatgcttggggtggaaacgagtatgggcagtgtggtgaagagcttgaaaagaaaggtgattctggtaggactttaaggagagatatcgtgactcctcaaagatgtgcatcaaagctttcggttcgccaggtagctgctggcggcacacattcagttgtgctgacacgcgaaggacatgtttggacctggggtcaaccatggccccctggagacataaaacaaatttcaacgcctgtgagagtacaaggtcttgagaaggttaagttgattgcggttggggcttttcacaatttggcgcttcttgaggatggaaatctgtgggcttggggcaataatgaatacgggcagctaggaacaggggatacccagcccagatcacaacccgttcctgttcaaggactatccggccttagattggttgatgttgctgccggtggttggcattctactgctctaacagatgatggagaggtatacgggtggggtagaggggaacatggaagacttggatttggagatgacaaaagcagtaaaatggtacctcagcaagttcagcttctagctggcgaggatattgtccaggtgtcatgtggcggaactcattctgttgcattgactcgtgatggtcgtatgttctcttttggccgtggggaccatggaagattaggatatggtagaaaggtgacaacgggtcatccatcagaagtacctattgacttaccaccaccaaaagatgacggtgaaagtggactagggcggtggtgcgctaaatatgtggcatgtgggggccgtcacacactcgccattgtagaatggcaagctacagagggagatgggttgatttgatcaaagttttattagaaatatcattatgagttgtattatcttataattatggagttatttaacttgagagcttcctatgactttgtttaaggttttgagagctactttatgaaa

SEQ ID NO: 1513 - DNA, 1354 bp, Helianthus annuus
ccacttccgtaactcttttttcaactctttccaatgtccgtcaatagtcacgccgtcatcgcctggggttccggagaagacgggcaactaggattaggagacaacgaggagaaagaatgggtatctccggtcacatctctcgcttccgtcgccgttcgctccgtcgtcgccggtagccgtaactctctcgccgtttgcgatgacggcaagttgtttacgtggggttggaatcaaagaggaactttggggcaccagccaacaaccaaaacggagaatattccgagtcaggttgaaactctcaacaaagtaaagattgttcaggcagccattggtggttggcattgtttggctgttgatgatcaaggccgtgcttatgcttggggtggaaacgagtatgggcagtgtggtgaagagcctgagaagaaagatgattctggtaggactttaaggagagatatttcgactcctcaaagatgcgcacctaagctttcggttcgccaggtagctgctggtggcacccattcagtagtgctgacacgcgaaggacatgtttggacatggggtcaaccatggccccctggagacataaaacaaatttcaacacctgtgagagtacaaggtcttgagaaggttaagctgattgcggtcggcgcttttcacaatttggcgcttcttgaggatggaaatctttgggtttggggcaataatgaatatggacagctcggaactggggatacccagcccagatcacagccggttcctgttcaaggattatccggcctcaaattggttgatgttgctgctggtggttggcattctaccgctctaacagatgaaggagaggtatacgggtggggtagaggggaacacggaagactcggatttggagacgacaaaagcagtaaaatggtacctcagcaagtgcagcttctagctggagaggatattatccaggtgtcatgtggtggaactcattccgttgctttgactcgcgatggtcgtatgttttcttttggccgtggagaccatggaagactcggatatggtcgaaaggtgacaactggtcatccatcagaagtgcctattgacctgccgccaccaaaagatgaagatggaggactagggcggtggtgtgctaaatacgtggcttgtggtggccgacatacacttgccattgtagaatggcgagctacagaggcagatgggttgatctgatgaaggttttattagaacaatgttgaggaattgtattatctaatatctatggagttatttaagttaaaagtttcctgtgaccttgtttaaagttttgtgaaacaagtggttgatgcaatgcaggtgtaacatgtttttt

SEQ ID NO: 1514 - DNA, 1562 bp, Brassica napus
gacaccgagcgagtgccctctgctttttcctcggttttccactcactttctctctctctctctttcgcagcagatggcttcagctacttccgtcatagcttggggctctggagaagatgggcagctaggacttggaacttacgaagaaaaggaatgggcttgcgttgttgaggctcttgacccttttgccgttcgctccgtcgtcggaggtagccgcaactccctcgccatttgcgatggtggcaagctgtttacatggggttggaatcaaaggggtacattaggacacccaccagagaagaaaacggaaagcgtccctagtcttgttaagtctctcgccaatgtcaagattacacaggctgctattggtggttggcattgtttagctgttgatgatcaaggccgagcttatgcctgggggggaaacgaatatgggcagtgtggtgaagagccttccaaggacgagtcaggtaggcctgttcgtagagatattgtaatccctaagcgttgtgcccctaaacttaccgtccgtcaggtagctgcaggaggtactcactctgtggttctaacccgtgaaggttctgtctggacttggggtcagccttggcctcccggtgacataaaacagatatctgttccggtaagagttcagggtcttgaaaacgttcgtctgattgctgttggagcatttcataacttggctctcaaagaagatgggactttgtgggcttggggtaataatgaatatggacaacttggtaccggagatacccaacctagatctcatcctattccagttcaaggcctcgatgatctcactttggttgatatagctgctggaggatggcattcaacagctttaaccgaagaaggagaggtgtatgcttgggggagaggagaacatggaaggcttgggtttggtgacaatgacaagagcagcaaaatggttgcgcagaaagttaatctcttagctggagaagacatcattcaggtctcatgtggtggaactcattcagttgctttgacaagagacggtaggatcttctcgtttggtcgaggagaccacggtagactcgggtacggaagaaaagtgacgacgggacagccattagagcttcctatagacattccaccacctgaaggacagtttaaccatgctgatgaagaagaggatggaaagtggatagctaagtttgtggcatgtggtggtcgacacactctagctattatggaatggaaggctgatcaagaggaggaggaaacagaataatcatgaagcattttgttatagagagaaaagggggagcaaaagaactgttaagcttttgacattcccatgaatgatgaatatctatatgaagaggaaggactaatactatatattgataataataatctcattaagaagttctttcttgttgtttttggttgaatctcttgggtttaaaggttgttttcaacaacctttgacaagatgaggaacacaaaatagggaagatgtactttgattttctagcttgtctttgtcttgatcgcctccatgagaagcatccacttcctcg

SEQ ID NO: 1515 - DNA, 1770 bp, Brassica oleracea
attcgaactaaaattaatagaaattttgaatttagttacctcgttaaattatcttacaccaccgtaaaaaaaattaaaatttacgaacacattttaggaatacgaatatacggaaatgaatgtcttaaaaccatattaagtaataattaaatgtctataaacacaacaacgctattattacacaacccctctctctctctctctctctctatagaatcccactgctttgcttttcctcttccctctgtgctttcattcatccacctctctctatctctctcaaatggtttcagctacttcagtcatagcctggggctcaggagaagatgggcaactaggaattggtagcaacgaagagaaggaatgggcttgtgtcgttgaagctctcgagccttactctgttcgctctgtagtctccggtagccgtaactccctcgccatttgcgatgatggaacgatgtttacatggggctggaatcaaaaaggaacattaggacacccaccagagactaagactgaaaatatccctagtcgtgttaaggctcttgccaatgtcaagatcactcaggcagcaattggtggttggcattgtttggctgttgatgatcaaggccgagcctacgcgtggggtgggaatgaatatggacagtgcggtgaagagcctctaaaagacgagatgggtagacccgttcgtagagatatcgtcatccctaagcgctgtgcccctaaactcacggtccgacaggttgctgcaggtggtactcactcagtggttctgacacgtgatggtcacgtgtggacttggggtcaaccctggcctcccggtgacataaaacagatatttgttccggtgagagttcaaggacttgagaatgtgcgtcttatcgctgttggtgcgtttcataacttggctcttgaagaagatgggaggctaatggcatggggtaataacgagtatggacaacttggaaccggtgatactcagccaacacctcatcctgttcctgtccaaggtcttgatggtctcactttggttgatattgctgcgggtggatggcactcaaccgctttaaccgatgaaggagaggtgtatggatggggaagaggagaacatggaagactagggtttggtgacaatgacaagagcagcaaaatggttccacagaaagttaatcttctagctgatgaagatatcattcaggtttcttgcggtggaacacattcagttgctttgacaagagatggcagaatcttctcgtttggtagaggagatcatggaagacttggttatggaaggaaagtaacaacggggcagccattggagttgcctataaagattcctccacctgaaggaagcttgaatcatgctgatgaagaagaagaagggaaatggttagctacatcgattgcttgcggtggacgccacactcttgccatcgttgaatggaagtccgatgatatttgatcgttataatctctatggtcaacttacgaagagaggaaacaaatattgattcataggaagaaaggcaaaaggagagtatgtttctataaggagaaacacatgttttatcatttcatataactttttcttagattaaattaaactttgattcaaatatataaatttgatcagccaatattttattactctttaagtttttgcttatatagtggtttattaatttaatctaatattcttattgaattctttcttttcaagttttctgtccttcatacatgtatagtgttcacaattaaaaaagcaga

SEQ ID NO: 1516 - DNA, 2360 bp, Arabidopsis thaliana
gcctttctgatgatgcgcctccgggcggtaatgctattgggacatggattacattctgatcaatagggactaatagtatggatttactttgtacttcagactaggttttggtctcttccgttttagtagttgttctcgtgtcgcttagagtctctgtaggtggtcaaagagatgataatattctgatttgtagagtattatctatctcattgtggtttaaaaatgcaatggttcctcgatcaggtagcgctggatccgatagtgtttcagggtgatactagatcaaaccattgcatttgggtccaatttgatagaggggaatgttatgtaccttcaattggatgtaatcatttggtaaataaaagttgatgttgaaccaaaaaaaaaaaaaaaatctgatacagggaaaagaaaagctttaaactcttaaaatctttttgtagacaattcaacacataagtctctttccctacatttcatttatttctcttttccttatttattcctctcttcttcttcttttgacagattatcctttttctattgttccatttttttattcatgttttccatgtgtacatttgtataagaagtttttttattcaaaatagtaatctgctgtaaacttaaaaataactccaaacacacattatcagtaaatattttgagcatgtttatagaaatacgaatatacggaaatcaatgtattgagtaattaggaataatatgaattaaatataattaaacacatacacttaacatataaacacatcgctattcctattattaccatccccctcgaatcccactgctttgcttttgcgcttgtctctctgtgcattcaccttctctctctcctctctctcctctctctttctctgtgtctaatggttacagctacttcaatcatagcctggggctctggagaagatgggcaactaggaattggtaccaacgaagaaaaggaatgggcttgcgtcgttgaagctctcgagccttactctgttcgctccgttgtctctggtagccgtaactccctcgccatttgcgatgatggcacgatgtttacatggggttggaatcaaagaggtacattaggacaccaaccagaaacaaaaacagagaacatccctagtcgagtcaaggcccttgccaatgtcaagatcactcaggcagcaattggtggttggcattgtttagctgttgatgatcaaggccgagcatatgcgtggggtgggaatgaatatggacaatgtggtgaagagcctttaaaagacgagatgggtaggcccgtacgaagagatattgtgatccctaagcgttgtgcccccaaacttacagtcagacaggtagctgcaggtggtactcactcggtggttcttacacgcgaaggtcatgtgtggacttggggtcaaccgtggcctcccggtgacataaaacaaatatctgttcctgtaagagttcaaggtcttgaaaatgtccgtcttattgctgttggagcatttcataatctggctcttgaagaagatgggagattattggcatggggtaataacgaatacggacaacttggaaccggtgacacccagccaacatctcatcctgttccagtccaaggcctcgatgatctcactttggtcgatattgctgcgggtggatggcattcaacggctctaactgataaaggagaggtgtatggttggggaagaggagaacatggaagactcgggcttggtgacaatgacaagagcagcaaaatggttccacagaaagttaatcttctagctgaagaagatataattcaggtttcttgtggcggaacacattcagttgctttgacaagagatggcagaatcttctcgtttggtagaggagatcatggtagacttggttatggaaggaaagtaacaacaggacagccattggagttgcctataaagattcctccgcctgaaggaagctttaatcacacagacgaagaagaagaaggaaaatggtcagctaaatcgattgcttgcggtggccgccacactcttgccattgtagaatggaagtccgatgatatttgacactcaatctcactggtcactgaagaacttgagaagagaagatatcaatagatttttactaaggaaggcaaaagaagagtgtatctatacaaagaaagagggaaaacatgcttatttcaaatttactttttccctacaaataatctttagaaaaaataataattttgatttctagggaaaaaaatttccaataattttgatcaggagatgtagacattttagtttgttgaaaaccttgaacaaaagtttgtgttttacaatcttttaaatcaattaaaaaaaattgtatca

SEQ ID NO: 1517 - DNA, 1423 bp, Brassica napus
ctgtgctttcattcattcagctcctctctccatctctctctcaaatggtttcagctacttcagtcatagcctggggctcaggagaagatgggcaactaggaattggtagcaacgaagagaaggaatgggcttgtgtcgttgaagctctcgagccttactctgttcgctctgtagtctccggtagccgtaactccctcgccatttgcgatgatgggacgatgtttacatggggttggaatcaaaaaggaacattaggacacccaccggagacaaagactgaaaatatccctagtcgagttaaggctctaaccaatgtcaagatcactcaggcagcaataggtggttggcattgtttggctgttgatgatcaaggccgagcctacgcgtggggtgggaatgaatatggacagtgtggtgaagagcctctaaaagacgagatgggtagaccctttcgtagagatattgtcatccctaagcgctgtgcccctaaactcacggtccgacaggtagctgcaggtggtactcactcagtggtgctgacacgtgatggtcacgtgtggacttggggtcaaccctggcctcccggtgacataaaacagatatttgttccggtgagagtacaaggtcttgagaatgtgcgtcttatcgctgttggagcgtttcataacttggctcttgaagaagatgggaggctaatggcatggggtaataacgagtatggacaacttggaaccggtgatactcagccaacacctcatcctgttccagtccaaggtcttgatggtctcactttggttgatattgctgcgggtggatggcactcaaccgctttaaccgataaaggagaggtgtatggatggggaagaggagaacatggaagactagggtttggtgacaatgacaagagcagcaaaatggttccacagaaagttaatcttctagctgatgaagatatcattcaggtttcttgcggtggaacacattcagttgctttgacaagagatggcagaatcttctcgtttggtagaggagatcatggaagacttggttatggaaggaaagtaacaacgggacagccattggagttgcctataaatattcctccacctgaaggaagcttgaatcatgctgatgaagaagaagaaggaattggttagctacatcgattgcttgcggtggacgccacactcttgccatcgttgaatggaagtccgatgatatttgatcgttataatctctatggtcaacttacgaagagaggaaacaaatattgattcataggaagaaaggcaaaaggagagtatgtttctataaggagaaacacatgttttatcatttcatatagctttttccctataaataatcttttagattaaattaaactttgatttccagggattttttttcaaatatataaatttga

SEQ ID NO: 1518 - DNA, 1239 bp, Vinca minor
aacacagccgttatcgcagggggtgcaggagaagaatggacagttaggaattggcaataatgatgagaaagatttggtctgcactatcaaagctctccacccttacaacgtttgttctgttgtcagcggtagtagaaattctctagccatttgcgatgacggcaagttatttacttggggttggaatcaaagagggactttgggacatccaccagagaccaaaactgagaatgttcctagtcaagttaaatctcttgctagtgttaagattgttcaggcagctattggcggatggcattgtttggctgttgatgatcaaggccgagcttatgcgtggggtggaaatgagtatggtcagtgtggtgaagagcctgaaaggaaagatgacactgggaaaccggtgaggagggatattgtaattccacaaagatgtgtgccgaagcttaatgttcgccaggttgctgctggcggcacacattcggttgtgctaacacgggaaggacatgtatggacatggggtcaaccatggcctcctggggacataaagcaaatttctactcctgttcgagtacaaggtcttgaaagtgtgagattgatcgctgttggagcttttcataatttggctctccttgatgatggaattctaatggcatggggcaataacgagtatggtcaattaggaactggtgatactcaaccaagatcacaggctattccagttcaagggctcgccggccttactctggttgatattgcagctggaggatggcattcaactgcattaacaaacgagggggaggtatatggctggggaagaggggagcatgggagacttggttttggagatgacaaaagcagtaaaatggttcctcaaagggttcagcttctagtcggagaggatatagtgcaggtctcatgtggaggcacccattctgttgctttaacaagtgatggccgcatgttctcttttgggcgaggtgaccatggccgtcttgggtatggaagaaagctgacaacaggtcatccatcggaagttcccatagatattcctcctcctgaacatctcggtgacaatgaagctgaaggccgttggtctgctaagtatgtcgcttgtggtggccgtcatacactggcaatagtcgagtgccagactcgtatatcggaacagtaggctatctttgtttaacttatattttactcgactgctgtacaagtagagttttgataaaaaacaatcac

SEQ ID NO: 1519 - DNA, 1338 bp, Cirsium arvense
ctgcaaatcgctacttccgtaaactctctttctaaactctttccaatggctgtcaacaataccgccgttatcgcctggggttcaggtgaagatggacaactaggacttggagacaatgaagagaaagaatgggtttcatctatcacatccctcaattccgtcaccgtccgttccgtcgtcgccggtagccgtaactctctcgccatttgtgatgatggcaagttgtttatgtggggttggaatcaaagaggaactctggggcaccaaccatcaactaaaactgagaacatcccgagtcaggttaaagctcttgacaacgtcaatatcgttcaggcagctattggtggttggcattgtctcgctgttgatgatcaaggacgtgcttatgcttggggtggaaatgagtatggacagtgcggagaagagcttgaaaagaaaggtgaatctggtcggactttaaggagagatattgttattcctcaaagatgcgcatcaaagctttcagttcgccaggtagctgctggaggtacacattcagtggtgctgacacgtgaaggacatgtatggacatggggtcaaccatggcctcctggagacataaaacaaatatcgacaccggtgagagtacaaggtcttgagagggttaagttgattgcagtgggggcttttcacaatttggctcttgttgaggatggaaatttatgggtttgggggaataacgaatatggacagcttggaacaggggatactcagccgagatcacaaccagttcctgttcaaggattatctggccttactttggttgatgttgctgctggtggttggcattctactgctttaacagatgaaggagaggtgtatgggtggggtcgaggagaacatggaagacttgggtttggagacgataagagcagtaaaatggtgcctcaacaggttcagcttctagccgatgaggatattgttcaggtctcatgtggtgggactcattctgttgcattaacacgcgatggtcgtatgttttcttttgggcgtggggatcatggaagattgggatatggtaggaaggtgacaaccggccatccgtcagaagttcccatcgaccttccgcctccggaagatgacgagagtgggaatgaactaggacgatggtgcgctaaatatgtggcttgtgggggtcgtcatacaattgccattgtagaatggcaaactacagaccccgatcccttaatctgaggggatttttaacgacgagaattcatcagaataaatttgaggaatggtttttatgtattaaaattaaactattgaagtatgattttgttaaaaaagagaaactta

SEQ ID NO: 1520 - DNA, 1547 bp, Brassica rapa
ataaaccacacaacaacgctttcattacacaacccctctctctctctatagaatcccactgctttgcttttcctcttccctctgtgctttcattcattcacctcctctctctatctctctcaaatggtttcagctacttcagtcatagcctggggctcaggagaagatgggcaactaggaattggtagcaacgaagagaaggaatgggcttgtgtcgttgaagctctcgagccttactctgttcgctctgtagtctccggtagccgtaactccctcgccatttgcgatgatggaacgatgtttacatggggctggaatcaaaaaggaacattaggacacccaccagagactaagactgaaaatatccctagtcgtgttaaggctcttgccaatgtcaagatcactcaggcagcaattggtggttggcattgtttggctgttgatgatcaaggccgagcctacgcgtggggtgggaatgaatatggacagtgcggtgaagagcctctaaaagacgagatgggtagacccgttcgtagagatatcgtcatccctaagcgctgtgcccctaaactcacggtccgacaggttgctgcaggtggtactcactcagtggttctgacacgtgatggtcacgtgtggacttggggtcaaccctggcctcccggtgacataaaacagatatttgttccggtgagagttcaaggacttgagaatgtgcgtcttatcgctgttggtgcgtttcataacctggcgcttgaagaagatgggaggctaatggcatggggtaataacgagtatggacaacttggaaccggtgatactcagccaacacctcatcctgttcctatccaaggccttgatggtctcactttggttgatattgctgcgggtggatggcactcaaccgctttaaccgataaaggagaggtgtatggatggggaagaggagaacatggaagactagggtttggtgacaatgacaagagcagcaaaatggttccacagaaagttaatcttctagctgatgaagttatcattcaggtttcttgcggtggaacacattcagttgctttgacaagagatggcagaatcttctcgtttggtagaggagatcatggaagacttggttatggaaggaaagtaacaacggggcagccattggagttgcctataaagattcctccacctgaaggaagcttgaatcatgctgatgaagaagaagggaaatggttagctacatcgattgcttgcggtggacgccacactcttgctatcgttgaatggaagtccgatgatatttgatcgttataatctctatggtcaacttacgaagagaggaaacaaatattgattcataggaagaaaggcaaaaggagagtatgtttctataaggagaaacacatgttttatcatttcatataactttttccctataaataatcttttagattaaattaaactttgatttccagggattttttttcaaatatataaatttgatcagccaatattttattagactctttaagtttttgcttatatagtgg

SEQ ID NO: 1521 - DNA, 1195 bp, Nicotiana benthamiana
cactctgatcactctttttattatatatatatttgtgtttttaggggctctggagaagatggtcaattgggtattggaaataatgaagagaaagaatgggtttgttctattaaagctcttaagtcctctgagaaagtttcttctattgttgctggcagtagaaactctcttgctatttgtgaagatggcaaactatttacatggggttggaatcaaagagggaccttggggcacccacctgagaccaaaacggagaacattcctagtcaggttaaagctctttccaatgtcaaaattgttcaggcggcgattggtggctggcattgtttggctgtggatgatcaaggcagggcttatgcttggggtggtaacgagtatggacaatgtggtgaagaaccggaaaggaaagatgacactggaaggcctattaagagagacatcatcatccctaagcgttgtgcctctaagctatctgttcgtcaggtagctgctggcggtacacactctgttgttcttacgaaggaaggacaagtttggacttggggtcaaccatggcctcctggtgacataaagcaaatttctactccggtacgtgtacaaggtcttgcaagtgtgaggttgattgcagtaggagcctttcataacctggcacttcttgatgatggagttctaatggcatggggtaataacgagtatgggcaacttggaactggcgatacccagccaaggtcacaacccattgctgttcaagggctatctggtctcactttggttgatattgctgctggaggatggcattctgcagctttgacagacgagggagaggtttatggctggggaagaggggaacatggtaggcttggatttggagatgacaaaagtagtaaaatggtgccgcagaaggttcaacttttagctggggagaacattgttcaggtatcatgtgggggcacacattctgttgcattaacacatgatggtcgtatgttttctttcggacggggagaccatggacgattaggatatggtagaaaggtgacaactggccacccatcagaagttccgataaatattccacctccaagtgatgtcagcagcactcaaggagagcgttggtgcgctaaactcgttgcttgtggtggccgccatactctggcgattgtagagtggcaggaagaatctgaatagtcgatat

SEQ ID NO: 1522 - DNA, 1578 bp, Chrysanthemum coronarium
cacactatcaatcatccatccctaaagacacaaacagtcccgctttccgtaaactgatattccattccatttccaatggccgtcaatactaactccgccgttatcgcctggggttcaggtgaagatggacaactaggattaggtgataacgaagagaaagaatgggtttccagtgtgacgtcacttcattccgtcactgttacttcactcgtcgctggtagccgtaactctcttgctattgccaatgacggaaagttgtttatgtggggatggaatcaaagaggaacattggggcatcaaccgtccactaaaactgaaaatgtacctagtcaggttaaagctcttgataatgtgaagattgttcaggcagctattggtggttggcattgcttggctgttgatgataaaggccgtgcttatgcttggggtggaaacgagtatggccagtgcggagaagagcttgagaagaaaggtgattctggtaggagagatattgtgattcctcaaagatgtgcatcaaagcttaccgttcgtcaggttgctgctggcggaacacattcggtggtgctgacacgtgaaggacatgtatggacatggggtcaaccatggccacctggtgacataaaacaaatttccacacccgtgagagtacaaggtctcgagaaagttaagttgattgctgttggggcattccacaatttggctcttcttgaggacggaaatctatgggtttggggcaataacgaatatggacagctaggaacgggggatactcagcccagatcgcaaccagttcccgttcaaggattatccggcctcaaattggttgatattgctgctgggggttggcattctacagctttaacagatgaaggagaggtatatgggtggggcagaggggaacatggaagacttggatttggagacgataagagcagtaaaatggtgcctcagcaagttcagcttctagccggagaggacattgtccaggtctcatgtggtggcactcactctgttgcactaacacgtgatggtcgtatgttttcttttgggcgtggtgatcatggccgattaggatatggtagaaaggtgactaccggccacccatcagaagtgcctattgacctcccgcccccaaaagacgccagtgatggtgaacccggacgttggtgtgctaaatatgtggcttgcgggggccgccatacactcgcgattgtggaatggcaagctacagagtcggatgggttgaactaatcaacggtgcaaatctttgatgattctcctatgtgatgataatggggagaattcattagagaaacaaaatcttgatggttagtattatctataatatccaagagttgtgtaagctgaagttttatatcactttgcctaaagttttgcgggttactatgtaaaacagggtggttaatccaatgagtgtaacatggctgttttaacaggatcgattcaggacaatctagtcctatagtaagattatttgaggcttaataatcatcttttcttgaacatataaatagcagtacatcacgaaactaaatctacccaggaaagtatgct

SEQ ID NO: 1523 - DNA, 3166 bp, Aristolochia fimbriata
atcaagctctattggcttctgtatattactgcaatttgtctcgatcagcttcgctcagataatgtaacttggaagtgggattttgtgcacgaaaaggcagtacaagagtcatagacaagtcacaagtgctcgagtgaccttttcttcccctatacacattacacacaccatacggcagtgtcatagaatatttgcccattttctttccagtagggcttttcaagaagcaggcacagcagagactaacaagctactagctgcagatgactaccgaagccactgaaacaatcgtcttagcatggggctccggcgaagatggtcagcttggccttggaaacaatgaagagaaagatttggtatgtagcatccaagcacttgatggagaaaaggttacctccgtcgtcgccggaagcaggaactctttggccatctgcgagaatgggaagctctttacctgggggtggaatcaacgcggcacgttgggacacccacctgaaactaagacagaaaatgtaccgagccaagttaaagctctcgacaacgtcaagattgttcaggcagcaataggcgggtggcactgtctggctgtagatgatcaaggccgtgcatatgcttggggtggaaatgaatacggtcaatgtggggaagagccagagcgaaaagatgataataccagggctttgagaagggatattgcaattcctcagagatgtgcaccaaaattatctgtacggcaggtggctgctggtggtacacattctgtggtgcttacaaatgatgggcatgtatggacgtggggccagccatggcctcctggggatataaaacaaatatctactcctgttcgagtgcaaggccttgagaaagtgaggtttattgccgttggtgcatttcataacctggcacttcgagaggatggaatgctatgggcttggggaaacaatgaatatggacaacttgggactggtgatactcaaccaagatcacaaccaattcctgtccaaggacttagtggtcttactttggttgatattgcagcaggagggtggcattcaactgcgctgatggatgatggagaggtgtatgcttggggaagaggtgagcatgggaggcttggatttggtgatgacaagagtagcaagatggtgccccaaagagtccagctccttgttagcgaggatatcgttcagttttcttgtggagggacacattctgttgcatgtactcgtggtggtcgaatgttctcatttggccgaggagaccatgggcggctgggttatggaaggaaagtgactactggtcacccgatggaagtgccaataaatatacctgcacgaagaaatctggaaaatgcaaatggtcactggtgtgctaaagtagttgcatgtggaggtcgacatactctagccattgctacatgggtcgagacccaggaatagcttgtatctagttagatttctttagtatctctgtatacaaaagagtttatttcacacgaacaggttgttaatctagatgaaacctatcactcaagcattattgttaaaattaccacaccatctgcataaataattgggcttgaaagttatggtgaaatagaatgaatggaggcctcaaacatgaattgattcttccgagcggatttccagcctatgattcatcacttctctggcacgggcacttctatgctgcagcctttgatggagagcctcggacatttgattgaaaaattcagcatcccatctgtgaatgagggaaggatcttctgcatagcagatgtatatagaagttacggcactttccaccactgtcatagccaaaccgaccaatatcattcctatcaacatagcagaaaagccaaccataatcactctgtcttttgccctgtgccatgtccaaacacctgtgcaagtcccagcaacaagccctcctaagatagttcccatcaggagaacggcacccgagcaatcataggcaattagtgcttcaattccagttgactggaatagctcccaggcgtctcttgcagaactgttgaagcctttgccataaaccgcaatctggacataggcatatttattgaaaaagcgcacaaggtattccacgaggtggaagaagaaatcaacacaacatagcaagcactcgttgttcccaatctttgaacggagccctctcagctcccaccgcatcgttcggatggcagctgtaaaaagtgaaccatagcagatactcccaaatgaagttgttagagcatgcctgaatgacttcaataatggccttgaaggcatggttgctgccgcccggccttcatgtatgagaacaagacataccatcccagatactatcacatgaactgtgttacagaggacagcaccagtccaaaataaactaacagatagtgccccaagaagccaccagcgtccaccatcaccaatactcgaggcaataacacctgctgctccaaaggaccatattgcaatccacagaagcatgagcagcataaatgcataagccactctgatgacctcaggaaggttccacaccatccttacagctttctgtagaactaacattgtgaaaggaaacctgtctataactgaaataacatacaaaaactgcagaagtgcagcaatggcaaatgcaattccccaaagaatttgtcgtccccagaaacaaagaacacttatgacggcaaggtatgtcatcaacccatggacagagaccttcatcatccgattcgcttgagaacccaacagggacaaccaagcccatccaagaactattccgataccagcagcaagaccataaagtggccaatatgtctctgttaatccactttggttctcaataaatctatatgtatacctgtcaatctttagcctatcaggttgtctaaatctattgagcccaagaactgtaagaactaaacctaatccaattagatgaatgatgaagatgcaaagccaaaatacatccctccaatgcctagaaggttctgagaccctaaccatggaaggagaactacttctctcattgctttggctgacatgaccgtcctgtaacagaaaacagtaactctggtaagacaatgaacttattcagaacaaaaaaaaaaaaaagaaaaacaactctagatctacaaacaaagacgcgagaaataaagaag

SEQ ID NO: 1524 - DNA, 1522 bp, Artemisia annua
gaaacaaacaaacagtgcaagtcccgctgctgcagcaataacaacttccgtaaactcattttccaatggccgtcaatactaacaccgccgttatcgcctggggttcaggtgaagacggacaactaggattaggtgacaacgaagagaaagaatgggtctccgccgtctcctcacttgattccgtcactgttagttctgtcgttgctggtagccgtaactctcttgccattgctgacgacggcaagttgtttatgtggggatggaatcaaagaggaactttggggcatccaccgtccactaagactgagaacgtacctagtcaggttaaagctctcgacaatgtcaagattgttcaggcagctataggtggttggcattgtttggctgttgatgatcaaggccgtgcttatgcttggggtggaaacgagtatggccagtgtggagaagagcttgacaagaaaggggattctggtaggactatgaggagggatattgtcattcctcaaagatgtgcatcaaagctttcagttcgccaggtagcagctggcggcacacattcagtggtgctgacacgcgaaggacatgtatggacatggggtcaaccatggccgcctggtgacataaaacaaatttccacacccgtaagagtacaaggtcttgagaaggttaagctgattgcagttggggctttccacaatttggctcttcttgaggatggaaatctatgggtttggggcaataacgaatatggacagctaggaacaggggatactcagccccgatcacaaccagtccctgttcaggggttatccgacctcaaattggttgatattgctgctggtggttggcattctactgctctaacagatgaaggagaggtatatgggtggggcagaggcgaacatggaagacttggatttggagacgacaagagcagtaaaatggtgcctcagcaagttcagcttctagctggggaggatattgtccaggtgtcatgtggcggcactcattctgttgccttgacacgtgatggtcgtatgttttctttcgggcgtggtgatcatggaagattaggatatggcagaaaggtgacaacgggtcacccatcagaagtgcctattgacctcccacccccgaaagatgctagtgatggtgaaccaggacgatggtgtgctaaatatgtggcttgtgggggccgtcatacactcgcgattgtggaatggcaagctacagaggcagatgggttgatctgattaaggttacaaatcttttgatgattctcccatgtgacaataacgggagaattctttagaaatgtatcttaatggctggtattatctaatatctaaggagttatataagctggaatattatgccactttgctaaaagttttgcgggtttctttgtaaaacaagtggttaatccaatcgagtgttaacatggttgcttattaacaagatctgttctggacaattttggtcctttagtgagattacttgaagcttaatagcgacatatttc

SEQ ID NO: 1525 - DNA, 2183 bp, Papaver somniferum
catcagacttcagttcacatggcttcggaaaaccccattgtcttatcctggggtgcaggagaagatggacggttaggtattggagagaatgaagagaaagaatgggtttgctctatcaaagctcttcaatctgagaaagtttcttcagttgttggtggaagtagaaactcacttgctatatgtgaagatggaaagttgttcacatgggggtggaatcaaagaggaaccttaggccacccaccagaaaccaaaactgaaaatactcctactcaggttaaagctcttgcaaatgtaaagattgttcaggcagcaattggtggatggcactgtttggctgttgacgatcaaggccgagcttatgcttggggtggaaacgagtatggtcaatgcggtgaagaacctgagaaaaaagatgatagtggtagggctttaagaagggatatcgtaattcctcaacgatgtgctccaaagcttaaagttcgccaggttgctgctggtggcactcactctgttgtgcttacacaagaaggccacgtgtggacatggggacagccatggcctcctggagatattaaacagatttcgactccagttagagtacaaggtcttgaaaaggtgaggcttattgcagttggcgcattccataatttggcactcctagaagaaggcgtgctatgggcttggggtaacaatgagtatggacaactggggactggcgatacacaaccaagatcgcaacctattcctgttcaagggctttccgatctcaccttggttgatattgcggctggtggatggcattctacggcattgacagctgaaggagaggtgtatggttggggaagaggagaacacgggaggcttgggttcggagatgacaagagcagtaaaatggtgcctcagagggttcagcttcttgtcggagagcacataatccaggtttcctgtggcggcacccactctgttgcattaactcgcgatggacgaatgttcactttcgggcgtggagaccatggacgtcttgggtacgggaggaaagtcaccacaggtcatcctatggaagtacccataaacctttcaaagtcaaaggatgtaccaagtggcagtgatgatgatgatactctaggccaaagatggtatgctaagtttgttgcttgtggtgggcgccatactctagcaatagctgtgctgcagcctgatgaagaactagcagaagaagaaacttaagaggtttctatagattctgatacttgtgttgaacccagattgatgggaatacaaactttataatgttagagatgtgcgaacttattaattacaactaaaaacaactttttaaactgtaatggagaaatagacatatttgccttgttaaaataaaagatgtattaattacattgctttctaaggcaatctaaacagggaccactgtttgttgtacatgaatgtcgaagcggttatctaatactacttctctatttcgcgcgctcctgtgttgtaagcgttgttgtaatgcttctgacagctggtcgaagaattctggatcccatctatggatcagagagggatcttcagcatagcagatgtatatagatgtaacagcactctctacaactgccattgccagtccaaccaagatgaaacccattaacatagcagtacaccctaccataaacactctatcactagttttatgccatgtccaaattcctgcacaggttccagtaattagcccacccaatatggttcccataaatagaactgcacctgagcagtcgtatgcaataagcgcttcaacaccagttgattgaaaaagctcccacgcatcccttgctgaagaattgaagtttttaccgtgaactgctatctggacgtatgcatacttgttgaaaaaccgaacaagtgtctctacaatatgaaacagaaaatcaacacagcaaagcaaacactcgttgttaccaatcttggatcgaattcccctgatctcccatcgcaatgtcctgatagcagccgtaaagagcgatccatagcagatgctgccaaatgaagttgtcacggcataccttagagatttcaccaatggtttgggaggcattgttgctgattctcggccaccatgtattagaacaagaaacaccattccagatactattacatgtaccgtattacataggacagcacca

SEQ ID NO: 1526 - DNA, 1293 bp, Solanum phureja
ctccactgtccactccactcaaccagtccacaatatacagattacagaagaagccaccatttttaccgattcttgaaaatcagactgaaagctctaaagtatccagacttagctctgcaagaaacagaaaactgaaagcagccagccacaagtatatatgacttccagaaacgccgtcatcgcttggggctctggagaagatggtcaattgggtattggaaacaatgaagagaaggagtgggcttgttcaattaaagctctaaaatctgaaaaagtttcttctgttgttgccggaagtagaaactctcttgccatttgtgaagatggcaaattatttacgtggggttggaatcaaagaggaaccttgggacacccacctgagacaaaaacagagaacattcctagtcaggttaaagctcttgccaatgtgaaaattgttcaggcggcaattggtggctggcattgtttggctgtagatgatcaaggcaaggcttatgcttggggtggtaatgagtacggacaatgtggggaagaaccagaaaggaaagatgacactggaacgcccgtaaagagagatattgtgatccctaagcgttgtgcctctaagctttctgttcgtcaggtagctgctggtggtacacactctgttgttcttacaagggaaggacaagtatggacatggggtcaaccatggcctcctggtgacataaagcaaatttctactcctgtccgtgtacaaggtcttgcaagtgtgaggttgattgcagtaggggcctttcataacttggctcttcttgatgatggagttctaatggcatggggtaataatgagtatgggcaacttggaactggggatacccagccaagatcacaacccattgccattcaagggctatctggtctcactttggttgatatcgctgctggaggatggcattctgcagctttgacaaatgagggagaggtttatggctggggaagaggggaacatggtagacttggatttggggatgacaagagtagtaaaatggtgccgcaaaaggttcaacttttagctggggagaacattgttcaggtttcatgtgggggaacacactctgttgcattaacgcatgatggtcgaatgttttcttttgggcggggagaccatggacgactaggatatggtagaaagtcgacaactggtcatccatcggaagttccaataaatattccgcctccaagtggtgatgtcagcagcacagaagaagagcgttggtgcgctaaacttgtcgcttgtggtggccgccatac

SEQ ID NO: 1527 - DNA, 1380 bp, Ambrosia trifida
ccaaaacactcctacagcaaaaatccctccattattagtaaacactttttctaaactctttccaatggctgtcaataataccgccgtcatcacctggggttcaggagaagacggacaactaggactaggagacaccgaagaaaaagaatgggtttcccccatcacttctctttcttccgtctccgttcgctccgtcgtcgccggtagccgtaactccctcgctgtttgcgatgacggcaagttgtttatgtggggttggaatcaaagaggaactttggggcaccagccaacgactaaaactgagaatataccgagtcaggttaaatctctcgacaatgtaaagattgttcaggcagcgattggtggttggcattgtttggctgttgatgatcaaggccgtgcttatgcttggggtggaaacgagtatgggcagtgtggtgaagagcctgagaagaaagatgattctggtaggactttaaggagagatatttcgactcctcaaagatgtgcatctaagctttcggttcgccaggtagctgctggcggcacccattcagtagtgctgacacgcaaggacatgtttggacgtggggtcaaccatggcctccgggggacataaaacaaatttcaacgcctgtgagagtacaaggtcttgagaaggttaagttaattgcagtcggggctttccacaatttggctcttcttgaggatggaagtctttgggtttggggcaataacgaatatggacagctaggaacaggggatacccagcccagatcacaaccggttcctgttcaaggattatccgacgtcaaattggttgatgttgctgccggtggttggcattctaccgctttaacagatgagggagaggtatatgggtggggtagaggggaacatggaagacttggatttggagatgacaaaagcagtaaaatggtacctcaacaagtacagcttcttgctggggaggatattatccaggtctcatgtggtggaactcattctgttgctttgacccgtgatggtcgtatgtttcttttggccgtggggaccatggaagattaggatatgggagaaaggtgactactggtcatccatcagaagtacctattgacctaccaccacctaaaaatgatgatggcagtggcctagggcggtggtgtgctaaatatgtggcttgtggtggccgccatacactcgccattgtagaatggcgagctacagagtcagatgggttgatctgatcaaggttttattagaacaatcttgatgatgtattatctaatatctatggagttatttaagataaaagtttcctatgactttgtttaaagttaagtggttgttgcaatgaaggtgtgacatgtgttcttgatc

SEQ ID NO: 1528 - DNA, 1616 bp, Arabidopsis lyrata
aaaacacatcgctattattattaccaccccccccccctcgaatcccactgctttgcttttgcgcttgtctctgtgcattcaccttctctctctctctcctctctctttctttctctctctctaatggtttcagctacttcaatcatagcctggggttctggagaagatgggcaactaggaattggtaccaacgaagaaaaggaatgggcttgcgtcgttgaagctctcgagccttactctgttcgctcagttgtctctggtagccggaactccctcgccatttgcgatgatggcacgatgtttacatggggttggaatcaaagaggtacattaggacacccaccagaaacaaaaacagagaacatccctagtcgagttaaagcccttgccaatgtcaagatcactcaggcagcaattggtggttggcattgtttagctgttgatgatcaaggccgagcatatgcgtggggtgggaatgaatatggacaatgtggtgaagagcctttaaaagacgagatgggtaggcccgtacggagagatattgtgatccctaagcgttgtgccccgaaacttacagttcgtcaggtagctgcaggtggtactcactcggtggttctgacacgcgaaggtcatgtgtggacttggggtcaaccgtggcctcccggagacataaaacaaatatttgttcctgtgagagttcaaggtcttgaaaatgtcagtattatcgctgttggagcatttcataatctggctcttgaagaagatgggagattattggcatggggtaataacgaatacggacaacttggaaccggtgacacccagccaacatctcatcctgttccagtccatggcctcgatgatctcactttggttgatattgctgcgggtggatggcactcaacggctttaactgataaaggagaggtgtatggttggggaagaggagaacacggaagactcgggtttggtgacaatgacaagagcagcaaaatggttccacagaaagttaatcttctagctgaagaagatataattcaggtttcttgtggtggaacacattcagttgctttgacaagagatggcagaatcttctcgtttggtagaggagatcatggtagacttggttatggaaggaaagtaaccacaggacagccattggagttacctataatgattcctccgcctgaaggaagctttaatcacgcagacgaagaagaagaaggaaaatggtcagctaaatggatcgcttgcggtggccgccacactcttgccattgtagaatggaagtccgatgatatttgatcctcaatctcactggtcactgaacaacttgagaagagaagagagcaatatgatttataccaaggaaggcaaagggagagtgtatttattaaaaagaaagagcaaaaacatacttgtttcaaattactttttccctataaataatctttagaaaaaaatagttttgatttcaagggaaaataaaattgcaaagaattttgatcaggggatgtagacttagtttcttgaaaaccttgaacaaaagtttgtgtttcacaatcttttaaatcaaaaaaaaaaaaaaaaattgtatcatgtgccaataaaaatta

SEQ ID NO: 1529 - DNA, 1247 bp, Cirsium arvense
tctttccaatggctgtcaacaataccaccgccgttatcgcctggggttcaggtgaagatggacaactaggcctaggagacaatgaagagaaagaatgggtttcctccgtcgcatctcttaattccgtcaccgtccgttcagtcgtcgccggtagtcgtaactctctcgccgtttgtgatgacggcaagttgtttatgtggggttggaatcaaagaggaactttgggtcaccaaccatcaactaaaaccgaaaacatccccagccaggttaaagctcttgacaacgtcaatattgttcaggcagccattggtggttggcattgtctggctgtagatgatcaagggcgtgcttatgcttggggtggaaatgagtacgggcagtgtggagaagagcttgagaagaaaggtgaatccggtaggactttgaggagagatatcgtgattcctcaaagatgcgcatcaaaactttcagttcgccaggtagctgccggaggcacacattcagtggttctcacacgcgaaggacatgtatggacatggggtcaaccatggcctcctggagacataaaacaaatctcgacgcccgtgagagtacaaggtcttgagaaggttaagttgattgcagtgggggctttccacaatttggctcttgttgaggatggaaatctaatggtttgggggaataacgagtacggacagctaggaacaggggatactcagcccagatcacaaccggttcctgttcaaggattatccggccttactttggttgatgtcgctgctggtggttggcattctaccgctttaacagatgaaggagaggtttatgggtggggcagaggagaacacggtaggcttggatttggagacgacaagagcagtaaaatggtgcctcaacaagttcagcttctagccgaggaggatattgttcaggtgtcatgtggtgggactcattctgttgcattgacacgcgatggtcgtatgttttcttttgggcgtggggatcatggaagattggggtacggtagaaaagtgacaaccgggcatccatcagaagtgcccatcgaccttccgcctccggaagatgccgagagtggcagtgaagtaggacgatggtgcgctaaatacgtggcttgtgggggtcgccatacgattgccattgtggaatggcaaactacagaccctaatctaatcccttgatctaatgggatttaatagaaataactacgagaattacatcacaataaa

SEQ ID NO: 1530 - DNA, 1305 bp, Eutrema halophilum
ccccctcgaatcccactgctttgcttttccgcttgtctctaagcattcattcaccttctctctcttctctctcttctctctctcccttgctcaaatggtttcagcaacttcaatcatagcctggggctctggagaagatgggcaactaggaattggtaccaacgaagaaagggaatgggcttgcgtcgttgaagctctcgagccttactctgttcgctccgttgtctccggtagccgtaactccctcgccatttgcgatgatggcacgatgtttacatggggttggaatcaaagaggtacattaggacacccaccagagaaaaagacagaaaatgtacctagtcgagtgaaggctcttgccagtgtcaagattactcaggcagcaattggtggctggcattgtttagctgttgatgatcaaggccgagcatatgcgtggggtgggaatgaatatggacaatgtggggaagagcctttgaaagacgagatgggtagacccgtgcgaagagatattgtgatccctaagcgttgtgcaccgaaacttacagtccgacaggtagctgcaggtggtactcactcagtggttctgactcgggaaggtcatgtgtggacttggggtcaaccgtggcctcccggtgacataaaacagatatctgttcctgtgagagtccaaggacttgagaatgtccgtctaatcgctgttggagcatttcataacctggctcttgaagaagatgggaggttattggcatggggtaataacgaatacggacaacttggaaccggtgatacacagccaagctctcatcctgttccagtccaaggcctcgatgatctcactttggttgatactgctgcgggtggatggcattcaacagctttaaccgataaaggagaggtgtatggttggggaagaggagaacacggaagactcgggttcggtgacaacgacaagagcagcaaaatggttccacagaaagttaaccttctaggtgaagaagatatcattcaggtttcttgcggcggaacacattcagttgctttgacaagagatggcagagtcttctcgtttggtagaggagatcacggaagacttggatatggaaggaaagtaacaacaggacagccattggagttaccgataaagattcctccgcctgaaggaagcttcaatcacgcagacgaagaagaagaaggaaattggtttgctaaatctattgcttgcggtggccgccacactcttgccattgtagaatggaaggctgatgatatttgatctctccgctctctcataaacaaaactta

SEQ ID NO: 1531 - DNA, 1301 bp, Chrysanthemum coronarium
cacactatcaatcatccatccctaaagacacaaacagtcccgctttccgtaaactgatattccattccatttccaatggccgtcaatactaattccgccgttatcgcctggggttcaggtgaagatggacaactaggattaggtgataacgaagagaaagaatgggcctccactgtcacctcacttcattccgtcaccgttggttcagtcgtcgctggtagccgtaactctcttgctattgccaatgacggaaagttgtttatgtggggatggaatcaaagaggaacattggggcatcaaccgtctactaagactgaaaatgtacctagtcaggttaaagctcttgataatgtcaagattgttcaggcagctattggtggttggcattgcttggctgttgatgataaaggccgtgcttatgcttggggtggaaacgagtatggccagtgcggagaagagcttgagaagaaaggtgattctggtaggagagatattgtgattcctcaaagatgtgcatcaaagcttaccgttcgtcaggttgctgctggcggaacacattcggtggtgctgacacgtgaaggacatgtatggacatggggtcaaccatggccacctggtgacataaaacaaatttccacacccgtgagagtacaaggtctcgagaaagttaagttgattgctgttggggcattccacaatttggctcttcttgaggacggaaatctatgggtttggggcaataacgaatatggacagctaggaacaggagatactcagcccagatcgcaaccagttcccgttcaaggattatccggcctcaaattggttgatattgctgctgggggttggcattctacagctttaacagatgaaggagaggtatatgggtggggcagaggggaacatggaagacttggatttggagacgataagagcagtaaaatggtgcctcagcaagtccagcttctagctggagaggacattgtccaggtctcatgtggtggcactcactctgttacactgacacgtaatggtcgtatgttctcttttgggcgtggtgatcatggccgattaggatatggtagaaaggtgactaccggccacccatcagaagtgcctattgacctcccgcccccaaaagacgtcagtgatggtgaacccggacattggtgtgccaaatatgtggcttgtgggggccgccatacactcgcgattgtggaatggcaagctacagagtctgatgggttgatctaattaagggtgcaaatctttgatgatctcctgtgtgatgataatgggga

SEQ ID NO: 1532 - DNA, 1386 bp, Lactuca sativa
ccggcttcaaaatcgctacttccgtaagccgtaaactctctttctaaacactttccaatgcctgtcgacaccaccgccgttatcgcctggggctcaggagaagatgggcaactaggacttggagacaacgaagaaaaagaatgggtttcctccgtcacctcccttaattccgccaccgtccgttccgtcgtcgctggcagccgtaactctctcgctatttgcgatgacggaaagttgtttacgtggggctggaatcaaagaggaactttagggcatcagccatcaactaaaaccgaaaacatccccagtcaagttaaagctcttgacaatgtcaaaatcattcaggcagccattggtgggtggcattgcttggctgttgatgatgaaggccgtgcttatgcttggggtggaaatgaatatggacaatgtggagaagagctagagaagaaaggtgaatcgggtagaactctgagaagagatattgtaatccctcaaagatgtgcatcaaagctttcagttcgccaggtggctgctggtggcacacattctgtagttcttacaaacgaaggacacgtatggacatggggtcaaccatggcctccaggcgacataaaacaaatttcaacacctgttagagtacagggtttggaaaaagtcaaactgattgcagttggggcttttcataatttagctcttctagaagatggaaatttatgggtttgggggaacaacgaatatggacaattaggaacaggggacactcagccacgatcacaacctgttcctgttcaaggattatcgggactcaaattgattgatgttgctgccggtggttggcattctacagctttaacagatgaaggagaggtatacgggtggggaagaggggaacatggaaggcttggatttggagatgataaaagtagtaaaatggtgcctcaacaagttcagcttttagctggggaagatattatccaggtgtcatgtggtgggacccattcggttgcgttgacacgcgatgggcgaatgttttcttttggacgtggggatcatggaagattggggtatggtagaaaggtgacaactggacatccgtgtgaagtgccaattgatttaaagtcaccaaaagatggtgaattggggcgttggtgtgctacatatgtggcgtgtgggggccgccatacgcttgcgattgtgaaatggaaggatgtggaggttaatgagatgatttgaaggatgtttttttttgatgattctcttgtgtgagtgatgagagatcatttgtgtttttgatgtattactgaatttttatatatatatggagtttattaaagttggaatgtttggattttggacatggtataatctattataaagaaatactat

SEQ ID NO: 1533 - DNA, 1516 bp, Chrysanthemum coronarium
gtatcaatcatccctaaacaaacaaacagtcccgctgctgctgcaataataacttccgtaaactcattttccaatggccgtcaatactaacactgccgttatcgcctggggttcaggtgaagacggacaactaggattaggtgacaacgaagagaaagaatgggtttccaccgtcacgtcacttgattccgtcactgttacttctgtcgttgctggtagccgtaactctcttgccattgctcacgacggcaagttgtttatgtgggggtggaatcaaagaggaactttggggcatcaaccgtcgactaagactgagaacgtacctagtcaggttaaagctcttgacaatgtcaagattgttcaggcagctattggtggttggcattgtttggctgttgatgatcaaggccgtgcttatgcttggggtggaaacgagtatggccagtgtggagaagagcttgacaagaaaggggattctggtaggactatgaggagggatattgtgattcctcaaagatgtgcatcaaagctttcggttcgccaggtagcggctggcggcacacattcagtggtgctgacacgcgaaggacatgtatggacatggggtcaaccatggccgcctggtgacataaaacaaatttccacacccgtaagagtacaaggtcttgagaaggttaagctaattgcagttggggctttccacaatttggctcttcttgaggacggaaatctatgggtttggggcaataacgaatatggacagctaggaacaggggatactcagcccagatcacaaccagtccctgttcaggggttatccgacctcaaattggttgatattgctgctggtggttggcattctaccgctctaacagatgaaggagaggtatatgggtggggcagaggcgaacatgggagacttggatttggagacgacaagagcagtaaaatggtgcctcagcaagttcagcttctagctggggaggatattgtccaggtgtcatgtggcggcactcattctgttgccttgacgcgtgatggtcgtatgttttctttcgggcgtggtgatcatggaagattaggatatggcagaaaggtgacaacgggtcacccgtcagaagtgcctattgacctcccacccccgaaagatgctagtgatggtgaaccaggacgatggtgtgctaaatatgtggcttgtgggggccgccatacacttgcgattgtggaatggcaagctacagaggcagatgggctgatctgattaaggttacaaatcttttgatgattctcccatgtgacaataacgggagaattcttaagaaatatatcttaatggcggtatcatctaatatctaaggagttatataagctggaatattatgccactttgctaaaagttttgcgggtttctttgtaaaacaagtggttaatccaatcgagtgtaacatggttgcttattaacaggatctgttctggacaattttggtcctttagtgagattagttgaagcttaata

SEQ ID NO: 1534 - DNA, 1516 bp, Fagopyrum esculentum
agtgttgctgtctggtcgccgctttcttctctcattcatgcctccttcacccgccatcactgccgtcatctcttggggctctggagaagatgggcaactagggcttgggaacaacgaagagaaggaattagtttgtgaagttgagtccctcaaaccctactccgtctcctccgtcgtcgccggcagtcgcaattctctcgccatatgtcaagacggaaaattgtttacttggggatggaaccagagaggaactttagggcacccatctgagaccaagaccgagaatgttcctagtcaggttaaagcacttgatggtgtcaaaatcattcaggctgccattggtgggtggcattgtttggctgttgataatcaaggtcgtgcttatgcctggggtggaaatgagtatgggcagtgtggtgaagaacttgagcgcaaagacgacagtggtagaacttctctgaaaagggatatcgtcatacctcagcgttgtgcacctaaactttccgttcaccaggtagctgcagggggtacgcactcagcagtcctgacaaaagaagggcatgtttggacttggggtcaaccttggcctcctggagacataaagcagatcaatgttccagtaagagtccaaggacttgaaaaggtgcgactcattgcagttggggcgtttcataatctagctcttggagaagatggaactttgtgggcatggggtaacaatgaatatggacaactgggaacaggagatactcaaccaagatcacatcccattcccgtactaggactatctggtctcaccttggttgatattgctgctggtggttggcactccatggcattgacaaaggagggagaggtttatggctggggtagaggagaacatggaagactgggatttggagatgacaagagcagtaagatggtaccacagaaagtgcaacttcttgcaggcgaggacataattcaggtatcctgtggaggcactcactcagttgcactaactcgtgatggacgaatattctcctttggacgtggggaccatggccgtctcggttatggaagaagagtgacaaccggacaccctatggaagtgccgataagtctccctcctaagcaagatgaagtggatggagaggaaggacattggcgtgccaagttcattgcgtgtggtggccggcacacactggcaatcgctcaatggcaaccgggtgaacgtgagtaggttgtgtgccccagtcgaaccagtcactcttttgaagtcaatgtatacttccatatctatataaaaacgaacaataatatgtcatatgttctgctaagacttattttgagtgtaacctaacgtttatttgcctggaaaatcagaacatttgaaagaagttgacagggttgttttgtacaaggaatcggatgggtaaattccgtgtcttaacagttatttagtgcataattgtgcattttcatagggtttcatttgtagttgtattattgtgtccttgcttaatggatgaacgat

SEQ ID NO: 1535 - DNA, 1419 bp, Centaurea maculosa
cgaatcgtaaactctctttctaaactctttctttccaatggctgtcaacaacaataccaccgccgttatcgcctggggttcaggtgaagatggacaactaggcctaggagacaatgaagagaaagaatgggtttcctccgtcacatctcttaattccgtcaccgtccgttcagtcgtcgccggcagccgtaactctctcgccgtttgtgatgacggcaagttgtttatgtggggttggaatcaaagaggaactttgggtcaccaaccatcaactaaaaccgaaaacatccccagccaggttaaagctctcgacaacgtcaaaattgttcaggcagccattggtggttggcattgtctggctgttgatgatcaaggacgtgcttatgcttggggtggaaatgagtacgggcagtgtggagaagagcttgagaagaaaggtgaatctggtaggactttgaggagagatattgtgattcctcaaagatgcgcatcaaagctttcagttcgccaggtagctgccggaggtacacactcggtggtgctcacacgtgaaggacatgtatggacatggggtcaaccatggcctcccggagacataaaacaaatctcgactcctgtgagagtacaaggtcttgagagggtcaagttgattgcagtgggggctttccacaatttggctcttgttgaggatggtaatctaatggtttggggaaataacgaatacggacagctaggaacaggggatactcagcccagatcacaaccggttcctgttcaaggattatccggccttactttggttgatgtcgctgctggtggttggcattctaccgctttaacagatgaaggagaggtttatgggtgggggagaggagaacacggtaggcttggatttggagacgacaagagcagtaaaatggtgcctcaacaagttcagcttctagccgaggaggatattgttcaggtctcatgtggtgggactcattctgttgcattgacacgtgatggtcgtatgttttcttttgggcgtggggatcatggaagattggggtacggtagaaaagtgacaaccggccatccatcagaagttcccatcgaccttccgcctccggaagatgccgagagtggcagtgaagtaggacgatggtgtgctaaatacgtggcttgtgggggtcgtcatacgattgccattgtagaatggcagactacagaccctaatctaatcccttgatctgatgggatttaatagaaataactacgagaattcgtcacaataaaattttgatcaatggttttatgtatgaagttatttaagtattattttcttattataagtggttgctgcaattaacatgattatttgacaagtatcttgtcgaattagaacatggatgcaggatggtccagactttgagaata

SEQ ID NO: 1536 - DNA, 1381 bp, Fagopyrum esculentum
ggttgctgtctggtcgccgctttcttctctcatccatgcctccttcacctgccatcactgccgtcatctcttgggggctctggagaagatggggcaactaggggcttggaaacacgaagagaaggaattaatttgtgaagttgggtccctcaaaccctactccgtctcctccgtcgtcgccggcagtcgcaattctctcgccatatgtcaagacggaaaattgtttacatggggatggaatcagagaggaactttagggcatccgtctgagaccaagactgagaatgttcctagccaggttaaagcacttgatggtgtcaaaatcattcaggctgccattggtgggtggcattgtttggctgttgataatcaaggtcgtgcttatgcctggggtggaaatgagtatgggcagtgtggtgaagaacttgaacgcaaagatgacagtggtagaccttctccgaaaagggatatcgtcatacctcagcgctgtgcacctaaactttctgttcaccaggtagctgcagggggtacgcactcagcggtcctgacaaaagaagggcatgtttggacttggggtcaaccttggcctcccggagacataaagcagatcaatgttccagtaagagtccaaggacttgaaaaggtgcgactcattgcagttggggcgtttcataatctagctcttggagaagatggaactttgtgggcatggggtaacaatgaatatggacaactgggaacaggagatacacaaccaagatcacatcccattcccgtactaggactatctggtctcaccttggttgatattgctgctggtggttggcactccatggctttgacaaaggagggagaggtttatggctggggtagaggagaacatggaagactgggatttggagatgacaagagcagtaagatggtaccacagaaagtgcagcttcttgcaggcgaggacataattcaggtatcctgtggaggcactcactcagttgcactaactcgtgatggacgaatattttcctttggacgcggtgaccatggccgtctcggttatggaagaagagtgacaactggacaccctatggaagtgccgataaatctccctcctaagcaacatgaattggacgaagaaggacattggcgtgccaagttcattgcatgtggtggccggcacacactagcaatcgctcaatggcaaccgggtgaacgcgagtaggtagcgtacccccgtcaaacctgtcactcttttgaagtcaatgtatacttccataactatataaaacgaacaataatatttatcatatgttcagctaagacttattttgagtgtaacctaacgtttcttcgcctggaaaataagaacatttgaaaagaagcg

SEQ ID NO: 1537 - DNA, 1410 bp, Musa acuminata
gtcccacttctctcgctccatctctatttcttgacacctaaagaaagccattaatcgatacctcgccatggccgccgccgaatccgcccaccccgtcgtcctcgcatggggatcaggcgaggatgggcaactggggatgggcaactgggaagagaaggactgggcctacagcatcaagtccctcgagcccaagaacgtcgtcgccgtcgttgccggcagcaggaactccctcgccatctgcggcaacggacaattgtatacatggggatggaaccagaggggaaccctgggtcatccgccggagaccaagacggagagcgtcccgagcctagttgatgccctcgccggcgtcaagatcgttcaggcagcaattgggggctggcattgcctggctgttgatgatcagggccgagcttatgcttggggtgggaatgaatatgggcagtgtggggaggagcccgagagaaaagaagatggcagtagggctctgaggagggacattgccattccccaaagatgtgcacctaagctctccgtccgccaggtagctgctggagggacacactccgtggtactgacgcaagatggtcatgtctggacttggggccaaccatggcctcctggagatattacgcaaatctcaactcctgtacgtgtgcaaggccttgagcgagtaaggttgattgctgttggtgcatttcataatttggcacttctagaggatggaaccttatgggcgtggggcaacaacgaatatggtcaactaggaactggtgatactcagccaagatcacaacctatccctgttcagggtttatctggtcttactttggttgacattgctgctggaggttggcattcaactgcactaaccaatgttggagaggtatatgcttggggaagaggggagcatgggaggcttggatttggagatgacaagagtagtaaaatggttcctcagaaggtccaactcctagtcggggaagatattgttcagatatcttgtggaggcactcattcagtggcatgtactcgtgatgggcgaatgttctcttttggaaggggcgaccatggacgcctaggctatgggaggaaggtcacaaccggccacccaatggaagtgcccatcaaactgctaccaccaagagacagcggcagcaccgacgggcagtggtgcgccaagcttgttgcctgcggtggacgccacactttggcgatggcatcatgggttgaggaacctggagattctatctaaagctgagacaaagagaagctcatgcaagcaaaattatggccacttgcattgaatccaatcgtaacttttgtgaaccggacaatatttagttagtatctgatgaaaaaaaaaagccatctgctatgaataaatcagaatgaagaattcaatacaac

SEQ ID NO: 1538 - DNA, 1546 bp, Chrysanthemum coronarium
cacactatcaatcatccatccctaaagacacaaacagtcccgctttccgtaaactgatattccattccatttccaatggccgtcaatactaactccgccgttatcgcctggggttcaggtgaagatggacaactaggattaggtgataacgaagagaaagaatgggtttccagtgtgacgtcacttcattccgtcactgttacttcactcgtcgctggtagccgtaactctcttgctattgccaatgacggaaagttgtttatgtggggatggaatcaaagaggaacattggggcatcaaccgtccactaaaactgaaaatgtacctagtcaggttaaagctcttgataatgtgaagattgttcaggcagctattggtggttggcattgcttggctgttgatgataaaggccgtgcttatgcttggggtggaaacgagtatggccagtgcggagaagagcttgagaagaaaggtgattctggtaggagagatattgtgattcctcaaagatgtgcatcaaagcttaccgttcgtcaggttgctgctggcggaacacattcggtggtgctgacacgtgaaggacatgtatggacatggggtcaaccatggccacctggtaacataaaacaaatttccacacccgtgagagtacaaggtctcgagaaagttaagttgattgctgttggggcattccacaatttggctcttcttgaggacggaaatctatgggtttggggcaataacgaatatggacagctaggaacaggagatactcagcccagatcgcaaccagttcccgttcaaggattatccggcctcaaattggttgatattgctgctgggggttggcattctacagctttaacagatgaaggagaggtatatgggtggggcagaggggaacatggaagacttggatttggagacgataagagcagtaaaatggtgcctcagcaagttcagcttctagccggagaggacattgtccaggtctcatgtggtggcactcactctgttacactgacacgtaatggtcgtatgttctcttttgggcgtggtgatcatggccgattaggatatggtagaaaggtgactaccggccacccatcagaagtgcctattgacctcccgcccccaaaagacgccagtgatggtgaacccggacgttggtgtgctaaatatgtggcttgcgggggccgccatacactcgcgattgtggaatggcaagttacagagtccgatgggttaatctaaatgagggtgcaaatctttgatgattctcctatgtgatgataatggggatagagaaacaaaatcttgatggttagtattatctataatatctaaggagttatgtaatacactttgcttaaagttttgcgggttgctatgtaaaacagggtggttaatccaatgagtgtaacatggctgttttaacaggatcgattcaggacaatctagtcctatagtaagattatttgaggcttaataatcatcttttcttgaacatataaatagcagtacatcacgaaactaaatctaccca

SEQ ID NO: 1539 - DNA, 1545 bp, Eutrema parvulum
cccctctccgaatcaatcacacactgctttgcttttccgcttgtctctgtgcattcattcattcaccttctctctctctcttctctctctctcccaaatggtttcagctacttcaatcatagcctggggctctggagaagatgggcaactaggaattggtaccaacgaagaaaaggaatgggcttgtgtcgttgaagctctcgagccttactctgttcgctccgttgtctccggtagccgtaactccctcgccatttgcgatgatggcacgatgtttacatggggttggaatcaaagaggtacattaggacacccaccacagacaaagacagagaatgtccctagtcgagttaaggctctttccaatgtcaagatcactcaggcagcaattggtggttggcattgtttagctgttgatgatcaaggccgcgcatatgcgtggggtgggaatgagtatggacaatgtggcgaagagcctttaaaagacgagatgggtagacccgtacgaagagatattgtgatacccaaacgttgtgccccgaaacttacagtccgacaggttgctgcaggtggtactcactcggtcgttcttacacgcgaaggtcatgtgtggacttggggtcaaccatggcctcccggtgacataaaacagatttttgttcctgtaagagttcaaggtcttgaaaacgtccgtcttatcgctgttggagcatttcataatctggctcttgaagaagatgggagactattggcatggggtaataacgagtacggacaacttggaaccggtgatacccagccaaccccctatcctgttccagtccaaggcctcgatgatctcactttggttgatattgctgcgggtggatggcattcaaccgctttaaccgataaaggagaggtttatggttggggaagaggagaacacggaagactcgggcttggtgacaatgacaagagcagcaaaatggttccacagaaagttaatcttctagctgaagaagatatcattcaggtttcttgcggcggaacacattcagttgctttgacaagagatggcagaatcttctcgtttggtagaggagatcatggaagacttggttatggaaggaaagtaacaacaggacagccattggagttgcctataaagattcctccacctgaaggaagctttaatcacgcagacgaagaagaagaaggaaagtggttagctaaatcgattgcttgcggtggccgccacactcttgccagagtagaatggaagtccgatgatgtttgatccttaaatctctccggtcacagaacaaacttacgaagagaagaaagcaaattatgattcataggaagaaaggcaaaaggtaaggggacaaaacatgtttcttgtttcatgttacgttttccctacaaataatctttagatttaaattattattttttcaggaaatgttttacaatatatcgaaaagaatcggtcttgtaaggaaaaatataatataacgttgtagaaaagggttttgattacttgtatcgtaagcaaagaaaaaa

SEQ ID NO: 1540 - DNA, 1792 bp, Elaeis guineensis
acagggcatttgagagttgacgacgataaacgcgtcgtcatctttatacgtttcgattcggaccacccccacttcagcttcgccgcttctctttccttctcttctcaaacacctccccacccaaaaccttctaccgaaaaactcatcgaggttcgccatggccgccaccccatcctcccactccgtcgtccttgcatggggctcaggggaagacgggcaacttggaatgggcgactgggaagagaaggactgggtctgctccgtcaaatccctcgagtccgagaacgtaaccgccgtcgtcgccggcagccggaactccctcgccatctgcgacagcggacatctgtttacctggggatggaaccagaggggaaccctgggccatgcgccggaaaccaaaaccgagagcgttcccagcctcgttgagtccctcgccaaggccaatgtcaagatcattcaggcggctatcggtgggtggcattgcctggctgtagatgaccagagccgagcttatgcatggggtgggaatgaatatgggcagtgcggggaggagccggagaggaaagaagatggaacaagggctctgaggagggacatcacgaccccacaacgctgtgctccaaagctttctgttcggcaggtagctgctggagggacacattctgtggtgctgacacaagatggtcatgtgtggacttggggccaaccatggcctcctggagatattaaacaaatatggactcctgtacgagtacaaggcctggaaagggtgcggctgattgctgttggtgcatttcataacttggcacttctagacgatggaatgttatgggcatggggtaataatgaatatggccagctaggaactggggatacacaaccaagatcacaacctattcctgttcaaggactatctggtctcactctggtcgatattgctgcaggaggttggcattcaactgcattgacagataatggagaggtatatgcttggggaagaggggagcatgggaggctcggatttggagatgacaaaagcagcaaaatggtgccccagaaggttcagctcctagttggggaagatattgttcaggtatcctgtggaggcactcattcagtcgcatgcactcgtgatggacgaatgttttcgtatggaagaggagaccatgggcgtcttggctatggaaggaaagtgacaactggtcacccaatggaagtgcctatagacttgccaccaccaaagaattgtctcagcactagtgggcgatggtgtgctaagtatgttgcctgtggcggacgtcatactttagcaattgctacatggattgatgagcctgaacagtcactatcgagctaaagtctactggttaactgatgttcggtccacgccctgaaatattctgtatcagaatactcctaatttgagaacctaaattgttagttctcttatggagaaaaataagtgttttatataaatgagtaaggatgagaggttatctgtttcaataccacattttacttcggagaggggtgtgtgtcaggtaacggatcaagcctgttgtttataacttctgtggctcatgtgtggtgcttctgacatttggtggaagaattcaggatatctctgcgcatgtgtgttgatgtgtgccctttcaatgactaccccagctagccccacctgaaaagcagaaaactattacatatttacctcaacatagaacagaggtctagcataaaaacctgactttgcttaaattctatgaaaagtggacttgtttgctctctaacaaaa

SEQ ID NO: 1541 - DNA, 2666 bp, Ananas comosus
cccgagcaagcaatggagtagggagatatattgttttattctttatatataaagtacaaagttgcttcctttttccgcgtgtttgtttccttgtctcacggagttcgcccatggccgctacccaaccctccccctcctccctcgtcctcgcttggggctcgggagaagatgggcaactggggatgggggattgggaggagaaggattgggttcgccccatcaaaaccctagagccctacaacgtcaccgccgtcgtcgcggggagccgcaactccctcgccatctgcgacaacggacatctcttcacatgggggtggaaccagagaggaaccctcgggcaccccccggagagcaaggccgagtgcgtccccagcctcgtcagatccctcgccgactccagcgtcaagatcgttcaggcagcgattggcgggtggcattgcctcgctgtagacgacaatgggcgagcttatgcgtggggtggtaatgagtatggtcagtgcggagaggaacctgagaggaaagaagacgggagcaaggctcttaggagggatattccgatcccccaacgatgtgcgccgaggctttctgttcggcaggtggctgctggagggacacactccgtggtgctgactcaagatggtcatgtgtggacatggggccaaccgtggcctcctggggacattaaacaaatatgggcgcctgtgcgagttcaaggccttgaaagagtgaggctgattgctgttggtgcctttcacaatttggcgctgttagaggatggaactttatgggcgtggggtaacaatgaatatggacagctaggcactggcgacactcaaccaaggtcgcagcctattcctgttcaagggttgtctggtcttaccttggttgatattgctgcgggaggttggcattcaactgcattgacagatgaaggagaggtatatgcttggggaagaggagagcacgggaggctcggattcggagatgataagagtagtaaaatggttcctcagaaggttcaactcttagttggagaagacatagttcaggtatcctgtggaggcactcattccgtcgcatgcacacgtgatggacgaatgttttctttcgggagaggagatcacggccgacttggatacggtaaaagggtaaccaccggacaccctatggaagtgcctataaacctgcctcctccgaaagaccgcagcggctcccacggacggtggtgcacgaagctcgtcgcgtgcggcgggcggcacaccttagcaattgccacctggaaagatgaaccagatcaatcaattccaacctaaacctagatgctagctggctaatgacagtattgttggattaaatagttggttgttagtattattatttatattatttaaaataaaggacttaaacagagtctgtcatgtggaaggaacagatcccttgtatgattggatgaggataagcaatttattacaaaggtttcatttatgctgtttgttcccaagccatttgaaaatccctgttaacatagcatgttattttaactgaattgttgtggtttatatggcttattattactataaatggaaatgtattttacttgcattactgagaacatgcttgatctctaatcctaatcggatctgaatgcttagcccgagtcgtgcctgggcctgcatccgacatagatggattccgggcccggcccattagcaatttcctatcacactgctctgcgaccaaccaaatcctcagagggagactcaagcgcggattacaaagataggaagccaaccaatcagaaccaatcattgcgccacgtgtaacacaggacttaaagggagtggacacaaacaaggagagaaagattgtgctaacgagagcagtgagccaagtgaaaattcgactgccaggagaagcaagagaggcgagcgaccgccgacagcgcaggggggaggataagatacaatggtggtggcgacggcgtactcgacggcggttctcggtggcgcttggctcccttcgcccggctccgtcgctcctcgctcccttctccttccccctctaccgaggcgctctgtctccgccgctccttcctcttcctccaccctttccctcgtcttggccccttgcttccgagaaacacagaggttctctttgctccaagttagagccacctcttcgtcggaggagacaccgagttccattcaaacggatgagctcctcgccgacttaaaggagaagtgggattctattgagaacaaatccaccgtctttttatacggtggcggcgcgatagtcgcagtttggctctcttctgtcgtcgtcggagccattaactctgttccattgcttcccaagatcatggaactagtggggcttggatacactggatggttcgtgtaccgctacctcctcttcaagcaaagcagaaaagaattggcggaagatatcgaagcgttgaagaaaaagatcactggaacaggcgaataatcgcgctttcgcatgaaaaattttctgcaagagatttttcccgaacacttgtataagaggaacttcatttatgtactattacttatgcattctatttctcgcaccaagaagttctttcccctcctagtgactacatcaactgatatgttatcagtaaacttcttctggatatggtg

SEQ ID NO: 1542 - DNA, 1272 bp, Brassica napus
atgggcagctaggacttggaacttacgaagaaaaggaatgggcttgcgtcgttgaggctcttgacccttttgccgttcgctccgtcgtcggaggtagccgcaactccctcgccatttgcgatgatggcaagctgtttacatggggttggaatcaaagggggacattaggacacccaccagagaagaaaacagaaagcgtacctagtcttgttaagtctctcgccaatgtcaagattacacaggcagctattggtggttggcattgtttagctgttgatgatcaaggccgagcttatgcctggggtggaaacgaatatgggcagtgtggtgaagagccttccaaggatgattcaggtaggcctgtgcgtagagatattgtaatccctaagcgttgtgcccctaaacttacagtccgtcaggtagctgcaggaggtactcactctgtggttctaacccgtgaaggttctgtctggacctggggtcagccttggcctcccggtgacataaaacagatatctgtgcctgtaagagttcagggtcttgaaaacgttcgtctgattgctgttggagcatttcataacttggctctcaaagaagatggaactttgtgggcttggggtaataatgaatatggacaacttggaaccggagatacccaaccgagatctcatcctattccggttcaaggcctcgatgatctcactttggttgatatagctgctggaggatggcattcaacagctttaaccgaagaaggagaggtatatgcttgggggagaggggaacatggtaggcttgggtttggtgacaatgacaagagcagcaaaatggttccacagaaagttaatctcttagctggagaagacatcattcaggtctcatgtggcggaactcattcagttgctttgacaagagacggcaggatcttctcgtttggtcgaggagaccacggtagactcgggtatggaagaaaagtgacgacgggacagccattggagcttcctatagacattccaccacctgaaggacagtttaaccacgctgatgaagaagaggatggaaagtggatagctaagtttgtggcatgtggtggtcgacacactctagctattatggaatggaaggctgatcaggaggaggaaacagaataatcatgaagtaagagaaagcacaacagagatgggactctagagacgagcattatgttatagagagaaaagggatagcaaaagaactgttaagcttttgacatttcccatgaatgatgaatat

SEQ ID NO: 1543 - DNA, 1860 bp, Cocos nucifera
cacgactcatatggatgcatcggtctcgtccggagacttcggaaaacgtctggcccatctcgacccgacacatccccacggaaaacgaaagagagtatttgagggttgacgccggtaattacgccgtcatttctttatgcgcttcgagttggacaacttgcacttccacttcgccgcttcgctttccttctctcctgaaacacctccccacccaaaaccttcgacccaaaatcttatcgagcttcgccatggccgccgccccatcctcgcactccgtcgtccttgcatggggctcaggggaagacgggcaacttggaatgggcgactgggaagagaaggactgtgtctgctccgtcaaatccctcgagtccgagaacgtaaccgccgtcgtcgccggcagccggaactccctcgccatctgcgacaacggacatctgttcacctggggatggaaccagagaggaaccctgggccatgccccggaaaccaaaaccgagagcgttcccagcctcgtcaagtccctcgccgaggccaaggtcaagatcgttcaggcggctatcggtgggtggcattgcctggctgtagatgatcagggccgagcctatgcatggggtgggaatgaatatgggcagtgcggggaggagccggagaggaaagaagatggaacaagggctatgaggagggacatcacgaccccacgatgctgtgctccaaagctttctgttcggcaggtagctgctggagggacacactctgtggtgctgacacaggatggtcatgtgtggacatggggccaaccatggcctcctggagatattaaacaaatatggactcctgtacgagtacaaggcctggaaagggtgaggctgattgctgtcggtgcatttcataacttggcacttctagaggatgggacgttatgggcatggggtaataatgaatatggccagctaggaactggggatacacaaccaagatcacaacctattcctgttcaaggactctctggtctcactctggtcgatattgctgcaggaggttggcattcaactgcattgacagataatggagaggtatatgcttggggaagaggggagcatgggaggcttggatttggagatgacaaaagcagcaaaatggtgccccagaaggttcagctcctagctgggcaagatattgttcaggtatcctgtggaggcactcattcagttgcatgcacacgtgatggacgaatgttttcgtatggaagaggagaccatgggcgtctcggttatggtaggaaagtgacaaccggtcacccaatggaagtgcctatagacttgccaccaccaaagaattgtctcagcactagtgggctatggtgtgctaagtttgttgcctgtggcggacgtcatactttagcaattgccgcatggatggatgagcctgaacaggcaccaccgagctaaagactactcagtccacgctctgaactactgtgtgtcggaatactcctaatttgaggacctaaattgctagttctattgtggagaaaagtatatgttttatataaatgaattaggatgagagtatctctgtttcaatacaacatttttctttggagagggggtgtgtcaggtaactaatcaagcctgttgtttataactcttctggctcatgtgcggtgctcccgacatttggcggaagaattcagcatatcatctttgaaataatgaagggctcttctgcacacacgtgttgatgtgtgcgctttcaatgactaccacagctacatattttccttcaacatagaaccgaggtcttgcataaaaacctgaccttgcttaaattctatttgaagtggacttgtttgctctctgt

SEQ ID NO: 1544 - DNA, 1344 bp, Cichorium intybus
ttcaggagaagacggacaactaggactaggagacaacgaagagaaagaatgggtttcctccgtcacatcccttaattccgtcaccgtccgctccgtcgtcgccggcagccgtaactctctcgctatttgcgatgacggcaagttgtttatgtggggctggaatcaaagaggaacattggggcaccaaccatcaactaaaaccgaaaacatcccaagtcaggttaaagctcttgacaatgtcaaagttgttcaggcagctattggcggttggcattgcttggctgttgatgatcaaggccgtgcttatgcttggggtggaaatgagtatggccaatgtggagaagaacttgagaagaaaggtgaatccggtcggacattaaggagagatattgtaatccctcaaagatgtgcatcaaagctttcagttcgccaggtggcagccggtggcacacattcagtggtgttgacacgcgaaggacatgtatggacatggggacaaccatggcctcctggagacataaaacaaatatcgacgcctgtaagagtacaaggtttagaaaaagttaagttgattgcagtgggggcttttcacaatttggctcttttagaagatggaagtttatgggtttgggggaacaatgaatatggacaactaggaacaggggatactcagccacgatcacaaccggttcctgttcaaggactttctggcctcaaattgattgatgttgctgctggtggttggcattctacagctctaacagaagaaggagaggtatacgggtggggaagaggggaacatggaagacttggatttggagacgataaaagcagtaaaatggtgcctcaacaagttcatcatctagctggcgaagacatcgtccaggtgtcatgtggtgggacccactctgttgcattgacacgtgacggtcgtatgtttgcttttgggcgtggggaccatggaagattggggtatggtagaaaggtgacaacggggcatccgtctgaagtaccgattgatttaccgccaccaaaagatggtgaattgggacgttggtgtgctaaatatgtggcgtgtgggggccgccatacacttgcgattgtggaatgggaaggtgtggaggttgttgagttgatttaatggaggttttgatgacatgactctctcatgtgagaaaataatgagaggtcatttgtgtttttgatgtattactgtggttttatatatggagtttatttaagttgaatttttttgatgttcgatatggtataatacattatagagtaatatgttatggtgacattgaagctcagattacacgtgttctagcgtacttggagttt

SEQ ID NO: 1545 - DNA, 1856 bp, Zea mays
caccgagagagcacaagacccccacgaccgcaggtcaagccgtactggactggaccggaccggacacacgcccagaaagccctgcagcagaactgcagaagacacggccgcggcagaagagcccaaatcacggccgcaaaagccacgcacgcggcgcttgtcctgcgcggcgcacggaaacccacctccacggcggcaccccgtgcgtcggctgcttgctgccccagtgccgccccgcgttcccttcgctcccgccgacaccgacgccgccactgccaccgccggcatggcgaccccgctccgcgccaccgcggtcctcgcgtggggttccggggaggacgggcagctgggcatgggcgggaacgaggagaaggactggccccacttcgttgaggcgctggggccctacgccgtcaccgccgtcgtcgccggcagccgcaactccctcgccatctgcgacgacggccgcctgttcacatggggatggaaccaacgcggcacgctcgggcacccgccggagaccaagacggagagctccccgggccccgtcgacgctctcgcgggtttcaagatcgtccaggcggcgattggcgggtggcattgcctcgcagttgacgacaaggggcgcgcctacgcctggggtggaaacgagtacgggcagtgtggtgaggagcctgagaggaaggaggacgggacgagggcgctcaggagggacatcccgatcccgcagcggtgcgcgctcaagctcaaagtccggcaagtagccgctggagggacacattcagtagttttgactcaagaaggtcacgtctggacatggggacagccatggcctccgggtgatatcaagcaaatatctacacctgtacgtgtgcaaggccttgagaaagtgagggtcattgctgtaggtgcattccataatttggcactaacggaggatgtaattttgtgggcatggggtaataatgagtatggtcagctggggactggagatacccaaccaagatcacaaccgatacgtgtcgaagggctatctgatctctcactggttgacattgctgctggaggctggcattcaactgcactaactatagatggagaggtgtatgcttgggggagaggagagcacgggaggcttggatttggagatgataagagtagtcacatggtgcccctaaaggttgagcttctagctggagaggatattgttcaggtatcatgtggaggaacacattcagttgcgctagctcgagatggccgaatgttttcttacgggaggggcgaccatggccgtctaggctacggcaggaaggtgacgacgggccaccccatggaattgcccatcaacctgccgccgctcagcagcagccgcgacggtcggtggcaggcgaaatacgtggcttgtggcgggcggcacaccctcgctattgcggagtggacagaggccactgattgatcaccgtttgtggaataagcacaaggccggtgccaacgggcgtaggtggggctgcagtcgatggcgctgccggccgccgcggtcggtacttaccagaagtagttcagtaccgactgccattgccatgtgtcgtcttttaattagttgatgtccaataaattcataagttttttttaaaaaagtctaagtaatctgaaaaggtatttatgaattatgtaacttttttactttttggtattatgttattttttatgttttatgagttatgtaaattttatttatgatttataaattacatactgtgtatttatattcatgaactatatacttttttattttggttacttatattccttcggtgaatttaattttataaaaacgtcccgttttcattttaaat

SEQ ID NO: 1546 - DNA, 1288 bp, Arnica chamissonis
aaaaacacggggaatattaagtttatcatccccaaacactccggcaacatatcgctacttccgtaaactctttttctaaactcttcccaatggctgtcaacaataccgccgtcgtcgcctggggttcaggagaagacggacaactaggactaggagacaacgaagagaaagaatgggtttcccccgtcacatctctcacttcagtgaccgttcgctccgtcgtcgccggtagtcgtaactctctcgccgtttgcgatgacggcaagttgtttatgtggggttggaatcaaagaggaactttggggcacccgccatcaactaaaaccgagaatatccctagtcatgttgaagctcctgacgatgttaagattgttcaggcagctattggtggttggcattgtttggctgttgatgatcaaggccgtgcttatgcttggggtggaaacgagtatgggcagtgtggtgaagaacttgagaagaaaggtgattctggtaggagagatattctgactcctcaaagatgtgcctcaaatctttcggttcgccaggtagctgctggcggcactcattcagtagtgctgacacgcgaaggacatgtttggacatggggacaaccatggccccctggagacataaaacaaatttcaacacctgtgagagtacaaggtcttgagaaggttaagttgattgcagttggggccttccacaatttggccctacttgaggatggaaatctgtgggtttggggcaataatgaatatggacagctaggaacaggggatacccagcccagatcacaaccagttcctgttcaaggattatccggcctcaaattggttgatgttgctgccggtggttggcattctaccgctctaacagacgaaggagaggtatacgggtggggtagaggggaacatggaaggcttggatttggagatgacaaaagcagtaaaatggtacctcagcaagttcagcttctagctggggaggatattgtccaggtgtcatgtggtggaacacattctgttgcgttgactcgtgatggtcgtatgttttcttttggccgtggagaccatggaagattaggatatggtagaaaggtgacaactggccatccatcagaagtacctattgacatacctccgccaaacgatgacggtggcagtggactagggcggtggtgtgctaagtatgtggcttgcggcggtcgtcatacaattgccattgtagaatggcgagctacagaggcagatgggttgatctgatcgaaggttgtatttgaaatctc

SEQ ID NO: 1547 - DNA, 1209 bp, Musa acuminata
gtaacctgttccgtttttcgtttgaaagagttccgatttgtgctcaggggttcaggcgaggatgggcaactggggatgggcaactgggaagagaaggactgggcctacagcatcaagtccctcgagcccaagaacgtcgtcgccgtcgtcgccggcagcaggaactccctcgccatctgcggcaacggacaattgtatacatggggatggaaccagaggggaaccctgggtcatccgccggagaccaagacggagagcgtcccgagcctagttgatgccctcgccggcgtcaagatcgttcaggcagcaattgggggctggcattgcctggctgttgatgatcagggccgagcttatgcttggggtgggaatgaatatgggcagtgtggggaggagcccgagagaaaagaagatggcagtagggctctgaggagggacattgccattccccaaagatgtgcacctaagctctccgtccgccaggtagctgctggagggacacactccgtggtactgacgcaagatggtcatgtctggacttggggccaaccatggcctcctggagatattacgcaaatctcaactcctgtacgtgtgcaaggccttgagcgagtaaggttgattgctgttggtgcatttcataatttggcacttctagaggatggaaccttatgggcgtggggcaacaacgaatatggtcaactaggaactggtgatactcagccaagatcacaacctatccctgttcagggtttatctggtcttactttggttgacattgctgctggaggttggcattcaactgcactaaccaatgttggagaggtatatgcttggggaagaggggagcatgggaggcttggatttggagatgacaagagtagtaaaatggttcctcagaaggtccaactcctagtcggggaagatattgttcagatatcttgtggaggcactcattcagtggcgtgtactcgtgatgggcgaatgttctcttttggaaggggcgaccatggacgcctaggctatgggaggaaggtcacaaccggccacccaatggaagtgcccatcaaactgctaccaccaagagacagcggcagcaccgacgggcagtggtgcgccaagcttgttgcctgcggtggacgccatactttggcgatggcatcatgggttgaggaacctggagattctatctaaagctgagacaaagag

SEQ ID NO: 1548 - DNA, 1471 bp, Gossypium raimondii
ataataaaaaaataaaaacagagagatcgtcgatcagatttagttgattgatccaaagaatcaaatggaatgaaatgaacgtcgactgagtggatttcagcaatgaaaagggtcttctcggcgcccggagattacatctacttcaagtcccaagtccctcttcacaggatccccatcggcacgaagcagtggcggtattatgattttggtcccaaagtggttactccactcatatgtcttcctggaactgcagggacagcagatgtctactacaaacaaatcatgtgcttgtccatgaagggttaccgggtcatttctgttgatattccctgtgtttggaatcatcaagagtggattcaaagttttgaaaagttcttggatgccatcgatgttcatcatatacatctgtatggtacatcccttggaggcttcctagcacaactttttgctcaacatcgtcccagacgggttaaatccttaattctatcaaatacatttttggagacacgcagttttgcagcagcaatgccttgggcaccttttgtcagttggaccccgtcttttttgttgaaacgatacgtcttaacaggaatccgtgatggccctcatgaaccttttattgccgattctgtggactttgttgtttcgcaggtcgaaacactctcaagagatgaattagcatccaggttgactttgacagttgactctgcttcagtaaaaccgctactactttcagattcatttattactataatggatacgaacgactactcggcaattcctcaacaacttaaagatcagttgagtgagaggtacccaggtgcaaggcgagcttatctcaaaacaggaggcgatttcccctttctttcccgccctgatgaagttaacctacatcttcagctgcacctgagacgggttggattggaagctcagccagagctggttcagagcatcccaaaagatggcaccggtggaggccccagcaaagaaaatgataaggaggatcgtgatgatgaacaaaaagataatgggggaaatcccgaaagcaattctgaagaaagccagccgtcaccttcggctccggaaagttcagaatctcatggtctagatgaacagctcctcagcaatgccgaaattcattacatcgatcagaaagattcaatcattttgaagccttctgcaatgtcaatgaatcaacacagtgcggctgccggaatcctcctccaatcgacatgggagttctttattttctctttgctgccgttatatgtggattcattatacatttattctaataatgcttggaaattgagacaactggtgtaaatagagcattggttagcagtttctgctcgttgtttatataaatataagctctgttgcaaacagtttctccattgacaatgttgtatctgttcagttattttaagttcctcattattgaattttcaaatcgaatcttgttcaccag

SEQ ID NO: 1549 - DNA, 1449 bp, Gossypium hirsutum
gaatcaaatggaatgaaatgaacgtcgactgagtggatttcagcaatgaaaagggtcttctcggcgcccggagattacatctacttcaagtcccaagtccctcttcacaggatccccatcggcacgaagcagtggcggtattatgattttggtcccaaagtggttactccactcatatgtctccctggaactgcagggacagcagatgtctactacaaacaaatcatgtgcttgtccatgaagggttaccgggtcatttctgttgatattccctgtgtttggaatcatcaagagtggattcaaagttttgaaaagttcttggatgccatcgatgttcatcatatacatctgtatggtacatcccttggaggcttcctagcacaactttttgctcaacatcgtcccagacgggttaaatccttaattctatcaaatacatttttggagacacgcagttttgcagcagcaatgccttgggcacctattgtcagttggaccccgtcttttttgttgaaacgatacgtcttaacaggaatccgtgatggccctcatgaaccttttattgccgattctgtggactttgttgtttcgcaggtcgaaacactctcaagagatgaattagcatccaggttgactttgacagttgactctgcttcagttaaaccgctactactttcagattcatttattactataatggatacgaacgactactcggcaattcctcaacaactcaaagatcagttgagtgagaggtacccgggtgcaaggcgagcttatctcaaaacaggaggcgatttcccctttctttcccgcccagatgaagttaacctacatcttcagctgcacctgagacgggttggattggaagctcagccagagctggttcagagcatcccaaaagacggcaccggtggaggccccagcaaagaaaatgataaggaggatcgtgatgacgaacaaaaagatgatgggggaaatcccgaaagcaattctgaagaaagccagccatcaccttcggctccggaaagttcagaatctcatggtctagatgaacagctcctcagcaatgccgaaattcattacatcgatcagaaagattcaatcatttttaagccttctgcaatgtcaatgaatcaacacggtgcggctgccggaatcctcctccaatcgacatgggagttctttattttctctttgctgccgttatatgtggattcattgtacatttattctaataatgcttggaaattgagacaactggtgtaaatagagcattggttagcagtttctgctcgttgttcatataaatataagctctgttgcaaacagtttctccattgacaatgttgtatctgttcagttattttaagttcctcattattgaattttcaaaaaagaaccagcaaaatgaacggttccctattagataaatgaagtttcaatccg

SEQ ID NO: 1550 - DNA, 1549 bp, Theobroma cacao
tagaaagttaggaacaacaataagagagagagaaaactaaaacagagagatcgtcgatcgatttaattgattgattcaaaaagaaggaatcgaatagaatgaatgtaaagtgattgtattcagcaatgaaaggcgtcttctcggcgcccggagattacatccacttcaagtcccaagttcctcttcacaagatccctattggcacaaagcagtggcgatattatgattttggtcccaaagtggttcctcctatcatatgtcttcctggaactacagggacagccgatgtctactacaaacagatcatgtccttatccatgaagggttaccgggtgatttctgttgatattccacgtgtttggaatcatcaagagtggattcaaagttttgaaaagttcttggatgccatcgatgttcaccatatacatttatatggtacatcccttggaggcttcctagctcaactttttgctcaacatcgtccaagacgggttaaatccttaattctatcaaatgcatttttggaaacacgcagttttgccgcagcaatgccttgggcgcctattgttggttggaccccgtcttttttgttgaaacgatacatcttaacaggaattcgtgatggccctcatgaaccttttattgctgattcagtggactttgtcgtttcacaggttgaaacactctcaagagaagacttggcatccaggttgactttgacagttgatagtgcttcagttggaccccttctactttcagattcatttattactatcatggatacaaatgatttctctgcaattcctcaacaactgaaagatcagctgagtgagaggtatccaggtgcaaggcgagcttatctgaaaacaggaggtgattttccatttctttcccgcccagatgaagtcaacctacatctccagctgcacctgagacgagttggggtagaagctcagccagatttggttcggagcatcccaaaagatggcactggtgggagccctagcaaagaaaatgatgaaaagaaggatagtgatgacccaccaaaagataatgggggcaatcccgaaagtacttctgaagaaagacagttgcctccagctcctgaaagttcagaatctcatggccttgatgaccagctcctcagcaatgcaaaaatttgttcccttggtcatgaaggtgcaattagtttgaggcattctgcattgttgaagaatcaacacactgtagcctctaaaatccttcttcaatcgacatgggagttctttattttctctttgcttcccttttacgtggagtcattgtacattacttctagttatggttggaaattcagacaactggtgtaaaatagaccataaattagcactttcttctcatcattgttgttcatacaagcaattgttgcagaccaacctgcggtttccgttgacaatgtcttacctgttgcattatttcaaagttcttgcttttattgaattcaaataatatgttgggcacctgggaccttgtaaatcctgcaggatctgaaaactaccatccttcgaaa

SEQ ID NO: 1551 - DNA, 1424 bp, Gossypium raimondii
atgaataagaggagagagtgagagatcgttgatcgagttaattgattgaatcaaaacaatagaaccgaatagaattaatgtagggagtgtagattcagcaatgaaaggcgtctccttggcgcccggagattacatccacttcaagtcccaagtcccccttcacaagatacctattggcacaaagcaatggcgatattatgattttggtcccaaagtagtttctcctctcatatgtcttcctggaattgcagggacagcagatatctactataaacagatcatgtccttgtccatgaagggctaccgggtgatttctgttgatattccccaggtttggaatcatcaagagtggattcaaagttttgagaagttcttggatgtcatcaatgttcatcatatacatttatatggtacatctctaggaggattcctagctcaactttttgctcaacatcgtccaagacgggttaaatccttaattctatcaaatgcatttttggagacacgcagttttgcagcagcaatgccttgggcacctattgttggttggagcccatcttttttgttgaaacgatttgtcttaacaggaattcgtgatggtcctcatgaaccttttattgctgattctgtggactttgttgtttctcaggttgaaacgctgtcaagagatgacttggcatccagattgactttgacagtagatactgcaacagttgaacctcttctactttcggattcatttattactataatggatacaaacgactactctgcaattcctcaacaactcaaagatcagctgagtgagaggtatccaggtgcaaggcgagcttatctgaaaacaggaggtgatttcccatttctttcccgtccagatgaagtcaacctacatcttcagctacacctgagacaagttggagttgaagctcggccagatttggttcagagcatcccaaaaggtggcaccggtgggagccctagcaaagaaagtgacaaaaagaaggatccagatgaccaacctaaagataatggaggcaaccctgaaagtacatctgaagaaagccagttacctcctagttcagaaattcacagccttgatgatcagctccttagcgatgcaaaaatatgttccatgggtcataaagatgcaattattttgatgcagtctcaatacactgtagtcaatagaatccttcaatcagcttgtgagttatttattttctctttgcttcccatttatgttgagtcatcgtacgttacttcaaataatgtttggaaattcagacaactgatgtaagtagcatagaacatagtagcactttcttctccattgttgttcatacaagcaaactgttgcagagccgctcgagttttccattgacagtgttgtacctgttttgttattaaagttattgctatttaat

SEQ ID NO: 1552 - DNA, 1488 bp, Gossypium hirsutum
tagggggacaaataaataaataaaaacggagggatcatcgatcgaatatcgatttaattgattgattcaaaacaacagaatcgaatggaatgaatgtaagagtcagtggattcaacaatgaaaggcgtctactcggcgcccggagattatatccacttcaagtcccaagtccctcttcacaagatccctattggcacaaagcagtggcgatattatgattttggtcccaaagtagttcctccacttatatgtcttcctggaactgctgggacagcagatgtctactacaaacagatcatgtccttgtccatgaagggttatcgggtaatttctgttgatattccatgtgtttggaatcatcaagagtggattcaaagtttcgaaaagttcttggatgccattgatgttcaccatatacatttatatggcacatctcttggaggcttcctagctcaactttttgcccaacatcgtcctagacgggttaaatccttaattctatcaaatacatttttggagacaagcagtttttcagcggcaatgcgttgggcacctattgttggttgggccccatcttttttgttgaaacgatacatcttaacaggaatacatgatggacctcaagaacctttcattgctgattctgtagatttcgttgtttcacaggtcgaaactctctcaagagatgacttagcatccaggttggctttcacagttgataatgcttcagttggacctcttctactttcagattcattcattactataatggatacaaatgactactcttcaattcctcaagaactcaaagatcagcttggtgagaggtatcccgctgctaggcgagcttatctgaaaacaggcgcggatttcccatttctttcccgcccagatgaagttaacctacatcttcagctgcatcttagacgagttggagtagaagctaagccagatttggttcgaaccatcccaaaagatggctctggtgggagccccggcaaagagaatgatgaaaagaaggatcatgatgaccaaccaaacggcaatgggggcaatcccgaaagtacttccaaagaaagccagtcacctccggctcctgaaagttcagaatatcacggcctatatgatcagctactcagcagtgcaaaagtcatttccataggtcgccaagattcaacattgatgaagaatcaacacattttagccaccggagtccttcaggtgacttgggagttctttatcttctcattgcttcccatttatgtttgctcgttgtacattactcaaaataatgtttggaaattcagaaaactggtgtaaaatagaacataacttagcagtttctttctcattgttgttgctcactgatttttctcatgttttttgttagctattttagtattgttaactgagttgataatttttaagagtttattgatcatgaaatcacgtgtaatataattacttaatccgaggttagggttgttg

SEQ ID NO: 1553 - DNA, 1400 bp, Gossypium hirsutum
cgttgatcgagttaattgattgaatcaaaacaatagaaccgaatagaattaatgtagggagtgtagattcagcaatgaaaggcgtctccttggcgcccggagattacatccacttcaagtcccaagtcccccttcacaagatacccattggcacaaagcaatggcgatattatgattttggtcccaaagtagtttctcctctcatatgtcttcctggaattgcagggacagcagatatctactataaacagatcatgtccttgtccatgaagggctaccgggtgatttctgttgatattccccaggtttggaatcatcaagagtggattcaaagttttgagaagttcttggatgtcatcaatgttcatcatatacatttatatggtacatctctaggaggattcctagctcaactttttgctcaacatcgtccaagacgggttaaatccttaattctatcaaatgcatttttggagacacgcagttttgcagcagcaatgccttgggcacctattgttggttggagcccatcttttttgttgaaacgatatgtcttaacaggaattcgtgatggtcctcatgaaccttttattgctgattctgtggactttgttgtttctcaggttgaaacgctgtcaagagatgacttggcatccagattgactttgacagtagatactgcaacagttgaacctcttctactttcggattcatttattactataatggatacaaacgactactctgcaattcctcaacaactcaaagatcagctgagtgagaggtatccaggtgcaaggcgagcttatctgaaaacaggaggtgatttcccatttctttcccgtccagatgaagtcaacctacatcttcagctacacctgagacaagttggagttgaagctcggccagatttggttcagagcatcccaaaaggtggcaccggtgggagccctagcaaagaaagtgacaaaaagaaggatccagatgaccaaccaaaagataatggaggcaaccctgaaagtacatctgaagaaagccagttacctcctagttcagaaattcacagccttgatgatcagctccttagcgatgcaagaatatgttccatgggtcatgaagatgcaattattttgatgcagtctcaatacactgtagtcaatagaatccttcaatcagcttgtgagttatttattttctctttgcttcccatttatgttgagtcatcgtacgttacttcaaataatgtttggaaattcagtcaactgatgtaagtagcatagaacatagtagcactttcttctccattgttgttcatacaagcaaactgttgcagagccgctcgagttttccattgacagtgttgtacctgttttgttattaaagttattgttatttaatta

SEQ ID NO: 1554 - DNA, 1545 bp, Gossypium raimondii
ctaatactcagaaagttagaaaacaataataaaagggacaaataaataaataaaaacggagggatgatcgatcgaatatcgatttaattgattgattcaaaacaacagaatcgaatggaatgaatgtaagagtcagtggattcaacaatgaaaggcgtctactcggcgcccggagattatatccacttcaagtcccaagtccctcttcacaagatccctattggcacaaagcagtggcgatattatgattttggtcccaaagtagttcctccacttatatgtcttcctggaactgctgggacagcagatgtctactacaaacagatcatgtccttgtccatgaagggttatcgggtaatttctgttgatattccatgtgtttggaatcatcaagagtggattcaaagtttcgaaaagttcttggatgccattgatgttcaccatatacatttatatggcacatctcttggaggcttcctagctcaactttttgcccaacatcgtcctagacgggttaaatccttaattctatcaaatacatttttggagacaagcagtttttcagcggcaatgcgttgggcacctattgttggttgggccccatcttttttgttgaaacgatacatcttaacaggaatacacaatggacctcaagaacctttcatcgctgattctgtagatttcgttgtttcacagatcgaaactctctcgagagatgacttagcatccaggttggctttcacagttgataatgcttcagttggacctcttctactttcagattcattcattaccataatggatacaaatgactactcttcaattcctcaagaactcaaagatcagctcggtgagaggtatcccgctgctaggcgagcttatctgaaaacaggcggggatttcccatttctttcccgccctgatgaagttaacctacatcttcagctgcaccttagacgagttggagtagaagctaagccagatttggttccaaaagatggctctggtgggagccctggcaaggagaatgatgaaaagaaggatcatgatgaccaaccaaacggcaatgggggcaatcccgaaagtacttccaaagaaagccagtcacctccggctcctgaaagttcagaatatcacggcctatatgatcagcgactcagtagtgcaaaagtcatttcaataggtcgcgaagattcaacattgatgagggatcaacacattttagccaccggagtcctccttcagttgacttgggagttctttatcttctcattgcttcccatttatgtttgctcgttgtacattactcaaaataatgtttggaaattcagaaaactggtgtaaaatagaacataacttagcagtttctttctcgttgttgttcactgatttttctcatttttttttagctattttagtattgttaactgagttgataatttttaagagtttattgatcatgaaatcacgtgtaatataattacttaatccgaggttatggttgttggaatttatatttaaacattattttaattcaatgaaaaa

SEQ ID NO: 1555 - DNA, 2463 bp, Gossypium raimondii
gggccagccttaaaaaaaaaaaaccctgcttgttttaaaaccctagctcaagtcgcgccgtttcttttaacatttttcgcttcatcttgacgccacactctctcattgtttctctgtcgaaatggaaggctcagtcgaagaaacggcgaaagcagtttccgatttagcattggattcgtctgctgccggtgaaactcagagcaaaaatgctcgtaagaaggaacttaaaaataagcagagggaagaggagcgtcgccgtaaggaggaggagaaagcagccaaacaggctgcagccaaggcaagcacacaaagtcagaaacatgcagccgctgatgacgaagatatggatcccacgcaattccacgagaacaggctgaaatttcttgcggcccaaaaggcagaggggaaaaatccttatcctcataaattcttcacatcaatgtctatcgttgaatatatagataaatatggaagcctaggcaatggggagcatattgaggatgccacagtatctttagccgggcgaattatgagcaaaagggcatccagctcaaagctgttcttctatgacttgcatggcggtggtgccaaagtccaggttatggctgatgcgagcaagtcaggcttggatgaagctgaatttgcaaaattccattcaactgtgaagcgtggtgatatagttggtgtcactgggtttccaggcaaaactaagagaggagagttgagcatctttccaaagtcatttttagttttatcccattgtctccatatgatgccaaggcaaaaagcaggccctgatgccagcgtgaagaaaactgatgtatggatcccaggaagtactaggaatcccgaaacgtatattttgaaggatcaggaaactcgttatcgccaacgttatcttgatttgatgttaaaccttgaggttcgtcaaatattcaagactcggtcaaagatcatttcttatgtgaggagctttcttgacaatcttgatttcttggaggttgaaactcccatgatgaacatgattgctggaggtgcagctgcccgtccatttgtaacccatcacaatgaattaaatatgaagctctatatgcgtattgcacccgagttatatcttaaggagctagtagttggtggactggatcgtgtgtatgagattggaaaacagtttagaaatgagggcattgatttgactcacaatcctgaattcactacctgtgagttctatatggcttttgctgactataatgacttgatggagcttactgaaaaaatgttgagtgggatggtcaaggaacttacaggcagctataaaattaaataccatgcaaatggccttgacaatgctccaattgagattgatttcactccacctttcaggaggcttgacatggtagaggagttagagaagatggctaacctcaacatacccaaggacttttccagtgatgaaactaacaagtatttggcagatgcatgtgcaaagctcgagattaaatgccctcctcctcaaactacagcacgtttgttggataaacttgttgggcattttctagaagagacgtgtgtgaatcctactttcatcatcaaccatcctgaaataatgagtcctttggcaaaatggcataggtcaaaaccagggctgactgaacgtttcgagctgtttatcaacaaacatgaactttgcaatgcatacactgagttgaatgatcctgttgtacaacgtcaacgatttgctgaacaactgaaggatcgacaatctggtgatgatgaagctatggctctagatgaaacattctgtactgcacttgagtatggattgcctccaactggtggttggggattgggtatcgatcggctagctatgctattaacagattcacagaatatcaaggaggttcttctcttcccagccatgaaacctcaggatgaaccatccactaaagctccagcaacttagggagttgaacctgccaaaatctgactcatcgccttgatctactatgtttgctgtaaaccagtggtgagatctgtcaagtttttggcgtcgattttgtcttgaaagaatattgcagttgacattcaaccctcttatgtgtttgctagtatagataggtgttttatcatacacgctagaagtcacgtcacctccatccattgtttatgattaccttaactgaatataatatagtcatgtctcatgtggaatggaaccaaaattgaattcagaattgtgtggaggtgtagtcaggcatttttcctagttaagttgcagcaaatattttctgctattgggatgtgatttagaatggaaatttctttttagaattttatttggctattacgcttgttttgctgtctaacgagaaggaagagaaaagaatttaatctcccctattttataataatttacaatattttaaaattttgtttttaatatttccctgtagtgacttgaggttt

SEQ ID NO: 1556 - DNA, 2226 bp, Gossypium hirsutum
gttttaaaaccctaaaaagctcaatagttaatccgtctcactgtttctttcttaatctttgggctttggctttgttcggaagccacattctctctatctcgctatctcaaaatggaaggctccgtcgaagaaacggccaagggagtttccgatttagcagtggattcggcttcccccgcagaaattcagagcaaaaatgctcgtaagaaggaacttaaaaataagcagcgggaagaggagcgtcgccgcaaggaggaggaaaaagcagccaaacaggctgcagccaaggcaagctcacattgtcagaaatctgctggagctgatgatgaagatatggatcccacgcaattccatgagaataggctgaaatttcttgcagcccagaaagcagaaggaaaaaatccatatcctcataagttctttgcgtcgatgtctattattgaatatatagataaatatggaagcttagccaatggggagcatattgaggatatctcagtatctttggctggtcgaattatgagcaaaagatcatcaagttcaaagcttttcttttatgacttgcatggtgatggtgccaaagtccaagttatggctgatgcaagcaagtcaggcttggatgaagcagaatttgcaaaattccattccagtgtgaagcgtggtgatatagttggtgtcactgggtttccaggaaaaacaaagagaggggagttgagcatctttcccaagtcatttactgttttatcccattgtctccatatgatgccaaggcaaaaagcaggtcctgatgccagtgtgaagaaaactgatttatgggtcccaggaagtaccaggaaccctgaagcatatattttgaaggatcaggaaacacgatatcgccaacggtatcttgatttgatgttaaacctggaggttcgtcaaatattcaagaccagatctaagatcatttcttatgtaaggagttttcttgacaatcttgatttcttggaggttgagactcccatgatgaacatgattgctggaggtgcagctgcccgtccatttgtaacccatcacaatgaattaaacatgaagctctacatgcgtattgcaccggagttatatcttaaggagcttgtagttggtggactggatcgtgtttatgaaattggaaaacagtttagaaatgagggtattgatttgactcacaatcctgaattcactacttgcgagttctatatggcttttgcagactataatgacctgatggagctcactgaaaaaatgttgagtggaatggtcaaggaacttacaggtggctataagattaaatatcactcaaatggccttgaaaatgatccaatagagattgatttcactccgcctttcaggaggcttgacatggtcgaggagttggagaagatggctaacctcaatatacccaaggacttttccagtgatgaagctaacaaatatttggtggatgcatgtgcaaagtttgagatcaaatgccctcctcctcaaacaacagcacgtttattagataaacttgttgggcattttctagaagagacgtgtgtgaatcctactttcataatcaaccatcctgaaataatgagtcctttggctaagtggcataggtcaaaaccaggactgactgaacgttttgaactttttatcaacaaacatgaactctgcaatgcatacactgagttgaatgatcctgttgtacaacgtcaacgattcgctgaacaactgaaggatcggcaatcaggtgatgatgaagcaatggctttggatgaaacattctgtactgcacttgagtacggattgccaccaacaggtggttggggactgggcattgatcggctagctatgttattaacagattcacagaatatcaaggaggttcttctcttcccagccatgaaacctcaggatgaaccatcagccaaagctccaggaacataagggagttcaacacttggctttgatgtgctgtgtttaccataagagctggcaagtttttttgttaattttctcgagttgcctattatggaataggtattcatggtatatgatagaagtccattgtttacggatgtgaatttactttgattagtctttatatggaattggtataaaaatattctgcatattattacaaaccctcagagaaaagatagacttttgtttgtttgtgtgtggtattttaaatggattcttcttcactaatatgatcatttt

SEQ ID NO: 1557 - DNA, 2217 bp, Gossypium raimondii
gacccagggtttttgttcgttttaaaaccctaataagctcaatagttaatccgtctcactgtttctttcttaacctttggctttggctttgttcggaagccacattctctctatctcgctatctcaaaatggaaggctccgtcgaagaaacggccaagggagtttccgatttagcagtggattcggcttcccccgcagaaactcagagcaaaaatgctcgtaagaaggaacttaaaaataagcagcgggaagaggagcgtcgccgcaaggaggaggaaaaagcagccaaacaggctgcagccaaggcaagctcacattgtcagaaatctgctggagctgatgatgaagatatggatcccacgcaattccatgagaataggctgaaatttcttgcagcccagaaagcagaaggaaaaaatccatatcctcataagttctttgcgtcgatgtctattattgaatatatagataaatatggaagcttagccaatggggagcatattgaggatatctcagtatctttggctggtcgaattatgagcaaaagatcatcaagttcaaagcttttcttttatgacttgcatggtgatggtgccaaagtccaagttatggctgatgcaagcaagtcaggcttggatgaagcagaatttgcaaaattccattccagtgtgaagcgtggtgatatagttggtgtcactgggtttccaggaaaaacaaagagaggggagttgagcatctttcctaagtcatttactgttttatcccattgtctccatatgatgccaaggcaaaaagcaggtcctgatgccagtgtgaagaaaactgatttatgggtcccaggaagtaccaggaaccctgaagcatatattttgaaggatcaggaaactcgatatcgccaacggtatcttgatttgatgttaaacctggaggttcgtcaaatattcaagaccagatctaagatcatttcttatgtaaggagttttcttgacaatcttgatttcttggaggttgaaactcccatgatgaacatgattgctggaggtgcagctgcccgtccatttgtaacccatcacaatgaattaaacatgaagctctacatgcgtattgcaccagagttatatcttaaggagcttgtagttggtggactggatcgtgtttatgaaattggaaaacagtttagaaatgagggtattgatttgactcacaatcctgaattcactacttgcgagttctatatggcttttgcagactataatgacctgatggatctcactgaaaaaatgttgagtggaatggtcaaggaacttacaggtggctataagattaaatatcactcaaatggccttgaaaatgatccaatagagatcgatttcactccgcctttcaggaggcttgacatggtcgaggagttggagaagatggctaacctcaacatacccaaggacttttccagtgatgaagctaacaaatatttggtggatgcatgtgcaaagtttgagatcaaatgccctcctcctcaaacaacagcacgtttattagataaacttgttggacattttctagaagagacgtgtgtgaatcctactttcataatcaaccatcctgaaataatgagtcctttggctaagtggcataggtcaaaaccaggactgactgaacgttttgaactttttatcaacaaacatgaactctgcaatgcatacactgagttgaatgatcctgttgtacaacgtcaacgattcgccgaacaactgaaggatcggcaatcaggtgatgatgaagcaatggctttggatgaaacattctgtactgcacttgagtacggattgccaccaacaggtggttggggactgggcattgatcggctagctatgttattaacagattcacagaatatcaaggaggttcttctcttcccagccatgaaacctcaggatgaaccatcagccaaagctccaggaacataagggagttcaacacttggctttgatgtgctgtgtttaccgtaagagctgtcgagtttttttgttaatttttcgagagttacctattatggaataggtattcatggtatatgatagaagtcaatggtatagtctttatgtggaattggtataaaaatattttgcatattatattacaaaccctcagagaaaagataatagacttttgtttgtttgtgtgtggtattttaaatggattctcctttactaatat

SEQ ID NO: 1558 - DNA, 2292 bp, Theobroma cacao
atcagttgggttttggttttaaaaccctagctctacacttccgtcgcactgttccttaacatttcgctttatctacaagccactctttgtctcactctctcaaaatggaaggctccgtcgaagaaacggcaaaagcagtttccgatttagcaatggattccacagctcacggtgaaactcagagcaaaaatgctcgtaagaaggagcttaaaaataagcagagggaagaggagcgtcgccgaaaggaggaggaaaaagccgccaaacaggctgcagccaaggtgggctcacaaagtcagaaacatgcaggagctgatgatgaagatatggatccaacgcaattccatgagaataggctgaaatttcttgcaggccagaaggcagagggaaaaaatccatatcctcataagttcttcccgtcgatgtctatcattgaatatatagataaatatggaagcttaggcaatggggaacatattgaggatctctcagtatctttggctgggcgaattatgagcaaaagatcatccagttcaaagctgtttttctacgacttgcatggtgatggtgccaaagtccaagttatggctgatgccagcaaatcaggcttggatgaatctgaatttgcaaaattccattccagtgtgaagcgtggtgatatagttggtgttactgggtttccaggcaaaactaagagaggggagctgagcatctttccgaagtcattcatagttttatcccattgtctccatatgatgccaaggcaaaaagcaggtcctgatgccaatgtgaagaaaactgatgcatgggtcccaggaagtaacaggaatcctgaaacatatattttgaaggatcaggaaactcgatatcgccaacgctatcttgatttgatgttaaacctggaggttcgtcaaatattcaggaccagatctaagataatttcttatataaggagcttccttgacaatcttgatttcttggaggttgaaactcccatgatgaacatgattgctggaggtgcagctgcccgtccatttgtaacccatcacaacgaattaaacatgaagctctacatgcgtattgcacccgagttatatcttaaggagctagtagttggtggactggatcgtgtttatgaaattggaaaacaatttagaaatgagggcattgatttaacccacaatcctgaattcactacctgtgagttctatatggcttttgcagactataacgatttgatggagctcactgaaaaaatgttgagtgggatggtcaaggaacttacaggcagctataaaattaaatatcatgcaaatggccttgataatgatccaattgagattgatttcactccacctttcaggaggcttgacatggtagaggagttagagaagatggccaatctcaacatacccaaggacttttccggtgatgaagctaacaagtatctggtggatgcatgtgcaaagtttgagatcaaatgccctcctcctcaaacaacagcacgtttattggataaacttgtggggcattttctagaagagacgtgtgtgaatcctactttcatcatcaatcatcctgaaataatgagtcctttggcgaagtggcataggtcaaaaccagggctgacagaacgttttgaactttttgtcaacaaacatgaactttgcaatgcatacactgagttgaatgatcctgtcgtacaacgtcaacgatttgctgaacaattgaaggatcggcaatcaggtgatgatgaagcaatggctttggatgaaacattctgcactgcactcgagtatggattgccaccaactggtggttggggattgggtgttgatcggctagctatgttgttaacagattcacagaatatcaaggaggttcttctcttcccagccatgaaacctcaggatgaaccatccgttaaagtttcatgtttggcttgacaaacagcatatggtagtctataaactaagctccagcaagttagggagttgaatctgctgaaatgacacttgggcttagtgtactgtgtttttggcaaaacccggttatgggagccgttaagttttggttgttaatttatccaatttgttgtcactgagagagctttgcggttgttattcaaccctctatgttagggtaatattgctggtgtagatgcttatcatatatatatatatatgatatatgatatggtataagtcacctcatcctcattctttacgaatgtgatttattttaactgaatactctgtcgaatggtacccaaatattttaaagcattttgca

SEQ ID NO: 1559 - DNA, 2025 bp, Manihot esculenta
atggaaagttctgtcgacgaaacagcgaaacaagtctctaatttatcaatggacgccgagtctacagcttctggaggagaaactgtcagcaagaatgcgcgcaagaaggaattgaagaataagcagagggaggaagagagacgacgcaaggaggaggagaaagccagacaggctgcagagaggactagtacccatgttcagaaacctgcagctgctgatgatgaggatatggacccaacgcaatactatgaaaatcggctgaaatatcttgcttctcagaaggctgaaggaaaaaatccatatcctcataaattctctgtttcaatgtccattgtagaatttatagaaaagtatggaggcttgagcaatggagagcatgttgaggatgtcaatgaatctttggctggtcgaattatgaagaaacgatcctcctcatcaaagctattcttttatgatttgcatggtggcgatgttaaagtccaagtgatggctgatgcgagcaagtcaggcatggatgaagctcaattttcgaggtttcactccagcgtgaaacgtggtgatattgttggtgtcattgggtttccaggaaaaactaaaaggggagagctaagtatttttccaagatcttttacggttttatctcattgtctgcatatgatgccaagggagaaacctggtcagaatcccaatgtaaagagaactgacatctgggccccaggtcaaaccaggaatcctgaagcttatactttaaaagatcaggaaactcgctatcgtcaacgttatctagatctgatgttgaatgctgaggttcgacagctattcaaggcccgatctaagatcatatcatatgttagaagctttcttgacaaccttgatttcctggaggttgaaacacccatgatgaacatgattgctgggggagctgctgctcgcccatttgttactcatcacaatgagctgaacatgaggctctacatgcgtattgcacctgaactttatcttaaagagttagttgttggtggtctggatcgtgtttatgagataggaaaacaatttagaaatgagggtattgacttgactcataaccctgagtttacgacctgtgaattttatatggcttttgcggactacaatgacctgatggaactaactgagagattgttgagtggaatggtcaaggaacttacagggggctacaaaattaaatatcacgcaaatgggcttgacaatgatccaattgagatagactttacaccaccttttagacggattgatatgatagaggagttagagaagatggccaacctcaacattccaaaggacctttccagtgatgaagctaacaagtatcttgttgctgcttgtgaaaggtttgatgtcaagtgtcctcctccgcagacaacagctcgtctgttagacaaattggtagggcacttcctggaagagacttgtgtgaatcctgccttcatcataaatcatcctgaaattatgagtcctttggcaaaatggcatagatcgaaaccaggcttgaccgaacgatttgaattatttgtgaacaagcatgagctatgcaatgcatatactgaattgaatgaccctgtggtacaacgtcagcgatttactgaacaactcaaggatcgacaatcaggcgatgatgaagcaatggcttatgacgaaacattttgcactgctcttgagtatgggttaccccctactggtggctggggaatgggtatcgatagactagctatgttgttaactgattcccagaatatcaaggaggtgctgctcttcccatctatgaagcctcaagatgaacctcctgctaaagcaacttgatgagttggagacagaggtgaagttgctgtcaactgctgataaattttaccatattgccttcccttcattttttgcgccaactcaatttttattggggatgatcatttgacactgcctgttaaaagtatgtgaaatgttatgaaatgctctcattaaatataattttatacgagatatttgttacct

SEQ ID NO: 1560 - DNA, 2314 bp, Vitis vinifera
agggtttgccggcggcagctgcagcagcagaagcctccatctctccactcaaaagcattctatctttccttcaccaaacgctgcgtttcagtcgattcttgagttaaagcctgaaaaaacctaaagctatattcccaatggagggtgctgctgaagaagctgccaaagcaatcttggatttatccgtggatggttcttcatctgaaaccacaagcaaaaatgctcggaagaaggagttgaagatgaagcagagggaggaggaaaagaagcgcaaagaggaggaaaaagcaaagcaggctgctgcagtatcaagctcgaaggttcagaaacccatggctggtgatgatgaagatatggatccaactcaatactttgaaaatagggtgaaatatcttgcagctcaaaaggctgctgggaaaaatccatatcctcacaaattctttgttacactatctatccttgaatacataaagaaatatggagccttaagcaatggggatcaccttgaggatgtcacagtatcattggctgggcgaataatgagcaaacggtcgtcctcttcaaagctatttttttatgatttgcatggtgatggtgctaaagttcaagttatggctgatgcaaggagctcagatatggatgaggctgaattttctaggttccattctggtgtgaagcggggtgatattgttggtgtcactggctttccaggaaaaaccaaaaggggggagctaagtatttttccaaaatctttcatagtcttatctcattgtctccatatgatgccaagacagaaagctggtcctggttctgataatgccaatgtgaagaaaactgatgtatgggtcccaggaagtaccaggaatcctgaaacatatattttgaaagatcaggaaactcgatatcgtcaacgttacctggatttgatgttgaatatggaggttcgacaaatattcaagacccgagctaagattatttcatacattagaagctttcttgacaatcttgatttcttggaggttgaaactccaatgatgaacatgattgctggaggagcagcggctcgtccatttgtgactcatcacaatgacctaaacatgaagttatatatgcgtatcgctcctgaactctatcttaaggagctagttgttggtggattagaccgtgtttatgaaatcggaaaacaatttaggaatgagggaattgatttgacccataatcctgaattcactacatgtgagttttatatggcctttgcagactacaatgacgtgatggagctcactgagaaaatgttgagtggtatggtcaaggaacttacaggtggctacaaaattaaatatcatgcaaatggcttggataaggacccaattgagattgactttactccacctttcagaaggattgacatgatagaggatttagagaagatggcagacctcagcatacccaaggatctctcaagcgatgaagcaaacaaatatttggtggatgcatgcttgaaatttgatatcaaatgcccccctcctcaaacaactgctcgtttgttggacaaacttgtggggcattttcttgaggagacatgtgtaaatcctactttcatcactaaccatcctgaaataatgagtcctttggcaaagtggcacagatcgaaacaaagcttgactgaacgttttgaattgtttgtcaacaagcatgaactttgcaatgcttacactgaattgaatgatcctgtggtccaacgtcagcgatttgccgaacaactcaaggaccgacaatcaggtgatgatgaagcaatggctttggatgaaacattttgtatggctcttgagtatggattaccacccactggtggctggggattgggaattgatcgacttacaatgatgttaacagattcacaaaatattaaggaagttcttctctttccagccatgaaacctcaagatgagccttctgtccagcctcctgctgaactttctagccaagctgtctaggggttggaagactgaaatcttgaatggatattgcatcggtgcacgtttttgggcttgctgtcaagttttgatcattaatttatctttaccatcacaactcatcttttcttcctttttttgtggggtttgtgattcaacccttcttaccataccatgctttttattatttatagctagatgtttcacttgtttgcaaaatgcaagcaacacttgctacttcaactcaggatttgagttcttggaacactgttaattataaattgagtttagagcagcagtgtaatttttttttttttgaaatattatgtgagatggag

SEQ ID NO: 1561 - DNA, 2212 bp, Citrus clementina
ctcacagaaaagcaaaaccctacttacacgcagactggcggctttcaatcctctctctgaataactcacctcactgtaaccttcctctccttcacacggaccaaaatggaagggtctgttgacgaaacagcgaaagctgtctcgaacttagccgtggattcatcttcatctgatcccgcagctggagaagaaaccatcagcaaaaatgcacgcaagaaggaactgaaaatgaagcagaaagaggaggaaaggcgacgtaaagaagaggagaagcggcagaaagaggctgagagggctgccaccaaggcaagcccccaaagtcagaaaccggctgctgatgatgaggatatggatccaacgcaatatcttgagaataggaagaggtatttggagattcagaagaaagagggaaaaaatccatatccccataaattttttgtgtcaatgtccatcattgaatatatagcaaactatggaggtttaggcaatggggatcatcttgaggacatctcagtatcattggcaggaagaatcatgagcaaacgatcttcttcatcaaagcttttcttttatgatttgcatggtgggggtgctaaagtacaagttatggctgatgcaagcaaatcagacatggatgaagtggaattctctaagtttcatgctagtgtgaaacgtggtgatatagttggcgtcacagggtttccaggaaaaactaaaagaggggaacttagcatctttccaaaatcatttgtagttttatcccattgtctccatatgatgcctaggcagaagcctggtgtggataatgccaatgtcaagaaagttgatgcatgggtccctggaagtaccaggaatcctgaaacatatattctaaaagatcaggaaactcgatatcgtcaacgttatctggatttgatgttgaatgtggaggttcgtcagatattcaagaccagatctaaggttgtttcatatattaggagattccttgacaatcttgatttcctggaggtcgaaacacccatgatgaacatgatcgctggtggagcagctgcccgtccttttgtgacccatcacaatgatctgaacatgaggctgtacatgcgtattgcacctgagctatatctaaaggagctggtagttggtggactggaccgagtttatgagataggaaaacaatttagaaacgagggtattgatctgactcataatcctgagttcaccacctgcgaattctatatggcttttgcagactacaatgacctgatggagcttactgagaaaatgttgagcgggatgatcaaggaaattacagggagctataaaatcaaatatcattccaatgggcttgataaggatccaattgaaattgatttcactccccctttcagaaggatagacatgatagaggagttagagaagatagcaaacctccaaataccaaaggacttggccagcgtagaagcaaacaaatacttagcagatgcatgtgtgaagtttgatatcaaatgcccccctcctcagacaacagctcgattattagataaacttgtggggcactttctcgaagagacgtgtgtaaatccttctttcatcattaaccaacctgagataatgagtcctctggcaaaatatcacagatcaaaaccaggcctgactgaacgttttgaattgttcattaataagcatgaggtttgcaatgcatatacggagctgaatgatcctattgtacaacgggagcgatttgccgagcaactgaaggatcgagaatcaggcgatgatgaagcaatggctttggatgagacattttgtatggctcttgagtatgggttgcctccgactgctggctggggtctaggcatcgatcggctggctatgttgcttactgactcacaaaatatcaaggaggttcttctcttcccagccatgaagcctcaagatgaacctgctgctgctaaagcagcaactcagtgagtttgaactgttgaattcgagaaagtttaatttgtttcttgtatgcgctatcggcattccaagaggaagtcctgccagtcaactttttgttattaattttgctccggttagttattgtttagggttttattatagaaccctttcagtgtggggtattttgtgaagtgccatatcatggtatttattaagtatagtggacatatatattattttaaattttaccaatttgaatcagcttgtt

SEQ ID NO: 1562 - DNA, 2374 bp, Eucalyptus grandis
aggttttttgttaacgccaaccccggtagtacgcgtgcatatcgctgtcgagagcctcctcagcttctttctcatcccagcaaaaaccctagcaccggcggcttctccgtgatataccttcctgctctacacccggtctctcccgtaaggcattgcggcgccgccgtcttccccggcaatggaaggaggtcccgccgacgaagcggcgaaagccgttgcggacctggccgtggacgcctcgtccggagacacgcagagcaagaatgcgcgcaagaaggagctgaagaacaagcagagggaggaagagaggcggcgcaaggaggaggagaaggctaagctggccgctagcaaggcaagttcccagtctcagaaacctggagcagctgatgatgaggacatggatccaacacaatactttcaaaacaggctgaagtatcttgaggcacagaagacagatgggaaaaacccttatcctcacaagtttcaagctttgatgtctatccctgaatatattaaccagtacggaggcttaaaaaatggagagcatcttgaggatgtatccatatctttggctggtcgaatcatgaacaaacgatcttcatcttcaaagctctttttttatgatttgcatgggggtggagcaaaagtgcaagtcatggctgatgctagtaaatcaggtatggatgatgctgagttttcaagatttcattccaacgtgaagcgtggggatattgtgggcatcagtggttttccaggaaaaaccaaaaggggcgagctaagcatatttcccaggtcttttatagttttgtcccattgtcttcacatgatgccaagacaaaaagctgctccaggttcagaaaatgcaaatgtgaagaaaacagaactgtgggttccaggaagtactaggaatcctgaaacctatattttgaaagatcaggaaactcgataccgtcagcgttatctggatttgatgttgaatctggaggttaggcatatatttaagacgagagccaaggtcatacagtatgttaggaagttcctcgatgatcttgacttcttggaggttgagacacctatgatgaacatgattgctggaggagctgctgcccgtccttttgtgactcatcataatgatctaaacatgaggctgtacatgcgtattgctcctgagctttacctgaaggagctggttgttggaggattggagcgtgtttatgagataggaaaacaatttagaaatgaaggaatagatttgactcataatcctgagttcactacttgtgagttctatatggcttttgcagactataatgatataatggagctcactgagaaaatgcttagtggaatggtgaaggaacttactggtggttataaaattaagtatcatgcaaatggacttgacaacgatccaattgagattgatttcactccccctttcaggaggattgacatgatagaagagttggagaagatcgctaatcttgacattccaaaggatctgtcgagtgttgaagctaacaagtacttgatggatgcttgcgctagatttgatgtcaagtgtgctcctccgcaaacgacaactcgtttgttggacaagcttgtgggtcacttcttggaagagacctgtgtgaatcctactttcatcatcaatcatcctgagatcatgagtcccttggcaaagtggcatagatcgaaaccaggcctgaccgaaagattcgagttgtttgccaacaagcatgaactatgcaatgcatataccgaattgaatgatcctgtagtacagcgggagcgatttgccgaacaactcaaggacaggcaatcgggtgatgatgaagccatggctttggatgaaacattctgtaccgcacttgagtatggtttgcctccaactggtggctgggggatgggtattgataggcttaccatgcttttgaccgattcgcagaatattaaggaagtgctcctctttccggctatgaaaccacaagacgagcctccggccaaagctccatcatcttagggatgttgacatacttaaaaactggaacattctggtgtttcgtccattccggtggaaagcactaccatccacctagaatcatagccagtacctcgcgccgtgacccaaaattatctgggtatctacattagtttttaagtacaacttgaagtatttttactgaaaagccagccatagggatgtggaagcacactttgtttggaactttattaatttgattcttggatgctttggtactcattttctctatattatgaggatgtgaaataggcaatgtttttgttaagagtatatgtcgaacactttggctcagagttaatagattgatacacatatgagcaagttctctaa

SEQ ID NO: 1563 - DNA, 1843 bp, Manihot esculenta
atggaaagctctgtcgacgaaacagcaaaagaagtctctaatttatcaatggacgttgagccttcagcttccgaaggagaaaccattagcaagaatgcacgcaagaaggaattgaagaataagcagagggaagaagagagacgccgcaaggaggaggagaaggccaaacaggctgcagagagggctagctccaaggttcagaaatctgcagcagctgatgatgaagatatggatccaacgcaatactatgagaataggctgagatatcttgcttcccagaaggctgaaggaggaaatccttatcctcacaaatttcatgtttcaatgtccgtcgttgagtacatagaaaagtacggaagcttaagcaatggagaacatattgaggatgtcactgaatctttggctggtcgaatcatgaagaaaagatcttcctcttcgaagttattcttttatgatttgcacggtggtgatgttaaagtacaagtgatggctgatgctagcaagtcaggcatggatgaagctgagttttctaggttccactccagtgtgaagcgtggtgatattgttggtgtcattggatttccaggaaaaactaaaaggggagagctgagtatttttccaagatcttttacagttttatctcattgtctccatatgatgccaagggaaaaacctggtcataatgccaatgtgagaagaactgatatctgggccccaggactggccaggaatcctgaagcttatattttgaaagatcaggaaacgcggtatcgtcaacgttatctagatctgatgctgaatgcggaggttcgacaattattcaaggcccgatctaagatcatatcttatctaagggggtttcttgacaatcttgatttcctggaggttgaaacacccatgatgaacatgattgctggcggagctgctgctcggccatttgttactcatcacaatgaactgaacatgaggctctttatgcgtattgcacctgaactttatcttaaagagttagttgttggtggtctggatcgtgtttatgagataggaaagcaatttagaaatgagggtattgatttgactcacaatcctgagttcacaacctgtgagttctatatggcttttgcggactacaatgacttgatggaactaactgagagattgttgagtggaatggtcaaggaacttacaggtggctacaaaattaagtatcacgcaaatgggcttgacaatgatccaattgaggttgactttacaccaccttttagacggattgacatgatagaggagttagagaagatggccaacctcaacataccaaaggatctttctagtgatgaagctaacaagtatcttgttgatgtgtgtgggaggttcgaggtcaagtgtccccctcctcagacaacagctcgtctgttggataagctggtggggcactttctggaagaaacttgtgtgaatcctactttcatcataaaccatcctgagatcatgagtcctttggcaaagtggcacagattgaaaccaggcttgactgaacgttttgaattgtttgtgaacaagcacgagctgtgcaatgcatacactgaattgaatgaccctgtggtacaacgtcagcgatttactgaacaactcaaggaccgacaatcaggtgatgatgaagcaatggcttatgatgaaacattttgcactgctcttgagtttgggttacctccaactggtggctggggaatgggtattgatcgtctagctatgttgttaactgattcccagaatatcaaggaggtgctgctcttcccatccatgaagcctcaagatgaatctcctgctaaaggtatcaaattct

SEQ ID NO: 1564 - DNA, 5284 bp, Vitis vinifera
cagtacaagcatgcttcatggttttttcctattaaacgacgtcgttttattttccgccgctgaatgtcgaagtctccccttcacggcttcaaccatacacttcgtttaaagtttcgcgcgttggcgatatttccatctttacccctccgattctcagctctgcagttctagggtttccagttcatccttaatcgccaatctctctacacagtgttttcacatcatggatggcaacaatgtacactctgaccaagtcattgcagagctgattgaaatgggatttgagttttcagctgttacagaagctatagaagttgttggtccatcattagatgatgctattgagtttattttgaatggtcctcatagatccagtaggggggcatcaagtaattctaaatgtcctaccagcactggaaaagctctggacaaaacagctttgatctcctcgcactctctggatcaaatgcgtcagtctagcttaacagaacatctccaaccagtaggtagatccaaacggatcagaactaattctgtatataatgcagtatcaccctatgggtcagagatgttgcctgagttgtctgcactgccagtttgttgccaacaagagctggagattggaaaggattgggtgcaaagagtcaatagtctcttgcacaagcattttgggattttgtccttgaagagtttccagaaggaagccctgtctgcttggttagctcaccaagactgtcttgttcttgctgcaacaggatctggaaaatctctctgttttcaagtcccagcacttctgacaggaaaggttgtggtagtaatttcacccttgataagtttaatgcacgatcagtgcttaaagcttgcaaaacatggggtgtcagcttgctttctggggtctggacaacctgacagcagtgtggagcaaaaagcaatgagtggcatgtatgagataatttatgtttgcccagagacagtattaagactaataaaaccgcttcagaggcttgcagaaaatcgcggaattgcactatttgcaattgatgaagttcattgtgtttctaagtggggccatgattttcgacccgactacaggcgattatctgtcttgcgagagaacttcagtgcttgcagcttaaaatttttagaatttgatataccaataatggcattgactgctactgcaacaattcgtgtccgagaagatatccttcattcactgtgcatgtcaaaggaaacaaaaattgtgctcacttcatttttccgatcaaatttaaggttttcagtaaaacatagtagaacatcatctccatcttcttatgagaaggatttctctgagttgatagatgtgtacacaaagagcaaggttggtgagaagaaacaaaaaatcttctctcaagagttggatgatgcatctgatgactccaccagctctgctgataggagcttatctgaggcagatagaatgtctccaagtgatgtggaaaacaatgctgcttcaaagcagagacagatgtcagtcgaatatctggaaaatgaggttgacctctttcagagtgtagatgactgggatgtttcctgtggtgaattctctggacaacctcctactgaacatacatttggctcatctgagacattggatccatcaatgaaactggatgaaagattgacacttttgaaggggcctttagaacaaggaccaactatcatatatgttcctactagaaaagaaacattaaacatagcaaaatatctttgtcggtgtggtgtaaaggctgctgcttacaatgcaaagttgccgaaatcacatctaaggcgtgttcacaaggaattccatgataatgctttacaggttgttgttgcaacaattgcttttggaatggggattgataagttaaatgtccgaagaatcatccattatggttggccacagagtttagaagcatattatcaagaagcaggtcgatctgggagggacgggaaattagcagattgcattctatatgctaacctttcaagagtaccaactcttttgccaagtcaaagaagtgaagatcagacaaaacaagcatataagatgttatctgattgcttcagatatggaatgaatactacatgttgtcgagccaaaacacttgtggagtactttggggaggatttttgtcatcaaagttgtatcttgtgtgatgtgtgtgttaatggacctcctgaaaagcagaatttgaaagatgaggcagatacttttatgcacgtgattgctgctcattatgggaagagcagttttgtggatgatttgtatgatgatgtgatatatggtgatgttgaacagcagagattcatggataaactaaatctcaggatgcttgtcagtagaataagagaacagtttcaaaaatttgcagcaattgatctgttatggtggcgaggtcttgctcgaatcatggaagataaagggtacatcagagagggagatgacaggatccatgtccagataaaatttccaaagccaacaaaactgggactggagttcttgcaatccacaacagagcaaacattcgatgtttatccccaagcagatatgctgctctcaacgagaaaccccaaatcttattccactttctcagaatggggaaaaggctgggctgatcctgagattcgtcgccagcgcttagaaaggaggcgatcccaaagaaagcctaggaaaagaaaatcaagaaaacatcaacccaacatgaaaacggctcagcgtcaaaaaatttgggccggcctcaccagaacgaactcaggtttacacgtaggctcagcgcactgtcatcagacttcacgcagaagcctccagctctctagggtttgccggcggcagcagcagcaggagaagcctccatctctcttcactcaaaagctttctatctttccttcaccaaacgctgcgtttcggtcaattctactagcctgaaaaacctaaagctacatttccaatggagggtgctgctgaagaagctgccaaagcaatctcagatttatccatggatggttcttcatctgaaaccataagcaaaaatgctcggaagaaggagttgaagatgaagcagagggaggaggaaaagaagcgcaaagaggaggaaaaagtaaagcaggctgctgcagtctcaagctcgaaggtgcagaaacccatggctggtgatgatgaagatatggatccaactcaatactttgaaaatagggtgaaatatcttgcagctcaaaaggctgctggaaaaaatccatatcctcacaaattctttgttacactatctatccttgaatacatagagaaatatggagccttaagcaatggggatcaccttgaggatgtcacagtatcattggctgggcgaataatgagcaaacggtcatcctcttcaaagctatttttttacgatttgcatggtgatggtgctaaagttcaagttatggctgatgcaaggagctcggatatggatgaggctgaattttctaggttccattctggtgtgaagcggggtgatattgttggtgtcactggctttccaggaaaaaccaaaaggggggagctaagtatttttccaaaatcttttgtagtcttatctcattgtctccatatgatgccaagacagaaagctggtcctggttctgataatgccaatgtgaagaaaactgatgtatgggtcccaggaagtaccaggaatcctgaaacatatattttgaaagatcaggaaactcgatatcgtcaacgttacctggatttgatgttgaatatggaggttcgacaaatattcaagacccgagctaagattatttcatacattagaagctttcttgacaatcttgatttcttggaggttgaaactccaatgatgaacatgattcctgggggtgcagcggctcgtccatttgtgactcatcacaatgatctaaacatgaagttatatatgcgtatcgctcctgaactctatcttaaggagctagttgttggtggattagaccgagtttatgaaatcggaaaacaatttaggaatgagggaattgatttgacccataatcctgaattcactacatgtgagttttatatggcctttgcagactacaatgacgtgatggagctcactgagaaaatgttgagtggtatggtcaaggaacttacaggtggctacaaaattaaataccatgcaaatggcttggataaggatccaattgagatcgacttcactccacctttcaggaggattgacatgatagaggatttagagaagatggcagacctcagcatacccaaggatctctcgagcgatgaagcaaacaaatatttggtggatgcatgcttgaaatttgatatcaaatgcccccctcctcaaacaacggctcgtttgttggacaaacttgtggggcattttcttgaggaggcatgtgtaaatcctactttcatcatcaaccatccagaaataatgagtcctttggcaaagtggcacagatcaaaacaaagcttgactgaacgttttgaattgtttgtcaacaagcatgaactttgcaatgcttacactgaattgaatgatcctgtggtccaacgtcagcgatttgccgaacaactcaaggaccgacaatcaggtgatgatgaagcaatggctttggatgaaacattttgtatggctcttgagtatggattaccacccactggtggctggggattgggaattgatcgacttacaatgatgttaacagattcacaaaatattaaggaagttcttctctttccagccatgaaacctcaagatgagccttcttctgtccagcctcctgcacaaccttctacccaagctgtgtaggggttggaagactgaaatcttgaatggatgtttcatcggtgcacgtttttgggcttgctgtcaagttttgatcgttaatttactatcacaacgacagtgacaatggctgcttccatgttgttcaaagccgaaagagaaaatcataaaccctagacaccaaacatgaaacaaatcccgggaagcagtgatgagaagggtttaaacattggaatttataacggtttggctaagataccaaagactttgaaattttttaatatatatatatatatatatatagagagagagagagagagagagagataatgataaaaaatgatttatcagatttatttttttatttttttaaaagtgatttaaaattcgaatttcatgataaaataaattaatgaaatgaaatattattgtaaaaaataaatatttagaaagctatacgtggggctgac

SEQ ID NO: 1565 - DNA, 2329 bp, Castanea mollissima
gcggattctcactgttcgcgtatcagctctcagacctctatctctctatactaaccccgtttccatccctacctcctctctctctctctctcttgtaacgtgagaaccaggatttccgattggtctaggtcttattaaaaatggagggctcagttgttgatgaaaaggagaaagcagtggtgacagactcccctgctgctggggaaactctcagcaaaaatgcactcaagaaggaattgaagaataagcaaagggaagaagaaaggcggcgcaaggaggaggagaaggcaaaacaggctgcttctatggcagattcccgcagcaagaaatctgcagcagctgacgatgaagatatggatccaacgcaatactttgaaaatagactgaaatatcttgtagctctgagggcagctggtgaagagccatatcctcacaaatttcctgttacaatgtctatccctgaatatgtagagaagtataacaacataggcaatggggagcatcttgaggatgatactgtaaatttggctgggcgtatcatgagcaaacgttcatcttcttccaagctattcttttatgatttacatggtggtgctgctaaagtccaagttatggctgatgctagcaagtcagatttgaatgaggaagaattttctaggttccattcgactgtgaagcgtggtgatattgttggcgtcaaggggtttccagggaaaactaaaaggggggagctaagtatttttccaaaatcgtttatagtcttatcccattgtctccatatgatgccaaggcaaaagcctaaggctggttctgtgtctgacaataccaatttgaagaaagaggaggcttgggtcccaggatgtaccaggaatcctgaaacatatgttttgaaagaccaggaaactcgttatcgacaacgctatttagatttgatgttgaatatggaggttcgacaaatttttaagacaagatcccagatcatttcatatattcggcgctttcttgacagtcgtgatttcttggaggttgaaacaccaatgatgaatatgattgctggtggagcagctgcccgtccgtttgtgacccatcacaatgacctgaacatgaagctattcatgcgcattgcgcctgagctctatcttaaggagcttgttgttggtggacttgaccgtgtttatgagattggaaagcagttcagaaatgagggcattgatttgacgcataatccggagttcaccacctgtgagttctatatggcttttgctgactacaatgacttgatggaactcactgagataatgttgagtgggatggtaaaggaacttacaggtggatataaaattaaatatcatgcaaatgggctggatgaggatccaattgagattgacttcactccacctttcagaaggattgacatgatagaagaattagagaagatggcaaacctcaatattcccaaggacttttccagtgatgaggccaacaaatatctgaaagacgtatgcacgaagtatgagatcaaatgtgcccctcctgaaacaacagcacgtttgttggacaaacttgtaggacacttcttggaagagacttgtacaaatcctgctttcataattaaccaccctgagttaatgagtcctttggctaagtggcatagaacgaagaaaggccttactgagcgttttgagttatttattaacaagcatgaactttgcaatgcatacactgaattgaatgaccctgtggtacaacgccagcgatttgctgagcagctcaaggatcggcaatctggtgatgatgaagcaatggctttggatgaaaccttctgtacggctcttgagtatgggttgcctccaacaggtggttggggattgggtattgatcggctaacaatgttgttaactgattcacaaaacattaaggaggttcttctcttcccagccatgaaacctcaagatgagccatctgctaaaggcaatgcaggagcttaggaaattttcaaaattctggaaaccagagctctcaacccagaaagttggcatgaacccaaggcaggagcttaggaaattcctttttatgggttgaaataccatccatccttgttaattcagtttactaattatgtcattcttcatatatctatttatttttagtttttggcaaattcaaaatattttgtgaaattaaatgaagaatcaagttattagaactgttgtaatctctctctcatatatttatgcatattttggagtttggagactcttgaaactcctatttatatttttttgtatgtgaattttgaaaatctaatagtttgttattaaatttctag

SEQ ID NO: 1566 - DNA, 2295 bp, Quercus alba
ggtcttattaaaaatggagggctcagtcgatgaaaaggagaaagcagtcttgggttcggtgacaggctcccctgctgctggagaaactgtcagcaaaaatgcactcaagaaggaattgaagaataagcaaagggaagaagaaaggcggcgcaaggaggaggagaaggcaaaacaggctgcttctatggcagattcccgcagcaagaaatctgcagcagctgacgatgaagatatggatccaacgcaatacttcgaaaatagactgaagtatcttgcagctctgagggcagctggtgaagagccatatcctcacaaattccctgttacaatgtctaaccctgaatatgtagagcagtataaaaacataggcaatggggagcatcttgaggatgttactgtaaatttggctgggcgtatcatgagcaaacgctcatcttcttcaaagctattcttttatgatttacatggtggtgctgctaaagtccaagttatggctgatgctagcaagtcagatttgaatgaggaagaattttctaggttccattcgactgtgaagcgtggtgatattgttggtgtcaaggggtttccagggaaaactaaaaggggggagctaagtatttttccaagatcgtttatagccttatcccattgtctccatatgatgccaaggcaaaagcctaaggctggttctgtgtctgacaatgccaatttgaagaaagaggaggcttgggtcccaggatgtaccaggaatcctgaaacatatattttgaaagaccaggaaactcgttatcggcaacgctatttagatttgatgttgaatatggaggttcgacaaatttttaagacaagatctcagatcatttcatatattcggcgctttcttgacagtcgtgatttcttggaggttgaaacaccaatgatgaatatgattgctggtggagcagctgcccgtccgtttgtgacccatcacaatgacctgaacatgaagctattcatgcgcattgcgcctgagctctatcttaaggagcttgttgttggtggacttgaccgtgtttatgagattggaaagcagttcagaaatgagggcatcgatttgacgcataatcctgagttcaccacctgtgagttctatatggcttttgctgactacaatgacttgatggaactcactgagacaatgttgagtgggatggtaaaggaacttacaggcggatataaaattaaatatcatgcaaatgggctggatgaggatccaattgagattgacttcactccacctttcagaaggattgacatgatagaagaattagagaagatggcgaacctcaatattcccaaggacttttccagtgatgaggccaacaaatatttgaaagacgtatgcacgaagtatgagatcaaatgtgcccctcctgaaacaacagcacgtttgttggacaaacttgtaggacacttcttggaagagacttgtacaaatcctgctttcatcattaaccaccctgagttaatgagtcctttggcaaagtggcatagaacgaagaaaggccttactgagcgttttgagttatttattaacaagcatgaactctgcaatgcatacactgaattgaatgaccctgtggtacaacgccagcgatttgctgagcagctcaaggatcggcaatctggtgatgatgaagcaatggctttggatgaaaccttctgtacggctcttgagtatgggttgcctccaacaggcggttggggattgggtattgatcggctaacaatgttgttaactgattcacaaaacattaaggaggttcttctcttcccagccatgaaacctcaagatgagccatctgctaaaggcaatgcaggagcttaggaaattttcaaaattctgaaacccagagctctcatcccggaaagttggcatgaacctttgatcgatgtgatttccgtcataactgaatttcttggggattttgtcactttttatgggtcgaaataccatccatccttgttaattcagtttactaattgtgtaattcttcatatatctttttatttttagtttttggcaaattcaaaatatcatgtgaaattaaatgaagaatcaagttattagaactgttgttgtctctctctcatatatttatgcataattgggagtttggagaaaaactcttgaaactcttatattttcttattggattcgaattttgaaaatttaactattagtttacatgttattatatcctctatgcttgcaaaatttcaagaagatcaaagattaacaattatgtcatcaag

SEQ ID NO: 1567 - DNA, 2588 bp, Ricinus communis
aataaaaaccctactcctcctactgctaaaaccagtatagcgccgtgacaatataatctcttccgtatttccatttctgcaaagaggctgcacggaagagaaatggaaggctctgttgatgaaacagcaaaagcagtttccaatttagctatggagggcggccctgaagctcttagcaagaatgctttgaagagggaacttaaaatgaagcagaaggaggaagagagacgccggaaggaggaggagaaggcggccaagcaggctgctctcaaggcccaaggtcagaaatctgcagcagctgatgaggaggatatggacccaacacaatacttcgaaaataggctgaaatatcttgcttcccaaaaggctgaagagagaaatccatatcctcacaagttctgtgttacaatgtccattgaggagtacaaacaaaagtatggaggcttaaacgacggagagcatcttgaggatgtcactgtgtctttggctgggcgaatcatgaaaaaacgatctgccgctgcaaagctcttcttttatgatttgcatggtggtggtgttaaagtccaagtgatggctgattttagcaaatcagacatggaagaagctgagttttctaagttccattccaatgtgaagcgtggtgatattgttggtgtcactggctttccaggaaaaaccaaaaggggagaactgagtatttttccatcatcttttgctgttctatctcattgtcttcatatgatgccgaaagaaaaagctggtcctggtgcagttaatgccaatagaactgatgtttggctcccaggatgtcccaggaatcccgatacatatattttaaaagatcaggaaactcgttatcgacaacggtatcttgatttgatgttgaatctagaggttcggcagatattcaagaccagatcgaggatcataacatatattagaagctttcttgacagccttgattttttggaggttgaaacacccatgatgaacatgattgctggtggagctgctgctcgtccatttgtgactcatcacaatgaattaaacatgaggctgtttatgcgaattgcaccggagctttaccttaaagagttggttgttggtggacttgatcgtgtatatgagataggaaaacagtttaggaatgagggtattgatttgactcataatcctgagttcacaacctgtgagttttatatggcttttgccgattacaatgacttgatggaactaactgagagattgttgagtggaatggtcaaggagcttacaggtggccacaaaattaagtatcatgcaaatgggctggagaaggatcctattgagattgattttacacctccttttagacgaattgacatgatagaggagttggagaagatggccaatctgaacataccaaaggaccttaccagtgatgaagctaacaagtatctggtggccgcatgtgagaggtttgaggtcaagtgtcctcccccacaaacaactgctcgtttgttggataagttggttgggcactttctggaggaaacttgtgtgaatcctactttcatcatcaatcatcctgagatcatgagtcccttggcaaaatggcatagatcaagacctggcttgactgaacgttttgaattgttcatgaacaagcatgaggtttgcaatgcatacactgaattgaatgaccctgtggtacaacgagagcgatttgctgatcaactcaaggaccgacaatctggtgatgatgaagctatggctttggacgagacattttgcacagccctcgagtatgggttacctccaactggtggctggggaatgggtatcgaccgcctagctatgatcttaactgattcacagaatatcaaggaagtactactcttcccagcaatgaagcctcaagatgaacatcctcccaaagcaacttaagctattatcagagctttgacatgtagagctgagtttcaatccatgtgcgcttgtcgcggaggtagacatgttgtcacactgctagataaatatttttttgtccgaatctcattcttatttgggtttgatcatttgacctatacttatttaatgaagaatttgaaatgttgtgatgtacctcattataatatatatagcagatgtaagtgtttcttcgttctacctaactgacatggtttcccctaggtagcctctcccaaaattgattcttattttgtaaggcaaggaggcggtggagaggtaaacccacagtgcaggtattgtttgtttgtaagatgcatgtctctttgctgattatcgatgcttttgtacagcctctcggtggctgtacctgataatctctttcaacatcacaaagctcagtccacttgtttgttgctttaaaagtcaaatgagtgcattaaacttgatgaataatgagatacatcaacttttatgacagggcggctgcaatctttcacatttaatttcatagttataaaatatcaggaaaaccttcaaatatgaaaaaggttatgattagtgttaggtatacgtcgactttggtgtatatgtactcttatgtttgtgctaataaacaggagcctcaagtgtccatatta

SEQ ID NO: 1568 - DNA, 2281 bp, Panax ginseng
actgcctcacacctcaacacccgtaccccttattcatcttctccagtcagccgcacctggcatcaccgtagcaatcagtgaagagatagagagattacgaacgtcgacgtaaagggcaagaaattggaacttaggaatctgcaaattttgttctagctccactgcgtctcatttgtatcatatacagaatggagggaacaattgaagaaacatctaaagcagttgctgatctatctgttaacaacagtactcttactcaatcagaaccagaagtcctcagcaagaatgctcgcaagaaagaattgaagaataagcagaaagaggaggaacgacaacgtaaggaggcggagaaggagaaaaagggtgctgcagtgccaagttcacaggttcagaagtccttagcaacagatgatgatgacattgatccaacgcaatactttgaaaataggcagaaagcacttgcagctcataaagcagctggaaataatccgtatcctcacaaattccttgtgtccatgtctgttccagaatacatagagaagtttgaaggcctagatagtggggaacatcttgagaacgtcgaagtatctttggctggacgaattatgaacaaacgatcgtcatcttcaaagctgttcttttatgatttgcatggtggcggtgccaaagtccaagtaatgactgatgcaaggagatctgatttggatgaagctgaattttcaaagctacatgctggtgtgaagcgtggagatattgttggtattattggaattccaggaaagagcaaaaggggggagctgagtatttttccaaaatcattcatagtgttatcccattgcctccatatgatgccaaggcagaaagtttcgtctggttctgataacgccaatgtgaagaaaactgatgtatgggtcccaggaagtggcaggaaccctgaaacttatatattaaaggatcaggaaactcgataccgtcaacgatatctagatttgatgcttaacatagaggttcgacatatattcaagacccgcgcaaagatcatttcttatattagacgttttcttgacaatctagattttctggaggttgaaacacccatgatgaacatgattgctggaggagcagcagctcgtccatttgtgacccatcacaatgacctgaacatgaagctgtttatgcgcattgcaccagaactttatctcaaggagcttgttgttggtggactcgaccgtgtctatgaaatagggaaacaattcaggaatgagggaattgacttgactcataatcctgaattcactacatgtgagttttatatggcttttgcagactacaacgacctgatggagctaactgaaagaatgttgagtgggatggtcaaggaacttacaggtggttataaagttaaatatcatgcgaatgggttagacaatgacccaattgaaattgacttcactccccctttcagaagaattgatatgatagaagatttggagaagatggctgatcttaacatacccaaggacctttctagcaatgaagcaaacaaatacttagctgatgcatgcacgaactttgagatcaaatgccccccacctcaaacaactgctcgagtgttggataaacttgtggggcactttctggaggagacatgtgtaaaccctactttcatcattaaccacccagagataatgagtccattggcgaagtggcacaggtccaagccaagcctgactgaacgatttgaattgtttatcaacaaacacgaactttgcaatgcatacactgaactgaatgatccggtggtacagcgccaacggtttgcggaccaacttaaggatcggcaatcaggcgatgatgaagcgatggctttggatgaaacattctgtacagctcttgaatacgggctacctccaactggtgggtggggattgggaattgatagacttgcgatgattttgacagattcacagaacatcaaggaagttctactctttccagccatgaaaccacaggatgaacctccaactaaagctgctgctgcacagataattaagaagggtgaaactataccagatttgttttttgtgaagtggtaggactggactctcctcaacaattatttgtcactatgagaagtagtgacggtcacatgtttggtgttatataaatacacaactcatcatgtaatgaaatgttgttcactcctttgaaatgacgagtgcaaaaccactgaagtgaatgctaacagagattgatctatttatgaaaggcatgttttgat

SEQ ID NO: 1569 - DNA, 2343 bp, Panax ginseng
cagtgaagagattacgaacgtcgacgtaaagggcaagaaattggaacttaggaatctgcaaattttgttctagctccactgcgtctcatttgtatcatatacagaatggagggaacaattgaagaaacatctaaagcagttgctgatctatctgttaacaacagtactcttactcaatcagaaccagaagttctcagcaagaatgctcgcaagaaagaattgaagaataagcagaaagaggaggaacgacaacgtaaggaggcggagaaggagaaaaagtgtgctgcagtgccaagttcacaggttcagaagcccttagcaacagatgatgatgacattgatccaacgcaatactttgaaaataggcagaaagcacttgcagctcataaagcagctggaaataatccgtatcctcacaaattccttgtgtccatgtctgttccagaatacatagagaagtttgaaggcctagatagtggggaacatcttgagaacgtcgaagtatctttggctggacgaattatgaacaagcgatcatcatcttcaaagctgttcttttatgatttgcatggtggcggtgccaaaatccaagtaatgactgatgcaaggagttctgatttggatgaagctgaattttcaaagttacatgctggtgtgaagcgtggagatattgttggtattattggaattccaggaaagagcaaaaggggggagctgagtatttttccaaaatcattcatagtgttatcccattgccttcatatgatgccaagacagaaagtttcgtctggttctgataacgccaatgtgaagaaaactgatgtatgggtcccaggaagtggcaggaaccctgaaacttatatattaaaggatcaggaaactcgataccgtcaacgatatctagatttgatgcttaacatagaggttcgacatatattcaagacccgcgcaaagatcatttcttatattagacgttttcttgacaatctagattttctggaggttgaaacacccatgatgaacatgattgctggaggagcagcagcccgtccatttgtgacccatcacaatgacctgaacatgaagctgtttatgcgcattgcaccagaactttatctcaaggagcttgttgttggtggactcgaccgtgtctatgaaatagggaaacaattcaggaatgagggaattgacttgactcataatcctgaattcactacatgtgagttttatatggcttttgcagactacaatgacctgatggagctaactgaaagaatgttgagtgggatggtcaaggaacttacaggtggttataaagttaaatatcatgcgaatgggttagacaatgacccaattgaaattgacttcactccccctttcagaagaattgatatgatagaagatttggagaagatggctgatcttaacatacccaaggacctttctagcaatgaagcaaacaaatacttagctgatgcatgcacgaactttgagatcaaatgccccccacctcaaacaactgctcgattgttggataaacttgtggggcactttctggaggagacatgtgtaaaccctactttcatcattaaccacccagagataatgagtccactggcgaagtggcacaggtccaagccaagcctgactgaacgatttgaattgtttatcaacaaacacgaactttgcaatgcatacactgaactgaatgatccggtggtacagcgccaacggtttgcggaccaacttaaggatcggcaatcaggcgatgatgaagcgatggctttggatgaaacattctgtacagctcttgaatatgggctacctccaactggtgggtggggattgggaattgatagacttgcgatgattttgacagattcacagaacatcaaggaagttctactctttccagccatgaaaccacaggatgaacctccaactaaagctgctgctgcacagataattaagaagggtgaaactataccagatttgttttttgtgaagtggtaggactggactctcctcaacaattatttgtcactatgagaagtagtgacggtcacatgtttggtgttatataaatacacaactcatcatgtaatgaaatgttgttcactcctttgaaatgacgagtgcaaaaccactgaagtgaatgctaacagagattgatctatttatgaaaggcatgttttgatacaaaaaaaaaaagaaaaaagaaaaaagaaaaaaagaaaaaagaaaaaagaaaaaagaaaaagaaaaagaaaagaaaagaaagaagaagagagagagagagagagagagagagggagaggggggggggggggggggggggggggg

SEQ ID NO: 1570 - DNA, 2266 bp, Panax ginseng
ccgtgtgccttcgctcccaccgacttccacacctcaacacccgaccccttacttcatcttctccagtcagccgcacctggcatcaccgtagcaatcagtgaagagattacgaacgtcgacgtaaagggcaagaaattggaacttaggaatctgcaaattttgttctagctccactgcgtctcatttgtatcatatacagaatggagggaacaattgaagaaacatctaaagcagttgctgatctatctgttaacaacagtactcttactcaatcagaaccagaagtcctcagcaagaatgctcgcaagaaagaattgaagaataagcagaaagaggaggaacgacaacgtaaggaggcggagaaggagaaaaagggtgctgcagtgccaagttcacaggttcagaagcccttagcaacagatgatgatgacattgatccaacgcaatactttgaaaataggcagaaagcacttgcagctcataaagcagctggaaataatccgtatcctcacaaattccttgtgtccatgtctgttccagaatacatagagaagtttgaaggcctagatagtggggaacatcttgagaacgtcgaagtatctttggctggacgaattatgaacaaacgatcgtcatcttcaaagctgttcttttatgatttgcatggtggcggtgccaaagtccaagtaatgactgatgcaaggagatctgatttggatgaagctgaattttcaaagctacatgctggtgtgaagcgtggagatattgttggtattattggaattccaggaaagagcaaaaggggggagctgagtatttttccaaaatcattcatagtgttatcccattgcctccatatgatgccaaggcagaaagtttcgtctggttctgataacgccaatgtgaagaaaactgatgtatgggtcccaggaagtggcaggaaccctgaaacttatatattaaaggatcaggaaactcgataccgtcaacgatatctagatttgatgcttaacatagaggttcgacatatattcaagacccgcgcaaagatcatttcttatattagacgttttcttgacaatctagattttctggaggttgaaacacccatgatgaacatgattgctggaggagcagcagctcgtccatttgtgacccatcacaatgacctgaacatgaagctgtttatgcgcattgcaccagaactttatctcaaggagcttgttgttggtggactcgaccgtgtctatgaaatagggaaacaattcaggaatgagggaattgacttgactcataatcctgaattcactacatgtgagttttatatggcttttgcagactacaacgacctgatggagctaactgaaagaatgttgagtgggatggtcaaggaacttacaggtggttataaagttaaatatcatgcgaatgggttagacaatgacccaattgaaatcgacttcactccccctttcagaaggattgatatgatagaagatttggagaagatggctgatcttaacatacccaaggacctttctagcaatgaagcaaacaaatacttagctgatgcatgcacgaactttgagatcaaatgccccccacctcaaacaactgctcgattgttggataaacttgtggggcactttctggaggagacatgtgtataccctactttcatcactaaccacccagagataatgagtccactggcgaagtggcacaggtccaagccaagcctgactgaacgatttgaattgtttatcaacaaacacgaactttgcaatgcatacactgaactgaatgatccggtggtacagcgccaacggtttgcggaccaacttaaggatcggcaatcaggtgatgatgaagcgatggctttggatgaaacattctgtacagctcttgaatacgggctacctccaactggtgggtggggattgggaattgatagacttgcgatgattttgacagattcacagaacatcaaggaagttctactctttccagccatgaaaccacaggatgaacctccaactaaagctgctgcatagataattaagaagggtgaaactataccagatttgttttttgtgaagttcagtggtaggactctccttaactaagagaactactgacagtcaaaatcttttttatcttctttatccggactcacatatttggttatataaatacacaactcagcatgtaatgaaatgttgttcactgttcttactcctttcaaatgacgagtgcaaaaccactg

SEQ ID NO: 1571 - DNA, 2616 bp, Panax ginseng
agtggtatcaacgcagagtacatgggggaccgggtaaatagaagaatttattctcctgtcgaaaacccctaatccatcagtcattacgctctcaaaaccctgcccccttttgttttctacgatcagccgcaccagtctgccgagagatcgagagaggaggaacgacgacgtaaagaaaaaaatgggaggaacaattgaggaatcatctaaagcaattgctgatctatccgttgacaactctaatcctatgcaatcagaaccagaagttctcagcaagaacgctcgcaagaaagaattgaaaaataaacagaaagaggaggaacgacgacgtaaggaggaagagaaggagaaaaaggttgctgccatgccaagctcacaggttcagaagcccttggcaacagaggacgaggatatggatccaacgcaatactttgaaaataggctgaaagcacttgcagctcataaggcagctggcaataatccatatcctcacaaattctctgtgtcaatgtctgtcctagaatacatagagaagtttgaaggcctagatagcggggaacatcttgagaatgtcgtagtatctttggctggacgaattatgaacaaacgatcatcatcatcaaagttgttcttctatgatttgcatggtggtggtgccaaagtccaagtaatgactgatgcaaggagatctgacttggatgaagttgaattttcaaagttccatgctggtgtaaagcgtggagatatcgttggcattactgggtttccaggaaagagcaaaaggggggagctgagtattttcccaaaatcattaatagtgttgtctcattgcctccatatgatgcctagacagaaagttgctcctggttctgataacaccaatgtaaagaaaactgatgcatgggtcccaggaagtggcaggaaccctgacacttatatcctaaaagatcaggaaactcgttatcgtcagcgatacttggatttgatgttgaacatagaggtccgacatatattcaagacccgcacaaagattatttcttatattagacgttttcttgacaatctagactttctggaggttgaaacaccaatgatgaacatgattgctggaggagctgccgcccgtccatttgtgacccatcacaatgatctgaacatgaagctgtttatgcgcattgcaccagaactttatctcaaggagcttgttgttggtgggctcaaccgtgtctatgaaatagggaaacaattcaggaatgaggggattgacttgacacataatcctgaattcagtacatgtgagttttatatggctttcgcagactacaatgacttaatggagctaactgaaagaatgttgagtgggatggtcaaggaacttacaggtggttataaagttaaatatcacgtgaatgggttagacaatgacccaatcgaaattgacttcacaccccctttcagaaggattgatatgatagaagatttggagaaattggctgatcttaacatacccaaggacctctctagcgatgaagccaacaaatatttagctaatgcatgcacaaagttcgagatcaaatgccccccacctcaaacaactgctcgtttgttggataaacttgtggggcactttctggaggagacgtgtgtaaaccctactttcatcattaatcacccagagataatgagtccactggcaaaatggcacaggtccaagccaagcctgacggaacgatttgaattgtttatcaacaaacacgaactttgcaatgcatacaccgaactgaatgatcctgttgtgcagcgccaacggtttgctgaccaacttaaggaccggcaatcaggtgatgatgaagcaatggctttggatgaaacgttctgtacagctcttgaatatgggttacctcctactggtgggtggggattaggaattgatcgacttgcaatgatgttgacagattcacagaacatcaaggaagttttactctttccagccatgaaaccacaggatgaacctcctaccaaagaggtaggaactctcctcaacttgtagtctgttctcaaagattttctcaccaagagatctggaagtcgggcatcagttatatactacccaacgatactgtcatggtttgtggttaattgctcatcattctattggagtggttggcaccatacttgtcaattatactatactagtggtggataaacttctaattagttgctaaatgattgaatagtaagcatagatttgaggtattatggaaacatgctatgactctctctctcactaacaaaaacacacttgcgagaggcttgaggtgaaggttgcagataaaatgcttaaataaagtagtgtagttgtgtagataaaataaagcctgaagttttagtgtaatgtaagtttgtatgaagagttgttcgtttatccttgagatgatggtacttaccgctacagcatttagtaattactctctccgtccaacaaaaagtcttatttaatatttaaaatttgatgtgaatttatttgattttgattaatgtaatattacccagattcttattttagtaaaaaaaaaaaaaaacaaaaaaaaacaaaaaaaataaaaagtaagtagg

SEQ ID NO: 1572 - DNA, 2128 bp, Prunus persica
acacaaaaaccccacaaagccctctgttgctctcccttcacataaggagtcgctgcaatggcaggcactgttgacgaaacaacgaaagcggtctcagatttgacaatggaatcggaaggagctatgagcaaaaatgcacgcaagaaggagctgaagaacaagcagaaggaagaggagaagcggcggaaagaggaggagaaggcaaagcaggccgctgcaacagcaagttcacaggttaagaaaattggagctactgaagatgaagaaatggatccaacgcaatactttgaaaacaggctgaagtatcttgctacccagaaggcagataataaaaatccatatcctcacaaattctttgtttcaatgagtgtgcttgaatatgtagagaagtatgacggcttaagcaatggggagcatcgtgatgagatcagtgtatcgctagctgggcgaatcatgagtaaaagatcctccagctctaagcttttcttttatgatttacatggtggcggacctggtggtggaaaggtccaagtcatggctgatttaagcaaatcagagttggatgaatctgaattttctaagttccattctagtgttaagcggggtgatattgttggtgtgactgggttcccagggaagacgaagaggggggagctgagcatttttccaagatcatttatagtcttatcacattgtcttcatatgatggcaaggcagaaagctggtcctgcttctgataatgctaatgtgaagaaaattgatggatgggtcccaggaagcccaaggaatcctgaaacttatattttaaaagaccaggaaactcgttatcgtcaacgctatctggatttaatattgaataccgaggttcgacaaatattcaagaccagatctaagatcattcaatatgttagaaggttcctggacaagcgtgatttcgtggaggttgaaactccgatgatgaatatgattgctggtggagcagctgcccgcccttttgtgacttatcacaatgaacttgacatgaggcttttcatgcgcgttgcacctgaactatatctcaagcagttagttgttggtggcctggaacgtgtttatgagattggaaaacaatttagaaatgagggtattgatttgactcataatcctgagttcactacctgtgaattctacatggcttatgcagactacaatgacgtgatgaccctgaccgaggaattgttgagtgggatggtcaaggaactcacaggtggatacaaaatcaagtatcactcaaatgggcttgataaggatccaattgagattgacttcactcctcccttcaggaggatcgacatggttgaggaattaaataagattgcagatctcaacataaatccagcagatctctctagtgaggaagctaacaaatatcttaaggaggcatgcaagaagtttgatatcaaatgttctcctcctgaaaccacagctcgtttgttggacaagcttgtggggcactttctggaagagacttgtgtacatcctgcatttatcattaaccatcccgagataatgagtcctttagcaaagtggcatagatcaaaacctggcctgactgagcgttttgagttgtttatcaacaagcatgaacttgctaatgcctacactgaactaaatgatcctgtggtacaacgccaacgatttgctgatcagctcaaggatcgacagtcaggtgacgatgaagcaatggctttggatgaaacattttgtggagctcttgagtatgggttacctccaactggcggttggggtttgggcatagatcgactatctatgttgttaactgattcacagaacattaaggaagttcttctcttcccagctatgaaaccacaggaagagccttctgctaaagcaaccgcaagctcttaggattattgggacacagcttttattatacttggaaggggtggtcttgtcgatggcctgcggtcactcttttctttttttttgtactgttgtacctcaagtttttgggtaacatctaaaatgtcagattatggatatagggtttactatattcttcatcactcacttgtgaatgcgactaatctatttattgaagtgtcaaattgttggacttcttctacaa

SEQ ID NO: 1573 - DNA, 2309 bp, Populus trichocarpa
ttgaagaataagaagaaagaaaaagaggaagagaaagctagacaggctgctgccaaggccagcacccaggttcagaaatctgcagcggcagccgatgatgaagacatggatcccacgcaatattatgaaaataggctgaaatatcttgatgctcagaagggagaagggaaaaatatgtaccctcataagttttttgttaccctgtccatccctgaatatattgacaagtatggggggttaagcaatggagagcatcttgaggatgtctctgtgtctttggctggtcgaataatgagtaaaagatcttcctcttcaaagttgttcttttatgatctgcatggtcttggtgctaaggtccaagtgatggctgatgcaagcaagtcaggtttcgatgaagcagagttttctaagctccattccagcgtgaagcgtggtgatattgttggtatcactggatttccaggaaaaaccaaaaggggagagctgagcatctttccaacatctttcatggttttatctcattgtctgcacatgatgcccaggcagaaagctggtcctggctcggatgctagtgcaaagaaatctgaggtttggaccccaggatcagtcaggaaccctgaagcatatattttaaaagatcaggaaacacgttatcgtcaacgatatctggatctaatgttgaattcagaggttcgacaaattttcaagaccagatctaaaatcattaaatacatacagaactttcttgacgatcttgatttcttggaggttgaaacaccaatgatgaatatgattcctggtggtgctgctgctcgtccattcaaaactcatcataatgatctgaacatgaagctgtacatgcgcattgcacctgaactctatcttaaagagttagttgttggtggacttgatcgtgtttatgaaattggaaaacaatttaggaatgagggtattgatttgacacataatcctgagttcacaacctgtgagttctatatggcttatgctgactacaatgacttgatggaactcactgagaagatgttgagtggcatggtcaaggaacttacaggtggctacaaaattaaatatcatgcaaatgggcttgacaaggatccaattgagattgactttacaccaccgtttagacggattgacatgatagaggagttggagaagatggccaacctcaatatacccaaggacctttccagtgatgaagctaccaagtatcttgtggctgcatgtgagaagtttgaggtcaagtgcccccctcctcaaacgacaactcgattgttagacaaactggtgggacactttctggaagagacttgtgtaaacccctccttcatcatcaaccatcctgagattatgagtccgttggcaaagtggcatagatcgaaaccaggcttgactgaacgctttgaattgtttgtcaacaagcatgaactttgcaatgcatacactgaattgaatgatcctgtggtacaacgacaacgatttgaagcacaactgaaggatcgacaatcaggtgatgatgaagcaatggctttggatgaaacattttgtatggctcttgaatatggattgccaccaactggtggatggggactaggcattgatcggttagctatgctgttaactgattcacagaatataaaggaggtgcttctcttcccagccatgaagcctcaggatgagcctcctgctaaagctacttccggtgtttgaaattttgagatttgcagtagaggtggctgtgttgtcaactttttgtagtgtttttttggctccaaactgataattatttggatttgtcatcggacacttgccgcagaggagggcttgacaagctacacgatactcattaattatagcagatgtagttttgtttcagttcttgactgtgagttgaatgatttggagatttttttaaaaacaaatctattttgcggtataaaagtctcttgtgcactgacggtataaaagtttcaagagctgcatcatatggaacttcgtgtttttggttgatgggtaaaactaaccgtttaagaacatttaaaaactccattaattatccatttttttagggatatagagcatattaattattatctccttaaatcctgtaacttgagaataaagttactcaagtgtcctttttctattttaaattggaatattcacctttacattaattcttttcttttggctttttttctcctcgacaaatccaccgagaacttaattttatctcatactttaacgtgctgactatcagcttttaatttgaagaataaataaaaact

SEQ ID NO: 1574 - DNA, 2296 bp, Citrullus lanatus
aacggtgtggtagtttcgtctccgtgaaaccctaaaattgaaacccactttccaatttttgctgttagaataatcctttccggctcggcggcggctctgtcttcatcaattctcccctccacgccttgcactccaagcaatctgcgtgctttataagcttcttcccattggagctttgactcttcatctgaaaatggcggattctatcgacggagctgcaaaggctgtctctgatttagcattgggttccgctactgccgctccagacacggcccactctgctccaagtgctgaagaaactataagcaagaatgcacgcaagaaggaattaaaactgaagcagaaggaagaggaaaggaagcgtaaggaggaactgaaggagaaagcaaaacaggaagcaccccagaataagaaatctgtagcagtagatgatgaagaaatggatcccacgcaatattttgaaaataggctgaaatatcttgcatctcagaaggcagatggtaaaaatccatatcctcacaagtttcaggtctcaatgtctctccctgagtacattgagaaatatggaagcttaagcaatggtgatcatcttgaggaagtcttggtatctctcgccgggaggataatgagtaaaagatcatcctcctcgaagttgttgttctatgatctccatggttctggagctaaaatccaagttatgacggatgcacgtaactcagagctagatgaagctgaatttgctaggtttcatgccagtgtaaagcgtggggatattgttggtgtcactgggtttccaggaaaaacgaagaggggagagctcagtatctttccaaagtcattcattgtcctttctcactgtctgcacatgatgccaaggcagaaggcggctcctggttctgagaatgcaaatgtgaagaaaaatgacacatgggtcccaggttgtaccaggaatcctgaaacctatattttaaaagatcaggaaactcgttatcgtcaacgatatctggatttgatgttaaatttggaagtgaggcaaatattcaaaaccagagctaaagtaatccaatatgttaggaagtttcttgatgatcttgacttcttggaggttgaaacgccaatgatgaacatgattgctggaggagcagcagcccgtccatttgtgaccttccacaatgatcttaacatgaaattgtttatgcgcattgcacctgaactctatcttaaggagttagttgttggtggattagaccgtgtatatgagataggaaagcaatttagaaacgagggtattgatttgactcataatcctgagttcaccacctgtgagttctacatggcgtttgctgactacaatgatttgatggaacttactgagaagatgctaagtgggatggtgaaggagcttactgggggctataaagtaaaatatcattccaatgggcttgataatgatccaattgagatcgacttcactccccctttcaggaggattgacatgatagaggaactagaaaagatggcaaatctcaatatacccaaggacttgtctagtgatgaagcgaataaatatcttagggaggcatgccaaaagtttgaaatcaaatgtcctccacctgaaacaactgctcgcttgctggataaacttgttgggcacttcctagaagaaacgtgtgtgaatcctgctttcatcatcaaccatccagagattatgagtcctttggctaagtggcacagggcaaggcctagtctaactgaacgtttcgaattgttcatcaacaaacatgaagtatgtaatgcttacacagaattgaatgatcctgttgtacaacgccagcgatttgctgaacaacttaaggaccggcaatcgggtgatgatgaagcaatggctttggatgaaacgttttgtacagctcttgagtatggattgcctcctactggtggctggggaatgggcattgataggctagctatgttgttgacggattcacagaacatcaaggaagttcttctattcccagccatgaagcctcaagatgaaccaccagctcccaaagcctcaagtggagtataggcattattacaatatgaggaaatccatgaggtgcgtttgccatcatgcagtgctattttacaatgtcaaaagttttgggtcattgtttagcgtccctgcgggaaattgttggaggaaatttaacttatatgagatttttctcttctataatttttttgttgttaatgcataattatctaattagacatcttaaattctttcgaaatgctctttgatccctgtaca

SEQ ID NO: 1575 - DNA, 2108 bp, Panax ginseng
agaaacatctaaagcagttgctgatctatctgttaacaacagtactcttactcaatcagaaccagaagtcctcagcaagaatgctcgcaagaaagaattgaagaataagcagaaagaggaggaacgacaacgtaaggaggcggagaaggagaaaaagggtgctgcagtgccaagttcacaggttcagaagcccttagcaacagatgatgatgacattgatccaacgcaatactttgaaaataggcagaaagcacttgcagctcataaagcagctggaaataatccgtatcctcacaaattccttgtgtccatgtctgttccagaatacatagagaagtttgaaggcctagatagtggggaacatcttgagaacgtcgaagtatctttggcaggacgaattatgaacaagcgatcatcatcttcaaagctgttcttttatgatttgcatggtggcggtgccaaagtccaagtaatgactgatgcaaggagatctgatttggatgaagctgaattttcaaagttacatgctggtgtgaagcgtggagatattgttggtattattggaattccaggaaagagcaaaagggggagctgagtatttttccaaaatcattcatagtgttatcccattgcctccatatgatgccaaggcagaaagtttcgtctggttctgataacgccaatgtgaagaaaactgatgtatgggtcccaggaagtggcaggaaccctgaaacttatatattaaaggatcaggaaactcgataccgtcaacgatatctagatttgatgcttaacatagaggttcgacatatattcaagacccgcgcaaagatcatttcttatattagacgttttcttgacaatctagattttctggaggttgaaacacccatgatgaacatgattgctggaggagcagcagctcgtccatttgtgacccatcacaatgacctgaacatgaagctgtttatgcgcattgcaccagaactttatctcaaggagcttgttgttggtggactcgaccgtgtctatgaaatagggaaacaattcaggaatgagggaattgacttgactcataatcctgaattcactacatgtgagttttatatggcttttgcagactacaacgacctgatggagctaactgaaagaatgttgagtgggatggtcaaggaacttacaggtggttataaagttaaatatcatgcgaatgggttagacaatggctcaattgaaatcgacttcactccccctttcagaaggattgatatgatagaagatttggagaagatggctgatcttaacatacccaaggacctttctagcaatgaagcaaacaaatacttagctgatgcatgcacgaactttgagatcaaatgccccccacctcaaacaactgctcgattgttggataaacttgtggggcactttctggaggagacatgtgtaaatcctactttcatcactaaccacccagagataatgagtccattggcgaagtggcacaggtccaagccaagcctgactgaacgatttgaattgtttatcaacaaacacgaactttgcaatgcatacactgaactgaatgatccggtggtacagcgccaacggtttgcggaccaacttaaggatcggcaatcaggcgatgatgaagcgatggctttggatgaaacattctgtacagctcttgaatatgggctacctccaactggtgggtggggattgggaattgatagacttgcgatgattttgacagattcacagaacatcaaggaagttctactctttccagccatgaaaccacaggatgaacctccaactaaagctgctgcatagataattaagaagggtgaaactataccagatttgttttttgtgaagttcagtggtaggactctcctcaactaagagaactactgacagtcaaaatcttttttatcttctttatccggactcacatatttggttatataaatacacaactcagcatgtaatgaaatgttgttcactgttcttactcctttcaaatgacgagtgcaaaaccactgaagtgaatgctatctgagattgatctatttattacttatgaaaggcatgatttgatctaa

SEQ ID NO: 1576 - DNA, 2042 bp, Valeriana officinalis
catctcaggcgccgtcagctggatttttttcaatcttacactatcaagccttcgttagtgatcagcgttgcagcttctgagtttgatcacaatatggagggttcaattgatgaagcatctaaagctgttaccgatctttcaattgatagcactgctaatccatctgaaccagaagctccgagcaaaaatgctacaaaagaaagcaataaagatgaagcagaaagaggaagagaggcgacgtaaggaagaggagaaggagaaaaaggaagctgccaacccaagttcgcaggctcagaaggctacagctgcagcagatgatgaagacatggatccaactcaatactttgagaatagggtgaaaggtcttactgttcttaaagaagctggccagaatccataccctcacaaatttcatgtctctatttctgtacttcaatatgtagacaagtatggaggccttgaaagtggggagcatctcgaaaatgaggaagtttatttggctgggcgaattactaacaagagatcctcatcgtcaaagttgtttttttatgatttacacggtggtggagctaaagtgcaagtcatggctgatgcaaggagatccgacctggatgaagctgaattttccaggtttcattccggtgttaagcgtggagatattgtgggtatagttgggttcccagggaagagcaaaagaggggaattaagtattttcccaaaatcatttgttgtgctatcgcattgtctacatatgatgccaagacaaaaggaccgctggttcagagagtgccagtgccaagaaaactgaagcttgggtcccgggaagtggcaggaatcctgaaacctatattctaaaagatcaggaaactcgataccgtcaacgttatctggatttaatgctgaacacagaagttcgacacatattcaagacccgggctaagattgtatcctatatcagaaggtttcttgacgatcttgattttttggaggttgaaacgccaatgatgaacatgattgccggaggagcagctgctcgtccattcgtgacacatcacaatgatctgaacatgaggctgttcatgcgaattgcccctgaactgtatctcaaagagcttgtcgtcggtggacttgatcgcgtctatgaaatcggcaaacaatttaggaacgagggaattgacttgacccataatcctgaattcacaacatgtgaattttacatggcttatgctgattacaatgacttgatggatctaactgagaaaatgttgagcgggatggtcaaggaacttacgggtggctacaaagttaaatatcatgcaaatgggttagagaatgagccaatcgaaattgatttcactccaccttttagaaggatagacatgattgaggagttggagaaaatggcaaatcttaacatcccaaaggattttacaagcgaggaaacaaggaaatatctggttgatgcatgtactaaatttgatattaaatgtgcccctcctcaaaccgtagctagattgctggacaaacttgtcgggcatttcctggaagaagtttgtgtaaacccagcatttatcatgaatcatccagaaatcatgagtccgttagctaagtggcatagatccaaacctggtctaaccgaacgttttgagttgttcatcaacaagcacgaactttgtaacgcatacacggaattgaatgatccggtggtccaacgccagcgttttgcggatcaactcaaggatcgacaatcaggagacgatgaagctatggcattggatgaaacattctgtacagctctcgaatatggattgcctcctactggtggatggggtattggtatcgatcggcttgctatgatgttgacagattcgcaaaacatcaaggaagtcttgcttttcccggcgatgaaaccccaggatgaacctccaactaaacctgcaacaacagtatagactcgcagattaccttttaatttaatgatttatcaaatgagattacagtggatttgttttttctatttttaatacgaccttaaaggcgtc

SEQ ID NO: 1577 - DNA, 2251 bp, Chenopodium quinoa
aacaattgtaaagcccaaactaaaacccctaacacctttcttctctatctcactctactcactctcagcgccgcccatcttcaaccaccgcactttttctctctcctctcttcttcttctccgccgtcattcatggcgtctccggccgacgacgctgccaagtccgtcgctaatttgtctatggattctaaccctaatcctgaacccgaactcagcaagaatgcgttgaagaagcaattgaagaacaagcagaaggaagaagaacgtcgtcgtaaggaggaggagaaggctgctaagcaggctgcaatgccgagctctcaaggtcagaaggctcaattagctgacgatgaggatatggaccctactcaatactttgagaaccgggtgaaatcgctggatgcacagaaggcggcaggaatcaatccgtacccacataagttctttgttacattgagtatccctgaatatattcagaagtatggtgttttgaacaatggggaccatcttgaggatgtgcaagtatcgatagctgggagaatcatgagcaagcgtgcatcgtcttcaaagcttttcttttatgatttgcatggcgaaggtgtcaaagtccaagtgatggctgatgctaggacttctgagctggacgaagctgaattttcaaagttccatgcttctgtgaaacgtggtgatatagtcggtgtaactggattcccagggaaaacaaagagaggggaactaagtattttccccaagtcttttgttgttttatctcattgcctccatatgatgcctagacagaagcctggtgttgctgctgcttcagagaacgccaataaaggtgaagtctgggtccctggaagtacaagaaatcctgagatgtacatcttgaaggaccaggaaacccgttatcgccaacgatacttggatttgatgttaaatactgaggtcagagaaatattcaggacccgttcaaagattattcaatatatcaggaggtttcttgacaatcttggtttcctagaggttgaaacaccaatgatgaacatgattcctggtggtgcggctgcacgtccatttgtgacctatcacaatgacctaaatatgaagctatatatgcgtattgcacccgaactgtatctaaaggagctagttgttggtggattagaccgtgtctatgaaattgggaagctgttcagaaatgagggtattgacctgacacataaccctgagttcacctcatgcgagttttacatggcatttgcagattataatgatctgatggagatgactgaaaagttgttgagtggtatggtgaaggaattgactggtgggtatgtcattaagtttcatgcaaatgggctagataaggagcctattgagattgatttcactccaccttacaggaggattgacatgatagaggaattagagaaaatggcgaatctgtctatacccaaggatttagctagtgaagagactactcaatatttgatcgatgcatgtgcaaagtatgatgtgaaatgcccacctccacaaacaactactcgcttgttggataaattggtgggactactttttggaggaaacttgcgttaatccagcttttatcataaatcatccagagataatgagtcctttagctaaatggcacaggtcaaaagcctgggttgactgagcgttttgaattgtttgtgaacaagcatgagctttgcaacgcgtacactgaactaaatgatcctattgtacaacgccagcgttttgctgaacaactgaaggatcgacaatcaggtgatgatgaagcaatggcgttggacgagacattttgtacagctcttgagtatgggcttccccctactggtggatggggaatgggtattgatcgacttacaatgatgctgacagattcccaaaatataaaggaagtcttgctcttccctgctatgaagcctcaggatgagccttcaaccacaccagctaaggcctaaaggtggagctgaagaacacttttgttgacaccactggcaaatgttatgtgattactttaggtggcttgctaattgaatcgtaaatcattttcaatactactccatttttgttactctaggaatgtgtcattcagcttttgtaacagaatcagtaatatctgattagtttctgcatattattagtatacatctggctgtttccttcgcatgtttgtatgtttcatatactaactaaattagctgaaccagtgcttgatttttgatgttat

SEQ ID NO: 1578 - DNA, 2139 bp, Chenopodium quinoa
cccccccccccccccctatcccctcgtcgtgccttgcctcccacgacattcaaccaccgcactctttctctctcctctcttcttcttctccgtcgtcattcatggcgtctccggccgacgacgctgccaagtccgtcgctaatttgtctatggattctaaccctaatcctgaacccgaactcagcaagaatgcgttaaagaagcaattgaagaataagcagaaagaagaagagcgtcgtcgtaaggaggaggagaaggctgctaagcaggctgcaatgccgagctctcaaggtcagaaggctcaattagctgacgatgaggatatggaccctactcaatactttgagaacagggtgaaatcgctggatgcacagaaggcggcaggaatcaatccctacccacacaagttctttgttacattgagtatccctgaatatattcagaagtatggtgttttgaacaatggggaccatcttgaggatgtgcaagtatcaatagctgggagaatcatgagcaagcgtgcatcatcttcaaagcttttcttttatgatttgcatggcgaaggtgtcaaagtccaagtgatggctgatgccaggacttctgagctggacgaagctgaattttcaaagttccacgctgctgtgaaacgtggtgatatagtcggtgtaactggattcccagggaaaacaaagagaggggaactaagtattttccccaagtcttttgttgttttatctcattgcctccatatgatgcctagacagaagcctggtgttgctgctgcttcagagaacgccaataaaggtgaagtctgggtccctggaagtacaagaaatcccgagttgtacatcttgaaggatcaggaaacccgttatcgtcaacgatacttggatttgatgttaaatactgaggtcagagaaatattcaggacccgttcaaagattattcaatatatcaggaggtttcttgacaatcttggtttcctagaggttgaaacaccaatgatgaacatgattcctggtggtgcggctgcacggccatttgtgacctatcacaatgacctaaatatgaagctatatatgcgtattgcacccgaactgtatcttaaggagctagttgttggtggattagaccgtgtctatgaaattgggaagctgtttagaaatgagggtattgacctgacacataaccctgagttcacctcatgcgagttttacatggcatttgcagattataatgatctgatggagatgactgaaaagttgttgagtgggatggtgaaggaattgactggtggttatgtcattaagtttcatgcaaatgggctagataaggagcctattgagattgatttcactccaccttacaggaggattgacatgatagaggaattagagaaaatggcaaatctgtccatacccaaggatttagctagtgaagagactactcagtatttgatcgatgcatgtgcaaagtatgatgtgaaatgcccacctccacaaacaactactcgtttattggataaattggtgggacactttttggaggaaacttgcgtaaatccagcttttatcataaatcatccagagataatgagtccgttagctaaatggcacaggtcaaagcctgggttgactgagcgttttgaattgtttgtgaacaagcatgagctttgcaacgcgtacactgaactaaatgatcctattgtacaacgccagcgatttgctgaacaactaaaggatcgacaatctggtgatgatgaagcaatggctttggatgagacattttgcacagctcttgagtatgggcttccccctactggtggatggggaatgggtattgatcgacttacaatgatgctgacagattcccaaaatataaaggaagtcttgctcttccctgctatgaagcctcaggatgagcctacaaccacaccagctaaagcctaaagctggagctgaagaacacttttgttgacaccactggcaaatgttatgtgattactttaggtggcttgctaattgaatcgtaaatcattttcagttctacaccatttttgttactctagggacgtgtgattcagccttttgtaacagtatcagtaacatctgtttatttttctgcatattattagattta

SEQ ID NO: 1579 - DNA, 2451 bp, Lactuca sativa
cacgactgaagtgtgtgtcaaaccgaataaataccgggtgccttaaccctacccgctaacgaatttccaattctatcctttttctttcatactagtcctacccgcacacacttccggccgtcttttcaatcagcttccagaaaccctaacgccattacagattcttccacacaatcttcccctacaatggcggacgtggatgctaccatctcaatcgacaatcctgtgtccgctccaccggagtcagatgttttaagcaaaaacgctcgcaagaaggagctgaagaacaaacagaaggaggaagagaggcgtcgcaaggaagaggagaaggagaaaaaggctgctgccatgccaaaatcagctgtccaaaagcagtcagctgcagatgatgaagacatggatccaacgcaatattttgaaaatcgcctgaaaacactcgctactcagaaggcagcaggaatgaacccctacccacacaaattccatgtctctatgtccattcttgaatacatagaaaagtatgaaagtttaaatagtggagatcatctggaggatgttcaagtttctttggctgggcgacttatgaacaaacgatcttcttcatcaaagctcttcttttatgacctccatggcactggtggaaaagtgcaagttatggctgatgcaaggagatctgatttggatgaagctgagttctctaagtaccattctggtgtgaaacgtggagatatagttggcattgttgggtttccaggaaaaagcaagagaggtgaactgagcatttttccaaaaacattcatggtgctttctcattgtcttcatatgatgccaaggcaaaagagtgcagctgttgcagagaacgccaatgtgaagaaaatcgatgcttggactccaggaagtggcagaaatcctgatgcatatattctgaaggatcaggaaacaagatatcgtcaacgttatttggatctgatgttaaactcagaagtcagacatatattcaagacccgggcaaagattgtatcttatattagacgttttcttgataatcttgattttttggaggttgaaactccaatgatgaacatgattgctggaggggcagctgcaaggccatttgtgacccatcacaatgacctaaacatgaggctgtttatgcgtattgcccctgaactttatctaaaggagcttgttgttggtggattggagcgtgtgtatgagataggaaaacagttcaggaatgaaggaattgatttgacacataatcctgaattcaccacgtgtgaattttatatggcttttgctgactacaatgacttgatggagataactgaacaactcttgagtggaatggtgaaggagctaacaggtggatacaaaattaaatatcatgcaaatgggttagatagtgaccccattgaaattgacttcacgcctcctttcagaaggattgatatgattggagagttggagaagatggcaaatctaagcataccaaaagatcttgcgggtgatgaggccaacaaatatcttgttgaggcatgcaaaaagtttgaaatcaaatgtcctccacctcaaacaactgcacgtttgctagacaaacttgtgggacactttttggaggaaacatgtgtgaacccttgtttcataattaaccatcccgagatcatgagtccattggccaagtggcacagatccaaaccaggattgactgaacgtttcgaattgttcatcaacaaacacgagcttgcgaatgcgtacaccgaactgaatgatccagtggtacaacgccagagatttgctgatcaattaaaggatcgacaatcgggagatgatgaagccatggctttggatgagaccttctgtacggctcttgagtatgggttgccaccaactggtggttggggactgggtgttgaccggcttgctatgttgttgaccgattcacagaacatcaaggaagttttacttttcccagcaatgaaaccacaagacgaagcacctgtcaaagctgcagaagtcgtgaaaagttgagctcagaaatctatcttcagttttgaggagattttgatggttgtcaaaagtttgtgatgaatagtttggacatagtgatgattgttagtgctattttcatgagattcgctcttgtctggtcttactttaccaaatttaaatattactttgtgtcctgattttgaaactattatggaaagaatttatatttatattaggcattatatgtgtgtaattgttttggttgctctacactttctgagatattgtatgtatgaatacacacacgctgaacctgcaagcctcgaagaatcaagatcagtttaagggattagcatcctaatacattaagccatgttttttttggtttaagcctgtttagttttgggcagataaatcgaactaataaactatttgaccatttacattccaacaattgtt

SEQ ID NO: 1580 - DNA, 2278 bp, Lotus japonicus
tgccgttcactgttctgacgatggaacctccctcatcggagcctgcagcttccggcgccggcgaaaacctcagcaaaaatgcattgaagcgggaactcaagaacaagcagagagaagaggagagaaagcgcaaggaggaagaaaaggccaaaaaggctgctgaactgcaacgtgctcaatctaacaaacctgcttctgccgatgacgatgatatggacccaacgcaataccatgagaacaggcttaagtatcttgctgcccacaaggcagaagggaataacccgtacccgcacaaattcgcggtctctatgtccattgagcaatacatcagcaaatatgaagggttgagcgatggggagcacgttgaagatgtctctgtgtctttggctggccgaattatgcacaaacgtacttcgggtgcaaagcttgtcttttatgatcttcatggtggtggcctcaaggttcaggttatggctgatgcaagtaaatctgatttgggtgaggttgagttttccaaattccattctaatgtgaagcgtggggatattgttggtatcactggatttccagggaaaagtaagaaaggggagcttagtattttccccaagacttttgtagtgctgtctcattgtttacatatgatgccaagggcaaagtctgctgctgctgctgctgataatgcaaatttgaagaaaagcgcatggatcccaggaagtaccaggaatcctgaaacatacattttgaaggatcaggaaacaaggtatcgtttacgccatttggatttgatgttgaatccagaggttcgagagatatttaagaccagatgtaaaatcatctcttacatcaggaggttccttgatgaccttgattttttggaggttgaaacacctatgatgaacatgattgctggtggagcagcagcccgtccattcgttactcatcacaatgatcttaacatgaggttgtacatgagaattgctccagaactttatcttaaggagcttgttgttggtgggctggatcgtgtatatgaaattggtaaacagtttagaaatgagggtatagatttgacacataatcctgagttcactacctgcgagttttatatggcttatatggactacaacgacttaatggagataacagaacaaatgttgagtggcatggttaaggaactcacaaaaggaagctacaaaatcaagtatcatgcagaggggattgataaggatcctattgaaatagacttcactccacccttcagaaggattgatatgattgaggaactagagaaaatggcaggcctcagtattcccaaggacttgtctagtgaggaaactaatcaatatctgaagaatgcttgcttgaagtatgacatcaaatgccctccccctgaaacaaccactcgcttgctggataaacttgtagggcactttttggaagaaacgtgtgtgaatcctacattcatcataaaccatcctgagataatgagtcctttggcgaagtggcacagatcaaaaccaggcttgacagaacgctttgaattgtttgttaataagcatgaactttgcaatgcatacactgaattgaatgaccctgtagtacaacgtcagagatttgctgaacaactcaaggatcggcaatcaggcgatgatgaagcaatggccttagacgaaacattttgtacagctctagagtatggtctgccaccaactgggggttggggtttgggtattgatcggctgacgatgatactgactgattctcagaatattaaggaagtacttctcttccctgccatgaaacctcaagattgatccttcaactaaacgcaggtgtagaaaagtgatttgttcagatatgttgctcatgttggttttctgatataaatccatttttcctcgaggtcgataggttcatatttcttccctacgttgttttcagaaacttgagaaattcaaaatgaccaggggggaattattttattattaatttgactagtagtttgccattgctggtcccttttaagaaaagggttggttggaggggttctttcttctgatgactttaccattgtaacttcactaccagctcatttttcatgtttcagattgcagttgaaatttccataccggtttttgagcatatccaaaacatgtgaaaatatttgagtaggcgaaatggtgtttcactagttgggttggtttggtttcactcatgcaacctatgtgaaaaagatgcaagcatcctatagatgctcattcaagttttcttattgtca

SEQ ID NO: 1581 - DNA, 2067 bp, Helianthus annuus
cctaacgccattgcagcatcttcaattcttgaccaccgttaacaatggcggaaccggcggcaaccgtcccaatcgacaacgctacctcgacaccggaggaaccagaaactttaagcaagaatgctcgtaagaaggagctgaagaacaagcagaaggaagaagaacggcgtcgtaaggaagaggagaaggagaaaaaggctgccgccatgccaaagtcagcagtccagaagcagtctgctgcagatgatgaagacatggatccaacgcaatattttgagaatcggctgaaaacactttctgctcaaaaggcagcaggaataaatccgtatcctcacaaatttgaggtcaaaatgtccattcttgattatatagagaagtatgacagtttaggtaatggggaccatctggaggatgttgaagtttctttggctgggaggttgatgaacaaacggtcttcttcatcaaagctgtttttctatgacttgcatggttctggtggaaaagtgcaagttatggctgatgcaaggagatctgatttggatgaagctgaattctccaagtaccattctggtgtgaaacgtggagatattgttggtatcgtcgggtttccaggaaaaagcaaaaggggagagctgagtatatttccaaaaacgttcacagtcttatcacattgtcttcatatgatgcctaggcaaaagcatgtagctggtgctgataattccaatgtgaagaaaattgacgcttggactccaggaagtggtagaaatcctgatgcatatatattaaaagatcaggaaacacgataccgtcaacgatatctagatctgatggtaaactcggaagtcagacatatattcaagactcggtcaaaggtcgtatcttatatcagacgttttcttgacagtgaaggctttttggaggttgaaactccgatgatgaacatgattgctggtggagctgctgcacgcccgtttgtgacccaccacaatgacttgaacatgacgctgtatatgcgcattgctcctgaactatatctgaaggagcttgtggtaggtggactcgagcgcgtatacgagattggaaaacagtttagaaacgaggggattgatttgacgcacaatcccgagttcacgacgtgtgaattttatatggcgtttgctgactacaatgacctgattacgttaactgagaaaatgttgagtggaatggtaaaggagctgacaggtggctacaaaattaaatatcatgccaacgggtatgataacgaccctatcgaaattgacttcactccacctttcagaaggattgacatgattgaagaattggagaagatagcaaatcttagcatacccaaagaccttacgagtgaagaagccaataaatatcttgctgatgcgtgcgcaaagtttgatattaaatgtcctccccctcgaacgacaacacgtttgctggataaacttgtgggacactttctggaggagcaatgtgttaatcctgcttttataattaaccatcctgagataatgagtccacttgcaaaatggcatcgatccaaaccgggattgactgaacgttttgaattgtttatcaacaagcatgagcttgccaatgcatataccgaactcaatgatccagtggtacagcgccagcgctttgcagatcaactaaaggatcgacagtcaggggatgatgaagcaatggctttagacgagacgttctgtacggctcttgaatatggtttaccaccaactggtggttggggtttgggtattgatcggcttacaatgttgctcactgattcacaaaacatcaaggaagttctacttttcccagccatgaagccacaagacgaaccacccgtcaaagctgtagaacacctgaaatctgagctcatatggttgctatcttcagttttgtctgtctgccaagatgtacctactttttgttcagaatgattcgtgctggatttgtttcgggtcaacttatggcgtatagcgtttaggtttgatcacgttactattgaatgtacatctctgaaaagtttactgatttaacagtgttatgaaa

SEQ ID NO: 1582 - DNA, 2147 bp, Helianthus annuus
cttttgacatacaaacacactccctgcatcagccgccgttttctaaaccctaactccggtaccggcggtttttcttcaccggaatcaatggcggactcgtcggaaaatgtcgtcatcgacaactccgcttctcccgctccggcggaagcagaaactatcagcaaaaatgctcgaaagaaggagctgaagaacaagcagaaggaggaagagaggcgtcgtaaggaagaggagaaggagaaaaaggctgctgccatgccaaaatcaggggcccagaagccttctgcagcagatgacgaagacatggatccaacgcaatattttgagaatcggctgaaaacacttgatgcccaaaaggcagctggatcgaatccctatcctcacaagttccatgtctcgatgtccattcttgaatatatcgagaagtatgaaaccttaaatagtggggaccacctggaagatgttcaagtttctttggctgggagactgatgagcaaacgcgcttcttcatcaaagctcttcttttatgatttacatggttctggtggaaaagttcaaattatggctgatgcaaagagatctgaattggatgaagctgaattctctaagtaccattctggtgtgaagcgtggagatattgttggtatcgtcgggtttccaggaaaaagcaaaagaggagagctgagtattttcccaaaatcgttcacagttctatcacattgtctacatatgatgccaaggcaaaaggttgcagctgctgcagataatgccaatgcaaagaagattgatgcttggactcctggaagtggtagaaatcctgatgcttatgttttaaaagatcaggaaacacgataccgtcaaagatatctggatctgatggtaaactcagaagtcagacatatattcaagacccgtgcaaaagttgtatcttatataagacgttttctcgacaatcgtgattttttggaggttgaaactcccatgatgaacatgattgctggtggagcagcggcacgtccatttgtaactcaccacaatgatttaaacatgacactatacatgcgaattgcacctgagctttatctgaaggaacttgtggttggtggacttgaacgtgtatacgagattggaaaacagtttaggaacgagggaatcgatttgacacataatcctgaattcacgacgtgtgaattttatatggcttttgcagattacaacgacttgatggacctaactgagaaaatgttaagtggtatggtgaaggagcttacaggcggatacaaaattaaatatcatgcaaatgggttggataatgaccctattgagatcgacttcactcctcctttcagaaggattgatatgattggagagttggagaaaatagcaaatcttaacatacctaaagaccttgccggtgaagaagccaataaatatcttgctgatgcatgcaccaagtttgatatcaaatgtcccccacctcaaacaacagcacgtttgctggataaacttgtgggacactttttggaggagcaatgtgttaatcctgcttttataattaaccatcctgagataatgagtccactggcaaaatggcatcgatccaaaccaggcttgaccgaacgtttcgaattgttcatcaacaagcatgagcttgccaatgcatacactgaacttaatgatccagtggtacaacgtcagcgatttgcagatcagctaaaggatcgacaatcaggggatgatgaagcaatggctttggatgaaacattctgtacggctcttgaatacggtttaccaccaactggcggttggggattgggtattgataggcttactatgcttctcactgactcacagaacatcaaggaggttttacttttcccagccatgaaaccacaggatgaaccgcccgtcaaagctgttgaaaacctgaaaatttgagctcgtatacggcgtggtcttcgggtttgtggacttgaaaacaccaagttttgttgagaatgactcatgctcaatttattgtgccaaaagttatgatgcatagcctttagatgtttgattgtttgtgttactatttaatgcattactttgtaccaaattgaaatcacaatgtgtcttttgaacttgaagctattatccaaagaatttaattg

SEQ ID NO: 1583 - DNA, 2126 bp, Ambrosia trifida
aatcgaaacacgctttaaaaaacactcctcagccgccatttccataaaccctaactccgtcaccggaaaaataaaaatcaatggctgactcgtcggaaaatgtcgtcatcgacacctctgctccggccgaggcagaaaccttaagcaaaaatgctcgtaagaaggagctgaagaacaagcagaaggaggaagagaggcggcgtaaggaagaggagaaggagaaaaaggctgcggccatgccaaaatcaggggctcagaagccatctgcagcagacgatgaagacatggatccaacgcaatattttgagaatcgattgaaaacacttgatgctcaaaaggcagcaggattgaatccctaccctcacaaatttcatgtctcaatgtccattcttgaatatattgagaaatatgaaaccttaagtagtggggaccacctggaggatgttcaagtttctttggctgggagactgatgaacaaacggtcttcttcatcaaagctcttcttttatgatttgcatggtactggcgggaaagtgcaagttatggctgatgcaaggagatctgatttggatgaagctgaattctctaagtaccattctggtgtgaagcgtggagatattgttggtatcgttggatttccaggaaagagcaaaaggggagagctgagtattttcccaaaatcgttcacagttttatcacattgtctacatatgatgccaaggcaaaaaaatgcagctgctgcagataatcctaatgcaaagaaaattgatgcttggactccaggaagtggtagaaatcctgatgcatatatattaaaagatcaggaaacacgataccgtcaaagatatttggatctgatggtaaactcagaagtcagacacatattcaagacccgttcaaaagttgtatcttatattagacgttttcttgacaatcttgattttttggaggttgaaactcccatgatgaacatgattgctggtggagcagctgcacgtccatttgtaactcaccacaatgatttaaacatgacactatacatgcgaattgcacccgaactttatctgaaggagcttgtggttggtggacttgaacgtgtatatgagattggaaaacagttcagaaatgagggaattgatttgacacataatcctgaattcacaacgtgtgaattttatatggcttttgcagattacaatgacctgatggaactaactgaacaaatgttgagtggtatggtgaaggagctgacaggtggatacaaaatcaaatatcatgcaaatgggttggataatgatcctattgaaattgacttcactcctcctttcagaaggattgatatgattggagagttggagaaaatagcaaatcttaacatacccaaagaccttgctggcgaagaagcgaataaatatcttgctgatgcatgcaccaagtttgacatcaaatgccccccacctcaaacaacagcacgtttgctggataaacttgtgggacactttcttgaggagacatgtgttaatcctgcctttataatcaaccatcctgagataatgagtccactggcaaaatggcatcgatcgaaacccggcttgactgaacgatttgaattgtttatcaacaagcatgagcttgctaatgcatacaccgaacttaatgatccagtggtacaacgtcagcgatttgcagatcaactgaaggatcgacaatcaggggatgatgaagcaatggctttggatgaaacgttttgtacggctcttgaatatggtttaccgccaactggtggttggggattgggtattgataggcttactatgctgctcactgactcacagaatattaaggaggttctgcttttcccggccatgaagccacaggatgaattgcctgtcaaagctgtcgaaaacctgaaaatatgagttcatatactgcgtcttcgtgtttgtgggctcgaggaacaccaaattttgttcagaacgattcatgcctgattcatatcgtgtcaaaacttatgatgaatagcctttagatgcttgtttgtgttacaatttaatgcattactttgtaccaagttgaaatcacaatgtgccttttgatcttgaagcttttatccaaagaatttaatt

SEQ ID NO: 1584 - DNA, 2232 bp, Malus domestica
cggattcaaatgttttaatacccatttgcaaaccctagctagcttccacatccattgccacacaaaaaccccagaaaagcctcctctcactcaacgctccccgctctagtactgaatcgctacaatggcaggcacacccgaaaaaacggcgaaagcggtcgcagatttgacattggaatcggaaggagctatgagcaaaaatgcacggaagaaggagttgaagaacaagcaaagggaagaagaaaggcgccggaaagaggaggagaaggctgctgccgtggcaagctcgcaagttaagaaagatgtagcaactgaagatgacgaaatggatccaacgcaatactatgaaaacagactgaagtatcttgctacccagaaggtagataaaaatccatatcctcacaaattctcttgttcaatcaccgtgtgcgaatgtgtagagaagtatgcaggcttaagcgatggggagcatcttgaggatatcagtgtttcattggctgggcgaatcatgagtaaaagatcgtctagctcaaaacttttcttttatgacttacatggtggaggacctgatggtgagaaggtccaagtgatggctgatttaagaaaatcagagctggatgaatctgaattttctaagttccattctagtgttaagcgtggtgatattgttggtattactgggtttccaggaaagactaagaggggggagttgagcattttcccaagatcatttatagtgttatcacattgtcttcatatgatgccaaggcagaaacctggtcctgcttctgatagtgctaatgtgaagaaaactgatcgatgggtcccaggaagtcccaggaatcctgaagcatacattttaaaagaccaggaaactcgctatcgtcaacgttatttggatctaatattgactaatgaggttcgacaaatattcaagaccagatttaaggtcattcaatatattagaaggttcctggacaatctggacttcttagaggtcgaaactcctatgatgaatatgattgctggtggagcggctgcccgtccttttgtgacttatcacaatgaacttgacatgaagcttttcatgcgcattgcacctgaactctatcttaaacagctagttgttggtggcctggatcgtgtttatgagattggaaaacaatttagaaatgagggcattgatttgactcataatcctgagttcactacctgtgaattctatatggcttatgcagactacaatgacttgatgacactgactgaggaaatgttgagtgggatggtcaaggaactaactggtggatataaaatcaagtatcattcgaatgggctcgacaaagatccaattgagattgactttactcctcctttcagaaggatcgacatggttgaggaattaaataagattgcaggtctcaacataaatccggagaatctctccagtgcagaagctaaccaatatcttaaggatgcgtgcaagaaatttgatatcaaatgttcccctcctgaaacaacaactcgtttgttggacaagcttgtggggcactttttggaagagacgtgtgtaaatcccgcgttcatcattaaccatcctgagataatgagtcctttagcaaagtggcatcgatcaaaacctgggctgactgaacgttttgaattgtttgtcaacaagcatgaacttgccaatgcatacacagaattgaatgatcctgtggtacaacgccaacgatttgctgatcaactcaaggaccgacaatcaggtgatgatgaagcaatggcactggacgaaacattttgcagagctcttgagtatgggttacctccaactggtggttggggtttgggcgttgaccggctctgtatgtggttaactgattcacagaatattaaggaagttctactcttcccggctatgaaaccacaggatgagccttctgctaaagccatttaggcgcctgagattattgggacgcatcaatcgatttttgtagcattcatcggactcgaagcggtcgtcttatcaatggcctggtgtacctttttggtttgattttttactgtcatatctgaagtgtttttgggtagatctataattgtccgactattcattagtaaatgcgactaatgtttatccgaagttctaaatttgtatttctccgttgtgttagtttcttttgaatgagtatttgttacgacttgaaagaaaaaagttgctctcttgtctcgtca

SEQ ID NO: 1585 - DNA, 2001 bp, Centaurea maculosa
cacacactcaccggccgccattatcactttccaaaaccctaaccccaattctcgattgctctgcacaacttccccgttaacaatggcggattcggctaataacaacaacaacgtctcaattgaagactcttctcctgcttcatcggaaccggaagtcgtaagcaagaatgctcgcaagaaggagttgaagaacaaacagaaggaggaagagagacgtcgtaaggaagaggagaaggagaaaaaggctgccagcatgccaaagtcagcgacccagaagccagctgctgcagatgacgaggacatggatccaacgcaatattttgacaatcggctgaaagcacttgcagctgataaggcagccggaatcaatccgtatcctcacaaattccatgtctcgatgtccattcttgaatatatagagaaatatgaaagcttaaatagtggggatcatcttgaggatgtccaagtatctttggctggacgactgatgaacaaacggtcttcttcatcaaagctgttcttttatgatttgcatggttctggtggaaaagtgcaagttatggctgatgcaaggagatctgatttggatgaagctgaattctccaagtaccattctggtgtgaaacgtggagacattgttggtatcgtcggatttccaggaaaaagcaaaaggggagagctgagtatttttccaaagacattcacagttttgtcgcactgtcttcatatgatgccaaggcaaaagagtggagctgttgcggcagataatgccaatacaaagaaagttgacgtttggactccaggaagtgttagaaatcctgatgcatacatattaaaagatcaggaaacacgataccgtcaacgttatttggatctgatggtaaactcagaagtcagacatatttttaagacccgggcaaaggttgtatcttatatcagacggtttcttgacaatcttgattttttggaggttgaaactcccatgatgaacatgattgctggtggagcagctgcacgtccatttgtaacccaccataacgatctaaacatgaggctgttcatgcgcattgctcccgaactttatctaaaggagcttgttgttggtggactggagcgcgtatatgagataggaaaacagttcagaaatgaggggattgatttgacacacaatccagaattcactacatgtgaattttatatggcttttgcagactacaacgacctgatggagataaccgagaaaatgttgagtggcatggtgaaggagcttacaggtggctacaaaattaaatatcatgccaatgggttggagaaggaacctattgaaatcgactttactcctcctttcagaaggattgatatgattggggagttggagaagatagcaaatcttaacatacccaaagaccttgcaggagatgaagccaataaatatcttgctgaagcatgtgcaaagtttgatatcaaatgtcccccgccccaaacaacagcacgattgctggacaaactagtgggacactttttggaggagacgtgtgtcaatcctgcttttataatcaaccatcctgagataatgagtcctttggcaaagtggcatcgatccaaaccaggcttgaccgaacggtttgaattgttcatcaacaaacacgagcttgccaatgcgtacaccgaactcaacgatccagtggttcaacgtcagcgatttgccgatcaactaaaggatcgacaatctggtgatgacgaagcaatggctctggatgagacgttctgtacggctcttgaatacggtttgccgccaactggtggttggggtttgggtattgatagacttgcgatgttgttgaccgattcacagaacatcaaggaggttctacttttcccagccatgaaaccacaggatgaagtgccaccacctgtcaaagctgcagaagtcgtgaaaagttaagccagctgagaaggtgttagttcgttctactaccaaattttgttcagaatgtttca

SEQ ID NO: 1586 - DNA, 1982 bp, Centaurea maculosa
ttggcggggacctcccggccgccatatccatcactttccaaaaccctaacccccattctctcgattgctctgcacaccttcccccattaacaatggcggattcggctaataataacaacaacgtctcaattgaagattcttctcctgcttcatcggaacctgaagtcgtaagcaagaatgctcgcaagaaggagttgaagaacaaacagaaggaggaagagagacgtcgtaaggaagaagagaaggagaagaaggctgccagcatgccaaaggcagcggcccagaagccggctgctgcagatgatgaggacatggatccaacgcaatattttgacaatcggctgaaagcacttgcagctgataaggcagccggaatcaatccgtatcctcacaaattccatgtctcgatgtccattcttgaatatatagagaaatatgaaagcttaaatagtggggatcatcttgaggatgttgaagtatctttggctggacgactgatgaacaaacggtcttcttcatcaaagctattcttttatgatttgcatggttctggtggaaaagtgcaagttatggctgatgcaaggagatctgatttggatgaagctgaattctccaagtaccattctggtgtgaaacgtggagacattgttggtatcgttggatttccaggaaaaagcaaaaggggagagctgagtatttttccaaagacattcacagttttgtcgcactgtcttcatatgatgccaaggcaaaagagtggagctgttgcggcagataatgccaatacaaagaaagttgacgtttggactccaggaagtgttagaaatcctaatgcatacatattaaaagatcaggaaacacgataccgtcaacgttatttggatctgatggtaaactcggaagtcagacatatttttaagacccgggcaaaggttgtatcgtatatcaggcattttcttgacaatcttgattttttggaggttgaaactcccatgatgaacatgattgctggtggagcagctgcacgtccatttgtaacccaccataatgatctaaacatgaggctgttcatgcgcattgctcccgaactttatctaaaggagcttgttgttggtggactggagcgcgtatatgagataggaaaacagttcagaaatgaggggattgatttgacacacaatccagaattcactacatgtgaattttatatggcctttgcagactacaacgacctgatggagataactgagaaaatgttgagtggcatggtgaaggagcttacaggtggctacaaaatcaaataccatgccaatgggttagataaagatcctattgaaatcgacttcactcctcctttcagaaggattgatatgattggggagttggagaagatagcaaatcttaacatacccaaagaccttgcaggagatgaagccaataaatatcttgctgaagcatgcgcaaagtttgatatcaaatgtcccccgcctcaaacaacagcacgattgctggacaaacttgtgggacactttttggaggagacgtgtgtcaatcctgcttttataatcaaccatcctgagataatgagtcctttggcaaagtggcatcgatccaaaccaggcttgaccgaacgctttgaattgttcatcaacaagcacgagctcgccaatgcatacactgaacttaacgatccagtggttcagcgccagcgatttgccgatcaactaaaggatcgacaatctggtgatgacgaagcaatggctttggatgagactttttgtacggctctggaatacggtttgccgccaactggtggttggggtttgggtattgatagactcacaatgttgttgaccgattcacagaacatcaaggaagttctacttttcccagccatgaaaccacaggatgatgtgccacctgtcaaagctgcagagatcgtgaaaagttaagctgagaaggtgttcgttctaccaaatttt

SEQ ID NO: 1587 - DNA, 2027 bp, Ambrosia trifida
actttaaaaaacactcctcagccgccatttccataaaccctaactccgtcaccggaaaaataaaaatcaatggccgactcgtcggaaaatgtcgtcatcgacacctctgctccggccgaggcagaaaccttaagcaaaaatgctcgtaagaaggagctgaagaacaagcagaaggaggaagagaggcggcgtaaggaagaggagaaggagaaaaaggctgcggccatgccaaaatcaggggctcagaaaccatctgcagcagacgatgaagacatggatccaacgcaatattttgagaatcgattgaaaacacttgatgctcaaaaggcagcaggattgaatccctaccctcacaaatttcatgtctcaatgtccattcttgaatatattgagaaatatgaaaccttagatagtggggaccacttggaggatgttcaagtttctttggctgggagactgatgaacaaacggtcttcttcatcaaagctcttcttttatgatttgcatggttctggcgggaaagtgcaagttatggctgatgcaaggagatctgatttggatgaagctgaattctctaagtaccattctggtgtgaagcgtggagatattgttggtatcgttggatttccaggaaagagcaaaaggggagagctgagtattttcccaaaatcgttcacagttttatcacattgtctacatatgatgccaaggcaaaaaaatgcagctgctgcagataatcctaatgcaaagaaaattgatgcttggactccaggaagtggtagaaatcctgatgcatatatattaaaagatcaggaaacacgataccgtcaaagatatttggatctgatggtaaactcagaagtcagacacatattcaagacccgttcaaaagttgtatcttatattagacgttttcttgacaatcttgattttttggaggttgaaactcccatgatgaacatgattgctggtggagcagctgcacgtccatttgtgactcaccacaatgatttaaacatgacgctatacatgcgaattgcacccgaactttatctgaaggagcttgtggttggtggacttgaacgtgtatatgagattggaaaacagttcagaaatgagggaattgatttgacacataatcctgaattcacaacgtgtgaattttatatggcttttgcagattacaatgacctgatggaactaactgaacaaatgttgagtggtatggtgaaggagctgacaggtggatacaaaatcaaatatcatgcaaatgggttggataatgatcctattgaaatcgacttcactcctcctttcagaaggattgatatgattggagagttggagaaaatagcaaatcttaacatacccaaagaccttgctggcgaagaagcgaataaatatcttgctgatgcatgcaccaagtttgacatcaaatgccccccacctcaaacaacaacacgtttgctggataaacttgtgggacactttcttgaggagacatgtgttaatcctgcctttataattaaccatcctgagataatgagtccactggcaaaatggcatcgatcgaaacccggcttgactgaacgatttgaattgtttatcaacaagcatgagcttgccaatgcatacaccgaacttaatgatccagtggtacaacgtcagcgatttgcagatcaactgaaggatcgacaatcaggggatgatgaagcaatggctttggatgaaacgttttgtacggctcttgaatatggtttaccgccaactggtggttggggattgggtattgataggcttactatgctgctcactgactcacagaatattaaggaggttctgcttttcccggccatgaaaccacaggatgaattgcctgtcaaagctgtcgaaaacctgaaaatctgagttcatatacggcgtcttcgtgtttttgggcttgaggaacaccaaattttgttcagaacgattcatgcctgattcatatcgtgtcaaaacttatgatgaatagcctttagcctttagat

SEQ ID NO: 1588 - DNA, 2229 bp, Echinacea purpurea
caggtaacaatataattttaatagtcacagatgccacccgtctccaccgtctcccaccatcccgtcatcatcaaccttgtcaaaagaacttcataaaccctaatccaacacttcgacaatacacacgcactcagccgccgtattcataaaccctaactccggtaccggaatcaatggcggacacgacggataatgtcaccgtcgacaactctactgccgcgccgccggaagcagaagccttaagcaagaatgctcgcaagaaggagctgaagaacaagcagagggaagaggaacggcgtcgtaaggaagaggagaaggagaaaaaggcagccgccatgccaaaatcagcagtccagaagcagtctgctgcagatgatgaagacatggatccaacacaatatttcgaaaatcggctgaaaacacttgatgctcaaaaggcagcaggaatgaatccgtatcctcacaaatttcatgtctcgatgtccattcttgaatatatagagaagtatgcaagtttaaagagtgaggaccgtctagaggatgttcaagtatctttggctgggagattgatgaacaaacggtcttcttcatcaaagctgtttttctatgatttgcatggttctggcggaaaagtgcaagttatggctgatgcacggagatctgatttggatgaagctgaattctctaagtatcattctggtgtgaagcgtggagatattgttggtatcgtcgggtttccaggaaaaagtaaaaggggagagctgagtattttcccgaaatcattcacagttttatcacattgtctacatatgatgccaaggcaaaagagtgcagctgctgcagataatcccgatgcaaagaaaattgatgcttggactccaggaagtggtagaaatcccgatgcatatattttaaaagatcaggaaacacgataccgtcaaagatatttggatctgatggtaaactcagaagtcagacatatattcaagacccgtgcaaaagtagtatcttatattagacgttttctcgacaatcttgaatttttggaggttgaaacacccatgatgaacatgattgccggtggagcagctgcacgtccatttgtgactcaccacaatgatttaaacatgacactatacatgcgaattgcacctgaactttatctgaaggagcttgtggttggtggactcgaacgcgtatacgagattggaaaacagtttagaaatgagggaatcgatttaacacataatcctgaattcacaacgtgtgaattttatatggcttttgcagactacaacgatttaatggagctaactgaacaaatgttgagcggtatggtgaaggagctgacaggtggatacaaaattaaatatcatgcaaatgggttggaaaatgatccaattgaaatcgatttcactcctcccttcagaaggattgatatgattggagagttggagaaaatagcaaatcttaacatacccaaagaccttgctggtgaagaagccaacaaatatcttgctgatgcgtgcaccaagtttgatatcaaatgtcccccacctcaaacaacagcacgtttgctggataaacttgtgggacactttcttgaggagacatgcgtaaatcctgcttttataattaaccatcctgagataatgagcccactggcaaaatggcatcgatccaagccagggttgactgaacgatttgaattatttatcaacaagcatgagcttgccaatgcatacactgaacttaatgatccagtggtacaacgtcagcggtttgcagatcaactaaaggatcgacaatcaggggatgacgaagcgatggctttggatgaaacgttctgtacggctcttgaatacggtttaccaccaactggtggttggggactgggtattgataggctaactatgctgctcactgactcacagaacatcaaggaggttttgcttttcccggccatgaagccgcaggatgaactgcctgtcaaagctgtcgaaaacctgaaaatttgagctcctatatggcgtcttcgggattgtgggcttgggaacacccatttttgttcagaatgattcacgctcgacctatcatgcatagcctttagatgtttgattgtttgtgttagtgtgtactattcaatgcattacgttgtactaagttgaaatcacaatgtgtctttgatcttgaatctattatccaaagaatttaattgacatcccacct

SEQ ID NO: 1589 - DNA, 2149 bp, Helianthus annuus
acacttttgacaatacacacactccctcatcagccgccgttttcataaaccctaactccggtaccggcggttcttcttcaccggaatcaatggcggactcgtcggaaaatgtcatcatcgacaactccgcttctcccgctccggcggaagcagaaactatcagcaaaaatgctcgaaagaaggagctgaagaacaagcagaaggaggaagagaggcgtcgtaaggaagaggagaaggagaaaaaggctgctgccatgccaaaatcaggggcccagaagccttctgcagcagatgacgaagacatggatccaacgcaatattttgagaatcggctgaaaacacttgatgcccaaaaggcagctggattgaatccctatcctcacaagttccatgtctcgatgtccattcttgaatatattgagaagtatgaaaccttaaatagtggggaccacctggaagatgttcaagtttctttggctgggagactgatgagcaaacgcgcttcttcatcaaagctcttcttttatgatttacatggttctggtggaaaagttcaaattatggctgatgcaaagagatctgaattggatgaagctgaattctctaagtaccattctggtgtgaaacgtggagatattgttggtatcgtcgggtttccaggaaaaagcaaaagaggagagctgagtattttcccaaaatcgttcacagttctatcacattgtctacatatgatgccaaggcaaaaggttgcagctgctgcagataatgccaatgcaaagaagattgatgcttggactcctggaagtggtagaaatcccgatgcatatgttttaaaagatcaggaaacacgataccgtcaaagatatctggatctgatggtaaactcagaagtcagacatatattcaagacccgtgcaaaagttgtatcctatataagacgttttctcgacaatcgtgattttttggaggttgaaactcccatgatgaacatgattgctggtggagcagcggcacgtccatttgtaactcaccacaatgatttaaacatgacactatacatgcgaattgcacctgagctttatctgaaggaacttgtggttggtggacttgaacgtgtatatgagattggaaaacagtttaggaacgagggaatcgatttgacacataatcctgaattcacgacgtgtgaattttatatggcttttgcagattacaacgacttgatggacctaacggagaaaatgttaagtggtatggtgaaggagcttacaggcggatacaaaattaaatatcatgcaaatgggttggataatgaccctattgagatcgacttcactcctcctttcagaaggattgatatgattggagagggggagaaaatagcaaatcttaacatacctaaagaccttgccggtgaagaagccaataaatatcttgctgatgcatgcaccaagtttgatatcaaatgtcccccacctcaaacaacagcacgtttgctggacaaacttgtgggacactttttggaggagcaatgtgttaatcctgcttttataattaaccatcctgagataatgagtccactggcaaaatggcatcgatccaaaccaggcttgaccgaacgtttcgaattgtttatcaacaagcatgagcttgccaatgcatacactgaacttaatgatccagtggtacaacgtcagcgatttgcagatcagctaaaggatcgacaatcaggggatgatgaagcaatggctttggatgaaactttctgtacggctcttgaatacggtttaccaccaactggcggttggggattgggtattgataggcttactatgcttctcactgactcacagaacatcaaggaggttttacttttcccagccatgaaaccacaggatgaaccgccagtcaaagctgttgaaaacctgaaaatttgaactcgtatacggcgtggtcttcgtgtttgtggacttgaaaacaccaagttttgttgagaatgactcgtgctcaatttattgtgccaaaagttatgatgcatagcctttagatgtttgaatgtttgtgttgctatttattgcattactttgtaccaaattgaaatcacaatgtgtcttttgaacttgaagctattatccaaagaatttaattg

SEQ ID NO: 1590 - DNA, 2088 bp, Helianthus annuus
cctaacgccattgcagcatcttcaattcttgaccaccgttaacaatggcggaaccggcggcaaccgtcccaatcgacaacgctaactcgacaccggaggaaccagaaactttaagcaagaatgctcgtaagaaggagctgaagaacaagcagaaggaagaagaacggcgtcgtaaggaagaggagaaggataaaaaggctgccgccatgccaaagtcagcagtccagaagcagtctgctgcagatgatgaagacatggatccaacgcaatattttgagaatcgactgaaaacactttctgctcaaaaggcagcaggaataaatccttatcctcacaaatttgaggtcaaaatgtccattcttgattatatagagaagtatgacagtttaagtgatggggaccatctggaggatgttgaagtatctttggctgggaggttgatgaacaaacggtcttcttcatcaaagctgtttttctatgacttgcatggttcgggtggaaaagtgcaagttatggctgatgcaaggagatctgatttggatgaagctgaattctccaagtaccattctggtgtgaaacgtggagatattgtcggtatcgtcgggtttccaggaaaaagcaaaaggggagagctgagtatatttccaaaaacgttcacagtcttatcacattgtcttcatatgatgcctaggcaaaaacatgtaactggtgctgataattccaatgtgaagaaaattgacgcttggactccaggaagtggtagaaatcctgatgcatatatattaaaagatcaggaaacacgataccgtcaacgatatctagatctgatggtaaactcggaagtcagacatatattcaagactcggtcaaaggtcgtatcttatatcagacgttttctcgacagtgaaaactttttggaggttgaaactccgatgatgaacatgattgctggtggagctgctgcacgcccgtttgtgacccaccacaacgacttgaacatgacgctgtatatgcgcattgctcctgaactttatctgaaggagcttgtggtaggtggactcgagcgcgtatacgagatcggaaaacagtttagaaacgaggggattgatttgacgcacaatcccgagttcacgacatgtgaattttatatggcgtttgctgactacaatgacttgatgaagctaactgagaaaatgttgagtggaatggtaaaggagctgacaggtggctacaaaattaaatatcatgccaacgggtatgataacgaccctatcgaaattgacttcactccaccgttcagaaggattgacatgattgaagaattggagaagatagcaaatcttagcatacccaaagaccttacgagtgaagaagccaataaatatcttgctgacgcgtgcgcaaagtttgatatcaaatgtcctccccctcaaacgacaacacgtttgctggataaacttgtgggacactttctggaggagcaatgtgttaatcctgcttttataattaaccatcctgagataatgagtccacttgcaaaatggcatcgatccaaaccgggattgactgaacgttttgaattgtttatcaacaagcatgagcttgccaatgcatacaccgaactcaatgatccagtggtacagcgccagcgctttgcagatcaactaaaggatcgacaatcaggggacgatgaagcaatggctttagacgagacgttctgtacggctcttgaatatggtttaccaccaactggtggttggggtttgggtattgatcggcttacaatgttgctcactgattcacaaaacatcaaggaagttctacttttcccagccatgaagccacaggacgaaccacccgtgaaagctgtagaaaacctgaaaatttgagagctcatatggtcgctatcttcagttttatctgtctgcaaagatgtaccaactttttgttcagaacgatttgtgttgaatttgtttcgggtcaacttgtggcgtatagcgtttaggtttgatcacgttactattgaatgtactctgatatacacaggtacatctctgaaaagtttactgatttaacagtgttatgaaa

SEQ ID NO: 1591 - DNA, 2213 bp, Petroselinum crispum
attgtacaatgtataaaacccctaaaaggcttttctcattttctcaactcagccgcagcaaccgcagataggaaacgcgacgccgaacacacttacactacctttgtcctctacttgctttactcccatcgataaatatggatggaacaattgaagaagcatccaaagctgttgccggattatctgttggaaattctactgctcagcctgaagcgggagcagctctgagcaagaatgctctgaagaaagaattgaagaataagcagaaagaggaggaacggcgacgcaaagaagaggaaaaggcaaagaaggctgccgccgttccaagctctaatgcacagaagtccttggcagctgatgacgacgacatggatccaacacaatatttcgataacaggattaaagcgcttgctgctcttaaaacagctggaataaatccatatcctcacaagttccatgtgtctatgtctgtcatagaatacgtagagaagtattctggcttgaattgtggggaacatttggagaatgtcgaagtatcattggcaggacgtattatgaacaaaaggtcatcatcgtcaaaacttttattttatgatttgcatggtgaaggtgccaaagtccaactaatgaccgatgcaaggatatctgatttgagtgaagctgaatttgcaaagttccatggtggtgtaaagcgtggagatattgttggggttgttgggtttccaggtaaaagcaaaaggggggagctgagtatgttcccaaaatcattcatagtgctgtcccattgtctgcatatgatgccacggcagaaacctgccactagttctgatattgaaagtgtgaagaaaattgatgcatggatcccaggaagtggtagaaaccctgaaacctatgttttaaaggatcaggaaactagatatcgtcaacgttatctggatttgatgttgaactcagaggtgcgacacatattcaaaacccgtgcgaaggtcatttcttatgttaggcgattccttgatgatctagattttctggaggttgaaacacctatgatgaacatgattgctggaggagcagctgcacgtccatttgtgacccatcacaatgaactgaacatgagactttttatgcgtatagcaccggagctttatcttaaggaacttgttgttggtggactcaaccgtgtctatgaaatagggaaacagttcagaaatgaagggattgacttgacacataaccccgagttcactacatgcgagttctatatggcttttgcagactacaatgatctgatggagatgacagaaaaaatgttgagcggaatggtcaaggaactgacaggaggttataaagttagatatcatgcaaatggcttagagaatgaagcaattgaaatcgattttactccccctttcagaaggattgatatgattgaagacttggagaagatggctggtctcaacattcctaaggacctcgctagtgatgaagccaacaaatatctagctgaggcctgcacaaagtttgagatcaaatgcgcgcctcctctaacaactgcgcgtttgttggataaacttgtagggcactttctggaggagacttgtgtgaaccccgctttcatcataaatcaacctgagataatgagtcctctagcaaagtggcatagatccaagccagggttgaccgaacgatttgaattatttatcaacaaacatgaactttgcaatgcttacacggagctgaatgatccagtggtacagcgtcaacggtttgcggaccaactaaaggatcgtcaatcaggtgatgatgaagcgatggccttggatgaaaccttttgcacagctcttgaatatggactacctcctacaggtgggtggggaatgggaattgatcggcttgcaatgttgctaacagactcacagaatatcaaggaagttctgctctttccagctatgaaaccacaggatgaagctccagttaaagcagtacaatctacaacttcataggtacttgagaagctaaatctatagcggactccattttttgttaatttcagcataacttcctcagctagtggtatgttttgaaagactcccatgaagactccaagacaaccatcagtctattactggtgttattatattttccaactttgtcatgcaactttctttttagtttcacatttcttgtatttgacacacttccatttgtgaatt

SEQ ID NO: 1592 - DNA, 1901 bp, Flaveria ramosissima
gtggtcaacatccccatcaacgactctacaactgcaacagatgaaggagaaaccataagcaagaatgctcgcaagaaggagctcaagaacaagcagaaggaggaagaaaggcgtcgtaaggaagaggagaaggagaaaaaggctgcctctatgccaaagtcagcggtccagaagcagtctactgcagatgatgaagacatggatccaacgcaatattttgaaaatcggctgaaagtacttgctgctcaaaaggcagcaggaatgaatccctaccctcacaaatttcatgtctcaatgtctattcttgaatatatagagaagtatgaaagtttaaatagcggggaccatctggaagatgttgaagtgtctttggctgggagattaatgaacaaacggtcttcttcatcaaagctgtttttctatgatttgcatggttctggtggaaaagtgcaagttatggctgatgcaaggagatctgatttggatgaagttgaattctccaagtaccattctggtgtgaaacgtggagatattgttggcattgttggatttccaggaaaaagcaaaagaggagagctgagtatttttccaaaatctttcacagttttatcacattgtcttcatatgatgccaaggcaaaaaagcgcagctgctgctgataataccaatgtaaagaaaattgacgcttggactccaggaagtggtagaaatcctgatgcatatatattaaaagatcaggaaacacgataccgtcagcgatatttagatctgatggtaaactcggaagtcagacatatattcaagactaggtcaaaggtcgtatcttatattagacgttttcttgacaaccttgattttttggaggttgaaactccaatgatgaacatgatagctggtggagctgctgcacgcccatttgtgacccaccataacgacttaaacatgacactgtatatgcgcattgctcctgaactttatctgaaggagcttgtggtcggtggacttgagcgtgtatatgagattggaaaacagtttagaaatgaggggattgacttgacacacaatcctgaattcacaacatgtgaattctatatggcatttgctgactacaatgacttgatggagcttactgaacaaatgttgagtggtatggtaaaggagctgacaggtggctacaaaattaaatatcatgccaatgggttagataatgatcctattgaaattgacttcactcctcctttcagaaggattgatatgattgaagaattggagaagatagcaaatcttagcatacccaaagatcttgcgggtaatgaagccaataaataccttgctgatgcatgcaccaagtttgatatcaaatgtcctccccctcaaacaacagcacgtttgctggataaacttgtgggacactttctggaggagacgtgtgttaatcctgcttttataattaaccatcctgagataatgagtccacttgcaaaatggcatagatccaaaccaggcttgactgaacgttttgagttgttcatcaacaagcatgagcttgccaatgcatacaccgaactcaatgatccagtggtacaacgccagcgttttgcagatcaactaaaggatcgacaatcaggtgatgatgaagcaatggctttggatgagacgttctgtactgctcttgaatatggtttacctccaactggtggctggggtttgggtattgataggctcacaatgttgctcactgattcacagaacatcaaggaagttctactgttcccggccatgaagccacaagacgaaccgcccgtcaaagctgtagagaacctgaaaatttgaagctcatgtatgaagtttcatcagcgtgagaagatgtaccaacagttttgttcctagcgattcatgct

SEQ ID NO: 1593 - DNA, 2193 bp, Chenopodium quinoa
gcccttgttcaaccaccgcactactttctctactacctctcttcttcttctccgtcgtcattcatggcgtctccggccgacgacgctgccaagtccgtcgctaatttgtctatggattctaaccctaatcctgaacccgaactcagcaagaatgcgttaaagaagcaaatgaagaacaagcagaaagaagaagagcgtcgtcgtaaggaggaggagaaggctgctaagcaggctgcaatgccgagctctcaaggtcagaaggctcaattagctgacgatgaggatatggaccctactcaatactttgagaacagggtgaaatcgctggatgcacagaaggcggcaggaatcaatccctacccacacaagttctttgttacattgagtatccctgaatatattcagaagtatggtgttttgaacaatggggaccatcttgaggatgtgcaagtatcgatagctgggagaatcatgagcaagcgtgcatcatcttcaaagcttttcttttatgatttgcatggcgaaggtgtcaaagtccaagtgatggccgatgctaggacttctgagctggacgaagctgaattttcgaagttccatgcttctgtgaaacgtggtgatatagttggtgtaactggattcccagggaaaacaaagagaggggaactaagtattttccccaagtcttttgttgttttatctcattgcctccatatgatgcctagacagaagcctggtgttgctgctgcttcagagaacgccaataaaggtgaagtctgggtcccaggaagtacaagaaatcctgagttgtacatcttgaaggatcaggaaacccgttatcgtcaacgatacctggatttgatgttaaatactgaggtcagagaaattttcaggacccgttcaaagattattcaatatatcaggaggtttcttgacaatcttggtttcctagaggttgaaacaccaatgatgaacatgattcctggtggtgcggctgctcgcccatttgtgacatatcacaatgacctaaatatgaagctatatatgcgtattgcgcccgaactgtatctgaaggagctagttgttggtggattagaccgtgtctatgaaattgggaagctgtttagaaatgagggtatcgacctgacacataaccctgagttcacctcatgcgagttttacatggcatttgcagattataatgatctgatggagatgactgaaaagttgttgagtgggatggtgaaggaattgactggtggttatgtcattaagtttcatgcaaatgggctagataaggagcctattgagattgatttcactcctccatacaggaggattgacatgatagaggaattagagaaaatggcaaatctgtccataccccaggatttagctagtgaagagactactcaatatttgatcaatgcatgtgcaaagtatgatgtgaaatgcccacctccacaaacaactactcgtttattggataaattggtgggacactttttggaggaaacttgcgtaaatccagcttttatcattaatcatccagagataatgagtccgttagctaaatggcacaggtcaaagcctgggttgactgagcgttttgaattgtttgtgaacaagcatgagctttgcaacgcgtacactgaactaaatgatcctattgtacaacgccagcgatttgctgaacaactgaaggatcgacaatctggtgatgatgaagcaatggcgttggacgagacattttgtacagctcttgagtatgggcttccccctactggtggatggggaatgggtattgatcgacttacaatgatgctgacagattcccaaaatataaaggaagtcttgctcttccctgctatgaagcctcaggatgagcctacaaccacaccagctaaagcctaaagctggagctgaagaacacttttgttgacaccactggcaaatgttatgtgattactttaggtggcttgctaattgaatcgtaaaccattttcaatactactccatttttgttactctaggaatcgtgtcattcagctttttgtaacagaatcattaaatctgattattttctgcatattattagtatacatctggctgtttccttctcatgtttgtatgtttcatatactaactaaattagctgaaccaatgcttgatttttgatgttataacctatccatg

SEQ ID NO: 1594 - DNA, 2311 bp, Elaeis guineensis
cttgcgtcccaagtagatcccaccaagggcaggacaaaaccctctaaaacctagaggctaaaacataacccgcccctctccactcctctcctctccttcgctcccctccaatctccccgcgatctctaatggcggacggagtcgaagcagcggctgagagcgtggccggcctctccatggactcctgcaaggccgaagccccaagcaagaacgctctcaagaaggagttgaagaagaagcagaaggaagaggagaagcggctcaaagaggaagagaagaagaagaaggccgcagccatgacgagtttgcagtctcagaagccatcatctgcggaggatgaagatatggaccctacgcaatactatgagagtaggctgaaggcccttgcttccctgaaggcagttggagtgaatccatacccgcataagtttcttgtgtccatgtccgttgtggactatgtcgagaagtatggaagattgagggatggggagcaccttaaggatgtcgaagtcagtttagcagggagaattatgaacaagcgagcttcttcgtcgaagctttacttttatgacttatatggtgatggtgttaaagttcaagtcatggctgatgccagggactcagacatggatgaggttgaatttgctagatatcatgctggtgtgaaacgtggcgatattgttggtatctgtggatatccagggaagagtaaaagaggagagctgagtatctttccaaagaagtttattgtcctctccccatgtcttcacatgatgccaagacagaaagctgccccaggtgctgataatgctgctgcaaagaaaaatgaaggtaaaacaccatcagatgtatgggtcccaggaatgacaaggaatcctgaaacatatgttctgaaagatcaggaaactcgatatcgtcaaagatatctggatctgatgttgaatcatgaggttaggcaaatatttaagactcgggcaaagattatttcttacatccggcatttccttgacaatcttggtttcttggaggtggaaacaccaatgatgaacatgattgctggtggagcagctgcaaagccctttgttactcatcacaatgaattgaacatgaagctgtacatgcgtattgctcctgaactgtacctcaaggagttagttgttggtgggctggaccgtgtttatgaaattggaaaacagtttaggaatgaggggattgatttaactcataatcctgaattcaccacgtgtgagttttatatggcttttgcggactacaatgatttgatggcactcacagaacaaatgttatctggaatggtcaaagagctaacaggtggttataaaataaagtatcatgcaaatggggtggacaaggatcctatagagattgattttactccccccttcagacgactcgacatgattgaaggattggaagctatggccaacctcagcataccaaaagatctttcaagtgaagcagcaaacaaatatttgttggatgcatgtgaaaaatttgatgtcaaatgcccccctcctcagactactgcaaggctgttggacaagcttgtagggcatttcttggaggagacgtgtgtaaatccaacttttattattaaccatccagagatcatgagtccgttagctaagtggcataggtcaagacctggcctgactgagcggtttgaattgtttgttaacagacatgaggtatgtaatgcatacacagaattgaatgatcctgttgtacagcgtgaacgatttgctggacagctgaaggatcgacaatcaggtgatgatgaggcaatggctttagatgaaacattttgcactgcccttgaatatgggctgcccccaactggtggttggggattggggatagatcggctagcaatgttgtttacagattctcaaaatataaaggaagttcttctctttcccgccatgaagcctcaagacgagccttctactaaagcttaattggatctcttacaatcataactggtgctgaagttttgcccaaatatttattttaaagaggtattttatgcctgcctgctggggtaggtaatagtacagtctccagtgtcatcatttgtgtttctttcaattttcagagaatggaaactattgttatgcttctcacattgatgaaaatatttgcgctgatgtttgttagcttgctgctattcaagcttatggtgagcttcatttaacccggtgtagaatatgcttctttatacaagtgtgctcgttgaactttgtccatgtgagatacaggaaaattaatgagatagaagaacctttaagct

SEQ ID NO: 1595 - DNA, 2216 bp, Elaeis guineensis
cctagagcaaacgccatccttttctctgctttcgccggcggccatctccacttcatcgacctccttcttgccgcaggcgtcgtctctctctccatctctaatggcggacggagtcgaagcagcggtggaaagcgttggcggcctctccatggactcatcttcggccggagcccccagcaagaacgctctcaagaaggagttgaagaagaagcagaaggaagaggagaagcggctcaaagaggaagaaaagaagaagaaggccgcggctatggcgaattcgcaatctcaaaagccagctgctgcagaagatgaagatatggaccctacgcaatactatgagaataggctgaaggtccttgcatccctgaaggcaggtggagtgaatccataccctcataagtttcatgtatccatgtccgttgtggagtatgttgagaagtatggaagtttgagcgatggggagcacctcaaggatgttgaagtcaatttagcggggagaattatgaacaagcgtacttcttcatccaagctttacttttatgacttgtatggtggcggtgttaaagttcaagtcatggctgatgctagggactcagacatggatgaggttgaatttgccagataccatgccggtgtgaaacgtggtgatattgttggtatatgtggatatccaggaaagagtaaaagaggagagcttagtgtctttccaaagaagtttgttgtcctatccccttgccttcacatgatgccaagacagaaatctgccctcggtgctgataatgctggtgcaaagaagaatgaagggaaaacaacaaatttgtgggttccgggaatgccaaggaatcttgaaacatatgtcttgaaagatcaggaaacaagatatcgtcaacggtatcttgatctgatgttgaaccatgaggttaggcaaatatttaagacccgggcaaagattatctcttacatccgaagtttcctcgacaatcttggtttcttggaggtggaaacaccaatgatgaacatgattgctggtggagcagctgcaaggccttttgttactcatcacaatgaactgaacatgacgttgtacatgcgtattgcgccagagctttacctaaaggagctggttgttggtgggctggaccgtgtttatgaaattggaaaacagtttaggaatgaggggattgatttaactcataatcctgaatttactacctgtgagttttatatggcttatgcggactacaatgatttgatgacactcactgaacaaatgctatccggaatggtcaaagagctaagaggtagttgtaaaataaaatatcatgcaaatggggtggaccaggatccaatagagattgattttactcctccattcagacgaatcgacatgattgaaggattggaagctatggccaacctcaatataccaaaagatctttcaagtgaagcagcaaacaaatatttgttggatgcatgtgaaaaattcgatgtcaaatgcccccctcctcagacaactgcaaggctgttggacaagcttgttgggcattttttggaggagacgtgtgtaaatccaacttttattattaaccatccagagataatgagtccattagccaagtggcatagatcaagagcaggcctgactgagcggtttgaattgtttgctaacaaacgtgaggtatgtaatgcatacacggaattgaatgatcctgttgtacaacgtgaacgttttgctgaacagctgaaggatcgacaatcaggtgatgatgaggcaatggctttagatgaaacattttgcactgctcttgaatatgggctgccaccaactggaggctgggggttggggatagatcggctagcgatgttgtttacagattctcaaaacataaaggaagttcttctctttcctgccatgaagcctcaagatgagccttctaacaaagcttagttggatctctaacaattggacctgatgatgaagttttgcccacatttattttgaggaggcatatgactgctggcacccacactttactgcatcaaggatcggtaatattatagtctccagaaacggcagttgtgtttattcaattttctgagtatagaaactgttcttatgcttcttacacatccaattgaaatatgtgctaatacttgttacttcacttctattcaagttaatgtgagctttatttaccctagtgtggaatatgttt

SEQ ID NO: 1596 - DNA, 1930 bp, Gossypium raimondii
acacaaattctgtgccaaatttcaagagcaaaccaaaaaaaggactgcaaattcagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaattgtcccgacaagaatattgatgctgaaactgaaaagcgccaccaacaattgaaggaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtagcatctttggaccatcctttgtccgaagaggtttctcatgctttgaaacaatcaattcgaagaggcttgcccagggttgaggcaaggcactatctttcagtataccaagatattgagtcccataataaggctttgttggagtttgctaagatcgatttcaacatgttacaatttttgcataggaaagagctaagtgagatttgtaggtggtggaaggatttagactttcaaagaaagttgccatatgcaagagatagagtggttgaaggttatttttggatctctggagtgtactttgagccccaatattcacttggtagaaagatgttgacaaaagtgatagcaatggcatctattgtagatgatacatatgactcatatgcaacatatgaagagctcattccctatacaaatgcaattgagaggtgggatatcaaatgcatagatgaacttcctgaatacatgaaaccaagctacaaggcactattagatgtttatgaagaaatggtacaattggtggctgagcatgggagacaatatcgtgtcgagtatgcgaagaatgcgatgatacgacttgctcaatcttaccttgtggaggccaaatggactcttcaaaactataaaccatcattcgaggagtttaaggctaatgcattgccaacttgtggttatgaaatgcttgctattacatctttcgtcggcatgggagatattgtaacgccagagacctttaaatgggcaactaataaccctaagatcattcaagcttccacaattatttgtaggtttatggatgatgttgctgaacacaagttcaagcataggagagaagacgattgctcagcaatcgagtgttacatggaagaatatggtgtaacagcacaagaggcatatgatgtattcaacaagcatgttgagagcgcgtggaaggatgtaaatcaagagtttttgaaaccaacagaaatgccaacagaggttttgaatcgtagcctaaaccttgcaagggtgatggatgtgctttacagagaaggagatggctatacatatgttggaaaagcggccaagggtggaattacttcattgctgattgagccaatcgcagtttgaaattatattaaaatttccttttcaagtctttttccttaaggaataaatattaaattttaagtaataatgttttataatattcttacttatcatataaagaaaaagtccaaattgattatatttgtattcactaccttgtattaatccaatgaagttttttctacctttttactatcaaa

SEQ ID NO: 1597 - DNA, 1920 bp, Gossypium raimondii
cctcacagattctgtgccaaatttcaagagcaaaccaaaaaaggcagcaaattaagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaattgccccgacaagaatattgatgctgaaactgaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggattcaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagatattgagtcccataataaggttttgttggagtttgctaagatcgatttcaacatggtacaacttttgcatagaaaagagctaagtgagatttctaggtggtggaaggatttagactttcaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagctcattccctatacaaatgcaattgagaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaaaccatcattcgaggagtttaaggctaatgcattgccaacttgtggttatgccatgcttgctattacatctttcgtcggcatgggagatattgtaacaccagaaacctttaaatgggcagccaatgaccctaagatcattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttctgttccttaaggaatagttattaagttataattaataatgttttataatatatatattataaaagaaattctaaatcaactgtctttgtattcatttccctgtattgatctaataaagttcttttcaagctttcatttgtgaaaaa

SEQ ID NO: 1598 - DNA, 1884 bp, Gossypium hirsutum
atttcaagagcaaaccaaaaaaaggctgcaaattcagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaattgtcccgacaagaatattgatgctgaaactgaaaagcgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatccattcgattccgactactccgagagcatggatacaatgtttcatgcgacgtattcaacaagtttaaagatgagcaagggaatttcaagtcatccgtgacaagcgatgttcgaggattgttggaactttaccaagcttcttatttgagggttcatggggaagatatattggatgaagcaatttctttcaccacccaccatttaagccttgcagtagcatctttggaccatcctttgtccgaagaggtttctcatgctttgaaacaatcaattcgaagaggcttgcccagggttgaggcaaggcactatctttcagtataccaagatattgagtcccataataaggctttgttggagtttgctaagatcgatttcaacatgttacaatttttgcataggaaagagctaagtgagatttgtaggtggtggaaggatttagactttcaaagaaagttgccatatgcaagagatagagttgttgaaggttacttttggatctctggagtgtactttgagccccaatattcacttggtagaaagatgttgacaaaagtgatagcaatggcatccattgtagatgatacatatgactcatatgcaacatatgaagagctcattccctatacaaatgcaattgagaggtgggatatcaaatgtatagatgaaattcccgaatacatgaaaccaagctacaaggctctattagatgtttatgaagaaatggtacaattggtggctgagcatgggagacaatatcgtgtcgagtatgcgaagaatgcgatgatacgacttgctcaatcttatcttgtggaggccaaatggactcttcaaaactataaaccatcattcgaggagtttaaggctaatgcattgccaacttgtggttatgccatgcttgctattacatctttcgtcggcatgggagatatcgtaacaccagagacctttaaatgggcagctagtgaccctaagatcattcaagcgtccacaattatttgtaggtttatggatgatgttgctgaacacaagttcaagcataggagagaagacgattgctcagcaatcgagtgttacatggaagaatatggcgtaacagcacaagaggcatatgatgtattcaacaagcatgttgagagtgcttggaaggatttaaatcaagagtttttgaaaccaacagaaatgccaacagaggttttgaatcgtagcctaaaccttgcaagggtgatggatgtgctttacagggaaggcgatggctatacatatgttggaaaagcggcaaagggtggaatcacttcattgctcattgaaccaattgcactttgaaattatgttaatttttcctctccaagcttgtttcttaagaaatagttattaagttctaattaataatgttttataatattcatatattataaaagaaagtccaaatcgattgtctttgtacttattgccttatattaattcaataaggttct

SEQ ID NO: 1599 - DNA, 1870 bp, Gossypium raimondii
atttgaagagcaaaccaaaaaaaaagcggcaaattaagctttcgaatatttgcttttgttcaatccaaatggcttcacaagtttctcaattgccttcttcatcaccccttacttccaataaggatgaaatgcgccccaaagctgattttcagcctagcatttggggagatctcttcctcacttgtcctaaaaaggatatcaatgcagaaactgaacaacgccaccaacaattgaaagaagaagtgaggaagatggttgtggcaccgatgaataattcaacccaaaagttaaacttcattgattcagtacaaagactgggtgtgagttaccatttcacaaaagagatcgaggatgaactagagaacatctaccataacaacaacgatgccgagaacgacatctacactacatctcttcgattccgattactccgagagcatggattcaatgtttcgtgtgatgtattcaccaagtttaaagatgagcaagggaactttaagtcatctatgacaagcgatgttccaggattgttggaactttatgaagcttcctatttaagggttcatggggaagatatattggatgaagcaatttctttcaccaccaaccatttaaggcttgtagtagcatctttggattatcctttatccgaacaggtttctcatgctttgaaacaatcaatccgaagaggcttgccaagggttgaggcgaggcactatctttcagtataccatgatattgaatcccataataaggctttgctggagtttgcaaagattgatttcaacatgttacaacttttgcataggaaagagctaagtgagatttgtaggtggtggaaggatttagactttcaaaaaaagttgccatatgcaagagatagagtggttgaaggttatttttggatctcaggagtatactttgagccccaatattcacttggtagaaagatgttgacaaaagtgatagcaatggcatctattgtagatgatacatatgactcatatgcaacatatgatgagctcattccctatacaaatgcaattgagaggtgggatatcaaatgcatagatcaacttccagaatatatgaaattgaactacaaagcactattagatgtttatgaagaaatggaacaactggtggctgagcacgggagacaatattgtgtcgaatatgcgaaaaatgcaatgatacgacttgctcaatcttaccttgtggaggccagatggactcttcaaaactacaaaccatcatttgaggagtttaaggctaatgctttgccaacttgtggttatgccatgcttgctataacatcttttgtcgggatgggagatatcgtaacaccagagacctttaaatgggctgccaatgaccctaagatcattcaagcttccacaattatttgtaggtttatggatgatgttgctgaacacaagttcaagcataggagagaagatgattgctcagcaattgagtgttacatggaagaatatggtgtaacagcacaagaggcatatgatgtgttcaacaagcatgttgagagtgcctggaaggatgtgaatcaagagtttatgaaaccaacagaaatgccaacagaagttttgaatcgtagcctaaaccttgcaagagtgatggatgtactttacagggaaggcgatggctatacatatgttggaaaagcggctaagggtggaataacttccttgctcattgaaccaatcgcactttaaaattatattattttttcctccaaaggaatatttaccaagttctaattaataatgttttataatataatataatataaaagaaagtccaaattgattgtctttgtactcactgcttatattaatccaatatttttttt

SEQ ID NO: 1600 - DNA, 1916 bp, Gossypium hirsutum
gactcgcacaaaatttgtgttatctttcaagagtgaatcaaaactgacaacaaattaagcatttgaatcttgctttttcatcaaccgaaatggccaaacaagtttctcaacttctttcttcatcaccccttacttccaacaaagatgaaatgcgtctgaaagccgactttcagcctagcatttggggagatctcttccttacttgtctcgacaatgatatcgatgctgaaactgaacaacgccaccaacagttggaaggaggagtgaggaagatgattgtggcaccaatggctaattcaacccaaaagttaaccttcattgattcggtccaaagactgggtgtgagttaccgattcaccaaagagatcgaagatgaacttgagaacatctaccataacaacaatgatgccgaaaatgacctctacactacatctcttcgatttcgattactccgagagcatggattcaatgtttcatgtgaggtattcaacaagtttaaagacgagcaaggggattttaagtcatcattgacaagcgatgttcgaggattgttggagctttacgaagcttcgtatttgagggttcatggggaagatatattggatgaagcgatttctttcactactgaccatttaacccttgcagtagcaactttagaatatcctttgtctgaacatgtttctcatgctttgaaaaaatcaatccgaagaggcttgccaaggattgaggcaaggcactatctttcagtataccaagatattgaatcccacaatacggctttgttggagtttgctaagatcgatttcaacatgttacaacttttgcataggaaagagctaagtgagatttgtaggtggtggaaggatttagacttcaaaagaaagttgccatatgtaagagacagagtggttgaatgttttttttggatcctgggagtgtactttgagccccaatattcacttggtagaaagatattgacaaaagtgatagctatgacttctgttatagatgatacatatgactcatatgcaacatatgatgagcttattccatatacaaatgcaattgagaggtgggatatcaaatgcatagaccaacttccagaatacatgaaactgagctacaaggcattattagatgtttatgaagaaatggaacaactgatggctgaggatggaagacaatatcgtgtagaatatgccaaaaatataatgatacaacttgctcaagctttccttatggaggccaaatggactcttcaaaaccacaaaccatcattcgaggagtttaaggctactgcattgcaaactactggttatgccatgcttgctattacagctttagttgacatgggagatattgtaacaccagagacctttacatgggctgctaataaccctaagatcattcaagcttctacaattatttgtaggtttatggacgatgttgctgagcacaagttcaagcagaggagagaagatgatttctcgggaattgagtgttacatggaagaatatggcgtaatggtacaagaagcatacaatgtgttttacaagcatatcgagagtgcctggaaggatgtgaataaagggtttttgaaaccaatcgaaatgccaatagaagttttgaatcgtatactaaatcttgcaagggtgatgaatgtgctttacaacgaaggtgatggctatacatatgttgggaaagcaactaagggtattatcagcatattgctcattgaaccggtcactctttgaaaattacaataattttcctcttcaagcttgttcttaaggggaaattattaggttctgattataatactctcatgtattccaaaataaattccaaattgtctgtctttgtactctttacctttatgttaatccaataaagatatttgccaccttttctttgtg

SEQ ID NO: 1601 - DNA, 1800 bp, Gossypium hirsutum
aaagcagcaaattaagctttcgaatatttgcttttgttcaatccaaatggcttcacaagtttctcaattgccttcttcatcaccccttacttccaataaggatgaaatgcgtcccaaagctgattttcagcctagcatttggggagatctcttcctcacttgtcctaaaaaggatatcaatgcagaaactgaacaacgccaccaacaattgaaagaagaagtgaggaagatggttgtggcaccgatgaataattcaacccaaaagttaaaacttcattgattcagtacaaagactgggtgtgagttaccatttcacaaaagagatcgaggatgaactagagaacatctaccataacaacaacgatgccgagaacgacatctacactacatctcttcgattccgattactccgagagcatggattcaatgtttcgtgtgatgtattcaccaagtttaaagatgagcaagggaactttaagtcatctatgacaagcgatgttccaggattgttggaactttatgaagcttcctatttaagggttcatggggaagatatattggatgaagcaatttctttcaccaccaaccatttaaggcttgtagtagcatctttggattatcctttatccgaacaggtttctcatgctttgaaacaatcaatccgaagaggcttgccaagggttgaggcgaggcactatctttcagtataccatgatattgaatcccataataagtctttgttggagtttgctaagatcgatttcaacatgttacaacttttgcataggaaagagataagtgagatttgtaggtggtggaaggatttagactttaaaagaaagttgccatatgcaagagatagagtggttgaatgctatttttggatcttgggagtgtactttgagccccagtattcacttggtagaaagatgacgacaaaagtgctagcaatggcatctcatttagatgatacatatgactcatatgcaacttatgatgagctcattatctatagaagtgctattgagaggtgggaaatcaaatgcatagatcaacttccagaatatatgaaattgaactacaaagcactactagatgtttatgaagaaatggaacaactggtggctgagcacgggagacaatattgtgtcgaatatgcgaaaaatgcaatgatacaacttcttcaattctactttatggaggccaaatgggctcttcaaaactacaaaccatcgttcgaagaatttaaggctaatgcagtgtcatctagtggttatgctatgcttgctatcacatctttcgtcggtatgggagatatgataacaccaaagacctttaaatgggcagttagcaatcctaaaatcattgaagcttccacaattatttgtcggtttacggatgatgttactgaacataagttcaagcataggagagaagatgaatggtcaacaattgactattacatgaaagaatatggcgcaacagcacaagaggcatacgatgtattcaacaagcatatcgagagtgcttggaaagatacgaatcaagagtttctgaaaccaagagaaatgccaacagaggttttgaatcgtagcctaaacctttcaagggtaatggatgtgttagacagggatggagatggttatacacatgttactaagccgattaaagatgcaatcacttcattgttgattgagcccatcacactttgaaattatattaagcttgttgtttaagggatagttattaagttccatctaataatgtggaaagtgcaatccattgtcttctacttgtggg

SEQ ID NO: 1602 - DNA, 1739 bp, Gossypium hirsutum
ttttaaatatttccttttgataaatcgaaatggcttcacaagtttctcaaaagctttcttcatcacccttttcttccaataaggatgaaatgcgtcccaaatccaatattccgccgcctagcatttggggagatgtcttcctcaattgtcccgacaagaatattgatgctgaaactgaaaaacaccaccaacaattgaaagaagaagtgaggaagatgattgtagcaccaatggctaattcaacccaaaagttacccttcattgattcagtccaaagattgggtgtgagttaccatttcacgaaggagatcgaagatgaactagagaacatctaccacaacgacaatgatgccgagaacgacctctacactacatctcttagattccgaatactccgagagcatggattcaatgtttcatgcaacgcattcaacaagtttaacgacgagcaagggaatttcaagtcatctgtgacaaacgatgttcgaggattgttggaactttacgaagcctcctatatgagggttcatggggaagatatattggatgaagcaatttctttcaccaccaaccatttaagccttgttgtagcatctttggactaccctttgtccgaacaggtttctcatgctttgaaacaatcaattcgaagaggcttaccaagggttgaggcaaggcactatctttcagtataccaagatattgagtcccataataaggctttgttggagtttgctaagatcgatttcaacatgttacaacttttgcataggaaagagctaagtgagatttgtaggtggtggaaggatttagactttcaaagaaagttgccatatacaagagatagagtcgttgaatgctatttttggatcttgggagtgtactttgagccccactattcacttggtagaaagatgatgacaaaagtgataataatgacatctattttagatgatacatatgactcatatgcaacatatgatgagctcattctctatacaagtgctattgagaggtgggagatcaaatgcatagaccaacttccagaatatatgaaactgagctacaaggcactattagatgtttatgaagaaatgaaacaactagtggctgagcatgggagacaatatcgtgtcgaatatgcgaaaaatgcaattatacgacttgctcaatcctactttgtggaggccaaatggactcttcaaaactacaaaccatcattcgaggaatttaagattaatgcattgtcatcttgtggttatgccatgcttgctattgcatctttcgtcggtatgggagatatcgtaacaccagagacctttaaatgggcaaccagtgaacctaagatcattcaagcttccacaattatttgtaggtttatggatgatattgctgaacacaagtttaagcataggagagaagacgattggtcagtaatcgactattacatgaaagaatataacgtaacagcacaagaggcatacgatgtattcaacaaatatattgagagtgcttggaaagatatgaatcaagagcttttaaaaccaacagaaatgccaacagaggttatgaatcgtagcctaaacctttcaagggtaatggatgtggtttacaaggaaggagatggctatacatatgttagaaaaagcgatgaaagatgtaatcacttcattgttgattgagccagtcacactttgaaatgatattaagcttgttgtttaagggatggatattaagtt

SEQ ID NO: 1603 - DNA, 1853 bp, Gossypium raimondii
gactcgcacaaaatttgtgttgtctttcaagagtgaatcaaactgacaacaacttaagcatttgaatcttgctttttcatcaaccgaaatggccaaacaagtttctcaacttctttcttcatcaccccttacttccaacaaagatgaaatgcgtcccaaagctgactttcagcctagcattggggagatctcttctttacttgatatcgatgctgaaactaaacaacgccaccaacagttggaaggaggagtaaggaagatgattgtggcaccaatggctaattcaaccctaaagttaaccttcattgattcggtccaaagactgggtaacatctaccataacaacaataatgccgaaaatgacctctacactacatctcttcgatttcgattacttcgagagcatggattcaatgtttcatgtgaggtattcaacaagtttaaggacgagaaaggggattttaagtcatcattgacaagcgatgttcaaggattgttggagctttacgaagcttcgtatttgagggttcatggggaagatatattggatgaatcaatatctttcactactgaccatttaacccttgcagtagcaactttagactatcctttgtctgaacatgtttctcatgctttgaaacaatcaattcgaagaggcttgccaaggattgaggcaaggcactatctttcagtataccaagatattgaatcccataatagagctttgttggagtttgctaagattgatttcaacatgttacaacttttgcataggaaagagctaagtgagatttgcaggtggtggaaggatttagacttccaaagaaagttgccatatgcaagagatagagtggttgaagattatttttggattctgggagtgtactttgagccccaatattcacttggtagaaagatattgacaaaagtggcagctatgacatctattatggatgatacatatgactcatatgcaacatatgatgagcttgttccatatacaaatgcaattgagaggtgggatatcaaatgcatagaccaacttccagaatacatgaaattgagctacaaggcattattagatgtttataaagaaatggaacaactgatggctaaggatggaagacaatatcgtgtagagtatgcaaaaaatgcgatgataccacttgctcaatcttaccttgtggaggccagatggactcttcaaaactacaaaccatcatttgaggagtttaaggctaatgctttggcaacttgtggttatgccatgctttctattacatcttttgtcgggatgggagatatcataacaccagagacctttaaatgggctgccaatgaccctaagatcattcaagcttccacaattatttgtagtgaggaattcaagcagaggagagaagatgattactcgggaattgagtgttacatggaagaatatggcgtaatagcacaagaagcatacgatgtgttcaacaagcatgtcgagagtgcctggaaggatgtgaataaagggtttttgaaaccaactgaaatgccaacagaagttttgaatcgtgtgctaaatcttgcaagggtgattaatgtgctttacaaggaaggtgatggctatacatatgttgggaaagcagctaagggtggtatcagctcattgctcatggaactgatcacactttgaaattataataattttcctcttcaagcttgttcttaaggagaaattattaggttctgattaatacaattttataatattctcatgtattgtaaaataaattccaaattgtctgtctttgtactctttgcctttatgttaatccaataaagatatttgccaccttttctttgtgaaa

SEQ ID NO: 1604 - DNA, 1815 bp, Gossypium raimondii
acacaaatatctgtgctaatttaagaacacaaatttattagcactttgaacaatctatttggttccaacaagagaaatacatggcttcacaagtttctcaaatccttgcttcaccccatacttccatcccctgcaacatggaaaatcgccccaaggctgattttcaccctggcatttggggagatatcttcctcaattgccctaatgaggatattgatactgcaactcaactccgatatgaagaactaaaagaagaagttaggcggatgcttgtggctcccatgggtgatagttcaaaccaaaaactgtccctaattgatgcagtccaaaggttgggtgtgtattaccattttgaggaagagattgaagatgcattagaagctatataccatgacaacaatgatgtcgacaatgatctctataccacctctcttcgatttcgattacttagagagcatggcttcaatgtttcatgtgaggtattcgataagttcaaagatgaggaaggaaatttcatgtcatccataaccactgatgtgcaaggactgttggagctttatgaagcttcgtatatgcgggtgcatggggaagatatattggatgaggcaatttctttcaccaccactcacctaactcttgcagcaccgactttagagtatccattgtcggaacaagttgcacatgccttaaaacagtccatccgaagaggcttgccaagggtcgaggctaggcgatacatttcgatataccaggatattgaatcccataataaggcattgttggaatttgcaaagatagatttcaacttgttacagcttttgcataggaaagagctaagtgaaatttgtaggtggtggaaggatttagactttacaaaaaagttaccatttgcgagagatagagtggttgaaggttacttttggataatgggagtgtactttgagccacaatactctcttggtagaaagatgatgacaaaagtaattgccatggcatccatcgtagatgatacgtatgactcatatgcaacatatgatgagctcattccctatacaaatgcaatcgagaggtgggatattaaatgtatggatgagctcccagaattcatgaaaataagctataaggcactattagatgtttatgaagaaatggagcaactaacggcagagcaagggagacaataccgtgttgaatatgcaaggaaggctatgatacgacttgctcaagcttaccttttggaagccaaatggacccatcaaaactacaaaccaacatttgaggagtttagggataatgcattgccaacctcgggctatggcatgcttgctattacagcttttgtgggcatgggagatgctataactccagagacatttgcatgggcaaccaatgaccctaagatcatcaaagcttccacaataatttgcaggttcatggatgacatcgctgaacacaagttcaagcatcggagagaagatgattgctcagccatcgagtgctacatggaacaatatggcgtaacggcacaagaggcttatgatgaattcaacaagcatatagagagctcctggaaggacattaacgaagagttcctgaaaccaacagaaatgccagtacctgttctaaatagaagtctcaaccttgcaagagtaatggatgtgctttacagagaaggagatggttatacacatgttggcaaagctgctaaaggtgggatcacttcattgctcatcgatccaattccactttgaacctatgtgccggttgaagatgtaattcattgagcaattgaattaataaattaagttaaattgc

SEQ ID NO: 1605 - DNA, 1957 bp, Gossypium raimondii
taagaactcaaatttattagcactttgaacaatatatttggttccaacaagagaaatacatggcttcacaagtttctcaaatccttgcttcaccccatacttccatcccctgcaacatggaaaatcgccccaaggctgattttcaccctggcatttggggagatatcttcctcaattgccctaatgaggatattgatactgcaactcaactccgatatgaagaactaaaagaagaagttaggcggatgcttgtggctcccatgggtgatagttcaaaccaaaaactgcccctaattgatgcagtccaaaggttgggtgtgtattaccattttgaggaagagattgaagatgcattagaagctacataccatgacaacaatgatgtcgacaatgatctctataccacctctcttcgatttcgattacttagagagcatggcttcactgtttcatgtgaggtattcgataagttcaaagatgaggaaggaaatttcatgtcgtccataaccactgatgtgaaaggactgttggagctttatgaagcttcgtatatgcgggtgcatggggaagatatattggatgaggcaatttctttcaccaccactcacctaactcttgcagcacctactttagagtatccattgtcggaacaagttgcacatgccttaaaacagtccatccgaagaggcttgccaagggtcgaggctaggcgatacatttcgatataccaggatattgaatcccataataaggcattgttggaatttgcaaagatagatttcaacttgttacagcttttgcataggaaagagctaagtgaaatttgtaggtggtggaaggatttagactttacaaaaaagttaccatttgcgagagatagagtggttgaaggttacttttggataatgggagtgtactttgagccacaatactctcttggtagaaagatgatgacaaaagtaattgccatggcatccatcgtagatgatacgtatgactcatatgcaacatatgacgagctcattccctatacaaatgcaatcgagaggtgggatattaaatgtatggatgagctcccagaattcatgaaaataagctataaggcactcttagatgtttatgaagaaatggagcaactaacggcagagcaagggagacaataccgtgttgaatatgcaaggaaggctatgatacgacttgctcaagcttaccttttggaagccaaatggacccatcaaaactacaaaccaacatttgaggagtttagggataatgcattgccaacctcgggctatggcatgcttgctattacagcttttgtgggcatgggagatgttataactccagagacatttgcatgggcaaccaatgaccctaagatcatcaaagcttccacaataatttgcaggttcatggatgacatcgctgaacacaagttcaagcatcggagagaagatgattgctcagccatcgagtgctacatggaacaatatggcgtaacggcacaagaggcatatgatgaattcaacaagcatatagagagctcctggaaggacgttaacgaagagttcctgaaaccaacagaaatgccagtacccgttctaaatagaagtctcaaccttgcgagagtaatggatgtactttacagagaaggtgatggttatacacatgttggcaaagctgctaaaggtgggatcacttcattgctcattgaccctatcccactttgaacctatgtgccagttggagttgcaattcattgagcaatcgaattaataaattaagttaaactgcgacgacgagaattgattttaactaatttgttttcttcatttatgtaaaaggttaataaattccacctcctttatatttttttttattttctaatcttgtaaaactcattgcttatgcgtaaaaaaaaattgtccattattctacatgtgaaattaaaaaagtt

SEQ ID NO: 1606 - DNA, 1603 bp, Theobroma cacao
tacaacctggaaattaaagttttcaatctatatccttcaacttttcctttagatgttttgattgatttcactcagttttctatcaattgagtttcctattgtgggtttacttgattggtgatattacttgattggccatttacctaccagaaaggtccaagacaaagcccaaaagccccatgtccgtgacgccaaattttaggcagcttaccagcaatagacggcaactagggttatcctttgtatcttacccaacaccaacagataattgaagcacttgtattctcagcagacggaaaaattatgatgcaggcgccttatgatgcaacggtgcggttgatgttggcttctctggagcggaatttgctgcctgatgctgttataaggaggctaacacggttgctcttggctagccgtctccgctctggttatagaccctccattgaactccaactctctgacctcctccaattcgctcactctttaaaggagatgcctatagctatcaagacagataagcctaaaactcaacattacgaactgccaacatctttcttcaagttggttcttgggaagaacttcaaatacagttgttgttacttctctgatgggtcgagaactttggaggatgctgaggaagcaatgttagagctgtactgtgagaggtcgcaattgaaagatgggcacacagttcttgatgtggggtgtggatggggttcactttctctgcacattgcccggaaatatcccaattgcagggtcacaggaatctgcaattccaccacacagaaagcttttatagaggagcaatgccgggatcatcagttacagaatgtggagatcattgttgcagacataagctcatttgaaatggaggcatcatacgacaggatatattccattgaaatgtttgagcatatgaagaactatcaggatcttctcaagacgctatccaagtggatgaaacaggatagtcttctttttgttcattatttctgccataaagcatttgcttaccactttgaggacataaatgaagatgactggataactaggtacttcttcacaggaggtacaatgccttcagctaatctgcttctttatttccaggatgatgtttctgttgtcaatcattggcttgtgaatgggaaacattatgcacagactagtgaagagtggctcaagagaatggaccacaacctggcttccattaagccaataatggagtcaacctatggcaaggatcaggctgtcaaatggaccgtctattggagaacattctttatcgctgttgcagaactttttggatacaataatggagaagaatggatggttgcactattcctattcaaaaagaaatgaagcagtcaatgctcctttccacctgaaaccaacattggaggataaaaggctcttgtattccaagaaagctgtaacaaccgcatcaggaaccaaaatagcctattttttccaatgttttacttggtgctgttatcttatatgttagtaatccttgctagttttttatttgttaagttaatccttactagttactattgtttaatttcaattttaaccagtgcccctttgtgggagttcaggg

SEQ ID NO: 1607 - DNA, 1214 bp, Quercus alba
gaatgaataagataacgcaggtaccgtacgaagcgacagttcggttgatgttgggttcactggagcggaatttgctaccggacgccgtgattaggaagctgacccgtctcctcttagccactcgccttcgctccggttacaagccctctgcccaactccaactatcccacctcctccaattcgtactttctcttagagagatgcccatagccatcaagactgatgatccaaagactcagcattatgaactcccaacctctttcttcaagctcgtccttggaaacaatcttaaatatagttgttgttacttctctgataactcaaaaaccctagagaatgctgaagaaacaatgttggagctctattgtgagaggtcacagttaaaagatggtcacactgttcttgatgttggatgtggctgggggtcactctctttgtacattgctcggaagtatagtaattgtagggttacagggatttgtaattcaacaacccagaaagcacatattgaagaacagtgtcgggatcttcagctgcagaatgtggagatcattgttgcagatattagcgtatttgaaatggaagcatcctatgaccgaatattttccatcgaaatgtttgagcatatgaagaactatgaggatcttctgaagaagatatccaagtggttgaaagaggacagctttctctttattcatcatttctgccataaagcatttgcttaccactttgaggacataaatgaagatgactggattactagatacttcttttctggaggtacaatgccttcagcaaatctgcttctttattttcaggatgatgtttctgttgttaatcattggcttgtgaatgggaagcactatgcacagacaagtgaagagtggttgaaaagaatggacaagaacttgtcttccataaagccaattatggaatcaacctatggcaaggattctgctgtgaagtggactgtctactggagaacattcttcatcgctgttgcagagctctttggatacaatgatggagaagaatggatggttgcacatttcttattcaaaaagaataaaagcagaagccaaagcttcttcctaattgattttcaattttttgtgagactttccaatttaagtatggtatcaaggaatcaatctactatcatttgtaataagtgtcacttgttttgtagtggaaataactcattactgagtttt

SEQ ID NO: 1608 - DNA, 1288 bp, Quercus alba
atgaataagataacgcaggtaccgtacgaagcgacagttcggttgatgttgggttcactggagcggaatttgctaccggacgccgtgattaggaagctgacccgtctcctcttagccactcgccttcgctccggttacaagccctctgcccaactccaactatcccacctcctccaattcgtactttctcttagagagatgcccatagccatcaagactgacgatccaaagactcagcattatgaactcccaacctctttcttcaagctcgtccttggaaacaatcttaaatatagttgttgttacttctctgataactcaaaaaaccctagagaatgctgaagaaacaatgttggagctctattgtgagaggtcacagttaaaagatggtcacactgttcttgatgttggatgtggctgggggtcactctctttgtacattgctcggaagtatagtaattgtagggttacagggatttgtaattcaacaacccagaaagcacatattgaagaacagtgtcgggatcttcagctgcagaatgtggagatcattgttgcagatattagcgtattcgaaatggaagcatcctatgaccgaatattttccatcgaaatgtttgagcatatgaagaactatgaggatcttctgaggaagatatccaagtggttgaaagaggacagctttctctttattcatcatttctgccataaagcatttgcttaccactttgaggacataaatgaagatgactggattactagatacttcttttctggaggtacaatgccttcagcaaatctgcttctttattttcaggatgatgtttctgttgttaatcattggcttgtgaatgggaagcactatgcacagacaagtgaagagtggttgaaaagaatggacaagaacttgtcttccataaagccaattatggaatcaacctatggcaaggattctgctgtgaagtggactgtctactggagaacattcttcatcgctgttgcagagctctttggatacaatgatggagaagaatggatggttgcgcatttcttattcaaaaagaaataaaaggagaagccaaagcttcttcctaattgattttcaattttttgtcagactttccattttaagatggtatcaaggaatcaatctactatcattttgaataagtgtcacttgttttgagtggaaatactcattactgagttttacacgcagagttatttcaaggatgttcaagttacaattatcactgatataagcataaattgatgctacggttcttat

SEQ ID NO: 1609 - DNA, 1565 bp, Populus trichocarpa
acatggagctcgttcatcaaggataagagaaagtcacagaatccaatctagagcgtgcggctctctatctgtgttggccaagaggtatttagctagcttgtagctgtagtagatttctacttgaaatggagagattaatgcaggtgccttatgaagcaacggtgaaggtgatgttagcatctctggaaagaaatttgctaccagatgcggtgatcaggaggctcactcgcatgctcttggcagaccgtcttcgttcttgctacaagacatcctctgaactccagctagctgaccttctccaattcgttcattctctaaaagaaatgcctatagctatcaagactgataagccaaaaactcaacattatgaattaccaacctctttctttaagctggtcctcgggaaaaatctcaaatacagctgttgttatttttctgataaatcgaacaccttggaagatgctgagaaagcaatgttggagctgtactgcgaaaggtcacagttaaaagatggacacactgtccttgacgttggatgtggctgggggtcactctctttatacattgcccaaaagtacagtaactgtaaaattactgggatttgcaattcaacaacacagaaagtacacattgatgagcagtgccgggatcttcagctgcagaatgtggagatcattgttgcagacattagcacatttgaaatgcaggcatcctatgaccgtatatactccattgaaatgtttgagcatatgaagaattatggagatcttcttaacaagatatccaagtggatgaaacaagatggccttcattttgttcattatttctgtcacaagcaatttgcttaccactttgaggatgttaatgaagatgactggattactaggtatttcttcacaggaggtacaatgccttctgcaaatctgttactttatttccaggatgatgtttccattgttgatcattggcttgtgaatgggaaacattattcacagacaagtgaggagtggctcaaaagaatggaccggaacctagctgccattaagccaataatggagtcaacctatggtaaagatcaagctgttaagtggactgtttactggagaacattcttcattgctgttgcagaactctttggatacaacaatggagaagagtggatggttgcacatttcctttttaataaaaaatgaagtattccaatctccttttcagcagaagataagactatgttggaagaggtggtgctgtacatctctttttccaagtcaataaggccttaatgataagggtttaagtgaatctgtcgactgaataaccaccattttgaatgtgtattccgttgtcagttgaataactgtgttcttatatctcaaacacagttgtaaattgggttaaccaatttctcagattctgttttatcaaacaggcgagccgtgctccaagtttctcagttaattcaaaatttccttctttgatttcagttttcattgctacattaggaattgcttgttgcatgctattgatacaaccatattatttgatagttttatcaatatttatat

SEQ ID NO: 1610 - DNA, 1318 bp, Quercus alba
agagagagagagagagagagagaatgaataagataacgcaggtaccgtacgaagcgacagttcggttgatgttgggttcactggagcggaatttgctaccggacgccgtgattaggaagctgacccgtctcctcttagccactcgccttcgctccggttacaagccctctgcccaactccaactatcccacctcctccaattcgtactttctcttagagagatgcccatagccatcaagactgatgatccaaagactcagcattatgaactcccaacctctttcttcaagctcgtccttggaaacaatcttaaatatagttgttgttacttctctgataactcaaaaaccctagagaatgctgaagaaacaatgttggagctctattgtgagaggtcacagttaaaagatggtcacactgttcttgatgttggatgtggctgggggtcactctctttgtacattgctcggaagtatagtaattgtagggttacagggatttgtaattcaacaacccagaaagcacatattgaagaacagtgtcgggatcttcagctgcagaatgtggagatcattgttgcagatattagcgtattcgaaatggaagcatcctatgaccgaatattttccatcgaaatgtttgagcatatgaagaactatgaggatcttctgaggaagatatccaagtggttgaaagaggacagctttctctttattcatcatttctgccataaagcatttgcttaccactttgaggacataaatgaagatgactggattactagatacttcttttctggaggtacaatgccttcagcaaatctgcttctttattttcaggatgatgtttctgttgttaatcattggcttgtgaatgggaagcactatgcacagacaagtgaagagtggttgaaaagaatggacaagaacttgtcttccataaagccaattatggaatcaacctatggcaaggattctgctgtgaagtggactgtctactggagaacattcttcatcgctgttgcagagctctttggatacaatgatggagaagaatggatggttgcgcatttcttattcaaaaagaataaaagcagaagccaaagcttcttcctaattgattttcaattttttgtcagactttccattttaagatggtatcaaggaatcaatctactatcattttgaataagtgtcacttgttttgagtggaaatactcattactgagttttacacgcagagttatttcaaggatgttcaagttacaattatcactgatataagcataaaattgatgctacggttcttattttgttca

SEQ ID NO: 1611 - DNA, 1530 bp, Manihot esculenta
atgaaggacttaattcagctgccttacgatgcttctgtgcgggttattttagcttcactggaacgaaatttgttgccagacgctgtcgttaggagattcactcgattgctgttggcctctcgtctccgttctggctacaagccttcttctgaactccagctcgccgacctccttcatttcgtgcattctctcaaacagatgcctattgctatcatgactgagaagcccaaagcgcaacattatgaacttcctacttctttcttcaagttggttctgggcaaaaatttcaagtacagttgttgttatttttctgacaaatcaaacaccttagaggatgctgaggaagcaatgttggagctctactgtgagaggtcacagctaaaagatggccacactgtccttgacattggatgtggctggggatcactctccatatacattgctcgaaagtacagaaattgcaggattactgggatttgcaactcaacaacccagaaagcattcatcgaggagcagtgtcgggaaaatcagctgcagaatgtagaaattattgttgcagatattagcacattagaaatggaggcatcctatgatcgcatattctccattgaaatgtttgagcatatgaaaaactacaaagatcttcttcacaagatatccaagtggatgaaagaggacagtcttctttttgtgcattatttctgccacaagacatttgcttaccactttgaggatataaatgaagatgactggattactaggtatttcttcagtggaggaacaatgcctgctgcaaatctgctgctttatttccaggatgatgtttctgttgtcaaccattggcttgtgaatgggaaacattatgcacagacaagtgaggagtggctcaaaagaatggacaagaacttgggtttgattaagccaataatggaatcaacttatggcaaagaacaatctctcaagtggactgtctactggagaacattcttcattgcagttgcagaactttttggatacaacaatggagaagaatggatggttgcacttttcctatttaagaaaaaatgaagcatgaaaaaaacaccctcctctcagttgaagatgacatgggagccatggctgaggcggagaatcccggtgatagagcaaagatctggttggcaaaatcgacgccaacagtaggagagctccgatcgttgaagagccaacaggattggcccaatgggaggcaaatctggttattgtggagacttttgttgggtgagaagagactgtcggttgagatggaaaaaaagcggagggaaagaatctagggacttgaatttatttgatatttttcgatgaattagcgacgggattaattttgtcactaatattttttctgtcgctaatctgccctttcgcgtcgtcaaaatgtaataagttttcctatcgcaaatttgtcgcagattctatcgctaattattgttttgcgacagacatatgtttcggtgcaaatttcgacgcaaaaacccctatttacttatagtg

SEQ ID NO: 1612 - DNA, 1475 bp, Euonymus alatus
cggccgggggaggtgagaaaactaaaaacgagtggtgagaattaagagccatgatagacccgcaggaggtgcagtagcaattcgcaaagcacagcgatcgagggagaagtccattgagaacatcagagagagccagagagataatggaagggttggtgcaggtaccatacgatgcgacggtgaagctaatgctggcttcactggagcgaaatctgctaccggacgctgtcgtgcggaggcttacaaggttgctcttggctagccgccttcgctccggttacaagccatcctctgaacaacagctctctgacctcgtgcactttgcacattctttgaaagagatgccaattgctatcaagactgagaaaccaaaaacccaacactatgaactgccaacctctttcttcaaactggtacttggcaaacatctcaagtacagctgttgctactttactgatgataagtcgagcaccttagaggatgctgagaaagcaatgtttgagctttactgcaaaagatcacagctaaaagatggtcaaactgttcttgatgttgggtgtggctggggatcgctctctctttacattgcccaaaaatacagaaattgcaaggttacaggaatttgcaattcaacaacacagaaagctcatatcgaggaacaatgccggaatcttcagctacaaaatgtggagattattgtcgcggatattagcacatttgaaatggatgcatcttatgaccgtatattctccattgaaatgttcgagcatatgaagaactacaaggagcttctcaagaaaatatcaaagtggatgaaagaggatagccttcttttcattcattatttttgccataaagcatttgcttaccattttgaggatataaatgaggatgactggattactaggcacttcttcactggaggaacaatgccttcttcaaatcttctgctttattttcaggatgatgtttcggttgtcgatcactggcttctgaatgggaagcactacgcacaaacaagtgaagagtggctaaaaagaatggaccagaactctgcttctatcaagccgataatggagtctacgtatggcaatgatcaggcagtcaagtggactgtctactggagaacattctttattgcagttgcggagctctttaactacaatgatggagaagaatggatggttgcacttttcctatttagaaggaagtaaagaaaaaggcaagagggaactcttcctagaggaagagtagatgaagggaaaaaagtgaatacaccattgttgtcatgaaaacaatgtttttcaatctaagtaaaacttcaatgagggtctatgtagcagtttgtgggagttaccctgtacattgtgggtgtttccctataataagtgtagtgcacatttatatgaaatatgttgttcaaataataggaagtatgcacctcacagagtctctttactcggaggtacaaggaa

SEQ ID NO: 1613 - DNA, 1149 bp, Tripterygium wilfordii
gaggtgagaagtatatccattgagaaaatcagagagagcgagggagatgatggaagggttggtgcaggtaccatacgatgcaacggtgaagctaatgctggcttcactggagcgaaatctgttaccggacgctgtcgtgcggaggcttacacggttgctcttggccagccgccttcgctccggttacaagtcctcctctgaactacagctctccgacgtcgtgcactttgcgcattctctgaaagagatgccaattgctatcaagactgatgaaccaaaaacccaacattatgaactaccaacctctttcttcaaactggtacttggcaaacatctaaagtacagctgttgctactttcctgataagtcgaggaccttagaggatgctgagaaagcaatgtttgagctttactgcgaaaggtcaaagttaaaagatggtcaaactgttcttgatgttgggtgtggctgggggtcactctctctctacattgcccaaaaatacagaaattgcaaggttacagggatttgcaattcaacaacacagaaagctcatattgaggaacaatgccggaatcttcagctacaaaatgtggagattattgttgcagatattagcacatttgaaatggatgcatcttatgaccgtatattctccattgaaatgtttgagcatatgaagaactataaggatcttctcaagaaaatatcaaagtggatgaatgaggatagccttcttttcattcattatttttgccataaagcatttgcttatcatttcgaggatataaatgatgatgactggattactaggcacttcttcactggaggaacaatgccttcatcaaatctactgctttattttcaggatgatgtttctgttgttgatcactggcttgtgaatggaaagcactacgcacaaacaagtgaagagtggctcaaaagaatggaccagaacttggcttctatcaagccgataatggagtctacatatggcaacgatcaggcagtcaagtggattgtatactggagaacgttctttattgcagtcgcggagctctttaattacaatgatggagaagaatggatggttgcgctattcctatttagaaggaagtaaagtaaaagacggacaaagaactgaatacgcca

SEQ ID NO: 1614 - DNA, 1413 bp, Eucalyptus grandis
gtcatcttcatgacgtacggataacaaattggaggacggcgacaaaaggcagaggcaggcagtgccgtccccaacagacgccaccgccgcgccgccgtcgaccgccctatcgcttcgagccttccgcgggcgaatggagaagatgatgcaggtgccgtacgaggcgacggtgaaggtgatgatggcctccctcgagcgcaacctcctgcccgacgccgtcatccggcggctcacgcgcttgctcctcgccggccgcctccgctcctgctaccgcccttcctccgacctccagctctccgacctcctccacttcgcccattctctgaaagaaatgcctatcgccatcacgacggagaagcccaaagaacagcattatgagctgcccacttcgttcttcaagctggtgctcggcaagcatctcaaatacagctgctgttacttctccgacaagtcgatgaccttggaggatgctgaaaaggcaatgctggagctctactgtgagaaatcccagttgaaagatggccacactgttctggatgtgggatgtggatggggctcactgactctgtatatagcacaaaaatacagcaactgcaagattacaggaatatgcaactcgacaacacaaaaagcacacattgaagagcagtgccggaatcttcagttgcagaatgtggagatcattgttgctgatatcagcacatatgaaatggaagcttcatatgatcgaatattctctatcgagatgtttgagcatatgaagaactataaggatcttctccagaaaatttcaaagtggatggaagaggatggccttctttttgttcatcatttctgccataaggcatttgcataccattttgaggacataaatgaagatgactggattactagatacttcttcaccggtggtacaatgccctcggctaacctgcttctttattttcaggatgacgtttctgttgtcaatcattggctggtcaatgggaagcattatgcacagacgagtgaagaatggctcaagagaatggatcagaatttggcttcaatcaagcccatcatggagggtacttatggcaaggaacaagctgtcaagtggactgtctactggagaacattcttcatcgccgttgcggaactatttggatacaatgatggagaagagtggatggtggcacttttcctgtttaaaaagaaatgagtttgttcatctctctatcgatttgaaggatacatgtttaagtatagcttggagattaagctgaggcacataattctggcgcagctaagcatgataacgaactctttatcattgttcaagatgaattagagtcgcaaccatttaaatagcagcaaattttgctatgttgtttgatgatcatgtaagagggaatttgaagcggacgaacatag

SEQ ID NO: 1615 - DNA, 1285 bp, Citrus sinensis
aaaaaaaacgctgaatttaataaatttaaaaagtaattacaggtcaacgatttcaccggttaccctttcaaaactggcagcatgaagaggcagagtccaaatccaagggtgtcaaggaattaaataaataaatacaaaaagcgcagttataattattgttatcatacatctgcggcacagaaataagagagaattgcaaatggaggggataatgcacgcagcttacgatgcaacggtgcggctgatgctgtcatcacttgaacggaacttgctaccggacgccgtcatcaggaggctcagccgtttgctcttgggaggccgacttcgctccggctacaaaccttcagctgagctccaactcagcgacctcctccagttcgcacattcactgagagagatgcctatagccatccagacggacaaggcgaaagagcagcattatgaactgccaacctctttcttcaagttggttcttggtaaatatttcaaatacagctgctgttacttctctgatgcatcaaaaaccttagaggatgctgagaaagcaatgttggagctgtactgtgagaggtcgaggttggaagacggtcacactgttcttgatgttggatgtggctgggggtcactgtccctctacattgctcaaaagtatagtaattgcaagattactgggatatgcaattcaaaaactcagaaagaatttattgaggagcagtgtcgggttcttgagcttcaaaatgtggagattattgttgcagatatcagcacatttgaaatggaagcatcctatgaccgaatatactccattgaaatgtttgagcatatgaagaactatcagaatcttctcaagaagatatcaaagtggatgaaagaagacacccttctttttgtccatcatttctgccacaaaacatttgcctatcactttgaggacacaaatgatgatgattggattacaaaatacttcttcactggtggaacaatgccttcagctaatctacttctttatttccaggacgatgtttctgttgttgatcactggcttgtgaatggaaagcattatgcacaaaccagtgaagagtggctcaaaagaatggacaacaacttggcttcaattaagccgataatggagtcaacatatggaaaggatcaagctgtcaagtggactgtttattggagaacattctttatagctgttgcagaactctttggatacaacaatggagaagaatggatggttacacatttcctattcagaaagaaaatggagtagaaggatgctgga

SEQ ID NO: 1616 - DNA, 1337 bp, Malus domestica
gcgagcagcagagctagacggtggagaaatgaacagagtaatgcaagcaccgtacgatgctaccgtccggttcgcgctggcttcgctggagcggaatctgctgccggacgccgtcgtgaggcggctgacacggctgctcttggcgagccgtctccggtccggttacaggccttcctccgagctccagctttccgacctccttcaattcgtgcaatctttgaaggagatgcccatagccataaagactgatgatccaaaagctcaacactatgaagttcccacatcttttttcaagatggtgcttgggaaaaatctcaaatatagttgttgctacttcaatgatgagtcaagcacattggaggatgctgagaaagcaatgttggagctctactgtgaaaggtcacagataagagatggtcacactgttcttgacgttgggtgtggctggggatctttgtctttgtacattgcgcagaaatacaacaactgcaaggttaccgggatctgcaactcaacgacacaaaaagcttttatagaagaacaatgccggaatcttcagctgcagaatgtggagatcatcgtcggagatatcagcacgtttgaaatggaggcttcctttgaccgaatattttcaattgaaatgtttgagcatatgaagaactataaggatcttctgaagaagatatccgggtggatgaaagacgacggccttctgtttgttcatcatttctgccataaagcatttgcttaccactttgaggataaaagtgaagatgactggattactaggtacttcttcagcgggggtacaatgccctcagcaaatctgctactttatttccaggatgatgtttccattgtgaatcattggctcgtcaacgggaagcactacgcgcaaacaagtgaagagtggctcaaaagaatggatcggaacacggcttccataaaaccgatcatggagtcaacttacggcaaggattcagccgtgaagtggacggtttattggcgaacattcttcatttccgttgcagaactcttcgggtacaacaacggagaagaatggatggttgttcatttcctattcaagaagaaatgaagcaaacaaagctctgttctgacacgaggcaatggcgatggaaaatcgagtgcatcttcgttgttcaataatgtttccttcatcttaactttgtaacagcagtcagcggtcagcaatgtcaaaaggaaatcaagcgcgtatttgttgttcaataatgtgactgttgagggattgtaaaagtataaacccttcaaattattagacagtttgctggttgatcacacaaaaccctaacagaaaa

SEQ ID NO: 1617 - DNA, 1648 bp, Citrus clementina
aaaaaaaacgctgaatttaataaatttaaaaagtaattacaggtcaacgatttcaccggttaccctttcaaaactggcagcatgaagaggcacagtccaaatccaagggtgtcaaggaattaaataaataaatacaaaaagcgcagttataattattattatcatacatctgcggcacagaaataagagagaactgcaaatggaggggataatgcacgcagcttacgatgcaacggtgcggctgatgctgtcatcacttgaacggaacttgctaccggacgccgtcatcaggaggctcagccgtttgctcttgggaggccgacttcgctccggctacaaaccttcagctgagctccaactcagtgacctcctccagttcgcacattcactgagagagatgcctatagccatccagacggacaaggcgaaagagcagcattatgaactgccaacctctttcttcaagttggttcttggtaaatatttcaaatacagctgctgttacttctctgatgcatcaaaaaccttagaggatgctgagaaagcaatgttggagctgtactgtgagaggtcaaggttggaagacggtcacactgttcttgatgttggatgtggctgggggtcactgtccctgtacattgctcaaacgtatagtaactgcaagattactgggatatgcaattcaaaaactcagaaagaatttattgaggagcagtgtcgggttcttgagcttcaaaacgtggagataattgttgcagatatcagcacatttgaaatggaagcatcatatgaccgaatatactccattgaaatgtttgagcatatgaagaactatcagaatcttctcaagaagatatcaaagtggatgaaagaagacacccttctttttgttcatcatttctgccacaaaacatttgcctatcactttgaggacacaaatgatgatgattggattacaaaatacttcttcaccggtggaacaatgccttcagctaatctacttctttatttccaggacgatgtttctgttgttgatcactggcttgtgaatggaaagcattatgcacaaaccagtgaagagtggctcaaaagaatggacaacaacttggcttcaattaagccgataatggagtcaacatatggaaaggatcaagctgtcaagtggactgtttattggagaacattctttatagctgttgcagaactctttggatacaacaatggagaagaatggatggttacacatttcctattcagaaagaaaatggagtagaaggatgctggagaaagaaagcaagcatgtgtttgtaaaactgacaattgttttagtgtgtgttttgcattttaaatgaaaataaggcttgccttgtaatcattataaggcagctgctaagttggaccatatcattgacggtgcacgtagcgttacagatggcccctgatgttgatgatttctatgattccctataggagattctagccattgtggcccgggacaaaggccctgtctagtgcacatagccctaacaatcattgtaatggagggagccctgtctaatgcctgtaatggatactcagctctccagttggtttctctttctcatatttctcggtttacgctgaatcaagtcactgcgtttgaatcatc

SEQ ID NO: 1618 - DNA, 1210 bp, Prunus persica
cgggaatgaaccggataatgcaaccaacgtacgatgctacggtccggttcgcgctatcttcgctggagcgaaatttgctaccggatgcggttgtacggaggctgacccgcctgctcctagcaagtcgtcttcgatccggttacaagcctacctctgagctccaactctctgacctcctccagttcgtacagtctctgaaggagatgcccatagccataaagactgatgacccgaaagctcaacattatgaagtgcccacatcttttttcaaaatagtgcttggaaaaaatctcaaatacagttgttattacttcactgatgggtcaagcaccctggaggaagctgagaaggcaatgctggagctttactgtgaaaggtcacagatcaaaaatggtcacactgttcttgatgttgggtgtggctggggatctttgtctttatacattgctcagaaatatagcaactgtaaggttacagggatttgcaattcaacaacacaaaaggctttcatagaagagcaatgccggaatcttcagctgcggaatgtagagatcatagtcgcagatatcagcacatttgagatggaagcatcctatgaccgaatattttctatcgaaatgttcgagcatatgaagaactacaaggatcttctgaagaagatttccaggtggatgaaacaggatggccttctgtttgttcatcatttctgccacaaagcatttgcttaccattttgaggacaaaaatgaagatgactggattactaggtatttcttcagtgggggcacaatgccttcagcaaatctactgctttatttccaggatgatgtttccattgtcaatcattggcttgttaatgggaaacactatgcacagacaagtgaagagtggcttaagagaatggaccagaatgtggcttccataaaaccaattatggagtcaacttatggaaaggattcggctgtgaagtggaccgtatattggagaacattcttcatttccgttgcagaactctttgggtataacaatggagaagagtggatggttgctcatttcctattcaagaagaaatgaagtaatgaaagcctgtttcgctacgaggcaacgccgatggaaatcaaacgtatttttgttgttcaaaaaatgttccttcttgagattgtaaaagcagcaatgtcaatggaaatgaattgtatctttgttgttcaata

SEQ ID NO: 1619 - DNA, 1424 bp, Trifolium pratense
gtataaacaaagtgtagcaagcaccaccaccacgtggctgtgtagtgttattcttaccatattatcatctggcaagcaaacagaagaagtttggtgtggtggttggaaaagatggaagggatgatgcagctaccatacaacacaacggtgaagctcatgcttggttcattggaacgcaatcttctccctgatgctgtcattaggagactcacgcgcctgcttttggccactcgccttcgctcttcttacaagtcttcttctgaacttcagctctctgatcttctccaatttgcacattctttacaagagatgcctattgctgtcaatactgatattccaaaatctcaacattatgaattaccaacctctttctttaagcttgttcttggaaagaatctcaagtacagttcttgttatttctcttctgcctcaaagacattggaagatgctgaagaagaaatgttgaaactgtactgtgagagatcaaacctgaaagatggtcatactgttcttgatgtcggatgcggttggggatcactgactttatacattgccaagaatttcagtaattccagggttacaggaatctgcaattccaccactcaaaaagcttttatcgaggagaaatgcctggagctgcagctgcaaaatgtggatatcattgttgcagacattagcacatttgaaatggaagcttcttatgacagaatattttctatagaaatgtttgagcatatgaagaactacaaagatcttctcaagaagatatccaaatggatgaaagaggatggtcttttatttgttcattacttctgccacaaaacatttgcctaccactttgaggacaaaaatgaagatgattggatcacaagatacttcttcactggaggaactatgcctgctgcaaatctacttctttattttcaagatgatgttactgtcatcaaccattggctggtaaacgggaaacactacgcacagaccagtgaagagtggctgaaaagaatggataagaacatgaaatccatcaagccaattatggaatcaacatatggccaagattcagctactaaatggactgtctattggagaacatttttcatagctgtagcagaactttttggatacaataatggcgaagaatggatggttgcacactttcttttcaaaaagaaataaacaaaaccgaaacgttattttcttgatttgcagcaaactgagtaaggatttaaaaggaggaaaaagaaactgttcaacaaggcggcatacttcaataattgttggatacttttattggttgatgaacttattttatttggttgtgcctatcttttgttacaaagtcttcaattggaaaataaatatcaaacgaaaggtaaatgaacagaatcaatttagtttggttgatgcatcacacagaattg

SEQ ID NO: 1620 - DNA, 2161 bp, Prunus mume
ctgtttttgtgtgtgcctctgctggggtccacgtcgacggttggtatgaggtacgacatggacagctaatttagtccataccagtagccagagaggaagcaaaggcagcgagagagtgggcggagctagaagaaacgaagcgagaatgaaccggataatgcaagcaccgtacgatgctacggtccggttcgcgctatcttcgctggagcgaaatttgctaccggatgcggttgtacggaggctgacccgcctgctcttagcaagtcgtcttcgatccggttacaagcctacctctgagctccaactctctgacctcctccagttcgtacagtctctgaaggagatgcccatagccataaacactgatgacccgaaagctcaacattatgaagtgcccacatcttttttcaaaatagtgcttggaaaaaatctcaaatacagcagttgttacttcactgatgggtcaagcaccctggaggaagctgagaaggcaatgctggagctttactgcgaaaggtcacagataaaagatggtcacactgttcttgatgttgggtgtggctggggatctttgcctttgtacattgctcagaaatatagcaactgtaaggttacagggatttgcaattcaacaacacaacaggccttcatagaagagcaatgccggaatcttcagctgcagaatgtagagatcatagtcgcagatatcagcacatttgagatggaagcatcctatgaccgaatattttcgattgaaatgttcgagcatatgaagaactacaagtatcttctgaagaagatttccaggtggatgaaacaggattgccttctgtttgttcatcatttctgccacaaagcatttgcttaccattttgaggacaaaagtgaagatgactggattactaggtatttcttcagtgggggcacaatgccttcagcaaatctactactttattttcaggatgatgtttccattgtcaatcattggcttgttaatgggaaacactatgcacagacaagtgaagagtggcttaagagaatggaccagaatatggcttccataaaaccaattatggagtcaacttatggaaaggattcggctgtgaagtggaccgtatattggagaacattcttcatttccgttgcagaactctttgggtataacaatggagaagagtggatggttgctcatttcctattcgagaagaaatgaagtaatgaaagcctgtttcgctacgaggcaacgccgatggaaatcaaatgtatttttgtagttcaatcaaataatgttccttcttgagattgtaaaagcagcaatgtcaatggaaatgaattgtatctttgttgttcaataatgttcctcttgagattgtaaacttcaaatgatatcatcgtgtggattaactagctcagcaaaagtacaatctagacgtcaaacaatttgctctttgaacacagcaagttctaacataaacgaaagcaaaaactactgagaagaaccagtcggagcgccatcggctttggttgttctggaggaagcaacttcaatggtggagctcacaggcccttcagcctccaagaagcgactcaactgtttatctgccaaatgttgctgcccagaacaagaacaaaaaaaacccaacaaacgaattgagcaagtattgatgatttcaatgaagactcgggagatggtttttatcgaaaacttacagagaggcaagctttgtatttctgccattctgaaacgcattcttctttgtcccattgaccctttacaaacttctctgaataccacctgcacataatatcaaaacccttttcagaaaaaccaaaaatggattgagggtattgagaaatagattagggttgaagatggatttacggggaataagggatacgatttgtctgcaaagaacatagaaaagctacatataaagaaaatgagagatgacctgctgaaacaattgtggtaagtagctctgagattagcacatggtgatgttgaagaagaagaggggcttctcttgttctgagagtctgtgaggatccccatctcgtcacaggtggcaggtccgatttcacacccagatgaaaaacgttatgggccggtatatatattcttggctagattgggctgtttcaaaagcactgggaaagtgat

SEQ ID NO: 1621 - DNA, 1390 bp, Sarracenia psittacina
cgtatgatgctatagtgagggggcgggataaccagcgaacttagagagatggctgcgttagtacaggttccgtatgatgctacagtgcgcctaatgctaacttcgctggagcgtaacctactacctgacggagtcataaggaggctcactcgcatgctactatcgactcgtctccgttccggttacaaaccctcatccgagctgcaactctcggatctcctccacttcgctcgctctttgcgagaaatgcctatagccatcaagactgaggagccaaaatctcaacactacgaactacctacctctttcttcaaacttgttcttggaaagcatctcaaatacagctgttgttacttcactgatgcatcaaacaccttagaggatgctgaaaaagcaatgctggagttgtactgtgagagggcacagataaaagatggccactctgttctcgatattggatgtgggtggggatcactctctttgtacattgcccaaaagtatcgtaattgcaaggttacagggttttgtaactcaacaacgcagaaagcatatattgaggaacagtctcgagatcttcagctgcagaatttggaggtcgttgttggagatattagcacatttgatatggatgcatcctatgaccgaatattttccattgagatgtttgagcatatgaagaactacaaggatcttcttaagaagatatctaagtggatgaatccagatagccttctttttgtacattatttctgccacaaagcatttgcttatcactttgaggatgtaaatgacgatgactggattactaggtacttctttactggaggtacaatgccggcagcaaatctactactttatttccaggacgatgtttctgttgtcaaccattggcttgtgaatgggaagcattatgcaaagacaagtgaagagtggcttaagcgaatggacaaaaacctgacttccataaagccaataatggagtcaacttacggaaaggattctgctatcaaatggactgtctattggagaacattcttcatagcagttgcagaactctttgggtacaacaacggggaagagtggatggttgcgcttttcctgttcaagaagaaatgaattcatctaatctcgatttgttggatagtaattagcaaaactcagggaaaaaaaacttcatttttcttcgacagtgtgtgattcttgtcataagattgggtggttgatttgctgaaccattgctttgcctaatatggagaaggccttttcttagtatgcccaggcttagcatatttccataccatgttcttcgtcaatttggagtcttaggaacgaatataaatttctgaatgtgactctgaactgggaggagataagattgaaaaaagcattt

SEQ ID NO: 1622 - DNA, 1244 bp, Platanus occidentalis
agagaagccatggaagcgttgattcaggtaccgtatgaggcgacagtgaagatgatgctggtctcgctggagcgcaacctcctcccggacgccgtcataaggaggctgacgcggttgttgttagccagtcgtcttcgcttgggatacaaaccctcctctgagctgcaactctccaacatccttcactttgcacattctcttgaagatatgccaatagcaatcaagaccgatatacctaagtcccaacattatgaattgcctacctccttcttcaagttggtgctaggaaagaatctcaaatacagctgttgttacttcattgataagtcaagcactttagaggatggtgagaaagcaatgttggagctgtactgtgagagagcacagataaaagatggtcaaactgtccttgatattggatgtgggtgggatcactctctttatatattgctcaaaatatggtaattgcaggattacagggtatttgcaattcaactactcagaaaacatatatagaggagcgatgtagagacttgcagctgcaaaaatgtggagatcattgttgcggatataagcacatttgaaatggatgctacctttgatcgaattttatccatagaaatgtttgaacacatgaagaactataagcagctccttaaagaaaatatccaagtggatgaatcaggatagcctccttttcatccattacttctgccacaaggcattcgcttaccactttgaggacaaaaatgaagatgactggattaccagatacttcttcactggagggacaatgccttctgcaaacctacttctttatttccaggatgatgtttctattgttaatcattggcttgtaaatgggacacattatgcacgaaccagtgaggaatggcttaagagaatggaccagaacatgtcttctataaagccaataatggagtcgacttatggcaaggattcagctgttaaatggaccgtctattggcggacattcttcatctcagtggcagagctcttcggatataacaacggagaagaatggatggttgcacttttcctattcaagaagaaataaagatgtcaggttcctacgacatatttctgtttttcttgcttatttcatttcttcttacaccgcttttggttggatgactgggatacaaaaaactggagctccagagaataattagggaaaccattccaaaagaactactgagttattatcatgaattgaaggaaaa

SEQ ID NO: 1623 - DNA, 1490 bp, Nicotiana benthamiana
gaggcagagcccataacttgtagataagcccctgtactgcataaaagagaaacttaaatagccatttttgcttctccttagtccttaaacagatcagaaagatggacgcgatagtacaagtgccttacaacgctacggtgcgtttaatgctgtcttctctagaacgcaatctcttgcctgatgccgttatacggcggctcacacgactgctcttagctgcccgacttcgttccagttacaagccttccgctgagcttcagctctctgaccttctccactttgtgcactctttaagagagatgcctatagctgtgatgactgagaaggcgaagtcccaacattacgagcttcctacgtctttcttcaagtttgttcttggaaagcacttcaaatacagctgctgttatttccacgacaagtcaagcactttagaggatgctgaaaaagcaatgatggaattatactgtgaaaggtcacagttgaaagatggacacactgtactagatgttggatgtggctggggatctctttctctatacatagcacaaaagtacagtagctgcaaaattactggaatttgcaattcagtgactcaaaaagcacatatcgaagagcaatgccgggaacttcagctgcagaatgtggagatcattgttgcagatattagcacatttgagatggaaggttcctatgatcgaatattgtctattgaaatgtttgagcatatgaagaactatggagatctcctcaagaaaatctccagatggatgaaaccagatagtcttctttttgttcatcatttttgccacaaggcattcgcttaccacttcgaggatgtcaatgatgatgattggatcactcgctacttcttcagtggaggtacaatgccttctgcaaatctcctcctttattttcaggatgatgtttctgtggttaatcactggctcgttaacggaaagcattatgcacagacaagtgaagaatggcttaagagaatggaccagaacaaaacttccattaagccaataatggaatcaacttatgggaaggattcagctgttaaatggactgtctattggagaacatttttcatttcagttgctgaactgtttggctacaacaatggagaagaatggatggttgcacatttcctcttcaagaagaaatgatttggccactgcccgcttttatactgcaaacaaactgtagaagaaataagcatgtctgctcagctgtccacatgcattttacccaaaaagcttcaataggagaacactctgtacgtctcatgtttgaagagttggatcttgcactgatttccttacttacagagcattaggagggtagacgatgtgccgattgctgtgatcttaatttgcatattagtttcgtgcttgttgttttatacttcaataacacacaagaggggtgatttgtgcggtgaccaatttttcgcttaaactgattatggaaagacctagttcttacaa

SEQ ID NO: 1624 - DNA, 1180 bp, Trigonella foenum-graecum
gataaggtattctgaaaaccaagactaccaccactagcacgtgtctttgtttattgttactagcattagtatcacaacacaagaacacagacacagaagaagtgtggtgtggtagatggaaaagatggaagggatgatgcagctaccttacaacacgacggtgaagctgatgcttggttccctggaacgcaacttgctacctgacgctgtcatcaggagactaacacgtttgcttttgtccactcgtcttcgctcttcttacaaaccttcctctgaacttcagctctctgatcttctccaatttgcacattctttgcaagagatgcctattgctgtcagtactgatgtgccaaaatctcaacattatgaattaccaacctctttctttaagctggttctcggaaagaatctcaaatacagttcgtgttatttctcttctgcttcaaagacattggaagatgctgaagaagaaatgttgaaactgtattgcgagagatcaaacctgaaagatggccatacagttcttgatgtcggatgcggttggggatcactcactttatacattgccaagaattacagtagttccagggttacaggaatctgcaattccacgactcaaaaagcttttattgaggagaaatgccgggagctgcagctgcaaaatgtggaaatcattgttgcagacattagcacctttgaaatggaagcttcttatgacagaatattttccatagaaatgtttgagcatatgaagaactataaagatcttctcaataagatatccaaatggatgaaagaggatggccttttattcgttcatcatttctgccacaaaacatttgcctaccactttgaggacaaaaatgaagatgattggattacgagatacttctttactggaggaactatgcctgcagcaaatctacttctttattttcaagatgatgttactgtcgtcaaccattggctggtgaatgggaaacactatgcacagaccagtgaagagtggctaaaaagaatggatcagaacaagacttccatcaagccaattatggaatcaacatacggcaaagattcagctactaaatggactgtctactggagaacatttttcatagcagtagcagagcttttcggatacaataatggcgaagaatggatggttgcacactttcttttc

SEQ ID NO: 1625 - DNA, 1439 bp, Trifolium pratense
tggaaaagatggaagaaataatgcagctaccatacaacacgacggtgaagctcatgcttggttcattagaacgcaatcttctccctgatgctgtcattaggagactcacgcgccttcttttggccactcgcctacgctcttcttacaagtcttcttctgaacttcagctctctgatcttctccaatttgcacattctttacaagagatgcctattgctgttaatactgatattcctaaatctcaacattatgaattaccaacctcttttttaagctggttcttggaaagaatctcaaatacagttcttgttatttctcttctgcctcaaagacattggaagatgctgaagaagaaatgttgaaactttattgtgagagatcaaacctgaaagatggtcacactgttcttgatgtcggatgcggttggggatcactcactttatacattgccaagaattacagtaattccagggttacaggaatctgcaattccaccactcaaaaagcttttgtcgaggagaaatgcctggagctgcagctggaaaatgtggatatcattgttgcagacattagcacatttgaaatggaagcttcttatgacagaatattttctatagaaatgtttgagcatatgaagaactataaagaccttctcaacaagatatccaaatggatgaaagaggatggtcttttatttgttcattacttctgccacaaaacatttgcctaccactttgaggacaaaaatgaagatgattggattacgagatacttctttaccggaggaactatgcctgcagcaaatctacttctctatttccaagatgatgttactgtcgtcaaccattggctggtaaacgggaaacactacgcacagaccagcgaagagtggctcaaaagaatggataaaaacatgaaatccatcaagccaattatggaatcaacatatggcaaagattcagctactaaatggactgtttattggagaacatttttcatcgctgtagcagaactctttggatacaataatggcgaagaatggatggttgcacactttcttttcaaaaagaaataaagttgaaactgttcttctcttgatttccgaattgagttaggatttaaaagtaataaaaaactgttcaacgagtctgcatacttcaataattgttgaatacttttattggttgatgaacttattttatttggttgtgcctttcttttgttacaaagtcttcaattggaaaatagatatcaccatagatcaatggcattcgtcgttgaaacgaaaggtaaatgaacacaatcaatttagtttgtgaacccagaattcaattcatcatgttctgttatttcctttttgaacttcttgtatcttgttctttcaacctgtcttgtgacatgtgaattgttgaccgacttgattcttggtttactgataa

SEQ ID NO: 1626 - DNA, 1362 bp, Solanum tuberosum
gcttccttctcgcgaatcaaaaaaatggatgcgatagtacagctgccttacgatgctacggtacgggtgatgctgggttctctagagcgcaacctcttgccggacactgttatacggcggctcattcgactgctcttagccgcccgacttcgctccggttacaaaccatcctctgagctacagctgtctgatcttctccaatttgtgcactctttaaaagagatgcctatagctgtgatgactgagaagccaaagtcccaacattatgaactccctacctctttcttcaagattgttcttggaaaacacctcaaatacagctgctgttacttcaaagacaagttgagcactttagaggatgctgaaaaagcaatgatggaattatattgtgaaaggtcacagttgaaagatggacacactgtacttgatgttggttgtggctggggctccctttctctatatatagcacaaaaatatagtgcctgtaaagttaccggtatttgcaattcagtcacccaaaaagcacacatagaagagcagtgcagggagcttcagctgcagaatttggagatcatagttgcagatattagcacattcgagatggaagaatcctatgatagaatattgtctattgaaatgtttgagcatatgaagaactatggagatctcctgaagaagatgtcaagatggatgaaggcagatagtcttctttttgttcattatttttgccataaagcatttgcttaccactttgaggatgtgaatgatgatgattggatcactaggtacttcttcagtggaggtacaatgccttctgccaatctcctcctttattttcaggatgatgtttctgtggttaatcattggctggttaatggaaaacactatgcacagacaagtgaagaatggcttaagagaatggatgagaacaagagttccataaagccaataatggagtcaacttatgggaaggattcagccgttaagtggactgtctactggagaacgtttttcctttcagttgctgaactgtttgggtacaacaatggagaagaatggatggttgcacatttcctcttcaagaagaaatgaatttgccaagcaaactgtaccaagtaataagcatgtcaacatgcatttgcactattaccataaattaaagtagaatgtgttgctatcatatattaatattactaccatattttctcccttacaaaatgacaatccatgtctatatattcagtcatttcatggaatataggatttgttgtaatttggattgcagccttactgtcacacatcatcttcacatgtaattcaatcttaactccaagttctttgaataaaaaaaaaaaaaaaaaa

SEQ ID NO: 1627 - DNA, 1455 bp, Fragaria vesca
atttaggatcgccattttcgagccaacaaaggtagcattgcatgtgtttggtcagagacacggtcccgctacagtgttatcctatctcgtagcagaagaaccagagccagagcagctagcaaagcaaaaatggatcgagtaatgcaggcaccctacgatgctaccgtccgattcgctctggcgtcactggaaaggaatctgttgccggacgccgttatacgacggttcacgcgcttgctcttagctagccggctacgcaccggttaccagccttcctctgagctccagctctcccaactcctccagttcgttaagtctctgaaggagatgccaatagctatcaagactgatgatgctaaagctcaacactatgaagtaccgacttctttcttcaagatggtgcttggaaacaatctcaaatatagttgttgttacttcactgataagtcaagcagcttggaggatgctgagaaggccatgttggagatgtactgtgagaggtcgcagattaaagatggcgatagtgttcttgatgtggggtgcggatggggatcactgtctctgtacattgctgagaagtataagaattgcaaggttactgggatatgcaattcagcaacacagaaggcttttatagaagagcagtgtaggaatcgtcagctggagaatgtggagatcattgttgcagatatcagcacatttgagatggaggcatcatatgacagaatattttccattgaaatgtttgagcacatgaagaactacaaggatcttctgaagaagatatccgggtggatgaaacaggacggccttctgtttgtccatcatttctgtcacaaagcatttgcttaccactttgaggataaaagtgatgatgactggattactagatacttcttcagtggaggtacaatgccttcggcaaatctactactgtatttccaggatgatgtttctgttgtcgatcattggcttgtcaatgggaagcattatgcacaaacaagtgaagaatggctgaagagaatggaccataactcagctgccataaaaccaattatggagtcaacttatggcaaggattcagctgtgaagtggactgtgtattggagaactttctttattgcggttgcagaactctttggctacaacaacggagaagaatggatggttgctctcttcctattcaaaaagaaatgaagcagccagagctctatttcagtacatctctacaaagcattgtcaatcttttccaaaataagtgtatctctgttcttcaatagtattaccgctgagattgtaagagcataaacacacctaattcggagaattcaaattatcatcgtgttcattaagtagctcagtaaactcacaatgtcaggcaatcttctagtggaacacagcaaactccactacaaagatcgccaaaattacacagttttgagtctttcgacaaag

SEQ ID NO: 1628 - DNA, 2048 bp, Cicer arietinum
gctttatattgctctcaatgcaataatatatatttagttttctataaagatatttttagcatcaaaagatatttccaaactccaaagaaaaaaaaaaagacaaaaaaaattcggttccagtggaaaaataaaaataaaacaactactaaaaagataaggtgttatagtagaaaccaagattaccatcacatgtctgtgtactgttattcttaccattaccacaaataacaaaacagacacataagaaaagtgtggtgtggtggttggacttgaattgaaacaatggaagggatgatgcagttaccatacaagacgacggtgaagctgatgcttggttcacttgagcgtaatttgctccctgatgctatcataagaagattcacacgtttgcttttggctactcgtcttcgctctggttacaaatcttcctctcaacttcagctctctcatcttctccaatttgtacattctttacaagagttgcctattgcagtcaatactgataagccaaaatctcaacattatgaattaccaacctctttcttcaggctggttcttggaaataatctcaagtacagttgttgttatttctcttctgcctcaaagacactagaagatgctgaagaagaaatgttgaaactgtattgcgagagatcaaacctggaagatggtcatacagttctcgatgtcggatgcggttgggggtcattgacattatacattgccaagaattacagtaattccagggttaccggaatctgcaattccacgactcaaaaagcttatattgaggagaaatgcttggagctgcagctgcaaaatgtggatatcattgttgcagacattagtacatttgaaatggaagcttcttatgacagagtattttccatagaaatgtttgagcatatgaagaactataaagatcttctcaacaagatatccaaatggatgaaagaagatagccttttatttgttcatcatttctgccataaagcatttgcctaccactttgaggacaacaatgaagatgattggattacaagatacttctttacgggaggaactatgcctgcagcaaatctacttctttatttccaagatgatgtttctgtcgtcaaccattggctggtaaatgggaaacactatgcacagaccagtgaagagtggctcaaaagaatggataagaacatgagttccatcaagccaattatggaatcaacatatggcatagattcagctactaaatggactgtctattggagaacatttttcatagctgtagcagaactttttggatacaataacggcgaagaatggatggttgcacactttcttttcaaaaagaaatgaagaaagccggaatcattcttctcttggtttgcgatttgagtatggatttaaaagggaacaaacaattcaacgaggctgaatacttcaatatttattgtatactttattgataaactagttttatttggttgtctgcctatgtttttgtgataaagtgagttttcacttggaaaataaatatcaccagagatcaatgccaaatggcctttgtagttgaaaatgaaggtgaatgaacaaaatctattctagtatggttggtacatcacacaaaatagcaagttaaatccagaataatccatttcaaagactgggtggacttaggtggaatcattcaaacttgaacaaaattgcaaatctatgagtgagtaattaatctatggagttttctgctagaactctatattgaaaacctgtgtggaaaagtgaaattcaatctaagctgttgttaatcattgatccattgtaactctaacaagatctgttttgatgtcaacccaccacaaacagtcttgtcatgaattacaggttttattgaactgggattctgtttgtaatgtcttgttctttcaacctgtccggtaacttgtgaattgttgactgacttgatccttggtttattgactgccaacaacttatttcaagtcatcctcactacagaattgccacttcgtggatgaaccttgacaggttttttaagt

SEQ ID NO: 1629 - DNA, 1324 bp, Euphorbia peplus
aatttcatcataatctccatcaatcttcctcacaatcagtgtattctcaaccttatactcactaatctctatcaaacaaaccaaatcatccatcaatttcagaatcttagagctaaatttcaagtttgtagctccaaaaaaccctgaaaatggagagcttaatgcagctaccgtacgacaccaccgtgaaagtaatgcttggatcactggaacgaaacttgcttcccgacgccgttattaggaggctcactcgcttgttgctcgccacgcgccttcgctccggttacaagtccacttctgagcttcagctctctgatctgctccagttcgtccattctctgaaagagatgccgatagcaattaagaccgacgacgctaaatctcagcattatgaacttcccactgctttcttcaaattggttctcggcaataatctcaagtacagttgttgttatttttcggataaatcaaacaatttggaggatgctgagaaagcaatgctggagctttactgtgagaggtcacagctaaaagacgggcatagtgtgcttgacgttgggtgtggatggggctccctctgtttgtacattgcccataagtatagcaattgcagggttactgggatttgcaattctaagactcagaaggctcacattgatgaccaggctcgggcccgtaatctgcagaatgtagaaatcattgttggtgatattaccacatttgaaatggaaggatcctatgaccgtatctactctatcgagatgtttgagcatatgaagaactataaggatcttctacacaagatatccaagtggatgaaagaagagagtcttctttttgttcatcatttctgccataagacatttgcttaccactttgaggatgtaaatgatgacgactggattacaaggtatttctttagtggaggaacaatgcctgctgcaaatcttttgctttatttccaggatgatgtttctgttgtcaatcattggcttttgaatgggaaacactatgcacagacaagtgaggagtggctgaaaagaatggaccagaagatgggtttaataaagccaataatggagtcaacctatggcaaggatgaagctgtcaaatggactgtctactggagaactttctttatatctgttgctgaactttttggatacaacaatggtgaagaatggatggttactctcttcctctttaagaaaaaatgaaccaccctcctcctcctttctgttgatcatatcctatatttgcatttttcaactttactactaaacaaggatacccaaacactcacttcttctatttctgtgctatt

SEQ ID NO: 1630 - DNA, 1794 bp, Mesembryanthemum crystallinum
gagcaaagataagagagagagagagagagagagagagagagaagagagaagaatggagaaattgatgcaaatgccatatgaagcaacagtgaagttgatgctaacttcacttgagaagaatttgttaccagatgctgtgataaggaggctcactcgtcttctattggctagccgtcttcgttcaagctacaaatcttccactgaaattcaattctctgatctccttcactttgcccactctttgagagagatgccaatagccattcagactgaaaagccaaaatctcaacactatgagcttcctacttccttctttaaacttgttctaggacaacacttcaaatacagttgctgttatttttctgacaagcacaccagcctagatgatgcggagaaagcaatgttagaaatgtactgtaagaggtcagagataaaagatggccatactgttcttgatgttggatgtggctgggggtctcttgctttgtacattgcccagaaatacagtaaatgtcaggtcactgggatatgcaactcggtgacacagaaagaattcattgaagagcagtgtagggatcgtcacctgcagaatgtggagattattgtagctgacataagtacatttgaaatggagggatcctatgatagaatattctctattgaaatgtttgagcatatgaagaactaccgagatcttctcaagaagatatcaaactggatgaaacccgatggctttctatttgttcattatttctgtcataaagcattcgcctaccactttgaggatgttaacgaggatgactggatcacgaggtacttcttcactggaggcacaatgccttctgcaaacctcctcttgtacttccaggatgatgtcactgttgtcaatcattggctcgtgaatgggaagcattacgcgcaaacaagcgaagagtggcttaaacggatggacaataacttggtttctataaggccgataatggagtcaacatacggtaaggattcagctaccaaatggactgtatattggcgaaccttcttcatagcggtggcagagctgttcgggtacaacgatggcgaagaatggatggttgctcacttcctattcaagaagaagtgaggttacttgtgcaagcttatgttctcatcaacgaacactaatttccacttgctaatgaaggctgcactatcttaccaaaactccatgtcacatctcagtttgggatgcttgcttactcctattttgttacagtccgtgtaaattattgtttgagctcagagctcatagacatgggaaagccttgatgcgctaaagtgagttgtccccatcgattagaaaaaaagtgtcttaagctcgcctattgattgggacaaattcaacaaggtaactgatatatcccagataaccatcctcacccaaaaaaacaaaaaactcgaggggggcccggtaccattccgcctatagtgagtcgattacggcgctaactggcgcggttatcacgtctgactggaaaaacctgcgtaccaactaaatgcctgagaaatccccttcgcaatggctataccaaagccccaccgtggctttccacattgccaccaatggcatggaccgccttacgggcatataccggcctctgtttgtcccactgccctacattaaggctaaacccgctttcgttttctcttttttccagtgggtttcccaagtaatggggctcttaggcatatgttcgccctcccaaaaaatttggggtggtttgggctccccaaaaggtttccctgtattacatttag

SEQ ID NO: 1631 - DNA, 1498 bp, Glycine max
aggataagtcagtagggaagagccctttgtggttgtggttgtgggtaggtgctgctgctgcttccattcctattcttacagtgaaggttcaatggaagggacaatgcagcttgcatacgagactgttgtgaagctcatgctggctgcactcgaacgcaacgtgctccctgacgtcatcaccaggagactcacgcgcttgctgttggctactcgccttcgctctgcttacaaaccctcctcccaacttcaactctccgatctcctctacttcgcgcattcattacaagagatgcccatagcaatcaacactgacaagcctaagtctcaacattatgaattaccaaccgctttcttcaagctcgtcctcggaaacaatctcaaatacagctgttgttatttctcttctgcctcaatgacgctggatgatgctgaagaagcaatgttgaaactgtactgtgagagatcaaacctgaaagatggtcatacagtgcttgatgtgggatgcggttggggatcgttggctctatacattgccaagaattacactaactgtagggttacaggaatctgcaattccacaactcaaaaggcttatattgaggagaagtgtagggatcttcagctgcaaaatttgaatattatagttgctgatattagcacatttgaaatggagacttcttatgacagaatattttccatagaaatgtttgagcatatgaagaactataaagatcttctgaagaagatatccaaatggatgaaagaggatagccttttatttgttcattacttctgccacaaagcatttgcctaccactttgaggacaaaaatgaagatgactggattacaagatacttctttactggaggaactatgccttcggcaaatctacttctttatttccaagatgatgttactgtcaccaaccattggctagtaaatgggaaacactacgcacagaccagtgaagaatggctcaaaagaatggaccagagaatgactttcatcaagccaattatgcaatcaacatacggcaaggactcagctaccaagtggactgcttattggagaacattcttcatagctgtagcagaactttttggatacaataacggtgaagaatggatggttgcacacttccttttcaaaaagaaataaataagccgaaacctagtctttttatttgactatttgagaacggccttaggacaaaaaagctgctacacgaggttgcacccttcaataatgttgtatacttttattagttaacttgttttagttggttgcttgtctttatttttccctgttgtaatggtgttgccactccaaccttattttatcttaaattttgggaaagtccaattcaaccctcggaacttagggtcatgcacgattgcatgtgttctctagtccataaattttaaaatgtgcacttaagagcctttgtaacgaaaatggttatgctcaaggtagatgaccatatatttgtgcacgctc

SEQ ID NO: 1632 - DNA, 1372 bp, Euphorbia esula
ccccattccacccttccatttcttttctctctttaatcaccaacatcaaatttcatcataatctccatcaatcttcctcacaatcactgtattctccaccttatactcactaatctctatcaaacaaaccaaatcatccatcaatttcagaatcttagagctaaatttcaagtttgtagctccaaaaaaccctgaaaatggagagcttaatgcagctaccgtacgacaccaccgtgaaagtaatgcttggatcactggaacgaaacttgcttcccgacgccgttattaggaggctcactcgcttgttgctcgccacgcgccttcgctccggttacaagtccacttctgagcttcagctctctgatctgctccagttcgtccattctctgaaagagatgccgatagcaattaagaccgacgacgctaaatctcagcattatgaacttcccactgctttcttcaaattggttctcggcaataatctcaagtacagttgttgttatttttcggataaatcaaacaatttggaggatgctgagaaagcaatgctggagctttactgtgagaggtcacagctaaaagacgggcatagtgtgcttgatgttgggtgtggatggggctccctctgtttgtacattgcccataagtatagcaattgcagggttactgggatttgcaattctaagactcagaaggctcacattgatgaccaggctcgggcccgtaatctgcagaatgtagaaatcattgttggtgatattaccacatttgaaatggaaggatcctatgaccgtatctactctatcgagatgtttgagcatatgaagaactataaggatcttctacacaagatatccaagtggatgaaagaagagagtcttctttttgttcatcatttctgccataagacatttgcttaccactttgaggatgtaaatgatgacgactggattacaaggtatttctttagtggaggaacaatgcctgctgcaaatcttttgctttatttccaggatgatgtttctgttgtcaatcattggcttttgaatgggaaacactatgcacagacaagtgaggagtggctgaaaagaatggaccagaagatgggtttaataaagccaataatggagtcaacctatggcaaggatgaagctgtcaaatggactgtctactggagaactttctttatatctgttgctgaactttttggatacaacaatggtgaagaatggatggttactctcttcctctttaagaaaaaatgaaccaccctcctcctcctttctgttgatcatatcctatatttgcatttttcaactttactactaaacaaggatacccaaacactcacttcttctatttctgtgctatt

SEQ ID NO: 1633 - DNA, 1229 bp, Citrullus lanatus
ctgatcattttgaaaatggcggagcttattcagatgccctatgacgtcactgttcgtcttgcactggcttctcttgaacggaatttgttgccggacgccgtcgtaagaaggttcacccgcttgttactcgcctctcgtcttcgctccggttacaagccttcctctcaacttcaactctccgaattgctccatttcgtgcactctttaagggaaatgcccatagcaattaagactgataaaccaaaagctcaacactacgaagtaccgacctccttcttcaagttggttttgggaaagaatctcaagtacagttgttgctatttcaatgacaagtcaagtactttggaggacgctgaggatgcaatgctgcgaatgtattgtgaaaggtcacaacttaaggatggtcacactgttcttgatgttggatgtggctgggggtcgctctcattgtacattgcccaaaagtataagaattgcacagtaacaggaatttgcaattcgaccacgcagaaagcttacatcgaggagcaatgccgggatctccaactgcataatctcaacatcatagttgcagacatcagcacatttgaaatggaagctgaatatgatagaatattttccattgaaatgtttgagcatatgaagaactacaaggatcttctcaagaaaatatcaggttggatgaaacaggatagtctcctatttgttcatcatttttgccataaggtttttgcctatcactttgaggatgtaaatgaagatgattggattactagatacttcttcgaaggtggtacgatgccttccgcaaatctacttctctatttccaggatgacgtgtcaatcgtagaccattggcttgtgaatggcaagcactattctcaaacaagtgaagagtggctcaaaagaatggacgagaatgcagctttaataaaaccaatcatggcaattacttatggcaaggactctgctgtaaagtggactgtttattggagaacattctttattgctgttgctgagttatttggatacaacaatggggaagaatggatggttagccatttcttattcaagaagaaatgatgcaagcagcaaagctaaggtacaatttttatgagcttggattgaatttcttcctttgagctattaatttggtgaagccatatgatccattgttttcttaagaggctccattaatctgcctgtggttttttctgattgaaatattt

SEQ ID NO: 1634 - DNA, 1422 bp, Trifolium pratense
ataaacaaagtgtagcaagcaccaccaccacgtggctgtgtagtgttattcttaccatattatcatctggcaagcaaacagaagaagtttggtgtggtggttggaaaagatggaagggatgatgcagctaccatacaacacaacggtgaagctcatgcttggttcattggaacgcaatcttctccctgatgctgtcattaggagactcacgcgcctgcttttggccactcgccttcgctcttcttacaagtcttcttctgaacttcagctctctgatcttctccaatttgtacattctttacaagagatgcctattgctgttaatactgatattcctaaatctcaacattatgaattaccaacctcttttttaagctggttcttggaaagaatctcaaatacagttcttgttatttctcttctgcctcaaagacattggaagatgctgaagaagaaatgttgaaactttattgtgagagatcaaacctgaaaggtggtcacactgttcttgatgtcggatgcggctggggatcactcactttatacattgccaagaattacagtaattccagggttaccggaatctgcaattccaccactcaaaaagcttttatcgaggagaaatgcctggagctgcagctggaaaatgtggatatcgttgttgcagacattagcacatttgaaatggaagcttcttatgacagaatattttctatagaaatgtttgagcatatgaagaactacaaagatcttctcaagaagatatccaaatggatgaaagaggatggtcttttatttgttcattacttctgccgcaaaacatttgcctaccactttgaggacaaaaatgaagatgattggattacgagatacttctttaccggaggaactatgcctgcagcaaatctacttctctatttccaagatgatgttactgtcgtcaaccattggctggtaaacgggaaacactacgcacagaccagcgaagagtggctcaaaagaatggataaagacatgaaatccatcaagccaattatggaatcaacatatggcaaagattcagctactaaatggactgtctattggagaacatttttcatagctgtagcagaactctttggatacaataatggcgaagaatggatggttgcacactttcttttcaaaaagaaataaagttgaaactgttcttctcttgatttccgaattgagttaggatttaaaagtaataaaaaactgttcaacgagtctgcatacttcaataattgttgaatacttttattggttgatgaacttattttatttggttgtgcctttcttttgttacaaagtcttcaattggaaaatagatatcaccatagatcaatggcattcgtcgttgaaacgaaaggtaaatgaacacaatcaatttagtttgtgaac

SEQ ID NO: 1635 - DNA, 1267 bp, Panax ginseng
gagagagagagatttatcttcttcctctggtctagagagagaaagttttagtgagagagaatccttattgaagagatgaatacgattgtgcaattaccgtacgatgctactgtgcgcatgatgttggcttcattggagcgtaatttactaccggacgctctgataaggagattgactcgtcttctattggctagccggcttcgatccggttacaaatcgtcagccgaactacaactctccgacctcctgcaattcgcgcattctctgagagaaatgtctatagccatcaagactgaggagccaaaatatcagcattatgagttgccaacctctttcttcaagcttgtgcttgggaagaatctcaaatatagttgttgctacttccctgataagtcgagcaccttagatgatgctgaaaaagcaatgttggaaatgtactgtgatagatcacaattagaagatggtcacactgttcttgatgttggatgtggctggggatctttatccatatacatagcacagaagtataacaaatgcaagataactgggatttgcaattcaacgacccagaaagcatttattgaggagcagtgccgggatcttcagctccaaaatgtggaggtcattgttgcagatattagcacgtttgatatggaagcatcctatgaccgaatattttccatagaaatgtttgagcatatgaagaactacaaggaacttctgaagaagatatccaggtggatgcaccctgatagtcttctttttgttcatcatttctgccataaagcatttgcttaccactttgaggacattaatgaagatgactggataactaggtacttctttacaggaggtacaatgccttcagcaaatctactactatattttcaggatgatgtttctgtagtcaaccattggcttgtgaatgggaaacattacgcacagacaggtgaagaatggcttaaaagaatggacaacaattggagttctgtaagaccaataatggagtctacttatggaaaggattcagctgttaagtggaccgtctactggagaacattcttcattgcagttgcagaactatttggatacaataatggagaagaatggatggttgcacattttttattcaagagaaatgaagtcaattaatcctttgttgagtctggatattgatgacctgagaataaataataaggttgacatgttccgactgtcattcatggcctcattgtaccatatttcacagatcaacagatcttgattg

SEQ ID NO: 1636 - DNA, 1409 bp, Arachis hypogaea
caagcagtggtatcaacgcagagtacggggggagcaactaccaaatcagtttaccatcactacgaagaaagagaaaagaaaacagagcgcgtggcgatggaaggcaaagggttattgaaactgccgtatgataccaccgtgaagtttatgctggcgtcacttgagcgtaacctcctcccagatgcactcattcggacactcactcgcgtccttttgtccacgcgccttcgctcttcctacaggccttcctcccaccttcagctctctgaccttctccattttgctcattctttgcgagagatgcctattgcagtcaacactgataagcccaaatctcagcactatgaattgccaacctctttcttcaagctcgtccttggaaccaatctcaaatacagttgctgttacttctcttctgactctcagacgctggaagatgctgaagaagcaatgttagaactctattgtgagagatcaaacctgaaagatggtcacacagtccttgatgttggatgtggttggggctcactggctctttacattgccaagaaatacagtaactgcaaggttacaggaatatgcaattccgcaacccaaaaggctcatattgatgagcagtcccgggatcttcagctgcagaatttggatatcattgttgcagatattagcacgtttgaaatggaaggttcctatgacagaatattttccatagaaatgtttgagcatatgaagaactataaagatcttctcaagaagatatcctcatggatgaaagaggatagccttttatttgttcattatttctgccacaaagtatttgcttatcattttgaggacaaaaatgatgatgactggatcactagatacttcttcacaggaggaactatgccttcagcaaatctactactttatttccaagatgatgttactgtcctcaaccattggctagtaaatggaaaacactatgcacagaccagcgaagaatggctcaaaagaatggacaagaatatcaccaccataaagcctattatggaatcaacttatggcaaggattcagctgttaagtggacagtatattggagaacattctttatagctgttgcagaactctttggatacaatgatggtgaagaatggatggttgcacacttccttttcaaaaagaaataaacagaagagctgaaataaaaaaaggagattgctagggtaccaacatttttagtagaataaaatagagagttggctagtgttaactcaaatacaagacaaataagagaaaaaatattggttccccaacatttacatgccttactaattgttctgtaattttatcatctttagattctatttggttgcccatcatgtagtatgtctcaatctttttttaaataagaaacctaatgccaata

SEQ ID NO: 1637 - DNA, 1623 bp, Sesamum indicum
caaacagttgttgaggtatagaaactggcttgatggcatagcagtgaaacccatgccagcggcaataaaagctacgcacctagaagacaactcaaaggccatgcttgaaacaatccacgtcacaaaaagataagatagcgtagaaagatcaaacggaggggaacccgtgaccgactgactctctctcactcggacattgccggtatggcggaggttaacggccgcatcatcgataccattgtgcagatgccctacgacgcaaccgtacgttttatgcttgcttctctcgagcgcaacttgctgcctgacgccgttgtgcgccgcctcactcgtctgcttctcgctagtcgcctccgctcaggatacagatcctccgcggaactccagttgtccgacctccttcaatttgcgcattctttgagagaaatgccaatagcaatcaagacggaaaagccaaagtctcagcactatgaagttccaacgtcttacttcaagcttgtccttggaaagcatttaaaatacagctgctgcttctttcccaacaagtcgagcaccttagaggatgctgagaaggcaatgctagagttatactgtgagaggtcacagataaaagatggtcaatcagtccttgatgttggttgtggctggggatctctttctatatacatagcacagaagtaccccaattgccaggttacggggatttgcaattcaataacccagaaagcacatattgaggagcagtgccgggaacttcagttgcagaatgtggagataattgtagcagatatcagcacatttgacatggaagcttcatatgacagaatattttccattgaaatgtttgagcatatgaaaaactatcaggatcttcttaagaagatatcgaagtggatgaaaccagacagttttctgtttgtccattatttttgccataaaacatttgcttaccactttgaggacgtaaatgaggacgactggatcactaggtacttctttactggaggtacaatgccttctgcaaacctgctcctttattttcaggacgatgtgtctatagttaatcattggcttgtgaacggcaagcattatgcacagacaagcgaggaatggcttaagagaatggaccagaacttgaattctataaagccaataatggaatgcacttatggcaaagattcagcggtcaaatggacagtctactggagaacatttttcattgcagttgcagaattatttggctacaacaatggagaagagtggatggttgctcatttccttttcaagaagaaataaaaagctactggatctagattcaaaaactgctgctaagtatacaaaagaactgacccatttggtcgaaactcatcatgttattgtagctgatggcaatggttttaagtaaggtcgcgccttacaagggattgcctctctcaaataattggcatgtagtgtattgggacttctttttatgcaaaattgcaagaacaacttcggctcatgactagatgaactcccccctatagaccatactgctagtcgtactggactcccaacactctgattgatcacaatatgcagggatccccaatcaatcaatagccacggtagtattcctctgat

SEQ ID NO: 1638 - DNA, 1373 bp, Amsonia hubrichtii
tagtttagccaaaggataatgcaaagtttcatactcaacggaatcccgtgaattgctgactgtcgtctctggagagagagagagagagagagaagataagcagagttaatcgagaattatcccttgaattcaattccatatcgtcctgcctttcttgaaatggatgcagtgttgcaggcaccctacgatgctacagttcgtttgatgttagcttcattggagcgcaatttgttgcctgatgcagtcataaggagactcacacggctgcttttagcaagccgccttcgctccggttacaagcccacctctgaacttcaactctccgatctcctccacttcgcacattcattgagggaaatgccaatagccattaagaccgaggatccaaaatctcaacattacgaacttcctacttctttcttcaagcttgttctgggaaagcatcttaaatacagctgttgtcttttctctgacaagtcaaagagtttagaggatgctgagaaagcaatgttagagctatactgtgagagggcacaactaaaagatggtcatactgttcttgatgttggatgtggctggggatctctttcgctatacataggtcaaaaatacagcaattgcaaggttactgggatttgcaattctttgacacagaaagcacatatagaggagcggtgccgggatcaccagctacagaatgtggagatcattgttgcagatataagcacatttgatatggaagcttcctatgaccggatattttccattgaaatgtttgagcacatgaagaactatagggatcttctgaagaagatatccacgtggatgaaaccagatggccttcttttcattcaccatttttgccataaagcatttgcttaccactatgaggatgtgaatgaagatgactggattactaggtatttcttcagtggaggtactatgccttcagcaaatttactcctttattttcaggatgatgtctctgttgttgatcattggcttgtgaatggaaatcattatgcacaaacaagtgaagagtggcttaagagaatggaccagaacatgagttctataagaccaataatggactccacatatggcaaagattcagctgtcaaatggactgtatactggagaacattcttcattgccgtggctgaactatttgcatacaacaacggagaggaatggatggttgtacacttcttgtttaagaagtaaatcttgtacatggcttaagaaaggtggccttgctcatgcaatttgtagtatcagaaatcaaaacctttcgaaacccaaccccattgcatatgaaaacctcttttagcattcaataaccaaatgtaattctttatcaatgtaaaaggatt

SEQ ID NO: 1639 - DNA, 1414 bp, Nicotiana tabacum
ggaggcagtgcccataacttgtagataagcccctgtactgcaagagtgaacataaaagagaaatttaagtgcatagcggccatttttgcttctccttagtccttaagcagatcagaaagatggatgcgatagtacaggtgccttacaatgctacggtgcgtttaatgctgtcttctctagagcgcaacctcttgcctgacgccgttatacggcggctcacacgactgctcttagctgcccgacttcgttccagttacaagccttccgctgagcttcagctctctgaccttctccactttgtgcactctttaaaagagatgcctatagctgtgatgactgagaaggcgaagtcccaacattacgagcttcctacgtctttcttcaagtttgttcttggaaagcacttcaaatacagctgctgttatttccgcgacaagtcaagcactttagaggatgctgaaaaagcgatgatggaattatactgtggaaggtcacagctgaaagatggtcacactgtacttgatgttggatgtggctggggatccctttctctatacatagcacaaaaatactgtagctgcaatgttactggaatttgcaattcagtgactcaaaaagcacatgtcgaagagcagtgccgggaatttcagctgcagaatgtggagatcatagttgcagatattagcacatttgagatggaaggttcctatgatcgaatattgtctattgaaatgtttgagcatatgaagaactacggatatctcctcaagaagatctccagatggatgaagccagatagtcttctttttgttcatcatttttgccacaaggcattcgcttaccacttcgaggatgttaatgatgatgattggatcactcgctacttcttcagtggcggtacgatgccttctgcaaatctcctcctttattttcaggatgatgtttctgtggttaatcactggctcgttaacggaaagcattatgcacagacaagtgaagaatggcttaagagaatggaccagaacaaaacttccataaagccaataatggagtcaacttatgggaaggattcagctgttaagtggactgtctattcgagaacgtttttcatttcagttgctgaactgtttgactacaacaatggagaagaatggatggttgcacatttcctcttcaagaagaaatgatttgccaactgtcccctcttatactgcaaacaaactgtacaagaaataagcatgtctgctcagctgtccacaagcattttcccaaaagctcaattagtgaaacatctgtacgtcccatatcccaagaggtggatcttgcactgatctccttacttacagagcattaggagatctagtacaccatgtgccgattgctgtgatcttacttgctatcagttcttgcctaa

SEQ ID NO: 1640 - DNA, 1565 bp, Solanum lycopersicum
agggatatgcaggatgaaggtaaattagcaaaaaatggaaaagcacgtcaagttgggagttttccgtcttcggatagaaaaggtactgggccacaacctgtagataagcttgaaagagagaagataaaagaagagtccatagcagcgaaaaaaataattttaaaaaaatggatgcgatagtacagctgccttacgatgctacggtaaggttgatgctgcgttcgctagagcgcaacctcttgccggacactgttatacggcgactcacacgcctgctcttagccgcccgacttcgctccggttacaaaccatcctccgagctacagctctctgatcttctccaatttgtacaatctttaaaagagatgcctatagctgtgatgaccgagaagccaaagtcccaacattatgagctctctacctctttcttcaagattgttcttggaaaacacctcaaatacagctgctgttacttcaaagacaagttgagcactttggaggatgctgaaaaagcaatgatggaattatattgtgaaaggtcgcagttgaaagatggacacactgtacttgatgttggttgtggctggggttccctttctctatacatagcacaaaaatatagtgcctgtaaagttaccgggatttgcaattcagtcacccaaaaagcacacatagaagagcagtgccgggagcttcagctgcagaatttggagatcatagttgcagatattagcacattcgagatggaaggatcctatgatagaatattgtctattgaaatgtttgagcatatgaagaactatggagatctcctgaagaagatctcaagatggatgaaggcagatagtcttctttttgttcattatttttgccataaagcatttgcttaccactttgaggatgtgaatgatgatgattggatcactaggtactttttcagtggaggtacaatgccttctgctaatctcctcctttattttcaggatgatgtttctgtggttgatcattggctagttaatggaaaacattatgcacagacaagtgaagaatggcttaagagaatggatgagaacaagagttccataaagccaataatggagtcaacttatgggaaggattcagccgttaagtggactgtctactggagaacctttttcctttcagttgctgaattgtttgggtacaacaatggagaagaatggatggttgcacatttcctcttcaagaagaattgaatttgccaagccaagtaataagcatgtctacatgcattcgcactattaccataagtagaatgtgttgctatgatgctatcctcgtcagtcctatcatatatagagaaaatttcataaatgagcttcagaaaaggcagctaagaatgtgatcactctgttactgaaatccatttggacaaaagttctttcttttggtgccttgtgttcataaaaatgttccattcatcgtcccctccacactgtctctctggagatggtttcgttgcccacaatattgggcaatccttttgtttagaggcttttagtggcacttgaactgcaacatgaaaa

SEQ ID NO: 1641 - DNA, 1403 bp, Panax ginseng
gagttatgtgagagagaatccttattgaagagatgaatacgatggtgcaattaccgtacgatgctactgtgcgcatgatgttggcttcattggagcgtaatttactaccggacgctctgataaggagattgactcgtcttctattggctagccggcttcgatccggttacaaatcgtcagccgaactacaactctccgacctcctgcaattcgcgcattctctgagagaaatgtctatagccatcaagactgaggagccaaaatatcaacattatgagttgccaacctctttcttcaagcttgtgcttgggaagaatctcaaatacagttgttgctacttccctgataagtcgagcaccttagatgatgctgagaaagcaatgttggaaatgtactgtgatagatcacaattagaagatggtcacactgttcttgatgttggatgtggctggggatctttatccatatacatagcacagaagtacaacaaatgcaagataactgggatttgcaattcaacgacccagaaagcatttattgaggagcagtgccgggatcttcagctccaaaatgtggaggtcattgttgcagatattagcacgtttgatatggaagcatcctatgaccgaatattttccatagaaatgtttgagcatatgaagaactacaaggaacttctgaagaagatatccaggtggatgcaccctgatagtcttctttttgttcatcatttctgccataaagcatttgcttaccactttgaggacattaatgaagatgactggataactaggtacttctttacaggaggtacaatgccttcagcaaatctactactatattttcaggatgatgtttctatagtcaaccattggcttgtgaatgggaaacattacgcacagacaggtgaagaatggcttaaaagaatggacaacaattggagttctgtaagaccaataatggagtctacttatggaaaggattcagctgttaagtggaccgtctactggagaacattcttcattgcagttgcagaactatttggatacaataatggagaagaatggatggttgcacattttttattcaagagaaatgaagtcaattaatcctttgttgagtctggatattgatgacctgagaataaataataaggttgacatgttccgactgtcattcatggcctcattgtaccatatttcacagatcaacagatcttgattgatatagaagttttaaaaaaaaaaaaacaaaaaaaaaaacaaaaaaaaaaaaacaaaaaaaaacaaaaaaaaaaacaaaaaaaacaaaaaaaaaaaaaaaaaaaacaaaaaaaaaacaaaaacaaaacaaacaacaacaacaacacacacacagacacacacacacacaaacaacccacc

SEQ ID NO: 1642 - DNA, 1378 bp, Medicago truncatula
tgactttgtttattgttatcagaacgcagccacagaagtgtggtgtggtagttgatggaaaagatggaagagatgatgcatctaccttacaacacgacggtgaagctgatgcttggttcacttgaacgcaatttgcttcctgataccgtcatcagaagactcacacgtttgcttttatcaactcgccttcgttcttcttacaaaccttcctctgaacttcagctttctgatcttctccaatttgctcattctttacaagatatgcctattgctgtcagtactgatgtccctaaatctcaacattatgaattacctacctccttctttaagctcgttcttggaaacaatctcaaatacagttcttgttatttctcttctgcctcaaagacattggaagatgctgaagaagaaatgttgaaactatattgcgagagatcgaacctgaaagatggtcatacagttcttgatgtcggatgcggttggggatcactgactttattcattgccaagaattacagtagttccagggttacaggaatctgcaattccacgactcaaaaagcttttattgaggagaaatgccgggagctgcagctgcaaaatgtggatatcattgttgcagacattagcacatttgaaatggaagcttcttatgacagaatattttccatagaaatgtttgagcatatgaagaactataaagatcttctcaagaagatatccatctggatgaaagaggatggccttttattcgttcatcatttctgccacaaagcatttgcctaccactttgaggacaaaaatgaagatgattggattacgagatacttctttaccggaggaactatgcccgcagcaaatctacttctttatttccaagatgatgttactgtcatcaaccattggctggtaaatgggaaacactacgcacagaccagtgaagaatggctcaaaagaatggataagaacaagacttccatcaagccaattatggaatcaacatatggcaaagattcagctaccaaatggactgtctactggagaacatttttcatagctgtggcagaactttttggatacaataatggtgaagaatggatggttgcacactttcttttcaaaaagaaataaagaaaactaaaaccattcttcccttgatttgcaaaccgagtcgggatttaaagagagagagaataaactgttcaacgaggctgcatacttcaataattcttgtttgcttttattgattgatgaactagttttatgtagtcgtctacctattttttatcacaaagtcttcccttggaaaacagatcaatgccaaatggcctctgtaattgacacgaaaggtgaatgaataaatttcattttagtgtgg

SEQ ID NO: 1643 - DNA, 1468 bp, Vinca minor
aatccctgtccctgacatagtttctgaaccagaaaacagagatatagagaaagaagcagcggaattaatcaagaaattatccatttttgaagaagtattcagtagtaaagatttaattttaatggaggcaattattaaggcaccgtacgatgtaacagttcgtttgatgttatcttcattggagaggaatttgttgccagatgctgtaataaggagattcactcgcctgcttttagcaagccgccttcgctccggttacaagcccacttctcaacttcaactctccgacctactccacttcgcacattcattaagggaaatgccgatagccattaagactgaagatgcaaaatctcagcattatgaactccctacttctttcttcaagcttgttctcggaaaacatcttaaatacagctgttgccttttctctgaaaccgcgaagacattagaggatgccgagatagcaatgttagacttatactgcgagagggcggagttaaaagatggtcagagtgttcttgatgttggatgtggctggggatctctttctttatacatagctcagaaatacagcaattgcaaggttactgggatttgcaattctgcaacacagaaagcacatattgaggagctgtgccgggaacatcagctacagaatctggagatcattgttgcagatataagcacatttgacatggaagcttcctatgaccgaatattttctatcgaaatgtttgagcacatgaagaactacaaggatctcctgaagaagatatcaatgtggatgaaaccagatagtcttcttttcattcatcatttttgccataaagcatttgcttaccactacgaggatgtgaatgaagatgattggattactaggtatttcttcagtggaggtaccatgccttctgcaaatttactcctatattttcaggatgatgtttccgttgttgatcattggcttgtgaatggaaaccattatgcacaaacaagtgaagagtggcttaagagaatggacgagaacacgagttctgtgaaaccgataatggagtccacatacggcaaggattcagctgtgaaatggaccgtttactggagaacgttcttcatcgccgtggctgagctatttggatacaacaatggtgaggaatggatggtcgtacacttcttgttcaagaagaagtagtattctttgtcatgcccaggaaaccaataaaacatcactacaaagttctcttaggctcttttaatcaaagtggaatttcatagttaagttcttatgcaatcttctactatactagggcagatttggttcatacaatatggatagaacctacaaaagatttggtctaaatttatgttaaaataatcccacaaaagtacaagtgggaaatcttcttaaccatttgagattccaagcattagttgaagtctcctctagcctatagtgctgaacacgtttttt

SEQ ID NO: 1644 - DNA, 1180 bp, Vaccinium corymbosum
gcaggtaccgtacgatgcaacggtgcgcttaatgctatcttcactggagcgtaatctgctgccggacgcagtgataaggaggcttactcgcttgcttctatccgctcgtctccgttctggttacaaatcctcttccgaccttcaactctctcacctcctcagtttcgttcactctttgacagaaagcgccatagcagtcaagaccgagaagccaaaaactcaacattatgagctgcctacctctttcttcaaacttgttctggggaagcatctcaaatacagctgttgttacttcactgatacatcaagcaccttagaggatgctgagaaagcaatgttagaattgtactgtgagagggcaaagctaaaagatggccactcagttcttgatattggatgtgggtggggatcactttgtctgtacattgcacagaagtatagtaattgcaaggttacagggatatgcaactcaacaacgcagaaatcatacattgaggagcaatctcgggatcttcagctgcagaatttggatgtcattgtagcagatattagcacattcgatatggaggcaacctatgaccgaatattctccattgaaatgtttgagcatatgaagaactacaaggatctccttaagaagatatctaagtggatggaaccagatagtcttctttttgtgcatcatttctgccataaagtatttgcctatcactttgaggatgtcaatgaagatgactggattactaggtacttcttcactggaggaacaatgccttcagcaaatctacttctttatttccaggatgatgtctctgtagtcaaccattggcttgtgaacgggaagcattatgcaaaaacaagcgaagagtggcttaagaggatggacaaaaacttgagctccgtaaagccaataatggaggcaacttacggcaaggattctgctgtcaagtggaccgtctactggagaacattcttcatagcagttgcagaactctttgggtacaatgacggggaagaatggatggttgcacttttccttttcaagaagaaatgaattcatcgcgtgttggtttcttaggtacgaagccaagtttcgggaggaaaaataatgtgtccattttgttggaattgggaagttgaacttctgaacaactgctgttcttcagtgaataaaaaagtc

SEQ ID NO: 1645 - DNA, 1510 bp, Cucurbita pepo
gagtggtagttagaacagtggaggaaaagctaaggctagaagcccaataattttgcgaatcagagcttcagccacacagcaatggcggagcttattcaggtgccttacgacgtcactgtccgtcttctaatggcttcactcgaacggaatttcttgccggacgccgtcgtaagaaggttcacccgcttgctactcgcctctcgtattcgctcccagtttaagccttcctctcaactccaactctctgattttctccactttgtgcacgctttaagggagatgccaattgctattaagactgataagccaaaagctcaacattacgagcttcctacctcgttcttcaagttagttttggggaagaatctcaagtacagttcatgctatttcaaggacaagtcaagtaccttggaggacgcagaggaggccatgctacaaatgtattgtgaaaggtcacaactgaaggatggccactctgttcttgatgttggatgtggctgggggtcactttcgttgtatattgcccaaaattacaagaattgtcaggtgactggaatttgcaattcaaccacacagaaagattacattgaggagcagtgccgggatctccagctgaataatgtcaacattattgttgcagacatcagcacttttgaaatggaagctgaatatgacagaataatttccattgaaatgtttgagcatatgaagaactacaaggatcttctcaagaaaatatcaggctggatgaaacaggatagtctcctctttgttcatcatttttgccataaagtctttgcctatcactttgaggataaaaatgaagatgattggattacgagatacttcttcgaaggcggcacgatgccctctgcaaatctactcctctattttcaggacgacgtgtcgattgtcgatcattggcttgtgaatggcaaacactattctcaaacaagtgaagagtggctcaaaagaatggacaagaacatagcttcaataaaaccaatcatggcaactacttatggcaaggattcagctgtaaagtggactgtttattggagaacattcttcattgcagtagccgagttatttgggtacaacaatggggaagaatggatggtttgccatttactattcaagaagaaatgatgcaaagcagcaaagcttcaataatctaagcggccataagaacgaggtgcgagttttatgaacttggactgattttcttcctttgaactttatgaatttggtgaagccatatgatccatagttcttgtaataagagttttgccattgcggtgcaagagctgattacaatatttatattagtgctgaatctgggtcggattattggcaccatgaggagcctctacgaccttttttagaacgtaattcggtgatgaattgtttgcactaaatttgaattcaattgatctgtagtctatgtagtctaaatatgcaactttcgggtagcagtaagagatttgaaggtatatatcataatacaatt

SEQ ID NO: 1646 - DNA, 1459 bp, Lupinus angustifolius
atttgtgtggcatagagggaagtagttttgtaaagaggagatcggagagagagagtgttggagttgtggtttgagcaatggaagggataatgcaagtgccatatcacactacaacgaagctgatgctggcttcattggaacgcaacttacttcctgatcctatcattaggagactcactcgtttgcttttggcctctcgtcttcgttcttgttctaagccttcttcccaacttcaactcgatgaccttatccattttgtacactctttacaagagatgcctattgcaatcgacacggacaaggcaaaatctcagcattatgagttaccaacctcattcttcaagctggttctcggagagaatctcaaatacagttcttgttatttctcttctaccacaaagactctggaagaggctgaagaagcaatgctggaactgtactgcgagagatcaaagctgaaagatggtcatacagttcttgatgttggatgcggctggggatcactgcctttatacattgccaagaagtacagtaactccaaggtcacaggaatctgcaattccacaactcaaaaagcttatattgaggagaggattcgggatcttcagctacaaaatttggatatcattgttgcagatattcgcacatttgaaatggaaagctcttatgacagaataatttccatagaaatgtttgagcatatgaaaaactacggagaacttctcaagaagatatccaaatggatgaaagaggacagccttttatttgttcaacatttctgccataaagtatttgcttaccactttgaggacaaagatgatgatgactggattacgagatacttctttactggaggaactatgccttcagcaaatctgcttctttacttccaaggtgatgttactgtggtcaaccattggctactaaatgggaaacattatgctcagaccagtgaagagtggctgaaaagaatggacaagaacattacttccatcaagccaattatggaatcaacgtatggcaaggattcagctaccaagtggactgtctattggagaacattcttcatagcagtagcagaactctttggatacaatgatggggaagaatggatggttgcacactttcttttcaaaaagaaataaaataagccataactgaatgaagaatgtgtgcttgctacaatcatgattagcttattttatttggttgtctgtttgcaactttatatgttttagcacctattgcctagcatgaaccttattttacttttggcgtgcagaattggaattgtagttaggaattgttattctgatttcacttggaattgtgaatctatgattggactttggatcatataaaaaattagaaaaaaaaattagaattataagctcaatttcaattacgtttggtatgcttgcttgtgtgtgttattgcatgtattactgaggaatattga

SEQ ID NO: 1647 - DNA, 2232 bp, Mimulus guttatus
tatccgctagactgacaagtgaaacgtggccacacaaacgccgcaggaattttgcatgctgaaagataaatcacagcgaaaatacgcaactccgtcatcttcagctgacgattccacggtaacaatggcggcagttaacggcggcattgtggattcgattgtccaggtgccctacgaggccaccgtacgcctcatgctcggttcgctcgagcggaatctgttgcccgacgccgtcgtgcgccgcctcactcggctccttctcgccagtcgcctccgctccggttacagatcctccgccgacatccagctgtccgatctcctcaattttgtgcattctttgaaagaaatgccgatagcaatccagacagaaacgccaaagtctcaacattacgaagttcctacatctttcttcaagcttgccctcggcaaacatctcaaatacagttgctgctatttttcagataagtcaagcactttagacgatgccgagaaggcaatgcttgagttgtactgtgagagatcgcagataaaagacggtcattccgttctcgatgtcggttgtggctggggatctctttccctatacattgctcagaaataccccaattgcctgatcaaagggatttgcaattccattacccaaaaggaacacatcgaggagcagtgtcgggatcttcaagtaaagaatgtggagatagttgttggagatatcagcacgtttgatatggaagcttcttatgacagaatattttccattgaaatgtttgagcatatgaaaaactaccgtgatcttcttaagaagatatccaagtggatgaaatcggacggtcttctgttcatccattatttctgccataaaacatttgcttaccactttgaggatgtcaacgaggacgattggatcactaggtacttctttactggaggtacaatgccctcagcagacctgctcctttactttcaggatgacgtttctatagtcgatcactggcttgtgaatggcaagcattatgcacagacaagtgaagaatggcttaagagaatggaccagaatttgagctcaataaagccattaatggagtccacttatggtaaagattcagctgtcaagtggaccgtctattggagaacatttttcattgcggttgcggaattgttcggctacaacaatggagaagaatggatggttgctcatttccttttcaagaagaaataaaaaagctaacgtaacaggtcacaaatgcaaaaaaaaatgctactgagtgtttgaaagtcgatgaaccgtttgttccaaacatcgatatgttattgttgatgatgacaatattctctactgtgtgagatgtgctcataagtagacattgatttttttacatcgttttcgtttaataaagctgatgaattccctccacacaaaccaaaactggtagtcgtacttgtattttaactcttcctcattgatcgcagtatatgcacgtagccctattacaaaacagggggaaaaacgtaaaacataatgatctgttttcaagaaatgcaaaataatcgagcaattcaaaccgttcgacaagtatctgcagtagcactcttgtggtccaaatccgagaataaatagtcattcagtgtctgatctatagatacaactctttattatgttcaagtcaatcttcaatgtgcagaaaggcaatatagtaagtgcgaatgtataactacatatttcatcacaacactataatttcaatccgaataacacttgtcataaagcatcgaacatcaactacattcaaagaaaaacatttcgggattgttccagtactttgaaagttcgatgcatagaaccgatattagtgtctttaaagaagtggtaatggaagaatatgtcagcttatgtatcatcttcatacaaaaacacctaacgtaactatcgaaattcagacatcatccgacacctagaaatgtgtcgtgataacactatcataactaggtatggaaattaaccgcgtttcacagatgacgaaaaaaaatcattgatcgagtgtaatgatcttatacaacaaattaaagctcatcgatttccagcatttacctctgattaaaaagaattttcaagagacaccggaggcacttttgaattgagctggattgttgaaatccattacgccatcggcatccaagaaccgacttagatgcttatcatccaaatgtttctgaaaatgaaaatatcaggccaag

SEQ ID NO: 1648 - DNA, 1474 bp, Lippia dulcis
gtcatgcttaatgcacgtcactggataacgggataaaatataaagaatagaaacgctcgattactcttactcgaagttctccggcaatggcggcggttaaaggaggcgttatggattcggttgtgcaggttccttacggcgccaccgtgcgcctgatgctagcttcactcgagcggaatctgctgcctgacgccgtcgtgcgccgcctcacgcggctgctgctcgccggccgcctcagatcgggttacagatcctcggccgacatccagctgtcggagctccttcagttcgcgcagtctctgagagaaatgccgattgcgatcaagacagaaaaggcaaagtctcaacactatgaacttcctacacctttcttcaagcttgtccttggaaagcatctgaaatacagtagctgctactttccagacaagtcaagcagcttagaggatgctgaaaaggcaatgctcgaattatattgtgagaggtcgcagataaaagacggacattctgttctcgacgttggttgtggatggggatcccttgttctgtacacagcacagaagtatcccaactgccagattactgggatttgcaattccacgacccaaaaagcacatattgaagagcaatgccgggatcttcagctgcagaatgtggagatcatcgtcgctgatatcagcacttttgatatggaagcttcctatgacagaatattctccattgaaatgtttgagcatatgaaaaactatcatgatctcctcaagaagatatccaagtggatgaaaccagacggtcttctatttgtccatcacttttgccataaaacatttgcttaccacttcgaagatctcaacgatgatgattggatcacaaggtatttcttgaaggagggtcaatgccctcagcaaacttgctcctttattttcaggacgacgtgtctatagttaatcactggcttgtgaacggcaaacattatgcgcagacgagcgaggaatggcttaagagaatggaccagaacgtgagttctataaagccaataatggaatcaacttacggcaaagattctgctgtcaagtggacggtctattggaggacatttttcatcacagttgcagaactatttggctacaacaatggagatgaatggatggttgctcatttccttttcagaaagaagtaaaatatgtaagcattgatgtgttattgcggctaaagacaaatgtatgtgaactatgagctccactcattcaaaactcttcgaaaataacaggagcaatgtccaaatgtattaaactggggaaataaaacacaagattagttgaattcgccccagatagaccgcatctgctaattgtaccggccttcgagcacagggttgtattcctattacatgaggaaaatattcatttttcagaaaacatgtgttggtatgtaaactgtacatatatatagcagtttcttaggattttgggatgag

SEQ ID NO: 1649 - DNA, 1351 bp, Solanum phureja
aacgtccataccattcttccttctcgcgaatcaaaaaaatgaatgcgatagtacagctgccttacgatgctacggtacggctgatgctgggttctctagagcgcaacctcttgccggacactgttattcactcgactgctcttagccgcccgacttcgctccggttacaggccatcctctgagctacagctctctcatcttctccaatttgtgcactctttaaaagagatgcctatagctgtgatgactgagaagccaaagtcccaacattatgaactccctacctctttcttcaagattgttcttggaaaacacctcaaatacagctgctgttacttcaaacacaagttgagcactttagaggatgctgaaaaagcaatgatggaattatattgtgaaaggtcacagttgaaagatggacacactgtacttgatgttggttgtggctggggctccctttctctatacatagcacaaaaatatagtgcctgtaaagttaccggtatttgcaattcagtcacccaaaaagcacacatagaagagcagtgccgggagcttcagctgcggaatttggagatcatagtagcagatattagcatattcgagatggaaggatcctatgatagaatattgtctattgaaatgtttgagcatatgaagaactatggagatctcctgaagaagatgtcaagatggatgaaggcagatagtcttctttttgttcattatttttgccataaagcatttgcttaccactttgaggatgtgaatgatgatgattggatcactaggtacttcttcagtggaggtacaatgccttctgccaatctcctcctttattttcaggatgatgtttctgtggttaatcattggctggttaatggaaaacactatgcacagacaagtgaagaatggcttaagagaatggatgagaacaagagttccataaagccaataatggagtcaacttatgggaaggattcagccgttaagtggactgtctactggagaacctttttcctttcagttgctgaactgtttgggtacaacaatggagaagaatggatggttgcacatttcctcttcaagaagaaatgaatttgccaagcaaactgtaccaagtaataagcatgtctacatgcatttgcactattaccataaattaaagtagaatgtgttgctatcatatattaatattactaccatattttcccccttacaaaatgacaatccatgtctatatattcagtcatttcatggaatataggatttgttataatttggattgcagccttactgtcacacatcatcttcacatgtaattcaatcttaactccaagttctttgaata

SEQ ID NO: 1650 - DNA, 1416 bp, Triphysaria pusilla
tcttgttatctcaccacaggtccattttcgcgatcggccattttattcacgtacaactctatcaccttagccttaggtaggtaggtaaggcagacggataaggagagcggatcctgtgactaccctatttcgagattttccctgcaaatggaggaggttaacggcggcggagttgtgggttcgatcgtacaggtaccgtacaatgccaccgtccgcctcactctcgtttcgctcgagcgaaatttgctgcccgacgccgtcgtgcgccgcctcaccagacttcttctcgccggacgcctccgatccggttaccggtcttccactgacgtacagctctctgatcttctagaattcgcaaattctttgaaggaaatgccgatagcaatcaaaacagaaaggccaaagtctcaacactatgaagttccaacatctttcttcaagcttgtcctcggaaagcatttaaaatacagttgctgctacttttcggacaaaacaagcactttagaggatgctgagaaggcaatgctagatttatactgtgagaggtcacaaataaaagatggtcactcagttcttgatgttggctgtggctggggatcactttctctacacattgctcaaaagtaccccaattgcaaggtcacagggatttgcaattcggcaacccaaaaggcacatattgacgaccaatgccgggctcatgggatgcagaatgtggagattattgttgctgatatcagcacatttgaaatggaagcctcctatgacagaatattttccattgagatgtttgagcatatgaagaattatcaggatcttcttaaaaagatatcacactggatgaaaccagatggtcttctgtttgtccattacttttgccataaaacatttgcttatcactttgaggatgtcaatgacgatgattggatcaccagatatttctttactggaggtacaatgccatcagcaaacctgctcttgtactttcagggcgatgtgtctatagttaatcactggcttgtgaatggcaaacattatgcacagacaagcgaagaatggctgaagagaatggaccataacttgagttctataaagccaataatggagtccacctacggcaaagactcggctgtcaagtggatcgcctactggagaacatttttcatttcggttgctgaactatttggctacaatgatggtgaagaatggatggtcgcacattttcttttcaagaagaaatagataagctaattgtttgtattcaataagtagtactatagttcatccatttgatagctaatgacaataagtttcagctaagggaggatgatgatgatagcctgtgatccaataagtctttttatctgtataagctcttcaaattattttgagcatgtaactgtgttttatttagag

SEQ ID NO: 1651 - DNA, 1403 bp, Phaseolus vulgaris
aaaatgacaaaaaggaaagaaagaaagaagagtagaggaaaatggaaagtcacataataagtggaagaagataagacacagtaggagaattgtggaactgtaggcgttcttgcttctgcactaaaggttcccttgcgcgcgtgggcttccatggaagggatgatgcagcttgcatatggcgctacggtgaagctcatgctgtctgcactcgagcgtaacctgctccctgacgccgtcaccaggagactcacgcgcgtccttttggctactcgccttcgctcttcttccaacacatcctcagatcttcagctttcacacctcctacatttcgcacattctttacaagagatgccgatagcaatcaacactgagaaggcgaaatctcaacattatgaattaccaacagctttcttcaagctcgtccttggaagcaatctcaaatacagctgttgctatttctcttctgcctcaatgacgctggaagatgctgaagaagcaatgttgaaactgtactgcgagagatcaaacctcaaagatggtcacacagtacttgatgtgggatgtggttggggatcgctggctttatacattgccaagaactacactaactgcagagttacaggaatctgcaattcaacaactcaaaaggcttatattgaggagaagtgccgagatcttcagctgcaaaatatgaatattatagttgctgatattagcacgtttgaaatggaggcttcttatgacagaatattttccatagaaatgtttgagcatatgaagaactacaaagagcttctcaagaagatatccaaatggatgaaagaggatagccttttatttgtgcattacttctgccacaaagcatttgcctaccactttgaggacaaaaatgaagatgactggattacaagatacttcttttctggaggaactatgccgtcagcaaatctacttctttattttcaagatgatgttacggtcatcaaccattggctagtaaatggaaaacactactcacaaaccagtgaagaatggctcaaaagaatggaccagagaatgacttacatcaagccaattatgcaatcgacctatggcaatgattcagctaccaagtggactgcctattggagaacattcttcatatctgtagcggaacttttcggatacaataacggtgaagaatggatggttgcacactttcttttcaaaaagaaataaaataagccaaaacctaatattttaatttgactgtttaagaatggcttccaaacctatttaactatttgtcctaagtagtcaggacaaaggaacttgccaatggaagttgcaatttcaataatgttgtgtacttaattaactctaaacataattaatcttataaaatttatttaatatgataaaat

SEQ ID NO: 1652 - DNA, 1456 bp, Cannabis sativa
tctttctcttctgttctcttctctttactgaaacttgaaactgagaaaaccaaccgaccagcctcgcaccctccaacaatggctgccctcgttcaactcccttacgacgccacagtcaagctcgctctcgcctctctcgagcgcaatctcttacccgacgccgtcattcgaagacttacccgcctcctcttggccactcgtcttcgatccggctacaaaccctccgcccatctccaactctccgaccttcttcgattcattcaatctctgaaggagatgccaatagcgatcaagactgatgagcctaaagcccagcattatgagttacccacttccttcttcaacctcgttctagggcaaaattttaagtacagctgttgttactttgagaaaagttcaagtactttagaggaagcagagaaggcaatgttggaaatgtactgtgaaaagtcaaagcttgaagatggtcaaactgttcttgatgttgggtgtggatgggggtcactttctttgtacattgctcagaagtataagaattgtaaggtcactgggatttgtaactcttctactcagaaagatcacattgaccagcgttgtagagagcttgaggttgagaatgtggaaatcattgtggctgatattagcacatttgaaatggaaagatcttttgatagaatatattccattgaaatgtttgagcatatgaagaattataaggagcttttgaagaaaatatcagggtggatgaaggaggatgctcttctatttgttcatcatttctgtcataaaacatttgcttatcattttgaggatgtaaatgaagatgattggattacaaggtacttcttcactggaggtactatgccttcagcaaatctattattgtatttccaggatgatgtttctgttattgatcattggcttgtgaatgggaagcattacgcacagacaagtgaagagtggctgaaaagaatggataagaatgtaaggttgataaagccaataatggaatcaacttatggaaaggagaatgctgttaagtggactgtttattggagaacatttttcattgcagttgctgaactatttggatataacaatggtgaagagtggatggttgctctttttctcttcaaaaagaagtaaaaaaaaaatcaattcaacttctgaattcctcctatgccattttaagtttgagcttctcatttcattgagtttaaggacactacttgtaaattaaaatcaatccaacttctgaattcctcctatgccattttaagtttgagcttctcatttcattgagtttaaggacactacttgtaaatttcgtctctgagaaataaaatgggtgtttggaaaatagatagtgtcgaagaagataatcttcataacacactcgatatcttgtcaaaaatttggtatttctctctaacaatataaatattttactttgaaa

SEQ ID NO: 1653 - DNA, 1542 bp, Chenopodium quinoa
ccaaacaccacaattctaagtttcattcaggcaacaaaagataagagatacagagaaacaaagcagtgaaaatacaggagaaaaaatggaggaaatgaagcaaatggcatacaaagcaactgccaagctaatgctaggcgcacatgaaagaaacttgttgcctgatgctcttattagacgccttactcgccttctcttagccagtcgccttcgttcttcctacaaatcttcttctcaacttcaactctctgatcttctacactttgttcattctttaagagaaatgccaatagcaattcagactgataaggcaaaatctcaacactatgagctccctacttctttcttcaagcttgttctaggaaagcatctcaaatacagttgctgttatttttctgacaagcagacaaacctagatgatgcagagaaagcaatgttagaattatattgtgagaggtcagggatacaagatggtcatactgttcttgatgttggatgtggctgggggtcgctcgctttgtacattgcacaaaagtacagtaactgcggggttaccggaatttgcaattcagtaacgcagaaagcacacattgaggataggtgcagggatcttcagctgaaaaacgttgagatcatagtagcagatataagcacatttgacatggagggatcttatgatcggatactgtctattgaaatgtttgagcacatgaagaattacagagatcttctaaagaagatatccaattggatgaaacctgatggccttctatttgttcattatttctgtcataaagcttttgcataccactttgaggatattaatgatgatgactggatcactcggtatttcttcaccggaggcacaatgcctgctgcaaatctgctcctgtactttcaggatgatgtctctattgtcaaccactggcttgaaaatgggaagcattacgcgcaaacaagcgaggagtggcttaaaagaatggaccgtaacttggcttacataaggccaataatggagtcgacttatggcaaagactcagctctaaagtggatagtatattggagaaccttcttcatagcagtggctgagttatttgggtacaataatggggaagaatggatggttgctcatttcctatttaagaagaaatgaggttgatcttgcagcttttattctcatcccagcagcatcaatgagcaatcataggaaacagaagagaaagctgattacccccccacccttaacattgtagtaagatttaacttttctaagagttttcacattgatgagtcgctgcgtatgggggctgggaaaggaccggggtagaaacaagcgactggggatgcatccaatcaaccgactttataaagtatggggctgcaagattgtaacaggtgttagtaatgctgctcactgtcaatgattaccctcttgaatcttgattagtgaattaatctcattcttcatctactctgttaattgttttatttatcgtttctgaataaaaagagtcgtgggaggcaaggcacacaggggatagg

SEQ ID NO: 1654 - DNA, 1232 bp, Aquilegia formosa
agatagaagagagagagagagagagagagagagagagagagagataagcatggcaatggaaggattgattcaagtaccatataatgttacagtaaagatgatgttatcttcattagagagaaacatactacctgatttgttagtaaggaagttaacaaagcttttgttatcaagtcgtcttcgtaatggttacaaacctacttctgaggaacaactctctgatcttcttcactttgcactatctcttcaagaaatgcctatagccatcaagactgatataccaaagtcccaacattacgagttgcccacttcatttttcaatctggtgctcgggaagcatatgaaatatagctgttgttattttatggatagctcaactaccttggaagatgcggagaaagcaatgttagatctgtattgtgaaagggcacagataaaagatggtcatacagtccttgatgttggatgtggttggggttcactgtgtttatttattgcgcagaaatacagtaactgcaaaattactgggatctgtaattcaacaacacagaaaacatatatagatgaacaatgcagggagcgacaactgcagaatgtggagattattgttgctgatattagcacatatgagatggatgcctcctttgacagagttttttctatagaaatgtttgagcatatgaagaactataagaagctgctcaagaaggtatccaagtggatgaacgaggagagtctcctttttgtccatcacttctgccataaagcatttgcctacaattttgaggatacaaatgaagatgactggattactagatacttcttcactggaggaacaatgccttctgcaaacctacttctgtactttcaggaagatgtttctgttgtcaaccattggcttgtcaatggaaaacattatgcacagacaagtgaagagtggttgaagagaatggaccaaaacttggccaccataaaacctataatggaaactacgtatggaaaagattcagctgtcaagtggactgcctattggcgaactttctttatttcggtggcagagctgtttggatataacaatggtgaggagtggatggttgtgcatttcttattcaaaaagaagtaaagatcccagatgatgtgttttatcttccttcctccttttaccttagctcatgatcatattgttgcttcaattagaaacttatctgaatatttaaggtacataacttggg

SEQ ID NO: 1655 - DNA, 1316 bp, Cajanus cajan
ggttctcccgtagaactaagttttgcacaagagatccaaatggaactgaaagttgcccaaaaatagaagagtcgagcacatgcatcaaagataaatttccagagagacattaacactgtcattgcaattgtattgctacttactcctatcatcgcaattaatggaaggattaaagcaggctgcgtatgaaactacggtgaagctcatgttggctgcactcgaacgcaagttgctccctgacattgtcaccagaacactcacgcgcttcttgttggctactcgccttcgctctgctcacaaatcattctctgaactccacctctccgatctcctccaatttgcacattctttacaagatatgcccatagcaatcaataccgagaagccaaaatctcaacattatgaattaccaactgctttctttaggatggtgctcggaaataatctcaaatacagctgctgctatttttcttctgcctcaatgacgctggatgatgctgaagaagcaatgttgaaactatactgtgagagatcaaacctcaaagatgggcacacagtacttgacgtgggatgcggttggggatctctggctttatacattgccaagaagtacactaactgcagggtaactggaatctgcaattccacaactcaaaaggcttacattgaggagaagtgccgggatcttcagctgcaaaatttgggtattattgttgctgacattagcacttttgaaatggaagcttcttatgacagaatattttccattgaaatgtttgagcatatgaagaactataaagagcttctcaaaaagatatccaaatggatgaaagaggatagccttttatttgttcatcacttctgccacaaagcatttgcctaccactttgaggacataaatgatgatgattggattacaagatacttctttactggaggaactatgccttcagcaaatctacttctttatttccaagatgatgttacagtcatcaaccattggttagtgaatgggaaacactactcaaagacaagtgaagaatggctcaaaagaatggaccatagaatgactttgatcaagccaattatggaatcaacatatggcaagaattcggctatcaagtggattgcatattggagaacgttcttcatagctgttgcagaactttttggatacaataacggtgaagagtggatggttgcacattttcttttcagaaagaaataaagtaagcccaaattgtaatatgaggttgcacacttcaataatgtttcgtatttttatcaacttattttaattcggcacctaaggtcct

SEQ ID NO: 1656 - DNA, 1302 bp, Cirsium arvense
cccgtcgtcttatcttcttcttctccgaccaaacttccaatcttggaagcacagaagaaatgagcaacttagtgcaggtaccctacgatgctaccgtcaagctaatgcttgtttcccttcaacgcaatctacttccagatccagttatacgcagactcactcgtctccttttagcaggccgtcttcgttcctgcttcaaacccaccactcaacaacagcttcaagatcttctcgattttgttcaatcattaaaagaaatgcctatagctgtcaagactgaagatgctaaagctcaacattatgagctgcctacctctttcttcaaccttgtacttgggaagaatttcaaatatagctgttgttatttccgtgacaaattaagctcgttagaggatgccgaggaagcaatgttgcaactttactgtgagaaatcacaactgcaagatgggcacaccgttcttgatgttggatgtggctggggatctctaagtatatatatcgcaaaaaaatatagtaattgtaaagttacagggatttgcaattcagtcacccaaaaagctcacattgaagatcagtgtcggaaacttaatctgcagaatgtggaggtgattgttgcagatattagtacatttgagatggaaggatcgtatgaccgaatattttccattgaaatgtttgagcatatgaaaaactataaggatcttctgaagaagatatccaactggatgaaaacagatggttttctctttgttcattacttctgccataaaacatatgcttaccactttgaggatgttagtgaagaagattggatcactaggtactttttcagtggaggtacaatgccttcagcaaatcttctcctttatttccaggatgatgtttctgtagtcaaccattggcttgtgaacgggaaacattatgcacaaacaagtgaagagtggctaaagagaatggataaaaatatagcatcaataaagccaataatggagtcaacttacggcaaagattcagcagtcaaatggaccgtgtattggagaacgtttttcatatcggttgctgaattatttggttataataatggtgaagaatggatggtcgcgcattacttattcaagaaaaaatgatcttaattccgagactaaaatcataccacgaaataagttccttcctttgtatcagtaataaaaacaaatgtctcaaaatggcataagaggaggagcattgctacaaggtcagttgtgtgacgatatctacttctggtaagttgtgaaagttggtcctagtacgaaaggaatagcg

SEQ ID NO: 1657 - DNA, 1199 bp, Daucus carota
agagagagagatggcattgaagaagatgatggaggtaccctacgcagctactgtacgtgtgatgctagcttccctcgaacgtaacttacttcccgatgctgtcattcgacaactcactcgtcttctcttatcctctcgtttgcgactcggctacgctccctctgctcatcttcaactcgctcaactccttcacttcgctcactctcttagagacttgcccatagccatcaagactgaggaccccaaagttcaacactatgaactgccaacctctttcttcaagcttgttctgggggagaatctcaaatacagttgttgctacttcaatgatacatcaagcaccttagatgatgctgagaaagcaatgttggaaacatactgtgaaagatcaggactcgaagatggtcacactgttctcgatgttggatgtggctggggatccttatctattttcattgcaaagaaatatagcaactgcaagattactggaatctgcaactcaaaaacccaaaaggcattcatcgaggaacgctgccgggatctcgatctccacaacgtggagatcattgttgcagatattagcacgtttgatatggaagcatcctatgaccgcatattttctatcgagatgtttgagcatatgaaaaactacaaggaacttctgaagaagatatcacggtggatgaaacctgacagtcttctatttgtccatcatttctgccataaaacatttgcttaccactttgaggacataaatgaagatgactggatcactaggtacttcttttctggtggtactatgccttcagcaaatctgctcctatattttcaggatgatgtttcagttgtcaaccattggctcgtcaatgggaaacattatgcacaaacaagtgaagagtggcttaaaagaatggacaagaacatgagttctgtaaggccaataatggagtctacatatggtaaagattcagctgttaagtggactgtctactggaggacatttttcattgcagttgcagaattgtttggatacagtaacggagaagaatggatggttgcacattttttgtttaagagaaaatgaagtatgttgctctattcagaagtactgaacttgtgaagaacagtaggatttaatcgatgcagtactgactatgttgccatcctcattctatcaaaccattaacaattataaattt

SEQ ID NO: 1658 - DNA, 1847 bp, Petroselinum crispum
gagagagagaggatggcactgaagaagatgatggaagtaccatacacagcgactgtacgaatgatgttagcttcacttgaacgtaatttactaccagatgctgtcattagacgactcactcgtcttctcttatccactcgtctgcgactcggttacgctccctctgctcatcttcaactcgctcaactccttcatttcgctcactctcttagagatatgcccatagccatcaagactgaggacgccaaagttcaacattatgaactgccgacctctttcttcaagcttgttctgggagagaatcttaaatacagttgctgctacttcagtgatacgtcaagcaccttagacgatgctgagaaagcaatgctggaaacatactgtgagagatcaggactagaagatggtcattctgttcttgatgttggatgtggctggggatccttatccatatacatagcaaagaaatatagcaaatgcaagataactgggatttgcaattcaacgacccagaaggcattcatcgaggagcgctgccgggatctagatctccacaacgtggagatcgttgttgcagatattagcacgtttgacatggaagcatcctatgaccgcatattttctatagaaatgtttgagcatatgaagaactacaaggaactattacagaaaatatcatggtggatgaaacctgatagtcttctctttgttcatcatttctgccataaaacatttgcttatcactttgaggacataaatgaagatgactggatcacaaggtacttcttttctgggggtaccatgccttcagcaaatctgctactatattttcaggatgatgtttcagttgtcgatcattggcttgtaaacgggaaacattacgcacagacaagtgaagagtggctcaaaagaatggacaaaaacatgagtgctgtaaggccaataatggagtctacatatggtaaagattcagctgttaagtggactgtctactggaggacattcttcattgcagttgcagaattatttggatacgctaacggagaagaatggatggttgcacatttcttatttaagaaaaaataaagtatgttaatttattcctggacctatactgctgaaccagtgaagaacagtatcttgtgaagcaaccaaggaagcgttttaggcgttgacgtgcgtcttgattagtttattgcaattggtttatatccgagcttggttactttttgatttctgaacgaacttgattattcatgtgttgtgtcgcatgcataaattgtaatgatatgtaagcttcgtgatactatataagggatactataaaaaccgcccctaaccctacccacccattgtatccctaaattgctcattgtcatccctaaatggcgcctcttcatcgaagttccacactcaaaagtagagaaatcatctcagtcacttccacacacaaacaccgagatatcaactcagtcatccctaaaaattgcaagtatatcagatttgccggatgatgtttttggtatgattttagcacgacttcccttggatcaataattccatgcgagctagttttttatgcgaggatgaaatcgccgaaacctaaactactctccagccagaatttatcaaatcccacctccaacattctctctactcaccattgctattcttcgtgataagaaccgggctgacttccctctttttcaccaaactcctaatatgcagtctgaaggtgttatgcctctttctgaatcctcttgtactccagtgaagtttgttaaacatgttttaccacctcaatttgaatcttttcatgtcattccaaatcctaatttgctttcagg

SEQ ID NO: 1659 - DNA, 1303 bp, Aristolochia fimbriata
gagagagagagagaatggcggagggtttgttgagtgtaccttacaatgcgacggtgcgaacaatgctgacgttgctggagaagaacctgctgccggatatggtgataagaaagcttacgaggcttctccttgccgaacggctccgttcgggctacctacgttcttccgaacttcagctcgctgctctcatggaattcgtcaattctttattaaatatgccaatagctgtggagactgataaagccaaagctcagcattatgagctacctactccattctttaagctagtgcttgggaggaatctcaaatacagctcttgttatttccaagatggatctaccacattggatgatgctgaagaagccatgctagagctttattgtgaaagagctcagataaaagatggtcacaccatccttgatgttggatgtggatgggggtcactttccttatacattgcggcaaagtaccagaactgtagagttactgggatttgcaactcaactacacaaaaaacgtttatagaagagcagtgcagggatcgccagttgttgaatgttgagatcatcattgcagatatcagtaaatttgggatggaggccaactttgatcggatcttgtctatagaaatgtttgaacatatgaagaactataaagatcttctaaagaagatatcatcgtggatgaagccagattcacttctctttatccaccacttttgtcacaaaatgtttgcttaccactatgaggacaaaaatgaagatgactggataactagatacttcttttcgggaggaaccatgccgtctgccaatttactcctgtatttccaggaagatgtaactgctgtcaaccattggcttgtgaatggaaaacattatgcacaaacaagcgaagagtggcttaaaagaatggataaaaaccttgacagcataaaaccaataatggagtcaacgtacggcaaggattcagccaccaagtggacagtctactggagaacattctttattgcagttgcagaactctttggatacaacaatggtgaggagtggatggttaaccatttactcttcaagaagaagtagatatcgaaacctgtacagcctcctagcatatgatgttgatctcttatatggagagggtcattttgtgaggaatgcagaaagtaaactctgcttaataaatttctaaaaagcaagtgatgacatctcaacgggctggaggtgaccaatgaaaatgaacaagtgatgcttaatcgtattctttttttcctaaataatagaatccaacatttaagccgaaa

SEQ ID NO: 1660 - DNA, 1734 bp, Centaurea maculosa
gaagccatgagcaacttagtgcaggtaccctacgatgctaccgttaagctaatgctggtttctcttcagcgcaatctgcttccagatgctgttattcgcaggctcactcgtctccttttagcaggccgtcttcgttcctgcttaaaacccacagctcaacagcagcttcaagatcttctggattttgttcactctttaagagaaatgcctatagctgttaagactgaagatgccaaagctcaacattatgagttgcctacctctttcttcaagcttgtacttgggaagaatttcaaatacagctgttgttatttccgcgataagataagctcattagaggatgcagaggaagcaatgctgcaactttactgtgagaaatcacaactgcaagatgggcataccgttcttgatgttggatgtggctggggatctttaagtatatacattgcacaaaaatatagtaattgcaaggttactgggatttgcaattcagtcacccaaaaagctcacattgaagatcagtgtgggaaacttaatctgcaaaatgtggaggtgattgttgcggatatcagtacgtttgagatggaaggatcctatgaccgaatattttccattgaaatgtttgagcatatgaaaaactataaggatcttctcaagaagatatccaactggatgaaaccagatggttttctctttgttcattacttctgccataaaacatatgcttaccactttgaggatgttagtgaagaagattggataactaggtactttttcagtggaggtacaatgccttcagcaaatcttctcctttatttccaggatgatgtttctgtagtcaaccactggcttttgaatgggaaacattatgcacaaacaagtgaagagtggctaaagagaatggatgcgaacatagcatcagtaaagccgataatggagtcaacttacggcaaagatgcagcggtcaaatggaccgtatattggagaacattcttcatatcagttgcggaactatttggttacaataacggagaagaatggatggtcgcacattacttattcaagaaaaagtgatcttaattgcatgactaaaatcataccacaaaataagctccttccattgtatcactaataaaagcaagtgtctgaaaatcacataagagaagggagcattgcttcaaaaaatttgcattacttgttatttcattgattttcgatcgaacattttgaagtagattcgtgtatatgattattgttgttgtatgatccgcaattctgctataataatatcaactagtgttttttcttttttgaaacaaattataaacattcaagttcatcgatcaaaaccattaaaatagtttatttctctcgatcaataataagttctacaaatttactccaaatttggagatttatacttctatcttctggtacaaaatttacatgatcttctaaacctgttgagataggaggacaagcaagccttgagggccaactaatatttcgttaaggaaactgatcaatccaaaccaaaccaccggagtcacatccactccaccgaggggcggaatcaccttccgggtcaccgtcaaaatcggctccgtgggggcgtatgctaccacgtacggaaattcccgaccggaagctttggataccacgacatgacgattcttgcaatgaacaggaacgaaatgccgatagaaaggacccaatacggctatcgccaactta

SEQ ID NO: 1661 - DNA, 1414 bp, Centaurea maculosa
cgggggacagacacataccagaaatgtaatatttaactatttatagacaaccgtcgtcttatcttcttctccttcttcctacttccaattccaatctccattgaagccatgagtaacttagtgcaggtaccctacgatgctaccgttaagctaatgctggtttctcttcaacgcaatctgcttccagatgctgttattcgcaggcttactcgtctccttttggcaggccgtcttcgatcctgcttaaaacctacagctcaacagcagcttcaagatcttctggattttgttcactcattaagagaaatgcctatagctgtcaagacggaagatgccaaagctcaacattatgagttgcctacctctttcttcaagcttgtacttgggaagaatttcaaatacagctgttgttatttccgcgataagataagctcgttagaggatgcagaggaagcaatgctgcaactttactgtgagaagtcacaacttcaagatgggcataccgttcttgatgttggatgtggctggggatcgttaagtatctacattgcacagaaatatagtaattgcaaggttactgggatttgcaattcagtcacccagaaagctcacattgaagatcagtgtgggaaacttaatctgcaaaatgtggaggtgattgttgcagatatcagtacatttgagatggaaggatcctatgacagaatattttccattgaaatgtttgagcatatgaaaaactataaggatcttctcaagaagatatccaactggatgaaaccagatggttttctctttgttcattacttctgccataaaacatatgcttatcactttgaggatgttagtgaagaagattggataactaggtactttttcagtggaggtacaatgccttcagcaaatcttctcctttatttccaggatgatgtttctgtagtcaaccactggcttttgaatgggaaacattatgcacaaacaagtgaagagtggctaaagagaatggatgcgaacatagcatcagtaaagccaataatggagtcaacttacggcaaagatgcagcagtcaaatggaccgtatattggagaacattcttcatatcagttgccgaactatttggttacaataacggagaagaatggatggtcgcgcattacttattcaagaaaaagtgatcttaattgcatgactaaaatcatactacaaaataagctccttccattgtagcactaataaaagcaagtgtctgaaaatgacataggagaagggagcattgcttcaaaaagttagcattacttgttgtttcattgattttcgatcgaacattttgaagtagattcgtgtgtatgattactgttgttgtatgatccgcaattccgctattataatatcaactagtgtttttacaaaaac

SEQ ID NO: 1662 - DNA, 803 bp, Gossypium raimondii
agtcagtcagtcggtcaaacaatcaaattcctcttcagctttagcttccacttccacctaacatttccatcttcccaatctttcctcctccatcggcccgtggtctttgacttgtccggctacgccgtttacaaagagctacattcagcaatatttgtaacagatggcttcttccttccgagcattcctaaacagtccagttggcccaaaaacaactcacttttgggggcctgttgcaaattggggttttgttctcgctggattggtggacatgaataagcccccagaaatgatttctggcaacatgacatcagcgatgtgtgtctattctgcattgttcatgaggtttgcatggatggtacaaccacgaaactatctactgttggcgtgccatgcttcaaatgagacagtacagctctaccaactctcccgttgggcaagagctcaagggtatttgtcggagaagaaagacaaagctacattgcagtaaagcagcttcagttggagccagctgcttttcgtttctttccattccaagtgtctgtgagttttactgtgatctgtgaagattgtagtattctgaacttactattaaagcattcattttgactgctaaaccaataatgattgttggagtgcatcttgattgaccctataatgtgttctgaatcttgattttacctgttaaaaaggtaaaattagcttagagttacaatcactgttgatttgggcatcaagtcatgtttttaataaatttggaatcgatttagcagatcacagaatgtatcatttttaactttgtc

SEQ ID NO: 1663 - DNA, 832 bp, Gossypium hirsutum
ctccattctacaggatcaaagctccaaagcagaagtcagtcagtcggtcaaacaatcaaattcctcttcagctttagcttccacttccacctaacatttccatcttcccaatctttcctccttcatcggcctgtggtctttgacttcttcggcgacgccgtttacaaagagccacattcagcaatatttgtaacagatggcttcttccttccgagcattcctaaacagtccagttggcccaaaaacaactcacttttgggggcctgttgcaaattggggttttgttctcgctggattggtggatatgaataagcccccagaaatgatttctggcaacatgacatcagctatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggagaagaaagacaaagctacatcgcagtaaagcagcagcttcagttggagctagctgcttttcgattctttccattccaagtgtctgtgagttttactgtgatccgtgaagattgtagtattctgaacctactattaaagcattcattttgactgctaaaccaataatgattgttggagtgcatcttgattgaccctataatgtgttctgattcttgattttacctgttaaaaaggtaaaattagcttagagttacaatcactgttgatttgggcatcaagtcatgcttttaataaacttggaatcgatttagcagatcacagaatgtataatttttaa

SEQ ID NO: 1664 - DNA, 1040 bp, Gossypium raimondii
cagagctacattcagcaatatttgtaacagatggcttcttccttccgagcattcctaaacagttcagttggcccaaaaacaactcacttttgggggcctgttgcaaattggggttttgttctcgctggattggtggacatgaataagcccccagaaatgatttctggcaacatgacatcagcgatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggataagaaagacaaagctacattgcagtaaagcagcttcagttggagctagctgcttttcgtttctttccattccaagtgtctgtgagttttactgtgatctgtgaagattgtagtattctgaacttactattaaagcattcattttgactgctaaaccaataatgattgttggagtgcatcttgattgaccctataatgtgttctgaatcttgattttacctgttaaaaaggtaaaattagcttagagttacgatcactgttgatttgggcatcaagtcatgcttttaataaacttggaatcgatttagcagatcacagaatgtataatttttaactttgtccatctcttttgagtacttagcagctatgttgtttccatttttcattttttttatccatacaccacctttattccgacccctaagtggcatttctaaatttttaataattagtaaattgcaaagaaactggcagcaaatcagacctaaaaaaagaagttaacaaaattccaatacatccaagtttttatgaagttaacagttgtcactggttcttaaaattttcagttacattcatacaattgaaacatcacacctattggatcccgatcgaacaggcatgtctggtccagtttttcatcattggtatattttctatcaaaacagccatagaccaacacatcctttgctaaagttttaaaccatcttcccc

SEQ ID NO: 1665 - DNA, 1329 bp, Gossypium raimondii
agggtccaaaaagcaaagttaaagcttagaacaagctggaaaaagaccgctgcttgaattagaacttgggcatgatttttggtttttgcccgagaatagtttgaaattttgtcctagctcctatacctatacattggcagtactttcagatgatctatatagctttctatttccgtagctgaatttattttagtatttgaaatttgatgatttataataatattttgtattcaacaatcgcagagctacattcagcaatatttgtaacagatggcttcttccttccgagcattcctaaacagttcagttggcccaaaaacaactcacttttgggggcctgttgcaaattggggttttgttctcgctggattggtggacatgaataagcccccagaaatgatttctggcaacatgacatcagcgatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggataagaaagacaaagctacattgcagtaaagcagcttcagttggagctagctgcttttcgtttctttcccttccaagtgtctgtgagttttactgtgatctgtgaagattgtagtattctgaacttactattaaagcattcattttgactgctaaaccaataatgattgttggagtgcatcttgattgaccctataatgtgttctgaatcttgattttacctgttaaaaaggtaaaattagcttagagttacgatcactgttgatttgggcatcaagtcatgtttttaataaactttgaatcgatttagcagatcacagaatgtataatttttaactttgtccatctcttttgagtacttagcagctatgttgtttccatttttcattttttttatccatacaccacctttattccgacccctaagtggcatttctaaatttttaataattagtaaattgcaaagaaactggcagcaaatcagacctaaaaaaagaagtaaacaaaattccaatacaccaagtttttatgaagttaacagttgtcactggttcttaaaattttcagttacattcatacaattgaaacatcacacctattggatcccgatcgaacaggcatgtctggtccagtttttcatcattggtatattttctatcaaaacagccatagaccaacacatcctttgctaaagttttaaaccatcttccccatgctccttgaccatgccatccgtatctgttgcgagaccaaaatttgaac

SEQ ID NO: 1666 - DNA, 839 bp, Gossypium hirsutum
ccaacattctctcctaccaaaaatattattccatcttcatcccttttaaccgccggccgtctttcacttctccggcgatatcattttttcccgtcaagagctactctcagcagaatttgtcacagatggcttcttccttccgagcattcttgaacagtccagttggtccaaaaacaactcacttttggggacctgttgccaattggggatttgttcttgctggactggtggacatgaataagcccccagaaatgatttctggcaacatgacttcagcaatgtgtgtctattcagcattgttcatgaggtttgcatggatggtacagccacgaaactatcttctgttggcatgccatgcttcaaatgagacagtacagctctatcaactttcacgttgggctagagctcaggggtatttgtctgagaagaaagaggaagcctcatctcagtaaagtacccttttttcctgcttttctttccattttgagattctgctattttcttgtgatccctgtaagaatctattctgagctttactttataaagaaactgatttaattctaccttcatctggccgaagcttaagcacatagtaagccgattactgttaagtggaatcatgatcggccgcctttcttattatgcatgagtggtaaaacagcttagaattctacaatcaatgttgattcaataaactttttcttgatttagctgaccataattgtataatgtgcaatgaggtatattgaaagtcttatatgtgatgcatcatcctagtgatactttccgggtagcacaatttcatgttgaaattcaaagcatttcgattttctattttt

SEQ ID NO: 1667 - DNA, 808 bp, Gossypium hirsutum
catcggcctgtggtctttgacttcttcggcgacgccgtttacaaagagccacattcagcaatatttgtaacagatggcttcttccttccgagcattcctaaacagtccagttggcccaaaaacaactcactttgggggtcgtgttgcaaattggggttttgttctcgctggattggcggacatgaataagcccccagaaatgatttctggcaacatgacatcagctatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggataagaaagacaaagctacattgcagtaaagcagcttcagttggagctagctgcttttcgtttctttccattccaagtgtctgtgagttttactgtgatctgtgaagattgtagtattctgaacttactattaaagcattcattttgactgctaaaccaataatgattgttggagtgcatcttgattgaccctataatgtgttctgaatcttgattttacctgttaaaaaggtaaaattagcttagagttacgatcactgttgatttgggcatcaagtcatgtttttaataaactttgaatcgatttagcagatcacagaatgtataatttttaaccttgtccatcacttttgagtacttagcagctgtgttgtttccatttttcattttttttatgcatacgctgcctttattccgacccctaagtggcatttcta

SEQ ID NO: 1668 - DNA, 834 bp, Gossypium raimondii
ataactaccaataattaaattactcccaacattctctcctaccaaaaaatattattccatcttcatcccttttaaccgccggccgtctttcacttctccggcgatatcattttttcccgtcaagagctactctcagcagaatttgtcacagatggcttcttccttccgagcattcttgaacagtccagttggtccaaaaacaactcacttttggggacctgttgccaattggggatttgttcttgctggactggtggacatgaataagcccccagaaatgatttctggcaacatgacttcagcaatgtgtgtctattcagcattgttcatgaggtttgcatggatggtacagccacgaaactatcttctgttggcatgccatgcttcaaatgagacagtacagctctatcaactttcacgttgggctagagctcaggggtatttgtctgagaagaaagaggaagcctcatctcagtaaagtacccttttttcctgcttttctttccattttgagattctgctattttcttgtgatccctgtaagaatctattctgagctttactttataaagaaattgatttaattctaccttcatctggccgaagcttaagcacatagtaagccgattactgttaagtggaatcatgatcggccgcctttcttattatgcatgagtggtaaaacagcttagaattctacaatcactgttgattcaataaactttttcttgatttagctgaccataattgtataatgtgcaatgaggtagattgaaagtcttatatgtgatgcatcatcctagtgatactttccgggtagcacaatttcatgtt

SEQ ID NO: 1669 - DNA, 561 bp, Theobroma cacao
tctatcttccactctttcttacgccagccccgccccggaatcgccgatcctcgttgccttctccggctacatcttttagacagagatattttcagaagcatttgtcacagatggcttcttccttccgtgcattcctgaacagtccagtcggtccaaaaacaactcacttttgggggcctgttgccaattggggatttgttcttgctgggttggcggacatgaagaagcccccagaaatgatatctggcaacatgacaacagcaatgtgtgtctattctgcactattcatgaggtttgcatggatggtacagcctcgaaactatctactccttgtatgccatgcttcaaatgagactgtacagctctaccaactttcccgttgggcaagagctcaggggtatttgtcagagaagaaagaggaagcctcatcacagtaaagcagctttcattcattctgagtttctgtgatttttgttgtgatccctgaagtatgtattctcaacttagcatataaagaatttgcttaaatcaactcacattcatttgactgcaagtttcaag

SEQ ID NO: 1670 - DNA, 684 bp, Cucumis sativus
aagagagagaaaaagaaaaagaaaaatagcctgctatcgttcttcatcttctgcttttgggtggtttcaaagtcaaaattctctagcggttctccattatctcttggccagatctccatcgaattgctgactgtcctccgacgttcgtcttctccagaaatcagagaatggcttcattccgagcattcttgaacagccctgttggtccaaaaactactcatttttggggacctgttgccaactggggattcgtggctgctgggttagcagacatgaacaagccaccagaaatgatttctggcaacatgacagcagcaatgtgcgtctattcagcactgttcatgagatttgcgtggatggtacaaccccgcaattacctacttcttgcttgtcatgcctcaaatgagactgtacagttgtatcaattctcacgttgggcaaaggctcaagggtacttgtcagagaagaaagacgaagctggatctcagtagcttgatgctgtattcccacatcctgttgtctttatgacattattttctacgggttgtaatttgactcattgataattgttgtgtatgttatttgaaaatatgtcagaggaaactacttcagtaacaccagaatggaattgggaatttttctcccaagaagcaataaaaatatttcatatttgccaattctgag

SEQ ID NO: 1671 - DNA, 747 bp, Citrullus lanatus
ccataagaaaagaatacccaaaaagaaaaaggaaaaaagaaaatggaaaaaagaaaaaagaaatgagcatactagtcgctcttcatcctctccttttgggtgggttcaaagtcaaaattctatagtggttctccattctctcttggccgatctccatcgaattactgactggtaggtttctgcacgtccttcttttgtagaattcagagaatggcttcattccgagcattcttgaacagccctgttggtccaaaaactactcatttttggggacctgtcgccaactggggatttgtggctgctggtttagcagacatgaacaagccaccagaaatgatttctggcaacatgacagcagcaatgtgcgtctattcagccctgttcatgagatttgcatggatggtgcaaccccgcaattacctacttcttgcttgtcatgcatcgaatgaaactgtacagttgtatcaattctcacgttgggcaaaggctcaagggtacttgtcagagaagaaagacgaagctgcatctcagtagcttgaagctatattccccatccttttgtttttatgtcatgattttctacgggttgtaattgactcattgataatcgttgtgtatgttatttgaaaatatatccaggaagctacttcagtaacaccaaaatggaattgggaatttttctcccgagaagtaataaatatttcagatttgccgattctgagtcaacatacaagaatgcagcacatg

SEQ ID NO: 1672 - DNA, 764 bp, Eucalyptus grandis
cggaatgcaaaaacaatctccatcttcttctctctcacacgtcagagaagtcaaacgaacaactctttcccagaagctcgcggcttcccagcttcgcttgtccccgccgtgatcggattctcgacccgcggcgacgccacgccggcgccaccctgctcgtcgccgtcgtcttcgggccgcaggaattacttgcagtaaatggcttcttttcgagctttcctgaacagtcctgttggccccaaaactactcatttttggggacctgttgcaaactggggatttgtggtcgctggattggttgacatgcaaaaaccgccagagatgatatctggcaacatgactgcagctatgtgcgtatactcagcactgtttatgaggttcgcatggatggtgcaaccacgcaactatctacttctcgcatgccatgcttcaaatgaaaccgtccagctctatcaactctcccgttgggcaaagggtcaggggtacttgtcggagaagaagaaagatgaagcctcgtcacagtgatatgttgtgaatgtatctttccctgttccaattgtcttttgatattttcactggagttccataaaacaatttcctttcttatgctattaaaatcgcgatttagcgagacttgagtgatcctagctggatttgtatatcttggtgttgcaatttacaatttatgttaaacaaatggtgcttacgattgcacatatgtgaatggataggatcacgctgtctatttgtgcttacaaaaaaaa

SEQ ID NO: 1673 - DNA, 586 bp, Eucalyptus grandis
gtaggaattacttgcagtaaatggcttcttttcgagctttcctcaacagtcctgttggccccaaaactactcatttttggggacctgttgcaaactggggatttgtggtcgctggattggttgacatgcaaaaaccgccggagatgatatctggcaacatgactgcagctatgtgcgtatactcagcactgtttatgaggttcgcatggatggtgcaaccacgcaactatctacttcttgcatgccatgcttcaaatgaaaccgtccagctctatcaactctcccgttgggcaaagggtcaggggtacttgtcggagaagaagaaagatgaagcctcgtcacagtgatatgttgtgaatgtatctttccctgttccaattgtcttttgatattttcactggagttccataaaacaatttcctttcttatgctattaaaatcgcgatttagcgagacttgagtgatcctagctggatttgtatatcttggtgttgcaatttacaatttatgttaaacaaatggtgcttacgattgcacatatgtgaatggataggatcacgctgtctatttgtgcttgcaaagaaaa

SEQ ID NO: 1674 - DNA, 1205 bp, Eucalyptus grandis
aataaagaaatgaagttacggccggggacggccaagtggccaacccatttaggtgaaagaggagattctacaggccagaaaaagtcgaagaaagaaaaacagggcagggagggaggccttaccttcgacatttcaaacccgaatcttgttgcacgactggtgacaaattgaaggtcgtgatgcgaaatctatgattaaccatatcgaagaatatcttctttgagctgtaaaaggggaagcttggattgggcgagatcatttgaaccctgatttcattaagcaggaattacttgctacaaatggcttctttccgagctttcttgaacagtcccgttggccccaaaactactcatttctggggaccagttgcaaactggggattcgtggttgctggattggttgacatgcagaaaccaccagagatgatatcaggcaacatgacagcagctatgtgtatatattctgcattgtttatgaggtttgcatggatggtgcagccacggaactacctactccttgcatgccatgcctcaaatgaatctgtccagctctatcaactatcccgttgggcaacggctcaagggtacttgtcccagaagaaagacaaagcctcgtcacaataatatgttgctgggtctttctttccccatttcactggtcttgtggtgatttcttcccaggagttcctgagaagtttgctttcatgctatccaaaccataattggcaggtcttgtgtgatcgcaacttgattcgtattttttcgcatcattgttgacgatttactttcagcaagtgatgcttgcatggaaacttaacctcctgttggacttggatgcccaatgatatatccctcgaactgtcgcatttccttggttgtgcacaccaagcatggcttttgttggcatggttcatgaggacaggtcggtatcgtcacataggactacactgtctgctgcggtctaagtggagatcagatattaggatctgtgaaagtgttgtgcacgtttgtgaggagacgttagaggaagcatttcatgtggtttcaatggggacactttcctctagcgattttaagtttggtggtctgctgggttttcgggtccctgtcatatctattaacaggaaatcaaacggatggattcccggggtcccacattgatgtccgtctagtcatcttgttgtctgtcgttttcagtgcagtgag

SEQ ID NO: 1675 - DNA, 727 bp, Euonymus alatus
ggccactcttgcgtagatcgaaaattatttaacgccctcccggacgcccaccaaaccttcacagctctgacctcctctctctccgacctactcagtgtcgccgatcagcgatagcttctccggcgaggcccaagaggtattcaggacagtaatatatggcgtctttccgagcgttcttgaacagtcctgttggtccaaagacaactcatttctggggtcctgttgccaactggggatttgttattgctgggctggtggacatgcagaaaccgccagaaatgatttctggcaacatgacagcagcaatgtgcgtttactcgggcttgttcatgaggtttgcatggatggtacagcctcgtaactatctgcttttggcatgccatgcttcaaatgagactgtgcagctttatcaactctcgcgttttgcaagagctcagggctatttatcagagaagaaagaagaagcctcaccgcagtaacttattacttccttctctctctctgttcatggttttggtttgaatttgtgaagaattgttgcactagctgccacagaagaaagaataagcctcactgcagtaacgtatcacatctctctctctctctgtgcccatggttttggtttgaaattgttgcaatttcctgtataagactcaatacttgtgttaaacgtatatttgattctggtgcaactgtaagcacaaactacatggatctacttttaatt

SEQ ID NO: 1676 - DNA, 731 bp, Euonymus alatus
ctcccagacgcccaccaaaccttcacagctctgacctctctttccgacctactcagtgtcgccgatcagcgatagcttctccggcgaggtccaagaggtattcaggacagtaatatatggcgtctttccgagcgttcttgaacagtcctgttggtccaaagacaactcatttctggggtcctgttgccaactggggatttgttattgctgggctggtggacatgcagaaaccgccagaaatgatttctggcaacatgacagcagcaatgtgcgtttactcgggcttgttcatgaggtttgcatggatggtacagcctcgtaactatctgcttttggcatgccatgcttcaaatgagactgtgcagctttatcaactctcgcgttttgcaagagctcagggctatttatcacagaagaaagaagaagcctcactgcagtaacttattacatccttctctctctctgttcatggttttggtttgaatttgtgaagaattgttgcactagctgccacagaaaaaagaataagcctcactgcagtaacgtattacatctctctctctctctctctgtgctcatggttttggtttgaaattgttgcaatatcccgtataagactcaatacttgtgttaaacgtatatttgattctggtgcaactgtaagcacaaactacatggatctacttttaattacatcttgcatctttttagtctgtgagtagtttaagatt

SEQ ID NO: 1677 - DNA, 534 bp, Cucurbita pepo
ttctctcctggctggatctctccattgagttgcagactgaaatcgaagaatggcgtcattccgagcattcttgaacagccctgttggtccaaaaactactcacttctggggacctgtcgccaactggggatttgttgctgctgggttagcagacatgaacaagccaccagaaatgatttctggaaacatgacagcagcaatgtgcgtctattcagcactgtttatgagatttgcatggatggtgcagccccgcaattacctacttcttgcttgtcatgcatcgaatgagactgtacagatgtatcaattctcacgttgggcaaagtctcaagggtacttgtcagagaagaaagatgaagctgcatctcagtagcctgattttgggcaaagtaattatccttttgtgttcgtgtcatgattttctgaaggttgtaattgacccattgataatcgttgtgtatgttatttgaaaatatgtgaggaaactacttcagtaacgccaaaatggaattgggaattttctcccgagaagca

SEQ ID NO: 1678 - DNA, 719 bp, Euonymus alatus
atcgaaaattatttaacgccctcccagacgcccactaaacctttacagctctgacctctctttccgacctactcagtgtcgccgatcagcgatagcttctccggcgaggtccaagaggtattcaggacagtaatatatggcgtctttccgagcgttcttgaacagtcctgttggtccaaagacaactcatttctggggtcctgttgccaactggggatttgttattgctggtctggtggacatgcagaaaccgccagaaatgatttctggcaacatgacagcagcaatgtgtgtttactcggggttgttcatgaggtttgcatggatggtacagcctcgtaactatctgcttttggcatgccatgcttcaaatgagactgtgcagctttatcaactctcgcgttttgcaagggctcagggctatttgtcacagaagaaagaagaagcctcaccgcagtaacttattacatccttcttgctttatccgttcatggttttggtttgaatttgtgaagaattgttgcactagctgccacagaagaaagtataagcctcactgcagtaacgtattacatctctctctgtgctcatggttttggtttgaaattgttgcaatttcctgtataagactcaatacttgtgttaaacgtacatttgattctggtgcaactgtaagcacaaactacatggatctactttcaattacatcttgcatcttt

SEQ ID NO: 1679 - DNA, 837 bp, Arachis hypogaea
cccccctactcccctgtgtcccgttggcagtctcagaagcagtggtatcaacgcagagtacggggggcttggtctggtcttttggtacactgctttcctcttatctcagattcaaccccgccggtacccgctctcccgccgtataagccacgaagtagtacttgtatcaaatggcttcctccttcaaagcatttttgaacagtccggttggccctaaaacaactcacttttggggacctgttgcaaattggggatttgttgctgctgggttggctgacatgaataaacctccagaaatgatctctggcaacatgacagcagcaatgtgtgtctactctgcattattcatgagattcgcatggatggtacagccgcgtaactatctacttcttgcatgccatgcatcaaatgagaccgtacaactctatcagctctcccgttgggcaaagggacagggttatctctcggataagaaggaagaagcttcaccacagtgactcaatgctagcacgttctgaatgtagcaacttgaagagatttttccatttgaatttgcgtatttatgaataattgattgtaagaaatgctcgtggaaactgagaggttgagattatccaagtttgtttgatctggggagggtttgaatggaaggtctaaacaattagtcaattagttaaaggcatatatgggtgggttttgtatgtatctgccccagaagcattttaacttcgaagaatttgtccatagctgaaattcacttccaagactgggaggtgaaaattggactcgactatatgatttggaccttcatatttatgtgaatgaacgttcataggt

SEQ ID NO: 1680 - DNA, 817 bp, Arachis hypogaea
gtatcaacgcagagtacggggggatgcttggtctggtctttggtacactgctttcctctcatctcagattcaaccccgccggtaccctctctcccgccgtataagccacgaagtagtacttgtatcaaatggcttcctccttcaaagcatttttgaacagtccagtcggccctaaaacaactcacttttggggacctgttgcaaactggggatttgttgctgctgggttggctgacatgaataaacctccagaaatgatctctggcaacatgacagcagcaatgtgtgtctactctgcattattcatgagatttgcatggatggtacagccgcgtaactatctacttcttgcatgccatgcatcaaatgagaccgtacaactctatcagctctcccgttgggcaaagggacagggttatctctcggataagaaggaagaagcttcaccacagtgactcaatgctagcacgttctgaatgtagcaacttgaagagatttttccatttgaatttgcgtatttatgaataattgattgtaagaaatgctcgtggaaactgagaggttgagattatccaagtttgtttgatctggggaggtttgaatggaaggtctaaacaattagtcaattagttaaaggcatatatgggtgggttttgtatgtatctgcccagaagcattttaacttcgaagaatttgtccatagctgaaattcacttccaagactgggaggtgaaattggactcgactatatgatttggaccttcatatttatgtgaatgaacgttcataggtaccaaaaaaaaaaaaaaaaacaaaa

SEQ ID NO: 1681 - DNA, 703 bp, Manihot esculenta
attctccccctcctgcagtcctgctccggtgctccctctctggtacttattacccaacatccccaaattctccggcgctccccggtcagaggtgttccgtatggcgtcattcagagcatttctgaacagtccagttggtccaaaaacaacacatttctggggacctattgccaactggggatttgttgctgctggcttggtggacatgaacaaacccccagaaatgatttcaggaaatatgacaggagctatgtgtatttattcagcgttgttcatgaggtttgcatggatggtacaacctcgtaactatctacttctagcttgtcatgcttcaaatgagactgtgcaactctatcaactctcccgttgggcaagggctcagggatacctgtcaacggagacggagaaaaaagagaaagcctcgtcagagtaactcaatgctgctactttttagctgccctgttttgctgggattattattttgaattgctgtggaactgggctttcataaaggtatatgaaataagtgaacctgtgataatggtacgtaaaacacacaaatcatggaacgatgctggtgttgtttcttgccgtgaaattttaagatgtggctagcgaatgtaggtgcgtaggcattaaaccttgtttgaacggccataggtacctttgaattttaattttaagcgaaatacttaggttgttt

SEQ ID NO: 1682 - DNA, 644 bp, Carica papaya
atctcaccaaaccacaatcgtctctctctctctctctcccctcccactcgtctgcggcaatcgccgaactacgcccttgacatcgccggcgagaggtgttcaagaggcagtcggaacatatggcttcatcattcagagcgttcttgaatagtccagttggtcctaaaacaactcatttttggggacccgtagccaactggggttttgttgttgctgggttggttgacatgcagaaaccccccgaaatgatctctggaaacatgactgcggcaatgtgcgtctactcaggattgttcatgaggtttgcatggatggtgcagccacgtaattatctacttctagcatgtcatgcttcaaatgagacggtacagctctatcaactttctagatgggcaaagggtcaagggtacttgtcatcatcggagaaaaaagaagaggcctcgtctcagtagtgacttgatgcggccttgtttccatgtcagtttccattaactctgcttctgatttgaagtgcatacattgttatttccaacagtgactattctgcatgcacggccattagttatcttcttgtttggataaataaagctttgaatccgaccacgataaatgatttgaattataaaagcttcgttttaccatag

SEQ ID NO: 1683 - DNA, 709 bp, Ricinus communis
ctcgaccgcacacaatcggcgattccaaaccattttcttcaccaatctctgtactaaaaacaccaaatcctcgcaacgctttctctctcatcctccgattccatccaccaccgtgctctccagcttctccggcgatctcaggtcagaggtattcaatatggcttcattcagagcattcttgaacagtccagttggtcctaaaacaactcatttctggggacctgttgctaattggggatttgttgctgctgggttggtggacatgaaaaaacctccggaaatgatttctggaaatatgacaggagcaatgtgtatttattcagcattgttcatgaggtttgcatggatggtacagcctcgtaactatctacttctagcatgtcatgcttcgaatgagactgtgcaactctatcaattttctcgttgggcaagggctcaagggtacctatcatcagagaaaaaagaaaaagagtcatccgagtaacttaatgtggccaaaagatactacagtaattcaatattcctccttttgctgcccatttttctgagattcttatcttgattttcagaaaactgatgttagttttgtcagttaaaactcttttgaaaagaacttgaatttgattgtacaagtgaagcttgacaccaatgattgtatgcactagttctctcacattagcatacaaaataagtgaatttatgatccaat

SEQ ID NO: 1684 - DNA, 643 bp, Malus domestica
gggagctggtaccgccccacaaacgctgcccctccgagaaggtcagagacttttccctgtaaattaaacgccgatcgtccccaattggagttctccggtaagagattctaagcggtagatatcacatatggcttcattccgagcattcttgaacagtccagttggtccgaaaacaactcacttttggggacctgttgcaaactggggattcgttgccgctggattggcggatatgaacaaacctccagaaatgatttctggcaatatgacagcagcaatgtgcgtttattcagcgttgtttatgagattcgcatggatggtacagcctcggaactatctgcttttggcatgccatgtctcaaatgagactgtccaactctatcagctctctcgctgggcgaggggtcaggggtacttagccccgaagaaagatgaagctgcaaccgagtaacttgctgcttcttttcattccctgctcgttcattgttttagttgcgaattttaccgaaaacagtgttgatcttgtgcgaggcgcgtgtgataaaatttgcttttgatgttaactgagctatcaatctcagcagaacaagtgctcttgtcatccattttcattcaatgtcatgcacttctttttgttcataaa

SEQ ID NO: 1685 - DNA, 913 bp, Malus domestica
atgggagctccatcggtgcactttattttggatgagatgagaaataagtcgattggggaagatctgtccgtcggtttggaactgcgagatctagagaatctgaactcctatactaccggagagacaggtcgcaaggattttaacttgacacgtgtgataatatcattgggccgaataaaattttgtgttttatttagtacacaagcgatccgaatcactgaagtctactttgttgttcttcctggggatctgccagcctgccaccacaaatcccctctcccctaatcgccgatcgtccccaactactccggctatttctccgataagagattgtaagaatggcttcgttccgagcattcttgaacagtccagttggtccaaaaacaactcacttttggggacctgttgcgaactggggatttgttgctgctggattggcggatatgaacaaacctccagaaatgatttctggcaacatgacagcagcaatgtgcgtttattcagcattgtttatgagattcgcatggatggtacaacctcgcaactatcttcttttggcatgccatgtctcaaatgagactgtccaactctatcagctctctcgctgggcgaggggtcaggggtacttggccccgaagaaagatgaagctgcatccgagtgatttgctgctgctttcattcccttgctcgttcattgtttttgttgtgatttttaccgaagacagtgttgatctcgtttaggacgcatatgatacagtttgcttttgatattacctgagcatgtggcctttttttgttcataattggttgtttttagtcaattgtgtaccagatgtctcaagcataaaccagtcgctactcgtttcgacggtgacgtttgaaagtaataaggaatttcacgatgatgaattct

SEQ ID NO: 1686 - DNA, 685 bp, Echinacea purpurea
acgtaacaacggtttagttagctgaaacacctctctgaaccgtttcgcagacaacgcagtgacagaaaatctgcgtcgaggagttcctgtaattttatgcagatttgtcaattgactcatttatggcttctttcaaagcatttttgaacagtcctgttggtccaaaaacaactcacttttggggccctgttgctaactggggctttgtcattgctggactagtagacatgaaaaagcctccggaaatgatttctggcaacatgactggagcaatgtgcgtatattctgcactgttcatgaggtttgcttggatggttcagccacgcaactatctgttacttgcctgccatgcttcaaatgagacagtgcaactctatcaactctcccgctgggccaagggtcaggggtacttgggagagaagaaagccgaggcctcgcctcagtgaatagaatgcaagtgatactctgttctctccaaagctgaaattgcgcttaccatcaatctgcaagaatggaaatggaaaatggaaaataaaaggcttgtatatgattcaaattggttatcatcttgagaaactatttttcctcaagactttcgactgatacacatccctctaatttgatatgttgtaaaaacgaaacttagatttcaagtggttattgcttgttttgttcctttcccttc

SEQ ID NO: 1687 - DNA, 764 bp, Euonymus alatus
ccaccaaaccttcacagctctgacctctctttttgacctaatcagcgtcgccgatcagctctagattctccggcgaggtacaagaggtattcaagacagtaatatatggcatctttccgagcattcttgaacagtcctgttggtccaaagacaactcatttttggggacctgttgccaactggggatttgttattgctggtctggtggatatgcagaaaccgccagaaatgatttctggcaacatgacaggagcaatgtgtatttactcgggattgttcatgaggtttgcatggatggtgcagcctcgtaactatctgcttttggcatgccatgcttcaaacgagactgtgcagctctatcaactctcgcgttgggcaaggggtcagggctacttgtcgcagaagaaagaagaagcctcaacccagtaacttgtcacaacatctctctctggcggtccatggtttcggtttgactttatgaagaaattgttcaccttcctgtacaatagtcgagactcccgactcctgtcaaacagatatttgattcttgtgcaactgtaagcacggttgtttcaacttattgactctttttcactaccattttcatttgaggaaaaataatcccttttaagagtttatcaatggtagtgatgtggagactggagagtcattttcagtaggttcgcaaggtctttgatctcccagtttccgtggttctcgcccttcacttgctctggcggagccttaagaaagacgtgctgtag

SEQ ID NO: 1688 - DNA, 673 bp, Vitis vinifera
ctcctccatcgctctccatccgagactacacggtaggaaagacgctccactttcattagacatcgttgatcggatcgaaggggtatttgagcagcagtggtaatatatggcttccttccgagcattcttgaacagtccagttggtccaaaaacaactcatttttggggacctattgccaactggggattcgttgctgctgggttggcggacatgaataaacccccagaaatgatatctggcaacatgacagcagctatgtgtgtttattcggccctgtttatgaggtttgcatggatggttcagcctcgcaactacctacttctcgcatgccatgcctcaaatgagactgtgcagctttatcaactctcccgttgggcaaagggtcaggggtacttgcaggagaagaaagacgaagctgcatctaactgacttggtgctgccttcttctactttgctcgatcagcgatttctgtcggggttcctggaaaccactggcatcttgtgtcagactcctctgaaacacttcactttcaattttattgcatgtattagcagaaccaagcagatcacagtcgaatgaatcttgattcctattgtggctttgcttttatggcaattaataaatctgtaagatagtagtatttgatccatgatttcattactgaaatgtag

SEQ ID NO: 1689 - DNA, 664 bp, Cucumis melo
tagcctgctatcgttcttcatcttctacttttgggtggtttcaaagtcaaaattctctagcggttctccattatctcttggccagatctccatcgaattgctgactgccctccgacgctcgtcttctccagaaatcagagaatggtttcattccgagcattcttgaacagccctgttgggccaaaaactactcatttttggggacctgttgccaactggggattcgtggctgccgggttagcagacatgaacaagccaccagaaatgatttctggcaacatgacagcagcaatgtgcgtctattcaggactgttcatgagatttgcatggatggtacaaccccgcaattacctacttcttgcttgtcatgcctcaaacgagactgtacagttgtatcaattctcacgttgggcaaaggctcaagggtacttgtcagagaagaaagacgaagctgcatctcagtagcttgatgctatattcccacatcctgttgtctctataacattattttctacgggttgtaatttgactcattgataatcattgtgtatgttatttgaaaatatgtcgaggaaactacttcagtaacaccagaatggaattgggaatttttctcccgagaagcaataaaaattatttcagatttgccaaaaaaaaaaaaaaa

SEQ ID NO: 1690 - DNA, 540 bp, Scabiosa columbaria
ctgcatcagatcaccactcctacaactactctctattctttcaatcttttattctttccttcaccattccaaagatttgcgcatctcttctttcgcctgtatatacgatcggaaccggcgtttctacttctccgaggtgttttaaacagcgacattatatatggcttccttcagagcatttttgaacagtccggttggccccaaaacaacacatttctggggtcccgtagccaactggggtttcgtcgttgctggactagttgatatgcagaagcctccggaattgatatctggcaacatgactggagcaatgtgcatatattcagcattgttcatgaggtttgcttggatggtacaacctcgcaattatctccttctggcatgtcatgcctcaaatgagactgtgcagctctatcaactctcccggtgggcaagagctcaaggttatttggggaagaaggaagacaaggccgtgtctgagtgactcggtactctggtttctatcttgttatctttggacttgtgtaactatttgattag

SEQ ID NO: 1691 - DNA, 868 bp, Panicum virgatum
ccgaggcactgaaaagcccagcccatatacctccatttgttccccggaataatcccaacaacaaccactccagatttccccatcttcacgctcgtcccgtcttcttcaacacctcgccgccgccagacgtcgacgagacgacgacgacgacaggcgacgaggtgtggtgaatccttggagaaatcgttcgccatgtcgacggcgctcaaggccttcctcaacagtccggtcggccccaagaccacccacttctggggtcccgtcgcaaactggggtttcgtgcttgcgggtttggttgacatgaacaaacctcctgaaatgatatctggcaatatgacagcagccatgtgcgtctattcagcactctttatgaggttcgcatggatggtgcagccgcggaactacttgcttctggcatgccatgcatccaatgagtcagtccagctctaccagttgtctcggtgggctagggcccaggggtatctggagaagaaagaaccggagactcagcagtaaaagaagtgtgtaaacctgcatttaccttcccaaataagagtgacctgcagcagcagtttgaaatgctgaatctggttgacaaatcccagaaaacaaattctatgccgtttatgtagtgttacaagtgtcgtatttttgtctcattttgtttcggatctgatctgatggctgtaaaatacacttgacgtggtttgaaaatgatgatcccaatcccttcttcctccatggctgtttgacaatcgctgttcgctgcagcccaaaaggccaaaacacacatgcatgtggtccgcccccaggcactccatagtctccacaggtgataggtttcgcctacatctggtcgacaccttgc

SEQ ID NO: 1692 - DNA, 793 bp, Tripterygium wilfordii
tgacctctcttttcggcctactcagtgtcgccgatcagctctagcttctccggcgaggtccaagaggtattcaagacagtaatatatggcatctttcagagcattcttgaacagccctgttggtccaaagacaactcatttttggggacctgttgccaactggggatttgttatcgctggtctggtggacatgcagaaaccgccagaaatgatttctggcaacatgacagcagcaatgtgtatttactcgggattgttcatgaggtttgcatggatggtgcagcctcgtaactatctgcttttggcatgccatgcttcaaacgagactgtgcagctctatcaactctcgcgctgggcaaagggtcagggctacttgtccgagaagaaagaggaagcctcacctcagtaacttggtgaatctctctctctggctgtcaatggttatggttcgagtttatgaagaaattgttgtcaccttcctgtacaagactcaagactcctgtcaaacgcatatttgattctggtgcgactgtaagcacagttatgactaattgactgttttcacttccattttcttttgaggaaaataagcccgtgggtcacagagttgatcaatggtaatgatgtagagtcattttcagacagttccggtagggctttgatcgccctgttccagtggttcctgcccttctgttacctacaagagcttctgaaagatatgcagtgtatccataaattctttctgggtcagaatttatttattacttgtccagcaaattgctgcacaattttc

SEQ ID NO: 1693 - DNA, 610 bp, Silene vulgaris
tctccgaagaattcgatccgtattttggtgaacatggcttcgactttccgggcatttttaaacagtcctgttggtcccaagactactcatttttggggccctgtagccaattggggttttgttgtggcggggcttgttgacatgaataaacctccagaaatgatttctgggaacatgactgcagccatgtgcgtctactcagcattattcatgaggtttgcatggatggtacagcctcgtaattatttacttctgacttgccatgcttctaatgagactgtccaaatgtaccaactctctcgatgggctagggcaaatgggtacttgtctgaaaagaaagaggaagcgaaaagcccagaactgtgattttcccttgccattgaattgctcgtcatttatttctgtcaaattgcatcttgattttcaccattgcactgcctgctttagtccccatgtaagctcggatttcagggttttgctcaaagataaataatctaccatgttttctttctttgttacaatgcctttgtgtccatgattccgtctcttgttgaaatatattttaaccccgacttgtaacaaacatgtgttatgagcaatgtttaatgtg

SEQ ID NO: 1694 - DNA, 956 bp, Chenopodium quinoa
tgaaagtcaaaaggtgaggtttgggactttggggatcggttgtcaaattattttttaagaaaggggagtcccgccccgcctgagataaataaacattcccacccttcaccggcgactagaaccttattagggggtcaacaactccggatcaattccagatttcaatcaatatttaaaggagataaatggcttctactttccgtgcttttttgaacagtcctgttggtcctaaaacaactcatttttggggccctgttgccaactggggatttgttgttgctggacttgtggacatgaataaacctcctgaaatgatatctggcaacatgagtgcagcaatgtgcgtttattcaggattattcatgaggtttgcatggatggttcagcctcgtaactacctacttctagcttgtcatgcttcaaatgagactgttcaactataccaattttcccgatgggcaagggctaatgggtacttgtcacaaaagaaagacgaagatacgccatcaaagtgatttattggatttgctgatcttcatttggcgcttttgttgcattaattatgtataagtgattgaatcatacgcttgtacaccaccttatcatacattgaagaaagattatgatcccattttacaaaccttcaactttggcaacagataattgctgctaattcttgaacagtgcagcttttctgacacgtttgatagagttgaaatgttcataaatcataatgttttggtattacccttttgttttttttttttctttttttttttttttttttgttttttttttttttttttgttttttttttttttttgtttttttttttttttttatttttttttttttttcttttttttttttacgtttacgtttagtttactagttatacttattagttgtttgttgtagtggtgagatagcacgagtaggatggtgggggggggggg

SEQ ID NO: 1695 - DNA, 593 bp, Amaranthus tuberculatus
ttacttcttcaattttcatctctccatttcctccattaattggattcacatggcttccaaacttcaagcatttttgaacagtccagttggtcctaaaactactcatttctgggggcctgttgctaattggggatttgttattgctgggcttgtagacatgaataaaccacctgaaatgatatcaggcaacatgactgcagcaatgtgtgtttactcaggactatttatgaggtttgcttggatggtacagcctcgtaactatcttcttttagcatgtcatgcttcaaatgaaactgtacagctataccaactttcgcggtgggcaagggctaatgggtatttatcacagaagaaagaggacggcgtgtctcaatgattccgtctcctgtacattaaagttctcatcttcaaagtctaaaaatttcttgtataagcaagacttttgatgtattttttttgttacttctcttgcaaatggtttgcaatcctgtatgaatggagtcactgaaacattgtctgcaatttggaacattacttttgtacatttgatttgagaggtagcacaccaggtaaccttgttcgatttcattaaa

SEQ ID NO: 1696 - DNA, 550 bp, Ambrosia trifida
atggttggtggctttcaatcaataggctgttagttcaacagttctgttgccatctattcgccggtgacgaagtgttttgataccaagctactatatggcttcatttcgagcatttctgaacagtcccgttggacctaaaaccactcatttttggggtcctgtagctaattggggatttgttgttgcggggctggtggacatgcaaaaacctccagagatgatatctggcaacatgactgcagcgatgtgtgtgtattctggattatttatgaggtttgcgtggatggtgcagcctcgtaactatctacttctagcatgtcatgcctcaaatgaaactgttcaaatgtatcaactttcacgttgggcaaggcatcaagggtatttacagccgaaggaagacaagtctacatcaacttgaaccgaatatgttgttttgttttgctttgcttgtatcgttgaagttcaatgtaattgttgatttaaaaactaagctagcttggcagctgcattaaccaccttgttcccaattgatggttacttgagatgatca

SEQ ID NO: 1697 - DNA, 688 bp, Fagopyrum esculentum
ggacgaagtcacctacccatttcagattttcagggaacgactcttacgactggacttcgcaaagcctcttactccaacgactccattaccgggatctcctgtttctttcgtcttctccgccttcctaatcacaacgttttagacatggcttccaccttcaaagcattcctaaacagtccagtcggccccaaaactactcacttctggggacctattgcaaactggggattcgttgccgctggactggtggacatgaacaaaccacctgaaatgatatcaggaaacatgactacagctatgtgtgtctactcagcattgttcatgcgatttgcatggatggtgcaaccccgtaactatctactccttgcatgccatgcttcaaatgagacagtgcaactttaccaactctcccgttgggcaagggctcacgggtatctggaggagaagaaagaagagaagaaatccgagtaatctcacgtcattgatgcttggtttctgtaggaaacaacatttgtggtcatgatcttttacttacattttcataacgagcttattgctagccatatggcttactaacttaagcaaagtgttatttttgaacgttttttcttctttctttcattctctctacttgcttgtgatgttggtgcttgtaatgctacatgtttagtcacgttcaataaagaaa

SEQ ID NO: 1698 - DNA, 615 bp, Flaveria ramosissima
aataataataatattccattccagaagaggccgtatctgacttgagggtgttagttcaccaatctaatcgccggcgacgaggtgttttaacaacaagataatatatggcttcctttcgagcgtttctgaacagtcctgttgggcctaaaacaactcatttctggggtcctgtagccaactggggatttgttgttgcggggctggtggacatgcagaaacctccagagatgatatctggcaacatgactgcagctatgtgtgtgtattccggattattcatgagatttgcatggatggtgcagcctcgtaactatctacttctagcatgtcacgcctcaaatgaaacggttcaaatgtatcaactttcacgttgggcaaagcatcaagggtatttacagccgaaggaagacaaggccacgtcgacttgaaccatatttattacattcgtgtggtactttcgtctttgttttgtttgtatcttcaaagtttaatgtaactgttgatttgagatgctaaactgcatttaccgcatgatcccaattgatggtgatactgatgacgacgacgatgatgatcatgattgttcgcttgttttgttcaataaagatcattact

SEQ ID NO: 1699 - DNA, 1044 bp, Mimulus guttatus
ccctctcccaaacaaagacttttttaggagctaaaagatctcttctctaatttcagacgaacacactcagaaaaatctccctctgaaaggttattttgacgcaaccatggcttccttcagaacatttttgaacagtcccgttggtcccaaaacaactcacttttggggtccggtagctaactggggattcgttattgctggattggttgacatgcagaaacctccagaattgatctccggaaatatgactgcagcaatgtgcgtgtattcggcgttgttcatgaggtttgcgtggatggttcagcctcgaaactatttgctgcttgcgtgccatgcttcaaatgagacggtgcaactctatcagttctctcgttgggccaaaggtcaagggtacttgacggaaaagaaagacgaggcctcgtctcagtgaacttctttttttcttatttaaaagaacaaggtctccagaggcctagacctcaacaggacccaccagccgaagaagtagataactgtcgaggcttgcaaaaacttgatttgtgggtacatgtgattattttcttaggtcgttatactttgtatttgaggtactatcaaagtctaaagacaagtttaatttggttagatcatggttcattgttgtacctctattctgcagtgaactgatttattttgttagtattggaatagggatggccatggggcgggttttgcattccccgcccccgccccgttaagaaacccgttgcacctgcccccgccccgccccgtaacgggtctaaaatttaccaacctgcaaccgccccgccaaaaaacccgtaaaagttgaagaaaaaggtataaaaaaaaaaaaaaaaaaaaaaaagaacaaactatcagtacataattcattaattaaaaaaaccagtcttcgaccaaatatcaaattcaaattagctaagagataatactaaatcaactatccgataggcgataatattacatccaacaattcaacatactataaataaaaaatattaccaacaatgcatccaacaattcaac

SEQ ID NO: 1700 - DNA, 776 bp, Orobanche aegyptiaca
tgacaattcaggtacatcgaattatctactcatttatggcttccttcaaagcatttttgaacagtccagttggtccaaaaactactcacttttggggtcctgtagctaactggggttttgttatcgcagggctagtggacatgaaaaaacctccagaaatgatatctggcaacatgactgcagcaatgtgcgtgtattctgggttgttcatgaggttcgcttggatggttcaacctcgcaactatctattacttgcatgccatgcttcaaatgagacggtgcaactctatcaactctccagatgggccaaaggccaagggtacttgggggagcagaaagatgaggctttgtctcagtgaaccgattctactttccgttttatgcatgaaaaaataaataaatggaataacgaacatgacgagatgaaaaccacctttccatgtgatttatctttatctcagttttacaattttagttgatgtaatatcaaagagactcggtcgctcggttaggattaattgtgacactggcagttttcaacacggaggaattccttcattgtgttataactagcagcatagtgaacggaaggtgatgattccatcatgacttgcaagttttcaatacaaaatgctcctagtatatagtaatactacatcgataagacatttacagtcgacaatgatctcttcaaccagtataaaaacatcgttggaatttatcatatattgttttctctgaaatgtattgaacgcaatcttcaacctgtatcaaac

SEQ ID NO: 1701 - DNA, 641 bp, Lippia dulcis
ctagcagcaaacgacgacttgcctcatccctttctgtgatacgattcattcacccagaattcttatctaaagggttcctgagttgccgattattctatggcgtctttcaaaacattcttgaatagtcccgttggtccaaaaacaactcacttttggggccctgttgctaactggggctttgtcattgctggactagtagacatgaaaaaacctccagaaatgatttcaggcaacatgaccggagcaatgtgtgtatattctgcattgttcatgaggtttgcttggatggttcagccgcgcaactatctgctacttgcctgccatgcttcaaatgagacggtgcaactctatcaactctcccgctgggccaagggtcaagggtacttgggagagaagaaagccgaggcctctcctcaatgaatagaatgctagtgatactttgtgttctctctagagctgaaatcgcagcttaccatccatccgcaaccagtggaaatggaaaataaaggattgtatatgattcaaaattgttattaccttgagaaactatttctcctcaagactcaaggagactattgtgtatcaaagattccctaatttgttatatttcaaatccagcttagattcctactaaaaaagaa

SEQ ID NO: 1702 - DNA, 618 bp, Primula obconica
tgtcgcagaagataaaaactccagtgtaagatccaaagaatctcttacagagcttctctctcatttgcgaccaacgaagattttgactctctctctatatatctctccggctacagatctcctacaacgattattgagtaacaaatggcttcttttcgagcattcttgaacagtccagttggccctaaaactacgcacttttggggtcccgttgcaaactggggatttgttctagcgggcttagtggacatgaagaaaccaccggagatgatatccggaaacatgtctgcagcgatgtgtgtgtattctgcattgttcatgaggtttgcatggatggtacaaccgcgtaactatcttctcttagtttgccatgcctcaaatgagacggtgcagctttatcagttttctcgttgggcaagggctaatggctacttggggcagaagaaggatgaagccgtcaccgagtgacttggcgctgttttctcatttttattcttctccaagcgataatttttttaagccgattaagctcaaagcattctatcagggtgaaattattgaacattctgtatgcaagattaaaccaattgtgttactattaatcaagtcttggttgct

SEQ ID NO: 1703 - DNA, 650 bp, Senecio madagascariensis
aagcagtggtatcaacgcagagtacgcggggtgctcccgaccaaaaatcagttgaaattctccagccatcaagtcgccggggcaggtactttaataacagcaagagagtatatggcttcctttcgagcatttctgaacagtcctgttggccctaaaactactcatttctggggtcctgtagccaactggggatttgttgctgcggggctggtggacatgcaaaaacctccagagatgatatctgggaacatgactgcagcgatgtgtgtttactctgcgttatttatgaggtttgcgtggatggtgcagcctcgtaactatctacttctagcttgtcatgcctcaaatgaaacggttcaaatgtatcaactttcacgctgggcaaaaagtcaagggtatttggagaagaaggaagacaaggctccgtcaacttaaatcacatctgttatctttatccttacctcgacttctatcattgtgtggtaattttggttttcttgttgattgttgttctttaaagcttaatgtaattgttgaatcaaaactaagctagtttggcagccacattcgacatcttgatccccgttaacggggataccgataatgattccaatttgttttgttcaataaaaatcaatattttttttttc

SEQ ID NO: 1704 - DNA, 531 bp, Fagus grandifolia
tctctctcgcccaatcgccgatctgtccagtttctctgccgatttttgaggaaatggcctcgttccgagcattcttgaacagtccggttggtccgaaaacgactcacttttggggacctgttgctaattggggtttcgttgctgctgggttggcggatataaacaaacctccagaaatgatttcaggaaacatgacagcagcaatgtgtgtctactcggcattgttcatgagatttgcatggatggtacagcctcgtaattatcttcttctggcatgccatgtctcgaatgagactgttcaactctatcaactatctcgatgggcaaagggccaggggtacttgtcagagaagaaagcgaatctacatctcagtaacttgatgctgccattctttttcctgcctgttctactgtcttttgttgtggtttctgctgaaatcatacgaatgtcatgttggactcatttgaagcaatttgcttttgcacttatgccagtgtaagcatagctgagcagatgactgtcagtgaatc

SEQ ID NO: 1705 - DNA, 699 bp, Chenopodium quinoa
tgtcaaattatttttaagaaagggcaatcccgccccgccggaaaagctgagataaataacactccacccttcaccggcgactagaaacttattaggggatcaacaactccagatcaattccagatttcattcaatatttaaaggatataaatggcttctactttccgtgctttcttgaacagtcctgtgggtcctaaaacaactcatttttggggccctgttgccaactggggatttgttgttgctggacttgtggacatgaataaacctcctgaaatgatatctggcaacatgagtgcagcaatgtgcgtttattcaggattattcatgaggtttgcatggatggttcagcctcgtaactacctacttctagcttgtcatgcttcaaatgagactgttcaactataccaattttcccgatgggcaagggctaagtgggtacttgtcaacaaaagaagacgaagatacgccatcaaagtgatttatcggatttgctgatcttcatttggcacttttgttgcattatgtataagtgactgaatcatacgtttgtacaccaccttatcacacattgaagaaagattatgctcacaattcacaaattttcaactttggcaacacatacttgctgtttactcttgaaccgtgcagcttttctaacatatatgtttgatatatttgaaattttcagaatgtttt

SEQ ID NO: 1706 - DNA, 791 bp, Cleome gynandra
tcggggtatggatagagattcgaagatttgataccgcaatttcaaatatttcttctttcgtccgtctcttttgcggttacaccttatcggtttctccatcgccgccgggaatcgacctcgctcgcgttgacccaccgccgatcttcttcgattcccggagaaacatctcggataagtggtcagtgataagaaatggcatcaagattccaagcattcttgaacagtccagttggccctaaaacgactcatttttgggggcctgttgctaattggggttttgttgctgctggtttggtggacatgaacaaaccccctgaaatgatttctggaaacatgacatcagcaatgtgcatttactcagcattgttcatgagatttgcatggatggtacaaccacgcaactatttacttctcggttgccatgcttccaacgaagctgtacagctctatcagctctctcgttgggccagggttcaagggtacttgtcctccgagaaggaagaagagaagccctcccaataagttatttgtttgtgttccaatcattccctaaacatgcacattgcgaattcgaagaatgttttctatgtttatgataggtacttgtcttccgagatggaagaagtgaagccctcccaataagttatttgtttgtgttgcaatcattccctaaacatgctcatggcgaattcaaaaaatgctgtcttcttctatgtttgtgttgcttgtgataggcacttgtcttctgatgcgttcaaaatcgagtttaattcataaaccgttctatcatg

SEQ ID NO: 1707 - DNA, 605 bp, Euphorbia peplus
gacccgacccgactataacccggcgacttgaacttctccagcgatctccggccagaggtattcaatatggcttcattcagagcattcttgaacagtccaatgggtcctaaaacaactcatttctggggtcctgttgccaattgggggtttgtcgctgctggcctggtggacatgaaaaaacccccagaaatgatctccggaaacatgactggagcaatgtgtatttattcactattgttcatgaggtttgcatggatggtacaacctcgcaactacctacttctagcatgtcatgcttcaaatgagagtgtgcaactctatcaactctctcgttgggctagagctcaagggtacttgtcatccgataagaaagagaaagcctcatcagagtaaaatccaatgtttcttgtgctgctctgcttacctggaatacttattttgatgtttgagagaaatatgatgctggatttgtctttaaacatacttgattgattgtactaccaaaatttcaaggagcagattgtgaagtggatctttttcatcatgtaatgcacagttcttctgtaatggtgtatgaataaattaatgttgccagagttattctc

SEQ ID NO: 1708 - DNA, 464 bp, Heritiera littoralis
ttcctcctactttctctcccaccaaacatttccatcttccactctttcttgtgccagcgccctcatcagaatcgcccatcgtctttgacttcgccggagacattcttttaggaattacgaagggctactttcagcagcatttttaacagatggcttctaccttccgtgcattcctgaacagtccagttggtccaaaaacaactcacttttgggggccagttgccaattggggatttgttattgctggattggtggacatgaagaagcccccagaaatgatttctggcaacatgacaacagcaatgtgtatctattccgcattattcatgaggtttgcatggatggtgcagccacgaaactatctactgctggcatgccgtgcttcgaatgagtcagtacagctataccaactttccgttgggctagagcacaggggtatttgtctggaaagaaagaggaagcct

SEQ ID NO: 1709 - DNA, 766 bp, Carpinus betulus
agcttctactttcctcaccaagcatttctttgagtctctctccgtgtagcaaaatcgtcgatcgtcttcagagctattcaagcaaggatcggtcgtaaatggcttctttccgggcattcttgaacagtccggtcggtccgaaaactactcacttttggggacctgttgctaattggggatttgttgctgcggggttggcagacatgaataaacccccgaactgatttcgggcaacatgacagcagcaatgtgtgtctactcagcgttgttcatgagatttgcatggatggtacagcctcgcaattatctacttctggcatgccatgtctcgaatgagactgtgcaactctatcaactctcgcgatgggcaaagggtcaggggtacttgtcagagaagaaaaaggaatctgaacctcagtaactttaatgctgccatcttttccacccgttctagtgttttggattatggtttctgcagaaatcattcttcatctcatatgagactcattcggagcgatttgcatttgctcttacagccgtaagcataactgagcagatcactgttaagtgaatcttgttccctgtcatctttgtttgtatgttttcataactatgcgtggaaactgatgaaactatagagctccaaattcgtaattgatgatgctgaaatcaagttatcaaatatgtgttttatggttttcatgttagactaaataacttattctagattcaatgacatacaaaagcactagttagaataaagtaa

SEQ ID NO: 1710 - DNA, 927 bp, Prunus persica
atgggcctgtttggtgggcttgaattggattcgagcccacaccgagccttctccctccaatccagtcttcatcatatcaccccgataaaactaggttcttcaccaatcacttccggcgaacttgagctgtttccagcgaacctcacccatctctggctcaaaccatgtcatctccgatctcctatttcttttctggacttcttcgtcataagtgattcttctgtggtcggtgtctccttcgtcccctgtgcttctccttcatcgtcttcgccgattaagatcttgcgttttgtttcgattgccatagattctaagcggcagttatcaaatatggcgttccgagcattcttgaacagtccagttggtccaaaaacaactcacttttggggacctgtggcaaactggggcttcgttgccgctggattggcggatatgaacaaacctccagaaatgatttctggcaacatgacagcagcaatgtgcgtttattctgcattgtttatgagattcgcatggatggtacaacctcgcaactatctacttttggcatgccatgtctcaaatgagactgtccaactctatcaactctctcgctgggcaaggggtcaggggtactttacccagaagaaggatgaaccggagtcccagtagcttgctgcttctttcattcccttcctggttcattgccaaaaacagaagatactgccacaaccacctgcactccatgttcttgaagaaccagtagaagcaacttcagcggttggcttattcatttcgaaggatctcatgcttgcatttccttttgttgtatacgtaagcaaagtgcaagacccaacagtagacaataattgaaaaaagatccataactgtatgcactgagggaacaatacccctgattttaaataaataaaaacttctggaagaaat

SEQ ID NO: 1711 - DNA, 600 bp, Castanea mollissima
cagggtttggtcatacatggcttcgttccgagcattcttgaacagtccggttggtccgaaaacaactcacttttggggacctgttgctaattggggtttcgtcgctgctgggttggcagatatgaataaacctccagaattgatttccggcaacatgacaggagctatgtgtatctactcggcacttttcatgagatttgcatggatggtacagcctcgcaactatctacttctagcatgccatgtctcaaatgagaccgttcagctctatcaactctcacgatgggcaaagggccaagggtacttgtcacagaagaaagaggaatctacatctcagtaatttgatgctgcaatctttttctcccccgctttgctttctgtttgtagtgttatttgatgcaatatactcttgtgcttgtactgctattgtagcatagctgagcagttgactgttcagtaaatcatgtcttttttatctttatttgtactgatgcttttcgtaattaaaatgtggaagttgacaaacctcataagagtaagagctccaaatttgtaattggtgatgcagcaatcatgttattcaaataaatgttagattga

SEQ ID NO: 1712 - DNA, 710 bp, Chrysanthemum coronarium
ccaccgtcctgctgtcttaatcgaccaacacccaatcaatcatattcaaagtaaggtgtcttttttccgaccagagaatcttcaacattccggcgccgaggtgttatttactacaagacaatatatatggctaccttccgagcattcctgaacagtcctgttgggcctaagactactcatttctggggtccaatagcaaattggggatttgtcgctgcgggtcttgtggacatgcaaaaaccgccagagatgatatctggcaacatgactggagctatgtgtgtgtattctgccttattcatgaggtttgcgtggatggtgcagccacgtaactatttacttctagcatgccatgcctcaaatgaaacggttcagttgtatcagttatcacgttgggcaaagagtcaagggtatttgcagcagaaggaagacaaggctccatcagcttgaaccacgtcttctgttttcatccttttctggactcgatatttgtgtggtaattttggttttcttgttctttgaatatcaatgtaattgttatactataactactcacaatctcctcaatcctcttgatggtgataatgatgaaatcatttgttccatgggatatgttttcaataaaatcgatgtttctcgatttaccatcatcatgtaaccataacaaaaggtttgtaaagcctaaaatatccgagtttaatagtcaccta

SEQ ID NO: 1713 - DNA, 724 bp, Cichorium intybus
gcggggatacatatatatattaggtagaaccgttgaagaaaacttgcaaatgctccacccaatcatattccagagctggtagtcctccccagagggtgttggcttttctgtcattagttgacggcgacgatttttttaaaccagcaagataaaatatggctgcttttcgagcattcctaaacagtcccgttgggcctaaaactactcatttctggggccctgtagctaattggggattcgttgccgcggggttggtggacatgcagaaacctccagagatgatatctggcaacatgactgcagcgatgtgtgtgtactctgcattattcatgaggttttcatggatggtgcaacctcgtaactatctacttttagcatgtcatgcctctaatgaaaccgttcaactctatcaactttcacgttgggcaaaaagtcaagggtatttgcagcagaaggaagacaaggcctcatcaacttgaacttttaactgttgtctttatctttccatggactcttatctttgtgtggtaatttggttttaattttgctttgcttatttgaagctcattgtaattgataaatcaaaaattaagttttttctgacaattgtatccttgttcttgatatccatcaatggtgatattgatgaggatttgatcattgttgttgctgcttttttcttttagacctttattttgttctttggaatttgattgaataaaaa

SEQ ID NO: 1714 - DNA, 694 bp, Vaccinium corymbosum
ctaccaccagacgacgcctagctctctctagaagacggatcttcacgccgaaacgcagagatattattaaattgtagttctcctcaatggcttccttccgagcattcttgaatagtccagttgggcccaaaacaactcatttctggggtcccgttgctaattggggattcgtgcttgctgggctggtggacatgaagaaaccccctgaaatgatttctggcaacatgactggagctatgtgtatatattcggcattattcatgaggtttgcatggatggtacagcctcggaactatctacttctagcttgtcatgcctcaaatgagacggtgcagctctatcaattctctcgttgggcaaaggcaaacgggtacttgggggcaaagaaggaagaagctgcatctgagtaatgggtgctggttttcttcgtttgacttggtgattttatggtggttcctgcagaaacaactcatcgattggaattcattattcgattagggtactagcggaactaagcaaatcactttaagtcggtctttgtttcggctgtttgctgtttgtatttcgcgttttttcgcacgaatattccccaataatccattgtaagaaacttaagctttgacgtcagaaaattcatgccctgtggttaatcaatcttcttttgctacgtctggtttctatgtactattatttt

SEQ ID NO: 1715 - DNA, 647 bp, Cichorium intybus
atatatattaggtagaaccgttgaagaaaacttgcaaatgctacacccaatcatattccagagctggtagtcctccccagagggtgttggcttttctgtcattagttgacggcgacgatttttttaaacccgcaaaataacatatggctgcctttcgagcattcctaaacagtcccgttgggcctaaaactactcatttctggggtcctgtagccaattggggattcgttgccgcggggttggtggacatgcagaaacctccagagatgatatctggtaacatgactgcagcgatgtgtgtgtactctgcattattcatgaggttttcatggatggtgcaacctcgtaactatctacttttagcatgtcatgcctctaatgaaaccgttcaactctatcaactttcacgttgggcaaaaagtcaagggtatttgcagcagaaggaagacaaggcctcatcaacttgaacttttaactgttgtctttatctttccatggactgttatctttgtgtggtaatttggttttaattttgctttgcttatttgaagctcattgtaattgataaatcaaaaattaagttttttctgacaattgtatccttgttcttgattccatcaatggtgatattgatgaggatttgatca

SEQ ID NO: 1716 - DNA, 634 bp, Cichorium intybus
gcggggatctatatatattaggtagaaccgttgaagaaaacttgcaaatgctacacccaatcatattccagagctggtagtcctccccagagggtgttggcttttctgtcattagttgacggcgacgatttttttaaacccgcaaaataacatatggctgcctttcgagcattcctaaacagtcccgttgggcctaaaactactcatttctggggtcctgtagccaattggggattcgttgccgcggggttggtggacatgcagaaacctccagagatgatatctggtaacatgactgcagcgatgtgtgtgtactctgcattattcatgaggttttcatggatggtgcaacctcgtaactatctacttttagcatgtcatgcctctaatgaaaccgttcaactctatcaactttcacgttgggcaaaaagtcaagggtatttgcagcagaaggaagacaaggcctcatcaacttgaacttttaactgttgtctttatctttccatggactgttatctttgtgtggtaatttggttttaattttgctttgcttatttgaagctcattgtaattgataaatcaaaaattaagctttttctgacaattgtaccttgttcttgattcccaccaatgg

SEQ ID NO: 1717 - DNA, 632 bp, Flaveria ramosissima
gtggtcacccaataataataatattcgataggaggcagtatatgactgtagggtgttagttcaccggtcttcctcacatctaatcgccggcgacgaggaattttaataacaagataatatatggcttcctttcgagcgtttctgaacagtcctgttgggcctaaaaccactcatttttggggtcctgtagccaactggggatttgttgttgcggggctggtggacatgcagaaacctccagagatgatatctggcaacatgactgcagctatgtgtgtgtattccggattattcatgaggtttgcatggatggtgcagcctcgtaactatctacttctagcatgtcacgcctcaaatgaaacggttcaaatgtatcaactttcacgttgggcaaagcatcaagggtatttacagccgaaggaagacaaggccgcatcgacttgaaccaaatctattacattcgtgtggtacttttgtctttgttttgtttgtatcttcaaagtttaatgttattgttgatttgaaatgctaaactgcatttaccacatgatcccgattgatggtgatactgatgatgatgacgacgatgattgtttgcgtgttttgttcaataaagatcactacttcacaat

SEQ ID NO: 1718 - DNA, 536 bp, Flaveria ramosissima
attccacaagaggcagtatctgacttgagggtgttagttcaccaatctaatcgccggcgacgaagtgttttaataacaagataatttatggcttcctttcgagcgtttctgaacagtcctgttgggcctaaaaccactcatttttggggtcctgtagccaactggggatttgttgttgcggggctggtggacatgcagaaacctccagagatgatatctggcaacatgactgcagctatgtgtgtgtattccggattattcatgaggtttgcatggatggtgcagcctcgtaactatctacttctagcatgtcacgcctccaatgaaacggttcaaatgtatcaactttcacgttgggcaaagcatcaagggtatttacagccaaaggaagacaaggccgcatcgaattgaaccaaatctattatatacgtgtggtacttttgtctttgttttgttttgtttgtatcttcaaagtttaatgttgttgttgatttgaaatgctaaactgcatttaccacatgatcccaattgatggt

SEQ ID NO: 1719 - DNA, 445 bp, Flaveria ramosissima
tatgactgtagggtgttagttcaccggtcttcctcacatctaatcgccggcgacgaggaattttaataacaagataatatatggcttcctttcgagcgtttctgaacagtcctgttgggcctaaaaccactcatttctggggtcctgtagccaactggggatttgttgttgcggggctggtggacatgcagaaacctccagagatgatatctggcaacatgactgcagctatgtgtgtgtattccggattattcatgaggtttgcatggatggtgcagcctcgtaactatctacttctagcatgtcacgcctcaaatgaaacggttcaaatgtatcaactttcacgttgggcaaagcatcaagggtatttacagccgaaggaagacaaggccgcatcgacttgaaccaactttattacattggtgtggtactttcgtctttgttt

SEQ ID NO: 1720 - DNA, 680 bp, Gerbera hybrid cultivar
ggccgtctcgagttcttctgccatctaatcaccggcgacgaggttcttattacaacaaaagagcacatggcttcctttcgagcattcctgaacagtcctgttgggccaaaaacttctcatttctggggtcctgtggccaactggggattcgttattgcggggctggtggacatgcagaaacctccagagatgatatctggcaacatgactggagctatgtgtgtatattctgcattgttcatgaggtttgcgtggatggtgcagcctcgtaactatctacttcttgcttgtcatgcctcaaatgaaacggtccagctttatcagttttcacgttgggcaaagagtcaaggatatttgcagcagaaggaagacaaggccccatcaacttaactctacatttgtgtggtaattttcattttagcatttgattgctctctttgaaagcctaattaaccttccatttctcaaaacaaagttatctttgcaacttcgttaagcagatcttgattaccgatgataatttgatcattactatcactttttcttttgtacatttatgttgtttggtgtttaagttgataattagttgttttcttgtttgtttattgtaatattcacttgggatcgtttcgattaatttcttggggctcaaatgctcaattaaaaaaaaaaaaaaaaaa

SEQ ID NO: 1721 - DNA, 596 bp, Glycyrrhiza uralensis
ggctgtccaaaagttccaaaggaatgaataataaagcccctttccgtggctgcttcgcttcacttcacttcacccctctctctgtctcagtctcagatttggtttcccatcagtcgttgcctctctctctcttcccaaaatcaacggcggcgattctctcagctgccacctacccacctaccttacccttctctctctctctctctctctctccagttccactttcagaagtagcagcggtgtcatatggcttcttccttcagagcattttggaacagtccagtaggtcctaaaacaagtcacttttggggacctgttgccaactggggattcgtggcagctgggttggctgacatgaacaaacctccagaaatgatctctggcaacatgacaggagcgatgtgtgtctattcagcattgttcatgagatttgcatggatggtacagccacgcaactacctacttcttgcatgccatgcttcaaatgagactgttcaactctatcaattctcccgatgggcaaaggcagaggggtttctctctgggaagaaggaggaagcttcagctcagtgacttgattctagaacttccctgaa

SEQ ID NO: 1722 - DNA, 2190 bp, Lupinus angustifolius
attattaaacgattagttaagattcaacaccctcttgttatttttatattatcatattttatatataatctccacaacttaattttttgtactttcttttcaccaaactcgaattcagaccacgcttctcttcggcgattctctcctccaccaccaccaccaccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccctagatctgtttatatcattccgcgctactatgttgttttaccagaattatatatttttataatcaaatttattcattgcttgcagcgttattctatcactgataattactcttttgtaagcaattactgaaatgttcttttctttaattttaaaacaatggaattgattgcagcacttttttgttttctttccaagtaatagataatagatttcagctttgttatgtgttaaatgtgtttcaagaaaatttgggcaattggctttgcacagtgaaaacagttttctttcatgtgatttcaatgaaatgtaaacaaaagaaaggaaaggaaaaattcattccttttatattgtcgtcgataagatcttgatagtttttagtcatattgcacacactttttagttttctttgtaccttccctaacagtcggaagctgaatctgttagggaaggtacaaaagtttgttgtaggtgttcgttcaatccattctctcatttggaaaagtgtgtcttgttttttttctcactatggatttttgatatcttcatttgtttctttaattctgtgatcattcttgaatgagttcctcattatagttgtgactataaattgttttccttcttttctttttgggatagactggctagtaataagtatacccttaagattataatcaacataaaggaaaaccgatcaacatttggcaccaccacaccactaatatctaaagctcgttaaaagaaggcaagtacaagattaagtgtgttgatactaatcaatagcatattgaaagtgactatagtcatagaactagcttagacatcaagacaaaagtctcctagttgggatcgctgagacactgaacaatattcttacatccctggtgagtggaatagtataaagatgcagagggatgttgttcactatgtaaaaagacttgtgctaatgtgttcttttgtatttttttcaaaccactttgctttctagtggtacaattcactatttgcctatttggtttttgaactaattcaaatcattgcctttacttctatacatatgatatgatatttttgctctgttgagctcatttaaccattttctaatggcagtcagtactagcactggtatcatatggcttcgttcagagcattcttgaacagtccggttggtcctaaaacaactcacttctggggacctgttgccaactggggatttgtagcagctggattggctgacatgcaaaaacctccagaaatgatctctggcaacatgacaggagcgatgtgtgtctattcagcattgttcatgagatttgcatggatggtaaagccacgcaactatctacttcttgcgtgccatgtctcgaatgagggtgttcaactctatcaactctcccgatgggccaaggcacaggggtatctctcagagaagaaggaagaagcctcatcctaatcccagtgactcgatgctaacattttccttaatgggggctccttgaaaagaattgccgtggaacttgccaatttatgaataattgatccaaacttgtggaaaatgtataagattgtttattttttatttggatttgagattgattgaaacaaaagtttttggaacataaacaaacggtttgagttatatatatcttatgttgaaattcaatttaatcataacgaatggagcatgcatgccccctaactcagg

SEQ ID NO: 1723 - DNA, 705 bp, Zea mays
ccttctaactgcaactgctgctcctctttgtctcccccgttccgttctccactgaactcctcgccctcgtcgacccgtgacccgtgagcctcttccactgccgccgtcgacgagagctgcgttagccgctagggacaggtgatttcggctgcttccctcatggcgaccgcgctcaagtcgttcttgaacagccccgttggccccaagaccacccacttctggggccctgttgccaactggggcttcgtcgtcgcgggcttggttgacatgaacaagcctcctgaaatgatatctggcaacatgacagcagccatgtgcgtgtattctggactgttcatgaggtttgcatggatggtacagccccggaattatttgcttctagcatgccatgcttccaacgagagtgttcagctctatcagctgtctcgctgggctagggctcaggggtacctggagaagaaagagccagagacacaacagtaaagagggtatgcaacactgcagtgacttgttcctttagtgaccatgcagtatgccgaggagatttcatatacctagcgccgttacaagcttctgcttgcttacttttctgtgcatttggttttacaatgcgttatgcaatgagtttcccccaaatacgcaatgagtttgggcactattttcgttttacctggctcatgtgcccatagtgctttgtaaaagacc

SEQ ID NO: 1724 - DNA, 689 bp, Quercus alba
gtttcgttttaccttaataaccaaactctctctgtctctctgtacccaatcgccgatctcactaccttccccggcgatttctcagggtttggtcatacatggcttcgttccgagcattcttgaacagtccggttggtccaaaaacaactcacttttggggacctgttgctaattggggtttcgtcgctgctgggttggcggatataaataaacctccagaaatgatttctggcaacatgacaggagcgatgtgtatctattcggcactgttcatgagatttgcatggatggtacagcctcgcaactatctacttctagcatgccatgtctcaaatgagaccgttcaactctatcaactctcacgatgggcaaagggccaagggtacttgtcacagaagaaagaggaatctacatctcagtaatttgatgctgccatctttttctcccccgctttgctttctgtttgtagtattatttgatgcaatatactcttgcgcttgtactgctattgtagcatggctgagcagttgactgttcagtaaatcatgcctttttttatctttatttgtactgatgtttttcgtaattaaaatgtggaagttgacaaacctcataagagtaagagctccaaatttgtaattggtgatgcagcaatcatgttattcaaataaatgttagattgatttcca

SEQ ID NO: 1725 - DNA, 570 bp, Parthenium argentatum
ctgccatctagtcgccggtgacgaggtctgttaataacaagataatatatggcttcctttcgagcatttctaaacagtcctgttgggcctaaaacaactcatttctggggtcctgtagccaactggggatttgttgttgcgggtttggtggacatgcagaaacctccagagatgatatctggcaacatgactgcagcgatgtgtgtgtattctggtttgttcatgaggtttgcgtggatggtgcagcctcgtaactatttacttctagcatgtcacgcctcaaatgaaacagttcaaatgtatcaactttcgcgttgggcaaaatatcaagggtatttacagccgaaggaagacaagactacatcaacttgaaccgaatatgttgtttttgttttcggttttgtttgtatctttgaagtttactgtaattgttgatttgaaaaactaagccagcttggctgccgcattaaccaccttgatcccagttgatggtgatactgatgatcatcatcaatgaggtgttttgttcaataaaaaaaatatgtcatgatttaatcgttaaaaaaaaaa

SEQ ID NO: 1726 - DNA, 1167 bp, Prunus mume
cgttttagaattagggttaggggtgggagtaggtaccgtctacatctgagttttcaggccagtgagagcatttcttagctgagttttcaggagcaagtttcgttataggcagatcggtggcaaattcacttctaatcgtcatgggcctgtttggtgggcttgaattggattcgagcccacaccgagccttctcctccaatccaatcttcatcatatcaccccgataaaactaggttcttcaccagtcacctccggcgaacttgagctgtttccagcgaacctcacccatctctggctcaaaccacgtcatctccgatctcttatttcttttctggacttcttcgtcataagtgattcttctgtggtcggtgtctccttcgtcccctgtgcttctccttcatcgtcttcgccgattaagatcttgcgttttgtttcgattgccatagattctgagcggcagttatcaaatatggcatcgttccgagcattcttgaacagtccagttggtccaaaaacaactcacttttggggacctgttgcgaactggggcttcgttgccgctggattggcggatatgaacaaacctccagaaatgatttctggcaacatgacagcagcaatgtgcgtttattctgcattgtttatgagattcgcatggatggtacagcctcgcaactatctacttttggcatgccatgtctcaaatgagactgtccaactctatcaactctctcgctgggcaaggggtcaggggtactttacccagaagaaggatgaaccggcgtccgagtagcttgctgcttctttcattcccttcctggttcattgccgaaaacagacgatactgccatcaccacctacactccatgttcttgaagaaccaggaagcaacttcggcggctggtttattcacttcgaaggatctcatgcttgcatttccttttgttgtacacgtaagcaaagtgcaagacccaatagtagacaataattgaaaaaagatccgtaactgtatgcactgagggaacaatacccctgattttaaataaataaaaacttatggaagaaatcagtgactgtgacataagaatatagcaaaattggagacatctctcaaaacgttaaactactaatttatttattttaataataatgtttcttcaaccactc

SEQ ID NO: 1727 - DNA, 643 bp, Carthamus tinctorius
cggggaatatattcccagagtaggtggtttccgaccagcaagacgccgagttcttctgccgtctaatctccggcgacgaggtgctttcaacagcaaaataatttatggcttcctttcgagcattcttgaacagtcctgttgggcctaaaacttctcatttctggggccctgttgccaactggggatttgttgttgcggggctggtggatatgcagaaacctccggagatgatatcaggcaacatgactggagcgatgtgtgtgtattctgcattatttatgaggtttgcgtggatggtgcagcctcgtaactatctacttctagcatgtcatgcctcaaatgaaacggttcagctctatcaattttcacgttgggcaaaaagccaagggtatttgcagaagggagataaggctccatcaacttgaagtgcaaccttggactctttctttgtgtggtatttttgttttagtttctttgaagcttttgatataatcattgaatttaaactaagctctgaattcaccatcttgatcatcgatggcgatgctgacaccgatttgatcattgatgtttttacttttttactctttttattttgttattcggtatttgattcaataaaaatccgacatgtttttgcaaa

SEQ ID NO: 1728 - DNA, 893 bp, Saccharum officinarum
aggattatgcaacaatttcggaaaaaaaatcttcaaatttgaactagaactagtatgtagctctctccaccgttggatgcgatgataccgccgggtccaccactatttaatttaaatccccattctccaactgcaactggacgattggtcctcttcttcaccaattcctctgtttctccccgttctccaccaaactcctcgccctcgtcgacttgtgagtctctcccgccgccgccgccgccgccgtcgccgtcgacgagagctgcgctaggtgatttcggctgcttccccttcccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctgggaatatgacagcagccatgtgtgtgtactctgcactctttatgaggtttgcatggatggtacagccccgaaattatttgcttctagcatgccatgcttccaacgaaagcgttcagctctatcagttatctcgctgggctagggctcaggggtacctagagaagaaagaggcagaggcccaacagtgaagagggtatgcaacactgcagtcacttgttcaataaggaaaatgtgctgtggaaaacattcattctgttagaatttgttggtgaagtggtggcgtggtgccgagaatgttccttcagtgaccatgcagtttctgtatgttgcaaaatatgctgaggaaatttctgtgatacctatggccggtacaagtttatcttctggttactttgctgcgcatttggcaaggcacatatggctttatattgtgtttgcaatgaattccaccaaacatgc

SEQ ID NO: 1729 - DNA, 628 bp, Triphysaria pusilla
agaagtcaataacgaattttttttgctgcggcttcagcttcacaatcaacgcacagtgagaaaaaaatccgttcaaggctcgtttgtttgctgagtcatcaatggcttcttccttcaaagcattcttgaacagtcctgtcggacctaaaacaactcatttttggggccctgtagctaactggggatttgtcattgctggactggtggacatgcagaaacctccggaaatgatatccggcaacatgactgcagcaatgtgcgtatattctgcgttattcatgaggtttgcatggatggttcagccccgtaactatctgttacttgcttgtcacgcttcgaatgagtcggtgcaactctatcaattctcccgctgggccaagggccaagggtacttgggagataagaaagaagagtccacatctcagtgagccggtgaattcttttactttttttttccgttgcttgaaaacaatgtccctatgactcaccatggcttacagaaactttgagttgtgggttcatgtaatcataataatttctcgtgttatttataactcatttatgtttgatgtatctttaatacctgaagacagcatacgttggttatatagatcatcgttgcctgagt

SEQ ID NO: 1730 - DNA, 803 bp, Triphysaria pusilla
actctcgactgcgtctctttattgggactaaatacaattttaccgaccaccaaacaactgacctcgaactttgaagcaaaaggaatctctttgcttggtagtttcagaatcagcgcactgtcagaaaaatctccgctcaaggctcgttcgtttgctgactcattaatggcatctcccttcaaagcattcttgaacagtcctgtcggacccaaaacaactcatttttggggccctgtagctaactggggatttgtcattgccggactggtggacatgcagaaacctccggaaatgatatccggcaacatgactgcagcaatgtgcgtatattctgcattattcatgaggtttgcatggatggttcagcctcgtaactatctgttacttgcgtgtcatgcttcgaatgagtcggttcaactctaccaattctcccgctgggccaggggccaagggtacttgggggataagaaagaagagcccacatctcagtgagccggtgctgctatttttcttttccgtttctatttcttacttgaaaacgaggcccctgtgtctcaccaaaggttacttaaactttgagttgtgggttcatgcatgtgatcatcataatttctcaggttattattaactcatttatgtttggtatatctctaagacccgaagaaaacttaatttgattatagatcgtgtttattgttgtttttaatgaactgattctttcactgtgacatcaaacgtacggggaacataataaaaacttgtgtgatttggaaggatttggtttatctagtactttaccattt

SEQ ID NO: 1731 - DNA, 617 bp, Triphysaria pusilla
atttctttgctgcggcttcagcttcacaatcaacgcacactgagaaagaaacaatctcctcttaaggctcgtttgtttgctgagtcatcaatggcttcttccttcaaagcattcttgaacagtcctgtcggacctaaaacaactcatttttggggccctgtagctaactggggatttgtcattgctggactggtggacatgcaaaaacctccggaaatgatatccggcaacatgactgcagcaatgtgcgtatattccgctttattcatgaggtttgcatggatggttcagccccgtaactatctgttacttgcgtgtcacgcttcgaatgagtcggttcaactctatcaattctcccgctgggccaagggccaagggtacttgggaaataagaaggaagagtctacatctcagtgagccggtgaatccttttactttttttttccgttgcttgaaaacaatgtccctatgactcaccatggcttacagaaactttgagttgtgggttcatgtaatcataataatttctcgtgttatttgtaactcatttatgtttgatgtatctttaatacctgaagacagcatacgttggttatatagatcaatgttgcctgagt

SEQ ID NO: 1732 - DNA, 616 bp, Triphysaria pusilla
ccaaattgggtctctttttggcctaaattaaagtttagaagtcaataacgaatttctttgctgcggcttcagcttcacaatcaacgcacagtgagaaaaaaaatccgttcaaggctcgtttgtttgctgacacatcaatggcttcttccttcaaagcattcttgaacagtcctgtcggacccaaaacaactcatttttggggtcctgtagctaattggggatttgtcattgccggactggtggacatgcagaaaccaccggaaatgatatccggcaacatgactgcagcaatgtgcgtatattctgcgttattcatgagatttgcatggatggttcagccccgtaactatctgttacttgcttgtcatgcttcgaatgagtcggtgcaactctatcaattctcccgctgggccaagggccaagggtacttgggagataagaaggaagagtctacatctcagtgagccggttcctgtgactcaccaaggcatacggaaactttgagttgtgggttcatgtaatcataataatttctcgtgttatttataactcatttatgtttgatgtatctttaatacgtgaagacagcatacgttggttatatagatcatcgttg

SEQ ID NO: 1733 - DNA, 538 bp, Valeriana officinalis
tacggcagtcacagatttgcgaaacctttaagagctcttgcgtgcgtctatcttcttctctgatacttcagtgagtaatacagcggtgtttcaaatggcttctttcagagcgtttttgaacagcccagtgggacccaaaacaacacatttttggggtcctgtagctaactggggattcgtcgctgctggactagttgacatgcaaaagccaccagagttgatatctggcaacatgactggagcaatgtgcgtatattcagcactattcatgaggtttgcttggatggtacagcctcgtaactatctacttctggcttgccatgcctcaaacgagactgtgcagctctatcaactctcgcgctgggcaagagctcacgggttcttggagaagaaggaagaaaaggccgagtctaaatgagttgtttcatcttcaacattattgaatttctgtaacatttgtagactataattatcatttgcctttgttcaactaaagctgtaagctacgtattttcatggtttaataatattcaacttg

SEQ ID NO: 1734 - DNA, 625 bp, Valeriana officinalis
tatagcgatcggattcgctcttccttttcgcctacggcagtcacagatttgcgaaacctttaagagctcttgcgtgcgtctatcttcttctctgatacttcggtgattaatacagcggcatcataaatggcttctttcagagcgtttttgaacagtccggtgggacccaaaacaacacatttctggggtcctgtagccaactggggattcgtcgctgctggactagttgacatgcaaaagccaccagagttgatatctggcaacatgactggagcaatgtgcgtatattctgcactattcatgaggtttgcttggatggtacagcctcgtaactatctacttctggcttgccatgcctcaaacgagactgtgcagctctatcaactctcgcgctgggcaagagctcacgggttcttggagaagaaggaagaaaaggccgagtctaaatgagttgtttcatcttcaacattattgaatttctgtaacatttgcagactataattatcatttgcctttgttcaaccaaagctgtaagctacgtattttcgttgtttaataatattcaacttgttcatctacttaatgttctggtctttgattaccagtcttgaatgcgataacaagt

SEQ ID NO: 1735 - DNA, 642 bp, Vinca minor
ttctcctactccatctaccgaaaccactcctcctcatctctttcgccggcgccaccaatccctcagttccctgaagtcggaacaaaaaaagaactttgcacgagaaagctatggcttccttccgagcattcttgaacagtcctgttggccctaaaacaactcacttttggggtcctgttgccaactggggatttgttgtggcaggcctggtggacatgcagaaacccccagaaatgatatctggcaacatgactgcagcaatgtgtgtatactcgggattgtttatgaggtttgcatggatggtacagcctcgcaattatttgctgttggcatgccatgcctctaacgaaacagtgcagctatatcagctatctcgttgggcaaagagtcaggggtacttgcaacagaaggaagagaagtctacatctgaatgagatgatgatctggctctccctttccttgcttcaactttggtgtggttcttcgactgttcgaacccgtctttgatcaagatcaggcaagaagtcatgtaaactcatttgtgcttataatttaatggttttgtttcatgtcggatatattgattgattgtgtgtaaccatgaaatttgatcccaataaaagctacaacaatatgttaatg

SEQ ID NO: 1736 - DNA, 665 bp, Humulus lupulus
aaaaacttgatttgagttgaggggttggtggtagctcagtcgaatccgatcggaccatctactccggcgacccgaaggtagtagactgaaatggcttcattccgagcattcttgaacagtccagttggtcccaaaacaactcatttttggggccccattgctaattgggggttcgttgctgcggggttggtggacatgcaaaaacctccagaaatgatctctgggaacatgactgcagcaatgtgtgtctattcagcattgttcatgagatttgcatggatggtacagcctcgtaactatctgcttttggcgtgccatgcttcaaatgaaactgtacagctttatcaattatcccgctgggcaaagggtcaagggtacttgtcagagaagaaagaagagaaagaagagaaagacaaagctgtgtctcagtaacttgatgcttctttcaatttattttttcaatgttgggtggtgattttctcagaaatcaaaactgatctcttatgtaagactcgtttaaaatagtttcattttaactgcctgcataagactttatgagcgtaccattcttcgctgaaccttgatttacatacatcaccttgatccatttggctgatggtttctcaaaaggaagaaataaaattagtgagcaaaaattctttacg

SEQ ID NO: 1737 - DNA, 646 bp, Humulus lupulus
aacttgatttgagttgagggaggggttggtggtagctcagtcgaatccgatcggaccatctactccggcgacccaaaggtagtagactgatatggcttcattccgagcattcttgaacagtccagttggtcccaaaacaactcatttttggggccccattgctaattgggggttcgttgctgcggggttggtggacatgcaaaaacctccagaaatgatctctgggaacatgactgcagcaatgtgtgtctattcggcattgttcatgagatttgcatggatggtacagcctcgtaactatctgcttttggcgtgccatgcttcaaatgaaactgtacaactatatcaattatcccgctgggcaaagggtcaagggtacttgtcagagaagaaagaagagaaagaagagaaagacaaagctgtgtctcagtaactcgatgcttctttcaatttattttttcaatgttgggtggtgattttcgcagaaatcaagactgatctcttatgtaagactcgtttaaaatagtttcattttaactgcctgcataagactttatgagcataccatttttcgctgaaccttgatttacatcactttgatccatttggctgatggtttctcaaaaggaagaaataaaattagtga

SEQ ID NO: 1738 - DNA, 717 bp, Arabidopsis lyrata
aaacccatttagcttttgacttgtgtgtgttcttcttcgctctctctgcctgtcttaataatattccctcaccaactcgtttcatttgtgggcaaagcttcttcgattttcctttcagaccaatcgggtttcgcatcggcggatatggctacatcaaggttccaagcattcttgaacagtccagtcggccctaaaacaactcatttctgggggcctatcgctaattggggttttgttgctgctggtttggtggatatgcaaaagccccctgaaatgatttctggaaacatgtcctcagcgatgtgcgtttactctgcattgttcatgagatttgcctggatggtgcaaccacgcaactatttgctacttgcgtgccatgcatcaaacgagactgtacaactctatcagctctcacgttgggctagagcccaggggtatttatcctccaagaaagaagaggagaaaccatctcagtaaaccaaaatgaggaaaggtttcttcgaagctacttcagaatttgttcttgggaattactgaatccatccatttgattttcttttgaaacgtgtttgtattgtgtccccaagctatggttactttacttgttggatcgttcactaacattatctcttttgtttttataagtaaccgcttgtaataaaatttgggaccagtcgccagtccacatttcgtgttcattacaaagaggttcacaca

SEQ ID NO: 1739 - DNA, 622 bp, Cleome spinosa
gggccgcgggcattgactttactgtggtggttcccggcgaaacatctccgacaagagggtttcagtagcaggtgataagagatggcatcgaggttccaagcattcttgaacagtcccgttggccctaaaacgactcatttctgggggcccgttgcaaactggggctttgttgctgctggtttggtggacatgaacaaaccccctgaaatgatttctggaaacatgacatcggcgatgtgcatttactcagcgttgttcatgagatttgcatggatggttcaaccacgcaactatttgcttctggcttgccatgcttccaacgagactgtacagctctatcagctttctcggtgggccaggagtcaggggtacttgtcatcagagaagcagcaggaggagaaaccgtccgagtagcggtaacccatcatggatcaagacaaaaaggtttcgactttgaatctgaataacttgggattgacactgcgaatctcgtaagagatggcaagacactgctttagtaacaacatcctatttgtgtgttaatgttcctactgttgaaattggtcgtcgctctttattgtgttcgggtttgcagaattccgtataatttacgatcattatt

SEQ ID NO: 1740 - DNA, 729 bp, Citrus clementina
  Sequence also found in Organisms: Citrus sinensis
aacttcccctctcagaccaagcatcgcctttctgtcgctgtgtcatcgaaagacagccggtactcttcttgatcccctgatacggcatcgtctccgagttatcaaagtcaaaagtatttgtccatggcttcggtgcgagcattctggaacagtccggttggtccaaaaacaactcacttttggggacctgttgccaactggggatttgttgttgcaggtttggtggacctaaagaaacctccagaaatgatttctggtaacatgacaacagcaatgtgtatctattcaggattgttcatgaggtttgcgtggatggtacagccacgcaattatttacttttggcatgccatgcttcaaatgagactgtacagctctatcacctttcccgttgggcaaggtctcaggggtatttgtcagagaagaagaaggatgaggcctcgtctcagtaattccttgctgctttctttcctgtccattttcattttatttttgctgtgatttaagcgcaaagtattagtaaggcttcacaagtccaccttcttgtgatactttgtatttgattctatgtcgaggataactcagcagatcactatcaattgaatctgatcctgtcatcaggatgtttgtatcagagtgccaaattggaaaatgatgatgaattttaaaaatcaacctccttttcttacatgctgttcagcagaagaagaggcatgtgttatttaacttat

SEQ ID NO: 1741 - DNA, 542 bp, Tropaeolum majus
tcagtttatttctcgtggattcatctcccttcatctccatcggcaagaggtgttcaaggagtagtaatcatttatggcatcatccttcaaagcattcttgaacagcccggttggtcctaaaacgactcatttttggggaccaattgctaattggggtttcgttgctgctgggttggcagatatgaacaaaccccctgaaatgatttcgggcaaaatgaccggagtaatgtgcgtatattcggcattgttcatgaggttttcatggatggtacaaccacgtaattacctactcctcgtatgccatgcctcaaatgaaactgtccagctctatcaactctcacgttgggcgaggggccagggatacttgtcgtccgagaagaaagatgaagcctcgcctatatgatgcaaaagcgttgatcataactctgcatctctatttcaagtatcatctaaatgtaaaacaatattagaagcgaagttatgtgaatcaccgtcccaatatgttccgtttattcatcacacatctacaaaaagtttcaatg

SEQ ID NO: 1742 - DNA, 585 bp, Olea europaea
gactcctgcatggcctccttcaaagcatttttgaacagtcccgttggtcccaaaacgactcatttttggggtcccgtcgctaactggggatttgttattgctgggcttgtggacatgcaaaaacctccagaaatgatatctggcaacatgactgcagcaatgtgtatatattctgggttgttcatgaggtttgcgtggatggtacagcctcgcaactatttacttcttgcctgccatgcttcaaatgagtcggtgcagctttatcaactctcccgttgggccaagggtcaagggtacttagggggagagaagaaggacgaggcctcgtctcaatagatcaatactgctgttacttgttggacaattcactttatccttgaaacccatcgcaaaataggagctttagattgtgaatttccacgcaactctcttcatttctgatcttgaaaacatatggatttcattgatatgtcactagcaattactagaatataatgaacactctgtgattgtataagaaacgtgataaaaaacttgctatgtatagaactttatgataagtctgtcttcgtccatctcaattca

SEQ ID NO: 1743 - DNA, 645 bp, Olea europaea
tctaaacttcagtcaccacaccgcgaaccaaccgacgatttttgtacagattcaagtgatttttacgttgcagactcctgcatggcctccttcaaagcatttttgaacagtcccgttggtcccaaaacgactcatttttggggtcccgtcgctaactggggatttgttattgctgggcttgtggacatgcaaaaacctccagaaatgatatctggcaacatgactgcagcaatgtgtatatattctgggttgttcatgaggtttgcatggatggtacagcctcgcaactatttacttcttgcctgccatgcttcaaatgagtcggtgcagctttatcaactctcccgttgggccaagggtcaagggtacttagggggagagaagaaggacgaggcctcgtctcaatagatcaatactgctgttacttgttggacaattcactttatccctgaaacccatcgcaaaataggagctttagattgtgaatttccacgctcttgctatgtatcgaactttatgataagtctgtcttcgtccatctcaattcaatgttgtgttatttcagagaatggtatgaaaatgatgagatttctattggcccttcaatggcccaccgatcttaaaaagtttatggataaagcttaa

SEQ ID NO: 1744 - DNA, 699 bp, Fragaria vesca
gcgagctgcaagagccccaaatccctctcccctcagtcttctctgaaaccaatcgccgatcgtctcaaatcggtttggctacttctccggttagagatactataagcagtagttgtcacatatggcttcgttcagagcattcttgaatagtccagttggaccaaaaaccactcacttttggggacctgttgcaaactggggttttgttgccgcgggactggcagatatgagtaaacccccagaaaagatttctggaaacatgacagcagcaatgtgcgtttattcagcattgtttatgaggtttgcatggatggtacagcctcgtaactacctacttttggcatgccatgtctcaaatgagacagtccaactctatcaactgtcccgctgggcgaagggtcaggggtacttgtcccagaagaagaaggatgaaactgccacccaataacttgctattgctgctgtcatctcattcttatatcttggtttctgctgtgatttttgatgtaaacagtgtccatcatgttcagactttcttatattgctgtttgccttctagataaattactgagcagatgaaacttgtactaaaatttgttctgttatgtcatgctttggtttcttttcgaaaatatttgttttagtggtggctttaagcaatcaaatagccaggatgtctaatgaatttctttgagctta

SEQ ID NO: 1745 - DNA, 782 bp, Camellia sinensis
attgttttattttctcaccatccaaacggagcgtcagacggtgtgtatctatctcgctctcgctctggctcgctgcgctgcgctgcgctgactctccctcaaacagagatattttgcatagcagttggtcctacatggcttcgttccgagcattcttgaacagtccagttggccctaaaacaactcatttctggggtcctgttgctaactggggattcgtaattgctgggctggtggacatgaagaaaccccctgaaatgatctcaggcaacatgactggagcaatgtgtgtatattctctattattcatgaggtttgcatggatggtacagcctcgcaattatctacttctagcatgccatgcctcgaatgagacagtgcagctctatcaactctctcgctgggcaaagggtaatgggtacttgggtgggcagaagaaggatgaacctgcacctcagtaacttggtgctgccctttttcttttccattgttgggcctgcttccctacagaaaacaagttgtcattgatgtgaaattaagcattttattagtatgtgattagggtactagcagaaccacacaatcatttcaagtaaattgtgactgctgttattttgtttgtattgcactctggctttgttacaatccaatattacctaaataaactgtttgtcagaatattcaagctccgaagtttgaaaagttttaaccataagaccatgcaactggttggttcagtgctattgctatacctgaaccttgttcacgagatcattatttgg

SEQ ID NO: 1746 - DNA, 558 bp, Chrysanthemum coronarium
aacaacaacaactcatccactttccggcgctgaggtgtttcttacaagaaaatagtattgatggcttcctttcgagcattcctgaacagtcccgtcgggcctaaaactactcatttctggggtccagttgccaactggggatttgtcgttgcgggtctggtggacatgcaaaaaccgccagagatgatatccggcaacatgactgcagctatgtgtgtgtattctgcattattcatgaggtttgcgtggatggtgcagcctcgtaactatttacttctcgcatgtcacgcctcaaatgaatcggttcagatgtatcagttttcacgttgggcaaagagtcaagggtatttgcagcagaaggaagacaaggctccatcagcttgaactacatcttttattttcatccttttctggacttgatctttatgtggtaattttggttatattgttctttgaatatcaatgtaattgttatactataactaagctagcttggaagctgcattcacactcttgatcccgttgatgatgatatgatcatttgttctttggtatatg

SEQ ID NO: 1747 - DNA, 666 bp, Chrysanthemum coronarium
gagaatcttcaacaacaacaactcatccactttccggcgctgaggtgtttcttacaagaaaatagtattgatggcttcctttcgagcattcctgaacagtcccgtcgggcctaaaactactcatttctggggtccagttgccaactggggatttgtcgttgcgggtctggtggacatgcaaaaaccgccagagatgatatccggcaacatgactgcagctatgtgtgtgtattctgcattattcatgaggtttgcgtggatggtgcagcctcgtaactatttacttctcgcatgtcacgcctcaaatgaatcggttcagatgtatcagttttcacgttgggcaaagagtcaagggtatttgcagcagaaggaagacaaggctccatcagcttgaaccacgtcttttatttcatccttttctggactcaatctttgtgtggtaattttggttatattgttctttgaatatcaatgtaattgttatactataactaagctagcttggaagctgcattcacactcttgatcccgttgatgatgatgatatgatcatttgttcgttggtatatgttttcaataaaatcgatgtttctcgatttaccatcatcatgtaaccataacaaaaggtttgtaaagcctaaaatatccgagtttaatagtcaccta

SEQ ID NO: 1748 - DNA, 607 bp, Setaria italica
attcctcgccctcgctcgtcgactcgaccccgccgccgccgtcggcgaaatctgcgcgaggtgatttcagcttccgcggggagcgggttccgccatggcgacggtgctcaagtcgttcctgaacagccccgtcggccccaagaccacccacttctggggccctgtcgccaactggggcttcgtcatcgcgggtttggttgacatgaacaagcctcctgaaatgatatccggcaatatgacagcagcaatgtgtgtgtattctggactctttatgaggtttgcatggatggtacaacctcgaaattacttgcttctggcatgccatgcttccaatgaaagcgttcagctttatcagttatctcgttgggctagggctcaggggtacctggagaagaaagagccagaggcccagcagtaaagatggaatggaatgctgcagtcactttttcaataaggaatttttgtttgtgaagcagtgaaaacattgttcattctgtggcccataagtttctgcatgctgcaaaatatgccgtggaaatctcaatgatacctgtgttgcatcactacaagttttccttcatgttactttttcagtgcgggaacaatt

SEQ ID NO: 1749 - DNA, 621 bp, Antirrhinum majus
ttgtcccaaaatatttataatcctttcttccatttttgcgcacaacaaagtgggaataatctccgataaaggttatttaggttgcagactcttctatggcttctttcaaaacgtttttgaacagccctgttggtccgaaaacaactcatttttggggtcctgttgctaattggggatttgttattgctgggcttgtggacatgcagaaacctccagaaatgatatctggcaacatgactgcagcaatgtgtgtatattctgcgttgttcatgaggtttgcatggatggtacaacctcgcaactatttgttacttgcctgccatgcttcaaatgagtcagtgcagctgtatcaattttctcgctgggccaagggtcaagggtacttgggagagaagaaaggtgaagcctccactcagtgaatgaatgccttatctttctggtccttgcttgtatgaaatttgtctctgtccccaaccacacaaacacaagaaataatcacaatccagctagttgtgggttggattggattatctttatttccattgtagatacaatttgtattgactaaacgtattggatcattctaattaaatcacagatattgttgtgggtcaacgtaca

SEQ ID NO: 1750 - DNA, 639 bp, Artemisia annua
attcccatcatccactttccggcgccgaggtgtttcgtacaagaaattagtatagatggcttcctttcgagcattcctgaacagtcctgttgggcctaaaactactcatttctggggtccagttgccaactggggatttgtcgttgcgggtctggtggacatgcaaaaaccgccagagatgatatccggcaacatgactgcagctatgtgtgtgtattctgcattattcatgaggtttgcgtggatggtgcagcctcgtaactatttacttctcgcatgtcacgcctcaaatgaatcggttcagatgtatcagttttcacgttgggcaaagagtcaagggtatttgcagcagaaggaagacaaggctccatcagcttgaaccacgtcttttattttcatccttttctggactcgatctttgtgtggtggtaattttggttatattgttctttgaatatcaatgtaattgttatactataataactaagctagcttggaaagctgcattcacacttttgatcctgttgatgatgatgatatgatcatttgttctttggtatatgttttcaataaaatcaatgtttctcgatttaccgtcatcatgtaaccataacaaaagggttgtaaagctttaatttt

SEQ ID NO: 1751 - DNA, 521 bp, Catharanthus roseus
agccaacctacgacggagccatctaccccagaacttgcagcaaggaatccgaaggggaagactctccgaatcccgctagcacggaaaggagggtttttattcaccttggtcaacgactgtaacaggaacttttactgctctaaagctacgtaattaagagttcttcagaacaaactcaaaatggcttccttccgagcattcttgaacagtcctgttggtcctaaaacaactcacttctggggtcctgttgccaactggggatttgttgtagctggcctggtggacacacagaaaccgccagaaatgatatctggcaacatgactgcagcaatgtgtgtatactcaggattatttatgagatttgcctggatggtacagcctcgtaactatttgctgttggcatgccatgcttcaaatgaaacagtgcagctatatcagctatcccgttgggcgaagggccaggggtacttgcaccagaaggaagagaaggccgcatctaactaagaggatctttatctccc

SEQ ID NO: 1752 - DNA, 784 bp, Centaurea maculosa
gacgccgagttcttctgccgtctaatctccggcgacgaggtgctttcaacagcaaaataatatatggcttcctttcgagcattcatgaacagtcctgttgggcctaaaacttctcatttctggggccctgttgccaactggggatttgttgttgcggggctggtggatatgcagaaacctccggagatgatatcaggcaacatgactggagctatgtgtgtgtattctgcattatttatgaggtttgcgtggatggtgcagcctcgtaactatctacttctagcatgtcatgcctcaaatgaaacagttcagctctaccaattttcgcgttgggcaaaaagccaagggtatttgcagaagggagataaggccccatcaacttgaagtacaaccttggactctttctttgtgtggtaatttttgttttagtttctttgaagcctttgatataatcattgaatttaaactaagctctgaattcaccatcttgatcgtcaatggcgatactgacgctgatttgatcgttgatgtttttacctttttacactttttattgtgttattcggtatttgattcaataaaaatccgacatgttcttgatatacaaatcgccattgaaatcataacatggttgtgttttgagcggtatgttgaggctttttagttttgcctaagctttttggcaatttatgtttgaactaagccgcaaccatcgagccacgaatcacgaaccagttaccactacatgtttgaaaatttatttggcaaaatatagaagatataa

SEQ ID NO: 1753 - DNA, 586 bp, Cephalotaxus harringtonia
ggtaattttaagtacatttggagcatagaatggcagcgacgtttcgtgcctttttgaatagtcctgtaggccccaaaacaactcacttctggggtcctgttgccaactgggggttcgtcgttgctggcttggtggatatgcagaagccaccagatatgatctcagggaacatgactgcagtgatgtgtgtgtattctggattgtttatgagatttgcttggatggtacagccacgcaattatctgcttttggcttgtcatgcctcaaatgaaactgtgcaactttatcagctctctcgatgggcttctgctaatgggtacctgtcaaagaaagagaaacctgagaaacagtaaaaattgctaatgtctgttaccctgttttggttagaaattgaatcgtggtcaatgtggcctttttattttggatttgatactatttacatgttatgatgaaaatgttgtgatgtgtactgaaataacaacccatttgataaaattccaatgctaaaaattacaagcttatgtccattgttcccctttttccagagccttttaacaaaaatggatggaagctgcattttggtaaa

SEQ ID NO: 1754 - DNA, 577 bp, Castanea mollissima
ctctctctctgtacccaatcgccgatctcactactttccccggcgatttctcagggtttggtcatacatggcttcgttccgagcattcttgaacagtccggttggtccgaaaacaactcacttttggggacctgttgctaattggggtttcgtcgctgctgggttggcagatataaataaacctccagaattgatttccggcaacatgacaggagctatgtgtatctactcggcacttttcatgagatttgcatggatggtacagcctcgcaactatctacttctagcatgccatgtctcaaatgagaccgttcagctctatcaactctcacgatgggcaaagggccaagggtacttgtcacagaagaaagaggaatctacatctcagtaatttgatgctgcaatctttttctcccctgctttgctttctgcttgtagtgttatttgatgcaatatactcttgtgcttgtactgctattgtagcatagctgagcagttgactgttcagtaaatcatgtcttttttatatctttatttgtaacttatgcttttcgttaatagaaaatagtggaaggtt

SEQ ID NO: 1755 - DNA, 748 bp, Echinacea purpurea
cggccgggggatacatttaagtgggaaagaggttgcaacttgcaactttgcaagtaatcgcccaatcataatatagtagtattccatggttggtgagggggtatatctgactagagcctgttagttctgttctgctgccatctagtctccgacgacgaggtgttttgataacaagatactacatggcatcatttcgtgcatttttgaacagtcccgttggacctaaaaccactcatttctggggacctgtagccaactggggatttgttgttgcggggctagtggacatgcagaaacctccagagatgatatcgggcaacatgactgcagcgatgtgtgtgtattccggattatttatgaggtttgcgtggatggtgcagcctcgtaactatctacttctagcatgtcatgcctctaatgaaacggttcaaatgtatcagctttcacgttgggcaaagcatcaagggtatttacagctgaaggatgagaagtctacatcaacttgaaccgtatgtcgtttttcttttgtttgtatctttgaagttcaatgtaattgttgatttgaaaaactaagcggcattaaccacaccttgatcccaattaatactgatgatgatcatcattattgttgggtgttttgttcaataaagatcaatatttcatgatttgatctttaactaactctattattttcactgtcaccaacatattattaaacttattacaggttatcaataattatcacccg

SEQ ID NO: 1756 - DNA, 563 bp, Flaveria ramosissima
ccagagtgtcgtcgatccttccacccaatctgacgttagtcgccggcgacgattatttcgaaggtgctttagcagcaagcaatatatggcttcctttcgagcattcctgaacagtcctgtcggtcctaaaactactcatttctggggtcctgtagccaactggggatttgttgtcgcggggctggtggacatgcagaaacctccagagatgatatccggcaacatgactgcagccatgtgtgtgtattctggattattcatgaggtttgcgtggatggtgcagccccgtaattatttacttctagcatgccatgcctcaaacgaaacggttcagatgtatcaactttcacgttgggcaaaacatcaagggtatttgcagaaggaagacaagtctgcatcatcttgaaccaattaccaaagcttttatttttgtgtgatagttttaattccttttatgtttgcttcttttgagtttaaatgtaattgctgatttgacaaaccaagctgatttggcagctgcattcaccatcttgatcccaattagtggggtcctgctgctgatc

SEQ ID NO: 1757 - DNA, 448 bp, Flaveria ramosissima
ctaaccaatctgccgttagtcgctagcgacgcagcaagcaaattatggcatcctttcgagcattcctgaacagtcctgtcggtcctaaaactactcatttctggggtcctgtagccaactggggatttgttgtcgcggggctggtggacatgcaaaaacctccagagatgatatctggcaacatgactgcagccatgtgtgtgtattctggattattcatgaggtttgcatggatggtgcagccccgcaattatctacttctagcatgccatgcctcaaatgaaacggttcagatgtatcaactttcacgttgggcaaaacatcaagggtatttgcagaaggaagacaagtcggcatcaacttgaaccaattaccaaagcttttatttttgtgtgatagttttaatttcttttatgtttgcttcttgaagtttaaatgtaattatatt

SEQ ID NO: 1758 - DNA, 920 bp, Setaria italica
attccccattttccaactactccgtcgactccaccaaatcctctgtgcttccactctccccccccccccccccccccccccccccccccccccccccccccccccccccccccccccccccccccccccccccccccccccccccccccccccccccaattcctcgccctcgctcgtcgactcgaccccgccgccgccgtcggcgaaatctgcgcgaggtgatttcagcttccgcggggagcgggttccgccatggcgacggtgctcaagtcgttcctgaacagccccgtcggccccaagaccacccacttctggggccctgtcgccaactggggcttcgtcatcgcgggtttggttgacatgaacaagcctcctgaaatgatatccggcaatatgacagcagcaatgtgtgtgtattctggactctttatgaggtttgcatggatggtacaacctcgaaattacttgcttctggcatgccatgcttccaatgaaagcgttcagctttatcagttatctcgttgggctagggctcaggggtacctggagaagaaagagccagaggcccagcagtaaagatggaatggaatgctgcagtcactttttcaataaggaatttttgtttgtgaagcagtgaaaacattgttcattctgtggcccataagtttctgcatgctgcaaaatatgccgtggaaatctcaatgatacctgtgttgcatcactacaagttttccttcatgttactttttcagtgcgggaacaattgcagtctcttgataccttttcattatttggcactatttggttttaactggccagtatgtcctcaactgtggcgaaattatgttgtacattgtcaatgttctttctggatgtgaatacaaatataaattggtcaaaatcctaatttttagaccctg

SEQ ID NO: 1759 - DNA, 965 bp, Setaria italica
cgatccggaatggacggagattttgcaccggatgtccctcgcatattggaactactgcagacgatctcgttccccaccgatctcccccagcgcccgccgctctccacgcgctcggcccgtgcgccgccctccacgctcccctgcccagctgcagctcgagtccggctggtgcggcagcaccctcccttcccacgacttctctgttctctccctcggcctcggtcttcctttcctagcggcgacgacagggcgagttgcgctgcccgttgttcatcgaccgacgggcgcttcgccggcgacgaacatccgacaggggtgtggcgtgaccaggtgcggtgaatcttaggaggaaccattcgccatgtcgacggcgctcaaggccttcctgaacagcccggtcggccccaagaccacccacttctggggtcccgtcgcaaactggggtttcgtccttgcgggtttggttgacatgaacaaacctcctgaaatggtatctggcaatatgacagcagccatgtgcgtgtactcaggactctttatgaggttcgcatggatggtacagccgcggaactacttgcttctggcatgccatgcatccaatgaatcagtccagctgtaccagttatctcggtgggctagagcccaggggtatctggagaagaaagaaccagagcctcaacagtgaaagagtgtataaactgcatttaccttcccaataagaatagctactgccgctacagttttgaatgctcaatctagtacacaaataccagaaaaccaattctacgccatatgtagtgttacaagtgttttccctcttttcgtggcgctcctgtctcggaatccaacttcgttgacgatcgtgctcatgtctcatttttctttttgatctgatggctgtaaaacacacatcacatggtttggaaaaaaatgatgatcccaatctctgtgccctccacagctgt

SEQ ID NO: 1760 - DNA, 928 bp, Setaria italica
cggagattttgcaccggatgtccctcgcatattggaactactgcagacgatctcgttccccaccgatctcccccagcgcccgccgctctccacgcgctcggcccgtgcgccgccctccacgctcccctgcccagctgcagctcgagtccggctggtgcggcagcaccctcccttcccacgacttctctgttctctccctcggcctcggtcttcctttcctagcggcgacgacagggcgagttgcgctgcccgttgttcatcgaccgacgggcgcttcgccggcgacgaacatccgacaggggtgtggcgtgaccaggtgcggtgaatcttaggaggaaccattcgccatgtcgacggcgctcaaggccttcctgaacagcccggtcggccccaagaccacccacttctggggtcccgtcgcaaactggggtttcgtccttgcgggtttggttgacatgaacaaacctcctgaaatggtatctggcaatatgacagcagccatgtgcgtgtactcaggactctttatgaggttcgcatggatggtacagccgcggaactacttgcttctggcatgccatgcatccaatgaatcagtccagctgtaccagttatctcggtgggctagagcccaggggtatctggagaagaaagaaccagagcctcaacagtgaaagagtgtataaactgcatttaccttcccaataagaatagctactgccgctacagttttgaatgctcaatctagtacacaaataccagaaaaccaattctacgccatatgtagtgttacaagtgttttccctcttttcgtggcgctcctgtctcggaatccaacttcgttgacgatcgtgctcatgtctcatttttctttttgatctgatggctgtaaaacacacatcacatggtttggaaaaaaatgatgatccca

SEQ ID NO: 1761 - DNA, 659 bp, Lotus japonicus
ctccccactcagatttggtctgtcattctcttccaaaatcaacggcggcgattctccctgccaccaccaacctcgccctctctgccaccactttcacttcaagaagtagcgctggtatcatatggcttcctccttccgagcattcttgaacagtccaattggacctaaaacaactcacttttggggacctgttgccaactggggattcgtcgtagctggattggctgacttgaacaaacctccagaaatgctatctggcaacatgacatcagcaatgtgtgtctattcagccttgttcatgagatttgcatggatggttcagccacgaaactatctacttcttgcgtgccatgcctccaatgagacagttcaactctatcatttcacccgttgggcaaagtcacaggggtatctctcggggaagaaggaggaagcttcacctcagtgacttgaatcctgatgcttaaaactttcctgaatggggagtgctttgaattgaatttgtacttgaacttgtgaatttatgaataattgattgtaagaagggtcttatggaaactgttaaagattgagaatgtgcaaagagtatgactgatccagaagtatttgtgaatcatggctttgaaattcaacttaattatacagtttattttgattta

SEQ ID NO: 1762 - DNA, 1062 bp, Mimulus guttatus
aacagtataaataatagcttcgccaccaccaaacgacgacgttttgtatcaattcatccctctctcacacgctcggaaatcttccccaaaggtctggtgaaattgccgacaactttatggcttcattcaaaacatttttgaacagtccggttggtccgaaaaccactcacttttggggtcccatagctaattggggtttcgttattgctgggctagtggacatgcaaaagcctccagaaatgatatctggcaacatgactgcagcaatgtgcgtatattcgggattgttcatgaggtttgcttggatggtacagcctcgtaactatttgttactagcctgtcatgcttccaacgagtccgtgcaactcttccaactctcccgttgggctaaggctcaagggtacttgggagagaagaaagacgaagccttgtctcagtgaagagccaaattcctgcttttcattttccccttgcataaaaacaagccctctcaatttgatacattttgttcttgatgtaaactcgaagacgcactttgtcattcgtattggttgcaatgtttgataattgtcccaattcatcacaagatgttcatctattgtttgcgttttatttacgacagaagattgaataatagaacaaacagaaatatatctcatataaataaaaagtctaaatactgtttgtaaccggcacacatcctctttgccttcaaacatacatctcaaccggcttttttacttgttgcatatcgaaaaaagaaaacaaaaatgcaggccttaaatatgtcatgaagtaatttactgctacaacatcaaaaaacgtaaaccaaggcttctttcatgaagatatttgaatccatactcggtcgggcaacgaacaagtctttttaatcttcatcgtcacttaacctcttcttgctacttctcttcgatttctttttcttacttgtgtgttcatctttaaatccctttttccgttttgcaggcgtttctattacttcagcttcctctactgtgttcgtaacttctggcacaggaactgtaatagtgtaaacacgtc

SEQ ID NO: 1763 - DNA, 661 bp, Olea europaea
aggtttttaaattgcagactccatggcttccttcaaagcatttttaaacagcccagttggtcccaaaacgactcatttttggggtcctgtcgctaactggggatttgttattgctgggcttgtggacatgcaaaaacctccagaaatgatatctggcaacatgactgcagcaatgtgtatatattccgggctgttcatgaggtttgcatggatggtacaacctcgcaactatttacttcttgcttgccatgcttcaaatgagtcggtgcaactttatcaactttctcgttgggccaagggtcaagggtatttgggaggagagaaggacaaggcctcgtcgcaatgaatcaacactgctatttcttcttggacaatcacatcgtcctagaaaacctctcccaataggagcttttgcttgttcattttgaatcttcattgacgtgtcatcactagaacataataaaacagtatgattgtatatgaaacgttgacaaaaaactatgtatcgaccgtattgaggatcttcttccctctcaattcaatgttgtcaattcagctgatagtatggaaatcaatgagtttgctattgcatgtaatgaataaataatatggctatttgcccttcaatggcctattcatctctcgagagacccattatttt

SEQ ID NO: 1764 - DNA, 645 bp, Orobanche aegyptiaca
cgacttcaagaaggagctaaaagatcttcgtggtttcacaatccgcatacagacggacaatctctgctagaggtctgttcgctgactcatttatggcttcttccttcaaatcatttttgaacagtccaattggacccaaaacaactcacttttggggtcctgtagctaactggggattcgtcattgctggactggtggacatgaagaaacctccagaaatgatatccggcaacatgacttcagcaatgtgtgtatattctggattattcatgagatttgcatggatggttcagcctcgcaactatcttttacttgcatgtcatgcttcaaatgagacggtgcaactctatcagctctctcgctgggccaagggtcaagggtacttgggagataagaatgaccagacctcatctcagtgaactgatgctgcttttgtattttgtttattacttgaaaacaaaggcctccgctctctactttttttggatgatgtatcgttaaagtcgaaagacagcttactttggttagatgtttatcattgttttcacgtttattgttttgtccagtgtctgttatcagaacgtaatggaacagtgtgattcataaagatttggccatcgaacacgtgaattttaaaagattttt

SEQ ID NO: 1765 - DNA, 1004 bp, Cajanus cajan
gttccaacaaattcgttaagcttaagccctgcgccatatctacccttcacatttgacccctttcttcttctcttccaaattcaacgctctaccgtttctcatctctctcttcaatttcgattccagaagtagcagtggtatcagatggcttccttcagagcattcttgaacagtccagttggtcccaaaacaacccacttttggggacctgttgccaactggggatttgtggcagctggattggctgacatgaacaaacctccagaaatgatctctggcaacatgacaggagcaatgtgtatctattcagcattgttcatgagatttgcatggatggtacagccacgcaactacctacttttggcttgtcatgcctcaaacgagactgttcaactctatcaattctcccgatgggccagggcagaggggcttttctcggctaagaaggaggaagcttcatcagagtgattttatgctgtcactttcctcattgagagtgatttgaaagattttgcatttgaattgccgatgtatgaataattggttactgattgtaagaaggggcttgtggaaattgtaaaaaagattgtggctgtgcaagggtatttggattaaaaggattgcacgagtctaaactatttgttgacacctcgtgggtgggttttatgtgtctaacatataactgacccagaaatcattaaacttgaagcataagccaaagatttttctattatattatgctgaaatcagttccattacaaactacaaagttggggtgctaaaagttgtaccgtgactatttatttcgtggaaacttggatgtcatggtattaatttttgatgccctattcgttctaaattataatttgagcacgaggattgaattggtttctgggcttaaccaaactgctattcttcatgaatcatgatcctcttttagctgtacctgccgcattagcagtcctgaaaagatgattatttggttaggctcatttttcttttta

SEQ ID NO: 1766 - DNA, 782 bp, Prunus mume
ttctccatctctataggtcgcagccgccgaacttgagccgtttccagcgaaccccacccatctctggctctggctcaaaccatgtcatttccgatctcttatttcttttctgggacttgttcgtcataagtgattcttctgtggtcggtgtctccttcgtccccagtgcttctctttcatcgtcaagatcttgcgttttgttttgattaacatagtttctaagcggctgtgacatggcatcattccgagcattcttgaacagtccagttggtccaaaaacaactcacttttggggacctattgcaaactggggattcgttgccgctggattggcggatatgaacaaacctccagaaatgatttctggcaacatgacagcagcaatgtgcgtttattctgcattgtttatgagattcgcatggatggtacagcctcgcaattatctacttttggcatgccatgtctcaaatgagactgtccaactctatcaactctctcgctgggcaaggggtcaggggtactttccccagaagaaggatgaacctgcgtccgagtagcgtgctgcttctttcattcatttgctggtccattgtgttgtttgttgtgatttttacccaaaacagtgttgatctcgtgtatgactcatttaatacagttctactttgatattaactcagcagatagatgttcagtgaaacctcttcttctatcgtctaatttgtatttaatgtcatacactggtttttttattatatttttttataaataaaatatttgttttt

SEQ ID NO: 1767 - DNA, 656 bp, Prunus persica
ctggctctggctcaaaccatgtcatctccgatctcttatttcttttctgggactcgttcgtcataagtgattcttctgtgagtttctaagcggctgtgatatggcatcattccgagcattcttgaacagtccagttggtccaaaaacaactcacttttggggacctattgcaaactggggattcgttgccgcgggattggcggatatgaacaaacctccagaaatgatttctggcaacatgacagcagcaatgtgcgtttattctgcattgtttatgagattcgcatggatggtgcagcctcgcaattatctacttttggcatgccatgtctcaaatgagactgtccaactctatcaactctctcgctgggcaaggggtcaggggtactttccccagaagaaggatgaacctgcgtccgagtagcgtgctgcttctttcattcatttgctggtccattgtgttgtttgttgtgatttttacccaaaacagtgttgatctcgtgtatgactcatttaatacagttctattttgatattaactcagcagatggatgttcagtgaaacctcttcttctatcgtctaatttgtatttaatgtcatgcactgggttttttactatatattttttatatataaaatatttgtttttaatcaa

SEQ ID NO: 1768 - DNA, 702 bp, Oryza sativa
atcttctctcaacccctcgccgcctcccgacctcgacgacgacgacgaccgacgacgaggtgcggctgaatttgctggaggattgattgattggccatgtcgacggcggtgaaggcgttcctgaacagtcccgtcggccccaagaccacccatttctgggggcccgttgctaactggggcttcgtcctcgcgggtttggttgacatgaacaaacctcctgaaatgatatctggcaatatgacagcagccatgtgcgtgtattcaggactctttatgagatttgcctggatggtacaaccacggaactatttacttttagcatgccatgcttccaatgaatcggttcagctctatcagatgtctcggtgggctagggcacaggggtatttggagaaaaaggagccagaggctcagcagtaaaaaaaagacgcaaagcgcagcatttagcttctcaataagaaaacttgtctcatgtccatcaatgctgagtctgtaacacaatataatctcagatcatatcttccttgtgtgccataagtgcttgcccctaatgttatttgatgtcaaacctgttccagaaaaatcagaatcgcacataatttctggttgtttttccgaaaacctttatgatttcctgtttgtaaaaactcatcacattgtgttgaaaatgattggttccaaatgtagtgcctgctgtttgac

SEQ ID NO: 1769 - DNA, 709 bp, Rosa hybrid cultivar
caaatccctctccctgagtttttctctgtaaccaatcggcgatcgtccccagttggttcggctatttctccgataagagatactataagcagcagtcgtaacatatggcttcgttcagagcattctggaatagtccagttggtccgaaaaccactcacttttggggacctgttgcaaactgggggtttgttgccgctggactggcagatatgagtaaacccccagaaaaaatttctggaaacatgacagcagcaatgtgcgtttattcagcattatttatgaggtttgcatggatggtacagcctcgtaactacctacttttggcgtgccatgtctcgaatgagactgtccaactctatcaactctcccgctgggcgaagggtcaggggtatttgccccagaagaaggatgaagctgccacccaataacttgttgcttctgtcatctcattgttatatcttcttttcagttgtgatttttgaattaaccaatgttcatcatgttaagactttcgtatattgctatttgcgttttagataaattaccgagcaggtgaaacttgttttgtaatctattctgtttatgtcatgctttgatttcttttcaaaagtatttgtttcagtcgtggctttatgcaatcaatagcatggaggatgtcttataaatccctttataagctcaagcttacaataaaaaaaaaaaaaaaact

SEQ ID NO: 1770 - DNA, 635 bp, Salvia sclarea
cactagaccttggctgtcactcaaaaatagaatgtcgccagcacttaacagcggttttagtagctgaaacacctctctgaaccattcgcacacaacgcattcacacagaacctgcgccgaggtttgtctattgactcatttatggcgtccttcaaggcatttctgaacagtcctgtcggtccaaaaacaactcacttttggggtccaatagctaactggggttttgtagttgctggattggtggacatgaagaaacctccggaaatgatatctggcaacatgactgcagcgatgtgcgtatattctgcgctattcatgaggtttgcttggatggttcagcctcgtaactatctgctacttgcctgccatgcttcaaatgagaccgtgcaactctatcaactctctcgttgggcgaagggtcaaggttatttggaggcaaagaaggagacgacacctgaatgaattgatgctgcactggctctgcgcttctccaactgaacccatgaacagaaaaacgtaaccacccgccacttgttctgtggattcacttatcattttatcttaatttcttctgttgttatacattaaattccaaaaaagactttattgtggttcttgctggatagtgtttcgtt

SEQ ID NO: 1771 - DNA, 758 bp, Sesamum indicum
cacacaacacacactgagaagatctccgctaaaggttttttactgacgaatccatggcttccttcaaagcatttctgaacagtcctgttggtcccaagacaactcatttttggggtcctgtagctaactggggatttgtcatagcaggagtggtcgacatgaagaaacctccagaaatgatatctggcaacatgactgcagcaatgtgcgtatattctgcgttattcatgaggtttgcatggatggttcagcctcggaactatctgctactcgcatgccatgcctcaaatgagtctgtccaactctatcaattctcccgctgggccaagggccaagggtacttgggagagaagaaacctgaggcctcacctcagtgaactgatgccgctttcctgttttttcttacttgaaaacaaggtccttgtgccgactgaacccaccaaccagaaaacgaaaccaacaccccagcgcccctgctagcaaaaactttagttgtcggttcatgtgattaatcttaatttcaggttgtcaagacttttgtacttgatgtaacatcaaagtccaaatacaacttatttcgtgtagatcatcggttttacggtgctctgattgtgccagccagttattggaacataataagacactgtgatttaagaagacttggccaccaaaagccatgtgtgttaaaacattgttgaagttgctctgtaaagggtttatcatgaattttctgcttttgaatccatcaatttgccacc

SEQ ID NO: 1772 - DNA, 670 bp, Helianthus annuus
gcagagtatgcggggggtcagcagtcatatattccttccatggtagggggtctgtctctgactggaggctgttagttctgacgtcatctaatcgccggcgacgaggtctgttaataacaagataatatatggccgcctttcgagcatttctgaacagtcctgttgggcctaaaaccactcatttctggggtcctgtagccaactggggatttgtcgctgcgggtctggtggacatgcagaaacctccagagatgatatcgggcaacatgactgcagcgatgtgtgtgtattccggtttattcatgaggtttgcgtggatggtgcagcctcgtaactatctacttctagcatgtcacgcctcaaatgaaaccgttcaattgtatcagctttcacgttttgcaaagcatcaagggtatttacagccgaaggaagataagtctacatcaacttgaacgaatatgttatttttcgtttttgtttcgtttgtatctttgaagttgaatgtaattgttgatttgaaaaactaagctatcttggcagctgctttaaccaccttgattgatctcaattgatggtgatactgatgatgatcatcattattgttcttgggtgtttggttcaataagagatctaatattttcgcgggtttaggcccaacaggactgttcag

SEQ ID NO: 1773 - DNA, 754 bp, Panicum virgatum
gcccaaccacaaccactccagattcccccatcttcacgtctcgtccctgtcttcgtcaacacctcgccgccgccagacgtcgacgagacgacgacgacgactgacgagtgacgacgaggtgtggtgaatccttggagaaatcgttcgccatgtcgacggcgctcaaggccttcctcaacagcccggtcggccccaagaccacccacttctggggtcctgtggcaaactggggtttcgtccttgcgggtttgcttgacatgaacaaacctcctgaaatgatatctggcaatatgacggcagccatgtgcgtctattcaggactctttatgaggtttgcgtggatggtgcagccgcggaactacttgcttctggcatgccatgcatccaatgagtcagttcagctctaccagttgtctcggtgggctagggcccaggggtatctggagaagaaagaaccagaggctcagcagtaaaagcagtgtataaacctgcatttaccttcccaataagagtgacctgcagcagcagtttgaaatgctgaatctgcttgacaaatcccagaaaataaattctatgctgtatatgtttacaagcgcctttccctccattctatggccctcctgtctcgtaattcgagtttccaaatatcgcgttcttgtctcattttctttcggatctgatggctgtaaaacacacattacatggtttgaaaatggtgatcccaatccctttgccctccatggctgtttgacaa

SEQ ID NO: 1774 - DNA, 679 bp, Tabernaemontana elegans
gaactttgcaagagtaggtcgctatggcttctttccgagcattcctgaacagtcctattggccctaaaacgactcacttctggggtcctgttgcgaactggggattcgtagtagcgggcctggtggacacacagaaacccccagaaatgatatctggcaacatgactgcagcaatgtgtgtatactcaggattgtttatgaggtttgcatggatggtacagcctcgcaattatttgctgttggcatgccatgcctcaaatgaagcagtgcagctatatcagttatcgcgttgggcgaagggtcaggggtacttgcagaaggaagagaaggctacatctcagtgaggtgatcttttctacctcgcttcttcaattcctccactctggggggttaattgactgtttgaaactgtctttcatcaaagatcacgcaagcagtcatgtaataaacacattcaagcgtataatttaatgatcttatttcatgattcggatgtattggttgtataattgtgaaattggaattctatataaagtcaagatggtgaacatttttctctttatgcttgcttttcatcagtgaaggcatttgttttgactctgtttaaagtgaagcttccagtctatgcctagcttgatccagattataaccagtttgtcactataaagctgtttggcac

SEQ ID NO: 1775 - DNA, 712 bp, Tragopogon dubius
caattataaatgctccacccaatcatactccagagttggtagtcctccgaccggtcttgagttattctgccatctactcggcgccgacgcaaattaggtcgtttatctacgttctcaccactgcagcacgacaccagggcagggttccatcgaccatcttcttcattctctcggcctcaccactgtatccgccagaggtgttttaaaaagaaagataatacatggcttcctttcgagcattcctcaacagtcctgttggacctaaaactactcatttctggggtcctgtagccaactggggatttgttgctgcggggctggtggacatgcagaaacctccagagatgatatctgggaacatgacagcagcaatgtgtgtgtactctggattattcatgaggtttgcatggatggtgcagcctcgtaactatcttcttcttggatgtcatgtctcaaatgaaacagttcagttgtatcaactttcacgttgggcaaagcatcaagggtatttgcagcagaaggaagacaaggccccatcagcttgagccacacctcttaatctggatcatatctttctgtgataattttgtttggttaatgtaattgttgaatcaaaattaagctttttcttgatcccatcaatggcgatactgatgaggatatgttactgccttttcttttgttcttgggtatttgattgaataaaaatcga

SEQ ID NO: 1776 - DNA, 546 bp, Triphysaria pusilla
tcaaggctcgtttgtttgctgacacatcaatggctttttccttcaaagcattcttgaacagtcccgtcggacccaaaacaactcatttttggggccctgtagctaactggggatttgtgattgccggactggtggacatgcagaaaccaccggaaatgatatccggcaacatgactgcagcaatgtgcgtatattctgcgttattcatgagatttgcatggatggttcagccccgtaactatctgttacttgcttgtcatgcttcgaatgagtcggtgcaactctatcaattctcccgctgggccaagggccaagggtacttgggagataagaaagaagagtccacatctcagtgagccagtgtttttttttttcgttgcttgaaaacaatgtccctatgactcaccatggcttacagaaactttgagttgtgggttcatgtaatcataataatttctcgtgttatttataactcatttatgtttgatgtatctttaatacgtgaagacagcataagttggttatatagatcatcgttgcctgagt

SEQ ID NO: 1777 - DNA, 615 bp, Arabidopsis thaliana
accaactcgtttcatttggggacaagcttcttcgattttcctctcagaccaatcgggctttcgaatcccatcagtagaaatggctacatcaaggttccaagcattcttgaacagtcccattggcccaaaaacaactcatttctgggggcctatcgctaattggggttttgttgctgctggtttggtggatatgcaaaagccccctgaaatgatttctggaaacatgtcgtcagctatgtgcgtttactctgcattgttcatgaggtttgcctggatggtgcaaccacgtaactatttgctacttgcgtgccatgcatcaaacgagactgtacaactctatcagctctcacgttgggctagagcccaggggtatttatcctccaagaaagaagaggagaaaccatctcagtaaaccaaaatgaggaaaggtttcttcaacgcggcttcagaatttgttcgtgggaattactgaatccatccatttgattttctttcgaaacgtgttttgtattgtgtccccaagctatggttgctttacttgttggatcattcactaacattatatcctttgttttcataagtaaccgcttgtaataaaatttgggaccagtcgtc

SEQ ID NO: 1778 - DNA, 708 bp, Brassica juncea
gtggactgttttgttattccatccatcctcggtcgtcactcttctctcaaatctccttcatcatcgaccaaccatcctcttcaatcggagctttcgcatccctcaggtggatttgggtcgataatggctgcatcagggttccaagcattcttgaacagtccggttggacctaaaacaacccatttctggggtcctatcgctaattggggctttgttgctgccggtttggtggatatgcaaaagccccctgagatgatttccggaaacatgacctcagccatgtgcatttactctgcattgttcatgagatttgcctggatggttcaaccacgcaactatttactacttgcctgccatgcttccaatgagactgttcagctctatcagctctctcgttgggctagagcccaggggtatctatcctccacgaaagaagaagagaaaccgtctcagtaaaacaaaatgaggaaggaaaggtttctttaattctgattctaatcagcatttgttcttttggaattgctgaactccatccatttggtttcctttaaaacatgtttatgttgtgtccccaagctatatggttgttttacttgttatatcctttcattgacgttatctctttggttttcataagtaaccaattggagacagtcccaacacaaattgctcttgaagcacatgcatgacatgaattgaaaaaagcac

SEQ ID NO: 1779 - DNA, 613 bp, Chenopodium quinoa
tagaaagtaaatttccagagaaaaagagaaagaccatttctcagattctctcccctcatttcttctccgccattgctgctccttcgtcaatctttcatcaactcttcggtgactcatggcttctacattccgcgcatttttgaacagccctgttgggcctaaaacaactcatttctgggggcctgttgcaaattggggatttgttgtcgctgggcttgtggacatgaataaaccccctgaaaagatatcaggcaacatgacttcagcaatgtgtgtttactctgcattattcatgaggtttgcatggatggtacagcctcgcaactatctactcctggcatgccatgcttcaaatgaaactgtgcagctataccaactttccagatgggcaagggctaatgggtacttgtcatcaaaaaagaggaaagcactgaactgtgatttcgccttttcactagggtgctgatcttcatatttctttaatggcatcttgtttgagcgatataaacatttgattgtatactacctaaacacaaattgttggtgattgctccagaaatgtctcaatttttccaaaattattatgttaaatctttcacatggtttgctactc

SEQ ID NO: 1780 - DNA, 589 bp, Ocimum basilicum
aacaaacgacgacttcgttcatccctctctgatctgcattctattcgctaagaaatcttctgtaaaggggtcttgagttgctgaatcgttatggcctctttcaaagcatttttgaacagtcctgtcggtccgaaaacaactcatttttggggccctgttgctaactggggctttgttatagctggactagtggacatgcaaaaacctccagaattgatatccggcaacatgactggagcaatgtgcatatattctgggttgttcatgaggtttgcttggatggttcagccgcgcaattatctgttacttgcctgccatgcttcaaatgagacggtgcagctctatcaactctcccgctgggccaagggtcaagggtatttgggaggagagaagaaagagaaggcctcgtctgagtgaatacgatgttagtggtgcttgaaatgaagaaggataataaggttatgtgaatcaattgtagcagggacccatttcaaatgtaaacaaatcaaacttttccagttgatttgaagatgatgcagaaattagtaatttgtaatgcattcttctgtgtcacatatatatctcttgt

SEQ ID NO: 1781 - DNA, 564 bp, Fraxinus spp
aggttgcagactccatggcttccttcaaagcatttttaaacagtccagttggtcccaaaacgactcatttttggggtcccgttgctaactggggatttgttattgctgggcttgtggacatgcaaaaacctccagaaatgatatctggcaacatgactggagcaatgtgtatatattccgggctgttcatgaggtttgcatggatggtacagcctcgcaactatttacttcttgcttgccatgcttcaaatgagtcggtgcaactttatcaactttcacgttgggccaagggtcaagggtacttggggggagagaagaagggtgaggcctcgtctcaatgaatcggtattgcctttcttcttggacaatcacttcaccctagaaaaaatctctcataaggagcttttggttgtggatttccatgcaattcgatttatttcatatcttgaaaaaatttggatacggatttctttcttgatgtcattatcaattactagaacataataaaatagtgtgattgtctaagaaatgtggatcaaaaactatgtattgagcctaatgaga

SEQ ID NO: 1782 - DNA, 617 bp, Tropaeolum majus
tctcggaggagattaaatcggtcagaagtgttcaagtggccattatcatagatggcatcatccttcaaaacattcttgaacagtccagttggtcccaaaacgactcatttttggggacctattgcgaactggggatttgttgctgctgggctggcagacatgtccaagccccctgaaatgatttctgggaacatgaccgcagcaatgtgcgtgtattctgccttgttcatgaggtttgcgtggatggttcagccacgcaactatttacttctggcttgccacgtttcaaatgaaaccgtacagctctatcaactctcgcgttgggcaaagggtcagggatacttgtcatcggagaagaaaaaggaagcctcgtcttagtcatttcatgcgacttgtttggtcaatgttgcagtaagttttcttctgatttctacaagaaggtattgttagtagactgggcggggcagaacatatatgtgatattaccaagtgaactttgatctccagtcatcttcttgtttatagaggttttaaaccataaacaataatgtgttatctaagttcctgttttgactgtattattgaggaacggcaaaatatgatttttattgctccca

SEQ ID NO: 1783 - DNA, 660 bp, Primula obconica
catttccattttctcttgcgatcgccctttgctgcgttaagatacctttttaaggagcaattcccatagatggcttctttccgagcattccttaacagtccagttggacctaaaacaacgcacttttggggtcccattgctaactggggattcgtcgttgctgggctggtggacatgaagaagcctcctgaaatgatatctggcaacatgactgcagcaatgtgtgtatattctgcattgttcatgagatttgcatggatggtacaaccacgtaactatctgcttcttggttgccatgcctcaaatgagacggtgcagctctatcagttttctcgttgggcaaaagctcacgggtatttaggagaacaaaagaaggaagaagctgcaactgagtgatactgatggtgcttctaagcttctttatctttccatttcgaggctaaatgacagtggtagtgattgctgcagaaatgcaagtcggtctggatcgaaagaagtatttgttatagcttgggaccatatagaccttgaattctgacattttattgtttgtatttatttggtgttgttacatccccataatttgccgtcaagaaaattaagctcaaaaggccttagttatctttatgctttgcttatttgcatttccatgaatacaag

SEQ ID NO: 1784 - DNA, 945 bp, Amaranthus tuberculatus
gggataaaaaggtgtattgtataatccttgctgggcttcttccatccttgtttcaacattggcgttcccagtttgcatctctctatcgccattcgcctccattactggtttcacatggcttctagaattcaagcgtttttaaacagccccattggacctaaaacaactcatttctgggggcctgttgcgaattggggatttgttatagctgggcttgtggacatgaataaacctcctgagatgatatcaggcaacatgactgcagcaatgtgcatttactctggactattcatgaggtttgcatggatggtacagccccgtaactatcttcttttagcatgccatgcttcaaatgaaactgtgcagctataccaactatcacggtgggcaagggctaacgggtacttatcacagaaggaggaagccgcgtcaaaatgattcttccataaagatgctaatcaccagagtttttgtaagaaataattgaataagcaataagcatttatgtatactaccgaagggggcttgcttcagaaaatttctgaattattattattttttgtgttgcttctccttcatacaatttgatgccctttatgaattaaaaacattgtaacatgaggttgggacttctacaacttcataaacatcaccagtgatgctatttgaaatgaagcgccccgatttcgttgtttgattttaaaaaacagctcattgtagatggacatgaggaaaatcgctatgtttgattgtttatacagcttcattacagtaagcctcacttgatctaagaatcatttcttccggttctgggttatccaatttggggaccttttgggttaggtttaggtggattgtaagatcatgtaattctattacataattcttgtatgagacggtctcattgcgagacatgtctcatatatgagtaaatctgagactgcc

SEQ ID NO: 1785 - DNA, 879 bp, Lactuca sativa
gttgaccaaatgccccaggtactagtcttgtacaaaatacaacttatggggggttttatgtagacatacatataaaggtggaaccgttgaagaaaagttgtaaatgctccacccaatcatattccagagttggtagtcctcctcccccgaccaaaggccaaagggtgttgagttattctgccactagtcgacggcgacgatattttttttaaccaacaagataccatatggctgcatttcgagcattcttaaacagtcctgttgggcccaaaactactcatttctggggtcctgtagccaactggggttttgttgctgcggggttggtggacatgcagaaacctccagagatgatatctggcaacatgactgcagcgatgtgtgtgtactctgcattatttatgaggtttgcatggatggtgcagcctcgtaactatctacttctagcatgtcatgcctcaaatgaatcggttcaattgtatcaattttcacgttgggcaaagagtcaagggtatttgcaaaagaaggaagacgaggcttcatcaacttgagactcagcttttatcttcatcctttggactcttatctttgtgtgataattttggatttaatacatatagcttgtttctttgaagctttcgtgtaattgtttaaatcaaaactaagctttcttgacatctgaatccttgctcttgttcttgatccccatcaatggtgatattgatgaggatttgatcattgttgttactgctttttgttttagacatttattttgttcttgggtgtttgattgaataaaaagcaatattttcttgatttattatcgtttttgaaaccctcctaacagaagggttgtattttggcaaattattaaagcta

SEQ ID NO: 1786 - DNA, 586 bp, Zea mays
ctctacctgccccgttcctcaccagtctcttccgccggcgtcgacgagagctgcgctaggtgatctcgactgcttcctcgccccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctttatgaggtttgcatggatggtacagccccgaaattatttgcttctggcatgccatgcttccaatgaaagcgtccagctctatcagttatctcgctgggctaggtctcaggggtacctggagaagaaagaaccagaggccaaacagtaaagagggtatccaacactgcagtcatttgttcaataaagaaaatatgctgtggaaaacattcattctgttgccaatgcagttttttttgtatgtttgcaaaatatgctgaggaaatttcatgatacctagcgcagttacaagtgtctgcttacttttatgtgcatttgtcaagacac

SEQ ID NO: 1787 - DNA, 833 bp, Pennisetum glaucum
gtcggatgcgaagatagagtatggggcccacttctcctattccccaatccccattctccaactcgcgacgactgcaccaaatcctctgcttttctcccttcaccaaccaaactcctcgtcgccctcggtccgtcgactcgtctccatcccctccgccgccgccgccgaaagctgcgcgaggtgatttcagcttccgcgagggagaggattcggccatggcgacggcgctcaagtcgttcctgaacagccccgtcggccccaaaaccacccacttctggggccctgtcgccaactggggcttcgtcatcgcgggtttggttgacatgaacaagcctcctgaaatgatatccggcaatatgacagcagcaatgtgtgtgtattctggactgtttatgagatttgcatggatggtccaaccgcggaattacttgcttctggcatgccatgcttccaatgaaagcgttcagctttaccaattatctcgtgttgctagggctcaggggtacctggagaagaaagagccagaggcccaacagtagagatgctatggaatgctgcagtcaatcgttcaataagggaactttgtttgtgatgcagtgtaaacattgattgatggagtttcttcatgctgcaaaatatgccgtggaatctcaatgatacctgtgttgcgtctttactcatttttcattattgttactctgctgcacaaactcttaattgtggcgctttctgtacatcgtcgccactgttctttccagacatatttacttttagaacctgataaaaaaatcgacttttgtaaactacaaatttatgctttttttagtgtaaaa

SEQ ID NO: 1788 - DNA, 680 bp, Solanum tuberosum
cagaagccctcagtttcagatctctaataaagttgcaaattggaggaataaaatggctgaatagtgcaatggtgaagggaggaatttcgctaagggtgttgattttgagcttatgcaacttatcaggatatttcatatagcttgtcagaaatggcttcattcaaggcatttttgaacagccctgttggccctaagacaactcatttttggggtcctgtagccaactggggatttgtcattgctggactggtcgacacacaaaaaccaccagagatgatatcaggcaacatgacctcagcaatgtgtgtttattctgcgttattcatgagatttgcatggatggttcagcctcggaattatcttcttctggcatgccatgcctcaaatgagtcagtgcaactctatcaactatcacgttgggcaaagagtcaaggatatttgcaacagaatgcagccaaagcagagtgatctagtgttctttcttgtttatttttggacaaatttgcttggcatttctgaatgctttcatcaattgttgccaaaatgtttataaagaggcattaaacttttgcagtttgaatgactctacgttaataagccaagaaaaaagtaatgatttttggaatcggttgagaaatatctgctgatgcaaaatttacgataatagtgacttgaagtgt

SEQ ID NO: 1789 - DNA, 650 bp, Pseudoroegneria spicata
aatcgttcctcgttctccatctactccaccaaacccccatccccatctctcccccctaggctcgccttcgccgtcggtcgggctccctctccgacacgccgccgtcgataaatccacccgaggcatggcgacggcgttcaaggcgttcgtgaacagtcccgtcggccccaagaccacccacttctggggccccgtcgctaactggggcttcgtcctcgcgggtttggttgacttgaacaagcctcctgagatgatatctggcaatatgacagcagccatgtgtgtgtattctggactctttatgaggtttgcgtggatggtgcagccccggaactacttgcttctggcatgccatgcctccaatgagaccgtccagctctatcatttatctcgctgtgctagggctcaggggtatctggattccaagaaagagccagaggcccaacagtaaagggtgtggtctttctgaagtcggagcccggagccttgattccgcagccagcctttcaataagtaaaatttgtttctgaagctttgcaataccctccatgagaaaaaaaacctataaagtggaaatttctatttctatgatactcatgcctgcaatgtagcgttacagctttcttgttcctgaatcatggttcatgaca

SEQ ID NO: 1790 - DNA, 930 bp, Secale cereale
tcagcagatgtaaacgccctgtggtcaaatttacatttcacataatttatacgatcaacttggaagaaaagaagcatcaagaaaaaaactttaaaaaagaggcacaaaatcgttcctcattctccatctagtccaccaaacccccatccccatctctcctcccctaggctcgccttcgccgtcggccgggttccctctccgacacgccgccgtcgatacatccacccgaggcatggcgacggcgttcaaggcgttcgtgaacagccccgtcggccccaagaccacccacttctgggggcccgtcgctaactggggcttcgtcctcgcgggtttggttgacttgaacaagcctcctgagatgatatctggcaatatgacagcagctatgtgtgtgtattctggactatttatgaggtttgcgtggatggttcagccccggaactacttgcttctggcatgccatgcctccaacgaaaccgttcagctctatcatttatctcgctgtgctagggctcaggggtatctggattccaagaaagagccggaggcccaacagtaaagggtgtggtgtttctgaagtcggagcccggtgccatgattccgcagccagcctttcaataagtaaaatttgtttctgaagctttgcaatgctcttcatgagaaaaaaaccctatgaagtggaaatctctatttctacaatactcattcctgtaatgcagcgttacagctttcttgttcctgaatcatggttcatgacatattttttttcttttcaacaatgcacatagccagggttcaagttatccaccccagactcgctgcttgattgtactattgatttcaaccacgtccatagtatcttttgcctggtacccgccacaaagttgtgtaaaccacagttgcgttctttgcagttttggatgaccccct

SEQ ID NO: 1791 - DNA, 763 bp, Secale cereale
tcgttcctcattctccatctagtccaccaaacccccatccccatctctcctcccctaggctcgccttcgccgtcggccgggttccctctccgacacgccgccgtcgatacatccacccgaggcatggcgacggcgttcaaggcgttcgtgaacagccccgtcggccccaagaccacccacttctgggggcccgtcgctaactggggcttcgtcctcgcgggtttggttgacttgaacaagcctcctgagatgatatctggcaatatgacagcagctatgtgtgtgtattctggactatttatgaggtttgcgtggatggttcagccccggaactacttgcttctggcatgccatgcctccaacgaaaccgttcagctctatcatttatctcgctgtgctagggctcaggggtatctggattccaagaaagagccggaggcccaacagtaaagggtgtggtgttctgaagtcggagcccggtgccatgattccgcagccagcctttcaatagtaaaattgtttctgaagctttgcaatgctcttcatgagaaaaaaaccctaatgaagtggaaatctctatttctacaatactcattcctgtaatgcagcgttacagctttcttgttcctgaatcatggttcatgacatattttttttcttttcaacaatgcacatagccagggttcaagttatccacccccagactcgctgcttgattgtactattgatttcaaccacgtccatagtatcttttgcctggtac

SEQ ID NO: 1792 - DNA, 541 bp, Solanum phureja
gacgaacaccaccaactaaagagtagcaccactttatacacaatcgccaacagaagccctcagtttcagatctctaataaaggatatttcatatagcttgtcagaaatggcttcattcaaggcatttttgaacagccctgttggccctaagacaactcatttttggggtcctgtagccaactggggatttgtcattgctggactggtcgacacacaaaaaccaccagagatgatatcaggcaacatgacctcagcaatgtgtgtttattctgcgttattcatgagatttgcatggatggttcagcctcggaattatcttcttctggcatgccatgcctcaaatgagtcagtgcaactctatcaactatcacgttgggcaaagagtcaaggatatttgcaacagaatgcagccaaagcagagtgatctagtgttctttcttgtttatttttggacaaatttgcttggcatttctgaatgctttcatcaattgttgccaaaatgtttataaagaggcattaaacttttgcagtttgaatgact

SEQ ID NO: 1793 - DNA, 873 bp, Sorghum bicolor
gtgcgatgcgatgcgacttggaccgttggacgtggctcaatgccctcttcttctgacgtagattccttgtagggagacgtcagcatcggttccattctccccgtcttcgtcaacacctcgccgccgccggacatccgacgaccagcgacgaggtacggcgaacctttggagcaatcattcgccatgtctacggcactcaaggctttcatcaacagccctgtcggccccaagaccacccatttttggggccccgttgcaaactggggtttcgtcattgcgggtttggttgacatgaacaaacctcctgaaatgatatctggcaatatgacagcagccatgtgcgtgtattcaggcctctttatgaggttcgcatggatggtacagccacggaactacttgcttctggcatgccatgcctccaatgaatcagtccagctctaccagttatctcggtgggccagggcccaggggtacctggagaagaaagaaccagaggctcagcaatgaaaagagtggagtgtataggcctgcattcaccttctcagtaacaataagagtgatctgccgctgcagttttgaatcctcactctggcagacaaatcccagaaaaacaacctcttctatagttatactaatgccatatgcagtgttacagtgctattgcagaatctcactgcacttgtgatcagaagagttggtgtctcgttttgctttttctgatttgatggctgtaaaaacacacatcacatgtgtttgaaaatggtgatctcagtttctgtaccctcatggctgttcgccactccttccctgcagcccagacagaccacatacatatccatatataataatataagtgatgagttttgctgtcag

SEQ ID NO: 1794 - DNA, 887 bp, Glycine max
gaaacgcaaaaggcgatgccgtttgaagacgacaaaagcattaaaggtcacactgccacctttcagatttgacttcctctccggcgctgccattctcttccacggcagtgtttctctttctctctctctctatcttcaatttcgagaagtagctccagtattatatggcgtccttcagagcattctggaacagtccagttggtcccaaaacaactcacttttggggacctattgccaactggggatttgtagcagctggattggctgacctgaacaaacctccagaaatgatctctggcaacatgacaggagcaatgtgtgtctattcagcattgttcatgagatttgcatggatggttcagccacgcaactatctactttttgcttgccatgcctcaaatgagactgttcaactctatcatttttcccgatgggcaaaggcacaggggcttctgtcggaaaagaaggaggaagcttcatcccagtgatttgatgatgctaacacattcttgagtggagcgattttaaagattttgcatttgaacttggtgatgtatgaataattgattactgattgtaagaaacggctcgtggaaactgtaaaagattgtggctgtaccagagtattcggattagaaaggatttctcagaagtctaaactatttgttgaaggcatatgggtggttttaatatgtctaacatctgactgacccaaaagtctttaaacttatagcacaggcaaaggatttgtctatatctcacactgaaattccgttcaattactctacatagttgggggttaagaattgttctgtgactatttattcattgaaacttggatgtcatgttaataatttttgacgccctattctttctaaattacaatc

SEQ ID NO: 1795 - DNA, 611 bp, Helianthus annuus
ggtcagcagtcatatattccttccatggtaggtggtctgtctctgactggaggctgttagttctgacgtcatctaatcgccggcgacgaggtctgttaataacaagataatatatcatatatggccgcctttcgagcatttctgaacagtcctgttgggcctaaaaccactcatttctggggtcctgtagccaactggggatttgtcgctgcgggtctggtggacatgcagaaacctccagagatgatatcgggcaacatgactgcagcgatgtgtgtgtattccggtttattcatgaggtttgcgtggatggtgcagcctcgtaactatctacttctagcatgtcatgcctcaaatgaaaccgttcaattgtatcagctttcacgttttgcaaagcatcaagggtatttacagccgaaggaagagaagtctacatcaacttgaacgaatatgttatttgtttcgtttgtatctttgaagttgaatgtaattgttgatttgaaaaactaagctatcttggcagctgctttaaccaccttgattgatctcaattgatggtgatactgatgatggtcatcattattgttcttgggtgtttggttcaataaaga

SEQ ID NO: 1796 - DNA, 602 bp, Solanum lycopersicum
acgaacaccaccaactaaagagtagcaccactttatacacaatcgccaacagaagccctcagtttcagatctctcataaaggatatttcatatagcttgtcggaaatggcttcattcaaggcatttttgaacagccctgttggccctaaaacaactcatttttggggtcctgtagccaactggggatttgtcattgctggattggtcgacacacaaaaaccaccagagatgatatcaggcaacatgacctcagcaatgtgtgtttattctgcgttgttcatgagatttgcatggatggttcagcctcggaattatcttcttctggcatgtcatgcctcaaatgagtcagtgcaactctatcaactatcacgttgggcaaagagtcaaggatatttgcaacagaatgcagccaaagcagagtgatctagtgttctttcttgtttatttttggacagatttgcttggcatttctgaatgctttcatcaattgttgcaaaaatgtttataaagaatacattaaacttttgcagtttgaatgactgttggatctacacgttaataaacctagaaaaaagtaataatttttggaatcggttgagaaa

SEQ ID NO: 1797 - DNA, 575 bp, Utricularia gibba
attaacacgaggcatcaatggcttcttcattcaaatcctttttgaacagtccagttgggcctaaaacaactcatttttggggtccggtggccaactggggttttgtgattgcgggcctggtggacatgaagaagcccccagaaatgatatctggcaacatgacaggagcaatgtgcatttattccggtttgttcatgaggttcgcctggatggttcagcctcgcaactatctgctacttgcttgccatgcctccaatgagacagtgcaactctatcaactttcacgctgggccaagggccaggggtacttgggcgaggagaaaaaggaggctaagcctgtgtaagagacctcgcagattctctcctcttctccctctgctatttgtacttgacagaatctgtagtcccatgggattgattcgttgctgcactatcccacctcatgcggtgagcataaataagaaccagagcctttgatttatactttctcacgtgttgcattttcttctcttggatttcattctcaaaacaaataaattcaagctcttccttgaaccaaaaaaaaaaaaaaacac

SEQ ID NO: 1798 - DNA, 1030 bp, Triticum aestivum
aaaatcgttcctcttctccatctactccaccaaacccccatccccatctctcctcccctaggctcgccttcgccgtcggtcgggctccctctccgacacgccgccgtcgatacatccacccgaggcatggcgacggcgttcaaggcgttcgtgaacagccccgtcggccccaagaccacccacttctggggccccgtcgctaactggggcttcgtcctcgcgggtttggttgacttgaacaagcctcctgagatgatatctggcaatatgacagccgccatgtgtgtgtattctgggctctttatgaggttcgcgtggatggtacagccccggaactacttgcttctggcatgccatgcctccaacgaaaccgttcagctctatcatttatctcgctgtgctagggctcaggggtatctggattccaagaaagagccggaggcccaacagtaaagggtgtggtgtttctgaagtcggaggagccttgattccgcagccagcctttcaataagtaaaatttgtttctgaagctttgcaatgcccttcatgagaaaaaacctataaagtggaaatttctatttctatgatactcatgcctgcaatgtagcattacagctttcttgttcctgaatcatggtacatgacatattttttcttgtcaatgcacatagccggggttcaagttatcgaccccggagccgctgcttgattttactgttgatttcgaccacgtccatagtatattttgccttgtccccgccacaaagttgtgtaaaccacagccgcgttctttgcagttttggatgaccccctcggttccatttgtttatcaagggtatctacagtgcatgggatatccagcggatctacctttcgtccttgctttgagattcatgtttttttgggggtttcggctaatatttgtcttgtttcagacgtattgcataatgtttcgttggttgtttcctttttctaaagtgtaccatcataagagcaactccaacacggcgatccattttgtccgcttgcg

SEQ ID NO: 1799 - DNA, 721 bp, Echinochloa colona
tcttcgtcaacacctcgccgccgccagaggtcgacgacgaccagcgacgaaggttcgctgaatccttggagaaatcattcgccatgtcgacggcactcaaggccttcatcaacagcccgatcggccccaagaccacccacttctggggtcctgttgcaaactggggtttcgtccttgcgggtttggttgacatgaacaaacctcctgaaatgatatccggcaatatgacagcagccatgtgcgtgtattcagggactctttatgaggtttgcgtggatggtacaaccacggaactacttgcttctggcatgccatgcttccaatgaatcagtccagctctaccagttatccccggtgggctagggcccagggggtatctggagaagaaagaaccagaggctcagcagtagaattgtgtataaattgcatttaccttcccaataagagtgacctgccggagcagtttccaatgctgaatctggtagacaaatcccagaaaacaatttttatgccatatgtagtgttacaagtgtttttccctcattctatatatggtgctcgtatcacagaatcaaaaacttgactgacgatcgcgttcatgcctcgtttttcttctgatttgatggctgtaaaaacacacatcacatggtctgaaagtgttaatcccaatctctacttggcaatcgcccttcagtcgtgtgtggtcggcgtctctcaaggc

SEQ ID NO: 1800 - DNA, 586 bp, Brassica oleracea
attccatcctcgctcgctctcaaatctctcaaatcctcttcgcatcgcatccctcaggtggataaaatggcagcatcagggttccaagcgttcttgaacagtccggttggacctaaaacaacccatttctggggtcctatcgctaactggggctttgttgctgctggtttggtggatatgcaaaagccccctgagatgatctctggaaacatgacttcagccatgtgcatttactctgcattgttcatgagatttgcatggatggttcaaccacgcaactatttactacttgcctgccatgcttccaatgagactgttcagctctatcagctctcgcgttgggctagagcccaagggtatctatcctcgtcaactaaagaagaggagaaaccggctcagtaaactgaaatgaggaaagctttcttcagtgctgcttctgatgatcaacgattgaccatcagcatatctgttcttgggaattaatgaatccttaatccatctatttgcttttccttttgaaacgtgtttgtcttctatggttgatctacttgttgaatccttcatttacatatatctcttttgtttg

SEQ ID NO: 1801 - DNA, 667 bp, Brassica oleracea
atctctcgacttgttttgttattccatcctcgctcgctctcaaatctctcaaatcctcttcgcatcgcatccctcagggggataatatggcagcatcagggttccaagcgttcttgaacagtccggttggacctaaaacaacccatttctggggtcctatcgctaactggggctttgttgctgctggtttggtggatatgcaaaagccccctgagatgatctccggaaacatgacttcagccatgtgcatttactctgcattgttcatgagatttgcatggatggttcaaccacgcaactatttactacttgcctgccatgcttccaatgagactgttcagctctatcagctctcacgctgggctagagcccaagggtatctatcctcgtcaactaaagaagaggagaaaccggctcagtaaactgaaatgaggaaagctttcttcagtgctgcttctgatgatcaacgattgaccatcagcatatctcttcttgggaattaatgaatccttaatccatctatttgcttttccttttgcaacgtgttggtcttctatggttgatctacttgttgaatccttcatttacatatatctcttttgtttgaaataagtaaccgcttgtaataaaattttcggaccagtcgcaaagtcttcacaaattgctt

SEQ ID NO: 1802 - DNA, 620 bp, Brassica rapa
tgcagggtggataaaatggcagcatcagggttccaagcgttcttgaacagtccggttggacctaaaacaacccatttctggggtcccatcgctaactggggctttgttgctgctggtttggtggatatgcaaaagccccctgagatgatttctggaaacatgacttcagccatgtgcatttactctgcattgttcatgagatttgcttggatggttcaaccacgcaactatttactgcttgcctgccatgcttccaatgagactgttcagctctatcagctctcgcgttgggctagagcccaagggtatctatcctcgtcaactaaagaagaggagaaaccggctcagtaaacttaaatgaggaaagctttcttcagtgctgcttctgatgatcaacgatttgaccatcagcatatctgttcttgggaattaatgaatccttaatccatatatttgcttttccttttgaaacgtgtttgtcttctatgttgaatccttcatttacatatatctcttttgtttgaaataagtaaccacttgtaataaaattttcggaccagtcgcaaagtcttcacaaattgctttataggttttgccggcaggaggtgaccgaccatagt

SEQ ID NO: 1803 - DNA, 750 bp, Brassica napus
tggacgcctgcggcaccggtccggacttccgggtcgagcacgcgtccgattccatcctcgctcgctctcaaatctctcaaatcctcttcgcatcgcatccctcagggggataatatggcagcatcagggttccaagcgttcttgaacagtccggttggacctaaaacaacccatttctggggtcctatcgctaactggggctttgttgctgctggtttggtggatatgcaaaagccccctgagatgatctccggaaacatgacttcagccatgtgcatttactctgcattgttcatgagatttgcatggatggttcaaccacgcaactatttactacttgcctgccatgcttccaatgagactgttcagctctatcagctctcacgttgggctagagcccaagggtatctatcctcgtcaactaaagaagaagagaaaccggctcagtaaactgaaatgaggaaagctttcttcagtgctgcttctgatgatcaacgattgacaatcagcatatctcttcttgggaattaatgaatccttaatccatctatttgcttttccttttgaaacgtgtttgtcttctatggttgagctacttgttgaatccttcatttacatatatctcttttgtttgaaataagtaaccgcttgtaataaaattttcggaccagtcgcaaagtcttcacaaattgccttataggttctgccggcaggaggtgaccatagtaacttcacatgttttattagagt

SEQ ID NO: 1804 - DNA, 799 bp, Raphanus sativus
ggccacttgtgttttgtcattcctccttcacttatttctcggtctctcttctctccttcaccattcttagatcatcgatctgtcttcttagacccctttggcatctctcagtgcaggcggatttgggtagatagaaatggcaacagcatcaaggttccaagcattcttgaatagccccgttggacctaaaacaacccatttctggggtccgatcgctaactggggctttgttgctgctggtttggtggatatgcaaaagcctcctgagatgatctccggaaacatgacctcagccatgtgcatttactctgcattgttcatgaggtttgcctggatggtccaaccacgcaactatttactacttgcctgccatgcttccaacgagactgttcagctctatcagctctcccgctgggctagagctcaggggtatctatcctcaacgaaacaagaggagaaaccggctcagtaaactgtcacaaggaaaggtttcttcaacgcctctgcttgcttctgatgattaacgaaacggatcatctgcatatctcttcttgggaattaataaattctgaaaccatctgtttgcttttactttgaaacatatttgtgttgtgtccccaagctatgatgctttacttgttggatccttcattaacatctctcctttttaataaaattggggatccaaaatgaaaggccatagtggttttatatcatttttgaatgagacagagagtgagttcattatataaattctatttattaatatatgaaataataataaaactcttatcaagca

SEQ ID NO: 1805 - DNA, 450 bp, Brassica juncea
aacgaagaaggcccaacccacttgcatctctctcgagacttgttttgttattccatcctcgctcgctcactcctctctcaaatcctcttcgcatcgcatccctcagggtggataaaatggcagcatcagggttccaagcgttcttgaacagtccggttggacctaaaacaacccatttctggggtcctatcgctaactggggctttgttgctgctggtttggtggatatgcaaaagccccctgagatgatctctggaaacatgacctcagccatgtgcatttactctgcattgttcatgagatttgcatggatggtgcagccacgcaactatttactacttgcctgccatgcttccaatgagactgttcagctctatcagctctcgcgttgggctagatcccaagggtatctatcctcaactaaagaagaggagaaaccggctcagtaaa

SEQ ID NO: 1806 - DNA, 552 bp, Brassica napus
ttttgttattccatcctcgctcgctcactcctctctcaaatcctcttcgcatcgcatccctcagggtggataaaatggcagcatcagggttccaagcgttcttgaacagtccggttggacctaaaacaacccatttctggggtcctatcgctaactggggctttgttgctgctggtttggtggatatgcaaaagccccctgagatgatctctggaaacatgacctcagccatgtgcatttactctgcattgttcatgagatttgcatggatggtgcagccacgcaactatttactacttgcctgccatgcttccaatgagactgttcagctctatcagctctcgcgttgggctagatcccaagggtatctatcctcaactaaagaagaggagaaaccggctcagtaaagctttcttcaaccctgcttccgatgatcaacggatcatcagcatatcagttctaggaaattaatgaatccttgatccatctatttctattttccgttataacgttgttctcttcgtctacccactagtgtatgtatttacttgg

SEQ ID NO: 1807 - DNA, 609 bp, Cyclamen graecum
ccgcaatcgctctctcactaccgttaagataccttttacatagcagtttccacagatggcttcattccgagcatttcttgacagtcctgttggacctaaaacaactcacttttggggtcccgtcgctaactggggattcgtcattgccgggttggtggacatgaagaaacctcccgaaatggtatccggcaacatgactgcagcaatgtgcgtatattctgcattattcatgaggtttgcgtggatggtacaaccacgtaactatctgcttctagcctgccatgcctcgaacgagacggtgcaactctaccagttctctcgttgggcaaaagctcatgggtatttaggggcgcaaaagaaggaagaagctgcaactgagtgataataagcatatttatctttccatttctgcgcgtaataacatttctgcgcatattggtcttgggcgaaataagtatttgttgtgttctaatcaaggcgggatcaaatagaccttgaatctttctattattttgcggtttatatttggactggctttgtcattggacaatagcctgataaaatcgattcgaagaaatttgaattccaatggccataaattcgtcactt

SEQ ID NO: 1808 - DNA, 3226 bp, Cicer arietinum
ctttgcttgaattaattattaatgtttgataactgttcatgaatttcacaatctttgatagagaatacaattgcttcttagctaactactgataccattctgctgtttaaaaagaaaacagatggtcaatcaaagaaacctgttagggatattaacctaatacaaataatagaagagtaaagcaccataaatttaatgatgaatcattatgaaaattcaaaattattcactaatcaaattattaagaatagacatatttccatatatatcgtgtatgaaaattcaatgtatagttaatattcaatactactaatattctttgaaagactacgaaggaaacgagtgagggccttcttagccctaatctctgctttctctatttttttctcctcttcttcattagcagccttcatttcttgaacaaagtgcactttacgtacgagctttctcagctcctgcaagagatggtaaaaatgtgtcaaaaacaaaagacatttttatgccaataaacggaaacaacaacccgatcagcaaacatgtaatataattcactctgaaaacactcttttccattagattattttaggtgaatctcactgaagacctaggcttattctctatttaatacaattcacatgaaattcacccagtaataaagactgggttgaaaatattggatgtatgtttcaccaggaactgtaattgatcttgtcctgaaagtgcaagcatgcacaaatatgcatcaccttgatcatgccaagttcaaaatattacctgacgatcaaactcaacaccctgaactgaataaacttcattggtgatttgaatgtccttttcgaccaaaccatcaaaccaccttgttacttgattatcatcaacctgcatagattcccgatcagatgctccaacaataagaatacatcacaaggacaaaactcatttaaacaaagtaatatcatagaaagcataaatgaaaagaaattacaccctcccgatatgaaaaagagattaaggttcatcattgtacttagcgggctcatgtctagtcagtaagaaatgtaagcatgaactcatacctcatcctcctcctcgtcttcagtttctgtcaagttatcatcatcatctacagaatcatcagaccctaagccagttaaagcttgcagctccttgtgatcagaatcccttgtggcttttattaatcgatccattaattccggttccacgtcccgtagcaattttcctgaaacgacgatttatgtatgaaaaaaatgaatctgccatgcactgcagaatatacataatatcatgctaaatcactagatcttatcaacttactacacacattgaatgattactgacaaatgcagtctactataaagctaagatatacctataccaattcataaatgatgcaaaaaaataaaattggaaaggtaataacatgaatgaatgcttaaagctgatcataaatattgaactaatcctcatatatactgtgctgtcaacccaaatacagaacagaagataatggtttacctatataattgaactgacgccgtcttccttcgcggacatctgatcccattctctgcggcaaaacaacaaacaccttgtcttcaataaacatgcactagtgaaaaacacatcatttatatatactgataacaagacaagtaagtaggatgcggaaaagcaaaagcaagaaccttaaccaacataagtgcttcgtagacaatttggtccaaagaaaccaccctgcaacaacccaaaaacaaaatattgaagctctcatttcatttagcaaaaagattgaaagttttggaagtggagcattgaaaaattgaaaggaagaaaaactaacctaagaatacgtttgatttgtggaggagagaagttagacaaatccattccccatttgacagcacgtttagcttcacgcttcaattggttacgactcttaaagttagggtcttcttcatcttcgttgaattgggtagtagtggtgttgggtagtggaacattggctcttcgaaggtttccgcgaggggaagaagctaaggagaaatcacgagtgtttgtgggttgtgtaagtgttgatgatgatgatgaagttagaagaggaatttggtggtggtataatagtgcagcaacattgggagaagtgcgatggtggttgtgaaagtgcaaaacccaatgtcttagagaccgtagtactacttgctggctcatattttcatgtgtgaatgaacatcaacaatacaatgctcttccttttctattattttgtattcattaattgaaaaagtaaaacttataaaaaaaagtggagatgcgggggatcgaaccccgtgcctctcgcatgcaaagcgagcgctctaccatttgagctacatccccttttgtttatgttactaacaatattttatttgcctaattggtttttataagacgttattgttgtccgaccaattaaagtcaaaactcgaaagcattttcagatttgtttggcttttctcttcccaacatcaatcaaggccgccgatccttcttctctctctccagttttactttcagtagaagtgatatcttatggcttccttcaaagcatttttgaacagtccagttggtccaaaaacaactcacttttggggacctgttgccaactggggattcgtagcagctgggttggctgacatcaataaacctccagaaatgatttctggcaacatgacaggagcaatgtgtatttattcagcattgttcatgagatttgcgtggatggtacagccacgaaactatttacttcttgcatgtcatgcttcaaatgagactgttcagctctatcaacatacccgatgggctaaggcagaagggtatctctcggggaagaaggagaaagctccatcaagtgaatgaagttttttgaaaagatcgtgtttgaacttgtcgatgtatgaataattgattgatagaattgattgtaagaaagggatcgtggaaactccaaatgattgagaatttgcagagtatttgcttttgtaaggatatcaaataagtatattatcaaaggtttgatggtttttaaactgccctagagaagtctttcaacttttattttaagttaggaagggaaattgatatttattcaaataatgacattaactatcattttacgccattttagagagaatttgaacttcatactatgagattacaaaatcaagtt

SEQ ID NO: 1809 - DNA, 679 bp, Eschscholzia californica
gtctctctctctcggagttctgaaatctccttattcggtttaaagcagaaatcgattggaaatggcagctttcaaagctttcttgaacagtcctgtgggtcccaaaacgactcatttttggggtcctattgctaattggggattcgtcgttgctggattggtcgatatgcagaaaccccctgaactgatatctggcaacatgactggagcaatgtgtgtctattcggctttgtttatgaggttcgcatggatggtacaaccacgtaactatttgctcctagcatgccatgcttcaaatgagactgttcaactttatcagctccaacgttgggcaaaagcccaaggatacttggagaagaaggaagaagcaaaagtacctgagtagacttttgacccatctctctgctgtttccatctcaaattacatttggacttctgctcaatctttctgcaagacagttactgtttctttgttgtgttaaatctttatctgacaccatttgaatatgaagttactagtcatttgcttagtcgagtaacgggcaaatgaactcatttatttcaatcttgaatttgttagcttctgaaaggaggtactgtttgagcagctgtgcataaaaacacgaagtttcattacttcaatttctaaaagcttaaaccatgaaaaagtatgattttc

SEQ ID NO: 1810 - DNA, 565 bp, Fraxinus spp
gttgcagactccatggcttccttcaaaacatttttaaacagtccagttggtcccaaaacgactcatttttggggtcccgttgctaactggggatttgttattgctgggcttgtggatatgcaaaaacctccagaaatgatatctggcaacatgacggcagcaatgtgtatatattccgggctgttcatgaggtttgcatggatggtacagcctcgcaactatttacttcttgcttgccatgcttcaaatgagtcggtgcaactttatcaactttcccgttgggccaagggtcaagggtacttggggggagagaagaagggcgaggcctcatctcaatgaatcggtattgccttttcttcttggacaatcacttcatcctagaaaacatctctcataaggagcttttggttgtggatttccatgcaattctatttatttcatatcttgaaaaatattggatacggatttctttcttgatatgtcattagcaattactagaacataataaaacggtgtgattgtctaagaaacgtggatcaaaaactatgtatcgagcctaatgaga

SEQ ID NO: 1811 - DNA, 669 bp, Tropaeolum majus
tggattcatcgccccccatctccatctccatcggcaagtaatcatatatggcatcatccttcaaagcattcttgaacagccctattggtcctaaaaccactcatttttggggaccaattgctaattggggtttcgttgctgctgggttggcagatatgaacaaaccgcctgaaatgatttcgggaagaatgaccggagtgatgtgcgtatattcagcattgttcatgaggttttcatggatggtacaaccacgtaattacctactcctaatattccacgcttcaaatgaaactgtccagctctatcaactctcccgttgggcaaggggacaaggatatttgtcgtccgagaagaaagatgaagcctcctctatatgatgcaactcagcctctgttttcactgttctaatttgttgttttcctgtatctgcacgagctcgttagttaacttcgttcattggaagcttatgtttcggttcttcagaatgcgttgaccataactctgcatctctatttcaagtatcatctcaaatgtaaaacaatattagaagtaaagttatgtgcatcaccatccccatatcttccgtttattcatcacgcaactacaaaaagttccaatgcaactaacttaatcttctcaagtatattatttcatctatcctaatatatt

SEQ ID NO: 1812 - DNA, 782 bp, Lippia dulcis
accaccaaacaacgacttagcaagctgaagcacgggcatcgctccttttctttcgcacacaacacacagtgggaaaaggagaatctccgataaaggtttgtttattcctgactcatcatggcttccttcaaagcatttttgaacagtcctgttggtcccaaaacaactcacttttggggtcctgtagctaactggggattcgtcattgctgggctggtggacatgaaaaaacctccagaattgatatctggcaacatgactgcagcaatgtgcgtatattctggattattcatgaggtttgcatggatggtaaaacctcgcaactatctgttgcttgcctgccatgcttctaatgagaccgtgcagctctatcaattatcccgatgggccaagggtcaagggtacttgggagagaagaaagaggaagcatcctcgtctcagtgaactatgccccctcttgcaaggtcttcattcctccacccccaaccaaacatgaatgaacaggaaaacaaccccgggcgcataaaaccttttcttattctggattcttgtcagtcttaaatttctcagattgttacactttgtatttgatgtaacattgaattcgaaaatttcttactttatgctggttgtactttgctttttcatattccctgactgtgccactgatagttatcaaaatataataaaaccacatgttaagtgtaaaaagcattcaatgtgtctgtaagcctgaaattgtgcgtttgcaaacctactttatttccttagtttaaaaaaga

SEQ ID NO: 1813 - DNA, 673 bp, Echinochloa colona
tcgtcggcctcgcccgctgcgccgccgccgtcggcgaaagctgcgcgaggtgatttcagcttccgcggggagcgaattccgccatggcgacggcgctcaagtcgttcctgaacagccccgtcgggcccaagacctcccacttctggggacctgtcgccaactggggattcgtcctcgcgggtttggttgacatgaacaagcctcctgaaatgatatctggcaatatgacagcagcaatgtgtgtgtattctggactctttatgaggtttgcatggatggtacaaccgcgaaattacttgcttctggcatgccatgcttccaatgaaagcgttcagctctatcagttctctcgctgggctaggtctcaggggtacctggagaagaaagaaccagaggcgcagcagtaaagatggtatggaacgctgccgtcatttgttcaataatgaaatcttgtttgcggagcattgtaaacattgtgaacaaacacacaccctgtgaccatgaagtttctgcatgctgcaaaatatgctgttgaaatctctaggatacttgtgcttcattataggttttcattcgcattactgtgctgcaaatctgtccttttcaatgtgggattgcagtctttcttgcctcaaacttatgcatcccattgatattacaattaaatgtttgg

SEQ ID NO: 1814 - DNA, 684 bp, Echinochloa colona
tcttcgtcaacacctcgccgccgccagaggtcgacgacgaccagcgacgaaggttcgctgaatccttggagaaatcattcgccatgtcgacggcactcaaggccttcatcaacagcccgatcggccccaagaccacccacttctggggtcctgttgcaaactggggtttcgtcctcgcgggtttggttgacatgaacaaacctcctgaaatgatatctggcaatatgacggcagccatgtgcgtgtattcaggactctttatgaggtttgcgtggatggtacagccgcggaactacttgcttctggcatgccatgcttccaatgaatcagtccagctctaccagttatcccgggtggctagggcccaggggtatctggagaagaaagaaccagaggctcagcagtagaagtgtgtataaattgcatttaccttcccaataagagtgacctgccggagcagtttccaatgctgaatctggtagacaaatcccagaaaacaattttatgccatatgtagtgttacaagtgtttttccctcattctatatatggtgctcctatcacagaatcaaaaacttcactgacgatcgcgttcatgccccgtttttctttctgatttgacggctgtaaaacacacatcacatggtctgaaagtgatgatcccaatctccttggcaattgccct

SEQ ID NO: 1815 - DNA, 685 bp, Avena sativa
actccaccaacccaaatcatcatccgcctccccaagctcctcgccgttgccctcgctcgtcaactcgtcgacctctctccccggaccgccgccgtcgaacaatttaggtgatttaagcgcaggtggggaagattctgacatggcgacggctttcaaggcgttcgtgaacagccccgtcggccccaagaccacccacttctggggccccgtcgcgaactggggcttcgtcctcgcgggcttggttgacttgaacaagcctcctgaaatgatatctggcaatatgacagcagccatgtgtgtgtattctggactcttcatgaggttcgcgtggatggtacaaccccggaactacctgcttttggcgtgccacgcctccaacgaaaccgtccagctctaccatttatctcgctgcgctaaggctcaggggtacctggacaagaagaaagagccggaggcccaacagtgaataggagtacgctgtctctgaagccaagacgtgtgtaactccagagtcgttctttcaaactcaaaataatctgagatctgtttctgaagctttgcaatgctcatcatgtgaccgtacagtttatgtgttacactgggcagtggaaacctctctgcctgtcatgtgcttactagcgtttacaacctgctcctgaagccctgattcgtaaggttttgtttt

SEQ ID NO: 1816 - DNA, 660 bp, Avena sativa
ccaatacccaccctccatctgctccaccaaccatctctcgcttcccctaaactcgcctttgccgtcgctcgcatactggtcggcctccctctccggcaagccgccgtcgatacatccactcgaggcatggcgacggcgttcaaggcgttcgtgaacagccccgtcggccccaagaccacccacttctggggccccgtcgcgaactggggcttcgtcctcgcgggcttggttgacttgaacaagcctcctgaaatgatatctggcaatatgacagcagccatgtgtgtgtattctggactcttcatgaggttcgcgtggatggtacaaccccggaactacctgcttttggcgtgccacgcatccaacgaaaccgtccagctctaccatttatctcgctgcgctaaggctcaggggtacctggacaagaagaaagagccggaggcccaacagtaaaagagaaggagtactttgtttctgaagccagaggtgttactccagagtcattcttccgaaataatcgagatctgtttctgaatctttgcaatgctcatcatgtgaccgtacagtttttgtgttacactgggcagtggaaacctctctacctgtcatgtagcgtttacacaacttgttcctgaatccttgattcatgacgttttcttt

SEQ ID NO: 1817 - DNA, 532 bp, Avena sativa
ctcgcatactggtcggccttcctctccggcaagccgccgtcgcgtcgatacataaaactccaggcatggcgacggcgttcaaggcgttcgtgaacagccctgtcggccccaagaccacccacttctggggccccgtcgcgaactggggcttcgtcctcgcgggcttggttgacttgaacaagcctcctgaaatgatatctggcaatatgacagcagccatgtgtgtgtattccggactcttcatgaggttcgcgtggatggtacaaccccggaactacctgcttttggcgtgccatgcctccaacgaaaccgtccagctctaccatttatctcgctgcgccaaggctcaggggtacctggacaagaagaaagagccggaggcccaacagtaaaagagaaggagtactttgtttctgaagccagaggtgttactccagagtcattcttccgaaataatcgagatctgtttctgaatctttgcaatgctcatcatgtgaccgtacagtttatgtgttacactgggcagtggaaa

SEQ ID NO: 1818 - DNA, 402 bp, Avena sativa
gcatggcgacggcgttcaaggcgttcgtgaacagccccgtcggccccaagaccacccacttctggggccccgtcgcgaactggggattcgtcctcgcgggcttggttgacttgaacaagcctcctgaaatgatatctggcaatatgacagcagccatgtgtgtgtattctggactcttcatgaggttcgcgtggatggtacagccccggaactaccttcttttggcgtgccacgcctccaacgaaaccgtccagctctaccatttatctcgctgcgctaaggctcaggggtacctggacaagaagaaagagccggaggcccaacagtgaagaggagtacgttgtttctgaagccagataaagtgtaactccagagtcggttctttcgaaataatcgagacct

SEQ ID NO: 1819 - DNA, 889 bp, Ananas comosus
gggctcatttatttacaaatttaagtgtcaaggaactcgatcgacgacgacccaacaaaaccctagcctcgacctcggcctataaggtacctagcaagaaaagttgctatgtcagccttccgagctttctggaacagtcctgtggggccaaaaacaactcatttttggggacctgttgctaactggggcttcgtcgttgctggtttggtagatatgaacaaaccccctgagatgatatctggcaacatgactgcagccatgtgtgtttattcaggactctttatgcggtttgcatggatggtaaagcctcgaaactacctgcttttagcatgccatgcctccaatgaatcagttcagctctatcagttatctcgctgggcaagggcccaaggattcctggacaagaaagagcctgaggtgcagcaatagattctgaaagtgggttttatctttggtttattcaataaagaggtgatgttactgacgctttattttgtttagattgcaatttgaattgtttatactatttttatcaaagatcttgcgctggttctcctcctaaatctatctaaactgtgttgcgaatttgttgcttcgtggatttgcgattatctgttggtatccaagaagggattgatttttacccccccccccccccccccccccccccccccccccccccccccccccccccccccccccccccccccccccccccaaaataattggaacgactataggaatagtgtcagtagtaaaatactccgtttgggcttgtgtgagaaaattaggtcctattgtatgcaatgttagctgtgcactatgttataggatgcacatcttacatttcataattctagaatttaatagatccttttgattattatta

SEQ ID NO: 1820 - DNA, 801 bp, Amsonia hubrichtii
gcttgtatatccgttagcgaatcccccttcgtcctggttagggcgacgactcattccattccttcttgccttcgagccccggagcttgctgggtagtgaatggtccatgaaggttaaataagatttgtttttaagcaagcagagtagttaagccggagaggcaaaaaaagaagaagaaagaagcggttttcatttgattgagggaatcaagcgtactttcactgctgtggatcgacgcatattataagaactttgcacaagaaaggcactatggcttccttccgagcattcttgaacagtcctgttggccctaaaacaactcacttctggggtcctgttgccaactggggatttgtcgtagcaggcctcgtggacacacaaaaacccccagaaatgatatctggcaacatgactgcagcaatgtgtgtatactcaggattgtttatgaggtttgcatggatggtacagcctcgcaattatttgctcttggtatgccatgcctccaatgaagtagtgcagacatatcagctatcccgttgggcaaagagtcaggggtacttgcagcagaaggaagagaagactacatctcagtgagatgatctttttggaccttgcttcttcaatttcttcactcatggtcgttcagtgactgtttgaaactgtctttgatcaagatgaggcaagcagtcatgtaaacacattggcttatcaaatttaatggtcttatttcatatttcggatgtattggttcgtgtgatcatgaaacctgaacccagtaaacacaagatggtgaaagttttt

SEQ ID NO: 1821 - DNA, 1048 bp, Hordeum vulgare
agggcacaaaatcgttcctcattctccatctactccacgtctccaccaaacccccatccccatctctcatcccctaggttcgccttcgccgtcggtcgggctccctctccgacacgccgccgtcgatacatccacccgaggcatggcgacggcgttcaaggcgttcgtgaacagtcccgtcggccccaagaccacccacttctgggggcccgtcgctaactggggcttcgtcctcgcgggtttggttgacttgaacaagcctcctgagatgatatctggcaatatgacagcagccatgtgtgtctattctggactctttatgaggtttgcatggatggtacagccccggaactacttgcttttggcgtgccatgcctccaacgaaaccgtccagctctatcatttatctcgctgtgctagggctcaggggtatctggattcgaagaaagagccggaggccaaaaagtaaatggtgtggtgtttctgaagtcggagcctggagccatgattccgcagccagcctttcaataagtaaaatttgtttctgaagctttgcaatgctattcatgagaaaaaaacctacgaagtggaaatctctatttctatgatactcattcctgtaatgcagcgttacagctttcttgttcctgaatcatggttcatgacatattttttcttttcaacaatgcacatagccggggttcaagttatccaccccagagtcgctaattgattgcactgttgatttcaaccacgtccatagtatcttttgcttggtccccgccacaaagttgtgtaaaccacagtggtgttccttgtttttttggatgactgcctcggttccatttgttttccatttgtttcttgagggtatctaccgtgcatggaatatccagtgcatctaactttcgtcgttgctttgcgattcaggctatgtttttctagttttggctaaaatttgtcttgtttcaaaagttttgtgtaatgttccataccctgcacgttgttgcgggaatattttgcaatatatttcgatgtcatttgttgt

SEQ ID NO: 1822 - DNA, 902 bp, Cycas rumphii
ggtggagatgtcacccaatattgtttgatataatatgtacatacattaggatatggcacagagacaatacctacttctttagcgtacttttgaatatacatacatctatgtaaagagggcgtagaatcgtaagtagcggcggttccaggagtttcacaggacgatcctctgacatcatcgagaggagttcaattcaggtacacacagggcaattttagaggctctggaacaagggatggcggcactccgtgctttttggaatagtccagtaggccccaaaacaactcacttctggggtcctgttgctaactggggtttcgttgttgctggtttagttgatatgcagaagccgccagatatgatctcaggaaatatgactggagtaatgtgtgtatactcggcactgtttatgagatttgcctggatggtacagcctcgcaattatctgcttttggcttgtcatgcctcgaacgaaactgtgcaactttatcagctgtctcgatgggcttctgctcaagggttcttgtcaaagaaagaggaacctgagaagcaatgaagatacttttattcattgttgcctgttttaccccagatcctttagcagtgaagtttgaaataaaagttgcattgtcaatatgacattttagtgcaggattcaggaatattgttgattatgacgaaattagtgttgtcattgttaactacgtgattgaagctctgtgctgaaagcatcatttggatcaccgaagacaagttacaaccctgcttttattaattggcaaatatttcaattgagtacttgctaagatgcttttgatgtttgggttaaacctacctgtattacgctggtgtaaagaactctaaacaaatccacagctttgcaaaaaatccagtttttcaaa

SEQ ID NO: 1823 - DNA, 617 bp, Solanum melongena
atacagaggtaattttgataatcggagccattttttcggagcaactctacgtttcagatctctgattaaggaaattccacagtgtgtcgcatatggctaccttcaaagcatttttgaacagtccagttggccccaaaacaacacatttttggggtcccgtagccaactggggatttgtcattgctggacttgtagacacacagaaaccgccaaaaatgatatcaggcaacatgacttcagcaatgtgtgtgtattctgcactgttcatgagattcgcatggatggtaaagcctcgcaattatctacttttggcatgccatgcctcgaatgagacagtgcagctttatcaactatcacgttgggctaaaggtcaaggatatttgcagaagaatgcagacaaagctgtgtgatccagtcttacttcacgttggacctgtatgtagttttggtaattttccatctttctttaatacaggttattgtccttgatcatccaagagcttaactagcagctcaaagtattatacatattttcttatgccacagtaagatagcataatttgaatggcaagaaatgtaagtatgaaagaatttagtatgtttgtgatttcactcag

SEQ ID NO: 1824 - DNA, 715 bp, Panax ginseng
aaagcgcccaaaatatccaatagcaatagattgtaaatctttttttcttaacttgtctcagccgcaccacggcaccagaccatcgcctattcgacaattcttccattcgaagcacagtcacttgtcggaccaaagatctccgataatctagtctaaacagcagaatcaaatggcttcttctttccgggcatttttaaacagtccggttggccctaaaacaactcatttttggggtcctatagccaactggggatttgttatttcggggctggtagacatgcaaaagccccccgaaatgatatcgggcaacatgactggagtactatgcatatactctgcattattcatgaggtttgcatggatggttcagcctcgcaactatctacttcttgcatgtcatgcctcaaatgagtccgtgcagctctatcaattctcccgttgggcaaagactcaggggtactttctggaaaagggtgacaaagccgcacctcagtgacttgctgctgcttttctttttcctttcatcaagcaacgtaatcagatttctattgtgtggtgcttaccacattaaacaattatcagtgtggtgaaatttgtgtttgattaaaaccaagtgaatttgaaactttgcagatcacttgagtaaatcgtgtttaattactaattgaatgtcatttctgttgaataatgagaatgagacaaatggttcatttaa

SEQ ID NO: 1825 - DNA, 708 bp, Panax ginseng
aagcagtggtatcaacgcagagtacatggggagagcgtaaatcctccgaatctccaatgtcaaagcgcccaaaatatccaatagcaataggttgtaaatctttttttcttaacttgtcttagccgcaccagaccatcgcctattcgacgattcttccattcgaagcagtcacttgtcggatcaaagatctccgataatctagtctaaacagcagaatcaaatggcttcttctttccgggcatttttgaacagtccggttggccctaaaacaactcatttttggggtcctatagccaactggggatttgttatttcggggctggtagacatgcaaaagccccccgaaatgatatcgggcaacatgactggagcactatgcatatactctgcattattcatgaggtttgcatggatggttcagcctcgcaactatctacttcttgcatgtcatgcctcaaatgagtccgtgcagctctatcaattctcccgttgggcaaagactcaggcgtactttctggaaaagggtgacaaagccgcacctcagtgacttgctgctgcttttctttttcatttcatcaagcaacgtaatcagatttctattgtgtggtgcttaccacattagacaattatcagtggtgaaatttgtatttgattaaaaccaagcgaatttgaaactttgcagatcactcaagtaaattgtgtttaatt

SEQ ID NO: 1826 - DNA, 631 bp, Nicotiana benthamiana
gccaatcgaagccactgttagaaccatccttcagtttcagatcttccataaagggtatttcatatagctcgtcgcacatggctgcattcaaggcatttttgaacagccctgtgggtcctaagacaactcatttttggggtcctgtagccaactggggatttgtcattgcgggactggtcgacacacagaaaccaccagagatgatatcaggcaacatgacttcagcgatgtgtgtgtattctgcattgttcatgagatttgcatggatggtacagcctcggaattatcttcttctggcatgccatgcctcgaatgaatctgtgcaactctatcaactatcacgttgggcaaaaagtcaaggatatttgcagcagaatgcagccaaagcagagtgatttagtgttctctcttgtttttttggacaattttcgcatgtcatttccgagtgctttcatcaattgttgcagaaaaaattgcctttgataatccaagagctgaacttgcggcctatttccaagtaaatcttagtactattagtactgggacttttggtattcattatcatgtctataagaactgccacaataatacagcatgtttttaatgcacgacatgttattaaatttgcagt

SEQ ID NO: 1827 - DNA, 905 bp, Petunia hybrida
aagtgtgtaacaaaaagcaggacggtaccggtccgaattacctcgagacactgttggcctaatattcaccattcgcatttaataacaccactctacaaaaaattctttctcgcagcctttgacgtacaccaaccactaaaggaccacccctattatacacctaaggctttgccaatcaaagccactatttgcttaattttcagatcttccattaaaggatattccatatagcttgtcacacatggcagcattcaaggcatttttgaacagccctgttggccctaaaacaactcatttttggggtcctgtagccaactggggatttgtcattgctggactggtcgacacacagaaaccaccagagatgatatcgagcaacatgacctccgcaatgtgtgtttattctgcattgttcatgagatttgcatggatggttcagcctcggaattatcttcttctggcatgccatgcctcgaatgagacagttcaactataccaactatcacgttgggcaaaaagtcaaggatatttgcagcagaacgcggccaaagcagagtgattgtgtgatctttcttgtttatttttggacactttctgcttgtctttctttgagtgctttcatccaagagctaaactatcagcttacaaatctcagtactataatactgagacttttggggtatactatcatacctacaagaattgccacaataacatcagcataatttcaatgcactccacccaagttttccatggttcgccaatatttttttccgtcgtggttcttcaacaataagtcgaaaaggtgggacagtcgtcacaacaaagaggacagtcgttccccgtaacgaggcaaattgtttgcgagtagatatccctagacatcaccttattgcagctggggg

SEQ ID NO: 1828 - DNA, 558 bp, Ananas comosus
ctcatttatttacaaatttaagtgtcaaggaactcgatcgacgacgacccaacaaaaccctagcctcgacctcggcctaaaaggtacctagcaggaaaagttgctatgtcagccttccgagctttctggaacagtcctgtggggccaaaaacaactcatttttggggacctgttgctaactggggcttcgtcgtcgctggtttggtagatatgaacaaaccccctgagatgatatctggcaacatgactgcagccatgtgtgtttattcaggactctttatgcggtttgcatggatggtaaagcctcgaaactacctgcttttagcatgccatgcctccaatgaatcagttcagctctatcagttatctcgctgggcaagggcccaaggattcctggacaagaaagagcctgaggtgcagcaatagattctgaaagtgggttttatctttggtttattcaataaagaggtgatgttactgacgctttattttgtttagattgcaatctgaattgtttatactatttttatcaaagatcttgcgctggttctcctcctt

SEQ ID NO: 1829 - DNA, 929 bp, Pinus taeda
ttaagagggaggtttccttgctattccacggtccacggtccaagagggagggcgcactgttcacccaccgttccaaagttgtgtactattattctattttacggtgataatgacgcaatcattccatcattgtctcaatgtgcatattgcggccgttttgatcaagcgagaagcaaaggcaacccccggcgtacctctgagtactgtgaaaccatcacaatccttttgctctttggcagatctgaagggtactttaagtagagccgaatcaaggaatggcagcattgcgaacattttggaacagtcctgtcggccccaaaacaactcatttctggggtcccgttgccaactggggcttcgtcattgctggcttggttgatatgcagaagcccccagatatgatatcagggaatatgactgcagcaatgtgcgtatactcaggattgttcatgagatttgcctggatggtgcagccccgcaattatttacttttggcttgccatgcctcaaatgaaactgtgcaactttatcagctgtctagatgggcttctgctaatgggtacctatcaaagaaagaggaagccgagaagcaataaatgtttctgccatgtgatatttgcctttcattcctattctctgcaatatgcgttttttattttggctgttgattatgatgaaaatgttggggtatttgctgaaataccaattccttgtggtgcgattccagttatcaaaaaattaagtataggcatgatgctttcatattagtttggtaatttggtctaaagctaggaattgcattagacaagcacaagaaaagttgacaatttgtagcttttagagaagtattttgtcctttttatcactcgtgagatcttaaataattttttctgttttaaattcttgagcatttgaatcgtcttgtggat

SEQ ID NO: 1830 - DNA, 860 bp, Pinus taeda
tatagtgcatattcagattgcaattacagacgtattagaaccagattttccgcttcgatacagctcatcgagagcaacagagatccagatcaaaaaccagacagagtttacagaacatcgaaataccaagcccagggacagttaccctccggcgtacctctgagtactgtgaaaccatcacaatccttttgctctttggcagatctgaagggtactttaagtagagccgaatcaaggaatggcagcattgcgaacattttggaacagtcctgtcggccccaaaacaactcatttctggggtcccgttgccaactggggcttcgtcattgctggcttggttgatatgcagaagcccccagatatgatatcagggaatatgactgcagcaatgtgcgtatactcaggattgttcatgagatttgcctggatggtgcagccccgcaattatttacttttggcttgccatgcctcaaatgaaactgtgcaactttatcagctgtctagatgggcttctgctaatgggtacctatcaaagaaagaggaagccgagaagcaataaatgtttctgccatgtgatatttgcctttcattcctattctctgcaatatgcgttttttattttggctgttgattatgatgaaaatgttggggtatttgctgaaataccaattccttgtggtgcgattccagttatcaaaaaattaagtataggcatgatgctttcatattagtttggtaatttggtctaaagctaggaattgcattagacaagcacaagaaaagttgacaatttgtagcttttagagaagtattttgtcctttttatcactcctgagatcttaaataattttttctgtttt

SEQ ID NO: 1831 - DNA, 715 bp, Oryza sativa
gtgaatttggcgtggagtccatgagaccatgacccattctactgattcattttcttcttttgagtgaatttgttcccaaatcccaacccaccccacctccaaatctccaatcccctcgctccctaaatcacgctcgtcaaccgcgtcggcctctccaaccgccgccgcctccgccgccgtcgccgtcgccgtcgtcccgtagctaagtggtgatttggagcagctcgggaggggcagattcccgggcatggcgacggcggcgaaggcgttctggaacagccccgtcggccccaggaccacccacttctggggtcccgtcgctaactggggcttcgtcctcgcgggcttagttgacatgaacaagcctcctgaaatgatatctggcaatatgacagcagccatgtgtgtgtattctggactctttatgaggtttgcatggatggtacaaccgcggaactacttgcttctggcttgtcacgcctccaacgaaagtgttcagttatatcagttctcacgctgggcgagagctcaggggtacctggagaataaagagccagagggccagcagtaaagatgaagtctcttcctcaatgtaaagcttcgtttcctggatttctgtaacgctttattccgtgccctatagttgtctgcattgtgcattgtataaatatcttttatataaatatttggagaaaaataagtatttgtgactgaa

SEQ ID NO: 1832 - DNA, 1042 bp, Glycine max
gagatgaagtcatgaaacgcaaaaggcaatgccgtttcaagacagcaaaagaattaaattaaaggtcactgccgtactgttcctcctacccttcagatttgacttactctccggcgctgccattctttctttctatcttcaatcaatttcaagatcgtaacactggtattatatggcctccttcagagcattctggaacagtccagttggtcccaaaacaactcacttttggggacctattgccaactggggatttgtggcagctggattggctgacttgaacaaacctccagaaatgatctctggcaacatgacaggagcaatgtgtgtctattcagcattgttcatgagatttgcatggatggtacagccacggaactatctactttttgcttgtcatgcctccaatgagactgttcaactctatcacttcacccgatgggcaaaggcacaggggcttctgtcggaaaagaaggaggaagcttcatcccagtgatttggtgatgctaaaagactttcttgagtggagcgattttaaagattttgcatttgaacttggcgatgtatgaataattgattactgattgtaagaaggggcttgtggaaactgtaaaagattgtggctgtgcaagagtattcggattagaaaggattgctcagaagtctaaactatttgttgaaggcacatgggtgggtttaatatgtctaacatctggctggcccaaaagtctttaaacttataccataggcaaaggatttgtctattatatctcatactgaaattccgctcaattactctacacagttgggcgttaagaattgtactgtgactatttattcattgaaacttggatgtcatgttaataatttttaatgccctattctttctaaattgtaatctgagcatgaggaatgaataggtttctcggcataaccaaactgctagtcttcaagatcctctttcagttgcaccttacttaagcaaaagcggccttgaaaagatgattattcggttactctcatttttcttattaatatcaag

SEQ ID NO: 1833 - DNA, 495 bp, Thalictrum flavum
gttgtaaatggcagccttccgaacattctggaacagtcctgtaggtccaaaaacaactcatttttggggtcctgttgcaaattggggatttgttgctgctggattggttgacatgcagaaacccccagagctcatatctggcaatatgactggagcaatgtgtgtttattcggcgttgttcatgagatttgcatggatggtacagccacgtaattatctgcttctagcatgccatgcctcaaatgagacggtgcagctctatcagttctcacgttgggcgaaggctcaggggtacttggagaagaaaagcgaggaagctagtccccagtaaaccaccacccccacccctatggtttttataatttgccgttattgtttgcagacaattcgtatcagtgtaatattggacataatataagttttcatatacaattcaaaagcttccggatgttattttttctagtatgatttttttatcctgtaaaacaataaaca

SEQ ID NO: 1834 - DNA, 632 bp, Nicotiana tabacum
gccatcataacacaatcgccaatcgaagccactgttagaatcatccttcagtttcagatcttccataaaaggatatttcatatagcttgtcacacatggctgcattcaaggcatttttgaacagccctgttggccctaaaacaactcatttttggggacctgttgccaactggggatttgtcattgcaggattggtcgacacacagaaaccaccagagatgatatcaggcaacatgacttcagcaatgtgtgtgtattctgcattgttcatgagatttgcatggatggtacagcctcggaattatcttcttctggcatgccatgcctcgaatgaatcggtgcaactctatcaactatcacgttgggcaaaaagtcaaggatatttgcagcagaatgcagccaaagcagagtgatttagtgttctctcttgtttatttttggacaattttcgcttgtcatttctgagtgctttcatcaattgttgcaggaaaaaaattgcccttgataatccaagagctgaacttgcagtctatttccaagtaaatcttagtactatcagtactgggacttttgggattcattatcatgtctataggaacttccacaataatacagcatatgtttaatgcacg

SEQ ID NO: 1835 - DNA, 619 bp, Nicotiana tabacum
gccaatcgaagtcactgttagaaccatccttcagtttcagatcttccataaaggatatttcatatagctcgtcacacatggctgcattcaaggcatttttgaacagccctgttggtcctaagacaactcacttttggggtcctgtagccaactggggatttgtcattgcgggactggtcgacacacagaaaccaccagagatgatatcaggcaacatgacctcagcaatgtgtgtgtattctgcattgttcatgagatttgcatggatggtacagcctcggaattatcttcttctggcatgccatgcctcgaatgaatcggtgcaactctatcaactatcacgttgggcaaaaagtcaaggatatttgcagcagaatgcagccaaagcggagtgattttgtgttctctctcgtttatttttggacaattttcgcttgtcatttttgagtgctttcatcaattgttgcagaaaaaattgcctttgataatccaagagctgaactagcagcctatttccaagtaaatcttagtactatcagtactgggacttttgggattcattatcatgtctataagaattgccacaataatacagcatatttttaatgcacgccatgtt

SEQ ID NO: 1836 - DNA, 603 bp, Eschscholzia californica
gaaatctccttattaggttaaagcagaaatcggttggaaatggcagctttcaaagctttcttgaatagtcctgtgggtcccaaaccgaactcatttttggggttccgtattgctaattggggtagttcgtcgttgctggattggtcgatatgcagaaaccccctgaactcatatctggcaacatgactggagcaatgtgtgtctattcggctttgtttatgaggttcgcatggatggtacaaccacgtaactatttgctcctagcatgccatgcttcaaatgagactgttcaactttatcagctccaacgttgggcaaaagcccaaggatacttggagaagaaggaggaagcaaaagtacctgagtagacttttgacccatctctctgctgtttccatctcaaattacatttggacttctgctcaatctttctgcaagacagttactgtttctttgttgtgttaaatctttatctgacaccatttgaatatgaagttactagtcatttgcttagtcgagtaacgagcaaatgaactcatttatttcaatcttgaatttgttggcttctgaaaagaggtactgtttgagcagctgtgcataaaa

SEQ ID NO: 1837 - DNA, 522 bp, Fagopyrum esculentum
aggttaacagttaactacgaccgggacttcctctaatttgtcaaatttcccctttctgatcaacgacttctcgcctgatcttgagatcttctcccttcaatttattcagattcatctatctattttgagacatggcttctaccttcaaagcatttctaaacagtccagttggccccaaaacaactcacttctggggacctgttgcaaactggggattcgttgctgcggggctggtggatatgaacaaaccacctgaaatgatatctgggaaacatgactacagctatgtgcgtatactcggggttgtttatgcggtttgcatggatggtacaaccccgtaactgcttgcttcttgcatgccatgcttcaaatgaggcagtgcaactttatcaactctcacgttgggctagggctcatgggtatctagaggagaagaaggagaaactgaatccagatagtgttgcaaacgtgcagttatttgaccctctggtgtagtttggatatcctttctgcgtgtaattg

SEQ ID NO: 1838 - DNA, 6542 bp, Cannabis sativa
attgtttctcctgagtgcaagaccacatataaatcaagttaattaacctcgctgaccctaccattaatttccacgtagcttatatcaaacgtggcgtgactttaatggacaaatagctattcctcctggttctgcagctcagctgagttgctctctcgaataaaaccatataattattattaataaggaaagaataattgatttgaggagttgtgctgtgttagctctgttcaatacttcaatccgatcggatcatctactccggcgacccgacccattttctctgagcaaaggtagtaaacggatatggcttcattccgggcattcttgaacagtccagttggtcccaaaacaactcatttttggggcccgattgctaattgggggttcgttgctgcggggctagtggacatgcaaaaaccaccagaaatgatttctgggaatatgaccgcagcaatgtgtgtgtattcagcattgttcatgagatttgcatggatggtacagcctcgtaactatttgcttttggcttgccatgcttcaaatgaaactgtacagctttatcaattatcccgctgggcaaagggtcaggggtacttgtcggagaagaaagtagagaaagaagaaaaagaaaaatctgagtctcagtaacttgatgcttcttccagttttattttctatgttttgggtggtgattttctctgaaatcgaaactggtctcttatgttttgaaatgattgctttcattttaactgcctgcataagcaaaagagcatcccattttttgctgaaccttgatttacatccttgatgcatttgtcccatagtgtctcaaaggaagaaataaaattagtgaacaaaaagtacttgcatttttctggttatagaggataggactagaagaacataaggggaagttgacatgcaaataaggatttcaaaaatcgtattgatagatggctagccatggatcatcatggtggaggggagaccatacaacactccaaacctatgtctttaatattttagaattctatttctatcaattgtatattaatggcatttagaagtaaggtgaaacatatcatccaggtgaaagagaggaaaccgagtacccttcccttgttagtatgaaaggaaaagaagatcaaatcttatattattatttgatagttgggacttaggaggagaagtggaagaaattgcgagattttgttggagaatgatactctactacattctcataagattttccattatttgtgcaaatacattgaggggaatcgaaaccctgaatgctcacacacataggcactcacctactcagccacttgagcctttgcaatgtaagatcaaacatagatttaattgcagatttgaaaccctatagcttaatctcttcccttctaccaaattcatcgaaattctgttacctcatttgaaggccccagatagtgcaattcaaccagcccttgctgagttagtctatgtggatcacgtgctagattatacgagtactaggttgttatcttttgagttagtccatattgattaggtgcagcttatctttgaaaagttggaatggtgttcaattactgatcgatctgttaaaaggggagtgattgaaagaggagaaaagtaaataaatcgtatgatacttatgacttcgattttggcactaattgcgcacaagcaaatgcaatcagctcaacgccatggaatacaaaataagcaatgggtgtttaggatacaggaatagcctcccaaattcccaataaataaaatctaattggctcaaaatcatttcctacttccaacagttccttgaattgcacgtttaatattgaaatgagtttgttaacaatctttacagctttgttttcaaatttttaactatgttacctaaatattgaagacaaatataacaaaaaaacgttcagaatttttaggaaaaacaaataaaaccgaactgcccaaaatcaaattaagttcatttagtaaaaaggaatcaactcgagcaataaaagaggcaaaatgacaacaaaattttgactagcattttgtactcttgacattacatgaagcttaattatatgatatattaatttccaaaaattaatcgagccagttgtgtcacctacatatgatgaaaaaaaaatggtttttaagtctttcagaataaattacaacgctctcctaacaaaatttcattgtccttgcactctcaaaatttcatgttttcacaccactttgatgtacggcaggcttgcatttgataacaagaatatttcaatccgttgagtcccaaattaatcaagtacctcattctttaaccttttcttggactttagcttcttgcttccttcatcttctgtaaatatctgattacttctatttttctttttacttagcttcttgattccatcatcttctgtagatgtttcattgcttctcttcttctttttacaaagctttttgcttccttcatcttctgttgacatttcaatgcttctatttttcttctttttacttacctttttgctttcttcatcctctgtagatgtttcattgcttctatttttttgtttacttcccttctttgctttattctcttttgaaggtttcttcctttccacatcttgttcactttgctcatctccatctttattatcattggcagttggtgcttcttcaactgcaggatctcttctagagtaggcaacatctgctaagataagatattaggtgttatggtgcagagatggaaactgggaacatatagctttgtttacaagcataattggtgaacagactaaaatggactcgttcgttcacactttaagctacaaagtcggtaaataaaccctttaacatttagataatatgcgggtgaagaatatcccacatttcgtgaaatgaaatgttaaggcgggaagtggattagagtagtctcatgctcattagacaaatattgcctagccaaaaatataccctcaatctctctccaaacaactcttcctccctgctaagtactgccctcatacaatttcataataacataacattcataaataatcctttccttgtcatcattgcaggcctgagtgtttaagggaagaataacacaaaggaggaaattgtaccttcttcactgaaattggaatcaataataacactgacaagatgctgcttcagaaaaacctgcatggttataagattagtcataaacaataagcttaatgggggcatgatctaataaataagaaacacagttattgcaaagaaaaaaaatacattacaaggtaaatttctacttcaattgttgtttttataaattttataaactttgttgtttttaatattgagatttacacctagcaaagctaaggcaaaattcctggaccggctgagtaactttttaataccttctgcaactactaactaacaaaaaacattttcccccaacattttatctcttcatagaaagaaagctatagaaattcaatgacataccgcagcaagcaattgccgtgtccttatatcccacagacgtagatagctatccaatcctggacaaaaaagaggggtagggggttaaaaatctaattgcctgagaaaacttttaatgtagaagtcctaaagcaaaacctgaaccatttcagtgatgcaaaaagtgctaattggttaccttgtttacaactatttaccatccttttatcccctagatagtcaaaattacaatgcggcccagtggcccagtagtaaccaacctttcaacccattcaattatctagcagagcaataattatcattcttttctctcctgggaaatcaaattacaatccaacccactttatacaaacctttcaatctattccaacctattttcaagtagagtactataaatttctcaataaggataatataatactactcaccacatgacgctatcactggaagctctgggtgcctggctatcgatctaatgcttccagaacatttgcccaagaaggatcctaacaatttgcctgaagagaacacatcatcattaacactataaaggaagtaattgatttttcaaacaaaaaattaaagacacaacatggaagaatcaagtagaaaattggattattcaatatctacagtaaggtaaaagttactgaaaaattactcaaaccctggggtaaaagatgtaagaggtcacaattcaaaaaagaaattcaaacactaaaaaatattgcagaaacgaacgaccaaaatatacattctagacatgaaagcaatcatgcattcagaataaatcaactccatgactttcagaacattagataaacagtttacatatatgatgaaactccatttaccagtccgcatgtcaacagaggcaaggtcaccagatccattccctatatatatagtgtgaccatctaaatcttcagcaacagattttataggggtctcccggaaatcaaaggatataacaggccttctctgagcagaaatatcatagaggcgaacctgattgcacaaacgcacagtgaataaaattaccagaaaaaatgaagttaaaataaataaaaaaaaaagaatgaaaatcaagaaccttttatgacttctacatgtaaatatttaaaccacaatctcattcctttaacagtgaggaagaaagtaagagaaatagagtgcataatgagatgaaaatgtgttcatttccacagtatcatgaatgtagtattctcgaaacaaaacttctgatagaggatacctgatgactgttggtaccagccacaaatttacgatgatcatctttactaaggaaagtagcagatgtgaaccaagttggggtgaaaatgccaagactgtccttacgaggctacataaatgaaaatgattaaatcaatgtgaggccatacactagaaaaccagagcagatgacactataatttgaaagtgattgatgagataaagatctcacagattttgctgtccaaaactttgagcactcgtttaaatcccatacattcatctccactcccttcctgtggttgagattgaaaaaaatctaatcagtctttgaaagccaatgtatcaggtatttttcttagtgaatgatgagaagattccaagtagttttttcacaaattagatacaaaagcgctcaccctccgaataatgcataattttcacttccatccactttgaaacattgaatattaccagatgagcagacatcccacaatcttgaagatcccatcgtggcagaatctgcagatgtgatatcttcaaaggacctcattattgctttcccatttgccgtacaagtaagaaaagtgcaagacctaatagcataaaagaaatttaactgagatcaaagttctatattcccaaacaaagccaccaatgggattgaacaattggaagcttgggaaaggaagtttatacgatgatctaactatagtacaaaaatataggtccatatataatactatgaactcaatgaattaacgagacaagttgtattcccaacttatattatagaaagattctgaaaaatcaatgaacattacctagactcggattccaatctattttttgcaaacaaatgcaatccagcaataggatcaactacaggtccaccatcagtatcaccaacatcagaaattgcaaagcgaagattcccattaagaggattgagaatctcaatctgtaagaccattaggcagatttaaaataaataaaagcttcgaaacccagtggcaagcaacaaacagaaaccaatatgctgctcctggaatattcaaagtacaatgaagcaactcacagtgccattctttcttgcaacagctaacaactgccacaattaaacgaaaacaaaatacttgtcaatacttgggttttatggagccaaaattgcggcattatcccaaagaagaaaataataaaattcataatacaataaacgtaatgaacacacatacagggtcgtgtttggcgtccaccattgaagcggtaatcacggatttcgaggcgtccggctcgccccatctctctacgatctttggatgccctccttgcttactccgagcttcaataactataaatcaaacaagaaatttctttgaagagtacagatataaattgctgatgtaatattcatattcgttttctcagccttcttctgccaaaaacatcattgagtaaagtcgtggtagaagccatggacggaatccatcatcgtgctcatctagagtccaatagcaaaaattaagagtaaaactgacctttgatgagaccaagtgcgtcgaaggtgagagctctaagcggagggcaaccggggcattccaacgtcgtcgtgcgaggcatctctgaagctctaaaaccctaactctccttctttctctttctctctgcagacacgcaccaaaacataaacccttggtgttggaggaatatctatttagtccttgcaactttaagttttgcaattaggtccacagttatttctatagtctatactctatagtatataccctttcattataaaa

SEQ ID NO: 1839 - DNA, 547 bp, Brassica oleracea
ctctcatcatcaagctcccaaaacttcgcatccctcagaatagataaaatggcaacagcatcaaggttccaagcattcttgaacagtccggttggacctaaaacaacccatttctggggtcctatcgctaactggggctttgttgccgctggtttggtggatatgcaaaagcctccggaaatgatttctggaaacatgtcctcagccatgtgtatttactctgcattgttcatgagatttgcctggatggtgcaaccacgcaactatctcctacttgcctgccatgcttccaatgagacagttcagctctaccagctctctcgttgggctagagcccaggggtatctatcctccacgaaagaagaggagaaaccgtctcagtaagcctaaacgatgaatgaaagggtttctttaacgctgcaagcatttgttcttgggaattactgatatctatccatttgattttcctttgaaacgtgtttgtcttgtctccccaagctatatggttgctttacttgttggattcttcggtgacattatctctttt

SEQ ID NO: 1840 - DNA, 608 bp, Brassica oleracea
cggacgcgtgggtcatcatcaagctcccaaaacttcgcatccctcagaatagataaaatggcaacagcatcaaggttccaagcattcttgaacagtccggttggacctaaaacaacccatttctggggtcctatcgctaactggggctttgttgccgctggtttggtggatatgcaaaagcctccggaaatgatttctggaaacatgtcctcagccatgtgtatttactctgcattgttcatgagatttgcctggatggtgcaaccacgcaactatctcctacttgcctgccatgcttccaatgagacagttcagctctaccagctctctcgttgggctagagcccaggggtatctatcctccacgaaagaagaggagaaaccgtctcagtaaacctaaatgatgaaggagagggtttctttaacgctgcaagcatttgttcttggggaattactgatatctatccatttgattttcctttgaaacgtgtttgtcttgtgtccccaagctatatggttgctttacttgttggatccttcattgacaattatatcttttctttcacaagtaacagattataataaaacttgggacatgttggtggcaat

SEQ ID NO: 1841 - DNA, 1134 bp, Brassica rapa
gttctgttacctcgctctctttctctcgccctcaaattctctaatcatcgagctcccaaaacttcgcattcctcagagtagataaaatggcaacagcatcaagattccaagcatttttgaacagtccggttggccctaaaacaacccatttctggggtcctatcgccaactggggctttgttgctgctggtttggtggatatgcaaaagcctccggaaatgatttctggaaacatgtcctcagccatgtgtatttactctgcattgttcatgagatttgcctggatggtgcaaccacgcaactatctcctacttgcctgccatgcttccaatgagactgttcagctctaccagctctctcgttgggctagagcccaggggtatctatcctccacgaaagtagaggagaaatcgtctcagtaagcctaaacgatgaatgaaagggtttctttaacgctgcaagcatttgttcttgggaattactgatatctctatccatttgattttcctttgaaacgtgtttgtcttgtctccccaagctatatggttgctttacttgttggatccttcggtgacattatctcttttctttcataagtaaccacttgtaataaaacttgagagatgttggtggcagtccacatttcctgttactccaacacaaattgctaatgaacaagagacgacttagccaagttgagagtgctacttgagttttggatctttctccaagcacatgatttgacatgagtcgaaaacacagacacgaacgcaaatgaacaaacttttatctttcaaaccgtatccaatttcttgcagtttaaatcacatagaaatttatcatcaaaatcaaagtatagcaaaggtccctctagctacttcctccagagacaaaagactaactgatctgttttgctttgtttattttgcaaagcttgataggtactgtgtaaagctcatactgcatcaattaatgtttgcttggggacgctttattacatgaaatgaaacctgtcttaagcagaaactacggaattttgattcataatcctctcagaatttgaaaaccatttgctctgtgaatccgagttccttgagtattcccttaacctgcagtgaaacaaaccaacgtaac

SEQ ID NO: 1842 - DNA, 611 bp, Brassica napus
gagctcccaaaacttcgcattcctcagagtagataaaatggcaacagcatcaagattccaagcatttttgaacagtccggttggccctaaaacaacccatttctggggtcctatcgccaactggggctttgttgctgctggtttggtggatatgcaaaagcctccggaaatgatttctggaaacatgtcctcagccatgtgtatttactctgcattgttcatgagatttgcctggatggtgcaaccacgcaactatctcctacttgcctgccatgcttccaatgagactgttcagctctaccagctctctcgttgggctagagcccaggggtatctatcctccacgaaagaagaggagaaatcgtctcagtaagcctaaacgatgaatgaaagggtttcttcaacgctgcaagcatttgtttttgggaattactgatatctatccatttgattttcctttgaaacgtgtttgtcttgtctccccaagctatatggttgctttacttgttggatccttcggtgacattatctcttttctttcataagtaaccacttgtaataaaacttgagacgacttagccaagttgagagtgctacttgagttttggaac

SEQ ID NO: 1843 - DNA, 577 bp, Brassica napus
tagataaaatggcaacagcatcaaggttccaagcattcttgaacagtccggttggacctaaaacaacccatttctggggtcctatcgctaactggggctttgttgccgctggtttggtggatatgcaaaagcctccggaaatgatttctggaaacatgtcctcagccatgtgtatttactctgcattgttcatgagatttgcctggatggtgcaaccacgcaactatctcctacttgcctgccatgcttccaatgagacagttcagctctaccagctctctcgttgggctagagcccaggggtatctatcctccacgaaagaagaggagaaaccgtctcagtaaacctaaatgatgaaggagagggtttctttaacgctgcaagcatttgttcttggggaattactgatatctctatccatttgattttcctttgaaacgtgtttgtcttgtctccccaagctatatggttgctttacttgttggatccttcattgacaattatatcttttctttcacaagtaacagattataataaaacttgggacatgttggtggcagtccacatttcctgttac

SEQ ID NO: 1844 - DNA, 590 bp, Raphanus sativus
gacttgttctgttattcctctctctctctctcacaaattctctcatcatcgagctcccaaatttcgcatagcgaagagtaggatagaatggcaacagcatcaaggttccaagcattcttgaacagtccggttggccctaaaacaacccatttctggggtcctatcgctaactggggttttgttgctgctggtttggtggatatgcaaaagcctccagaaatgatatctggaaacatgtcctcagccatgtgtatttactctgcactgttcatgaggtttgcctggatggtgcaaccacgcaactatctactgcttgcctgccatgcttccaatgagactgttcagctctatcaactctctcgttgggctcgagcccaggggtatctatcctccacgaaagaagaagagaaaccgtctcagtaaaacaaaatgaggaaggaaaagtctttaattctgattctgatcagcatttgttcttttggaattattgaactccatccgtttgatttccctcgaaacatgtttatgtagattgttgttttacttgttggatctttcattgacgttatctctttggttttcataagtaa

SEQ ID NO: 1845 - DNA, 953 bp, Trifolium pratense
gggggattgattgaagtgcaaaaatcattcttcttccttcttccgtgggaccaccgtggctctctggctctagatttgtttgcctttctcttctcttccgcctatcgacgccgccgatcattctctctcttttctttgagtagaagtggtatcttatggctgccttcaaagcattttggaacagtccagttggtcctaaaacaactcacttttggggacctgttgccaactggggattcgtcgcagctgggttggctgacatcaacaaacctccagaaatgatctccggcaacatgacaggagcaatgtgtgtttattcagcattgttcatgagatttgcatggatggtacagccacgcaactatctacttcttgcgtgtcatgcttcaaatgagactgttcaactctatcaacatacccgatgggcaaaggcagaagggtatctctcggggaagaaggataaagaagtttcatcacagtgaatgcaatgatttgaacaaattgtttttgagcttgacagtgcatgaataattgatcgtcaaaattgattgtaatttataagggctcttggaaactgtaaaagattcggaatttgcagagttttttgttattgtatggattacagaggcttgatgattttaaaactgaccagaagtctttaaacttgtgcttcttttacgggacagaggtccgtaaacgtgaagcatacgcgatcaaacaaaatagctataaactgcagtttctcacataaaccgtattgagacgtgaggatgataaaatccatgttatggcttttgcagaaatttgaattggattttctctttaagtcattgaaaattggttataaaagattacttagacgtccaattcatttttagaaacattgttgaaaagcacatagttgtggaactaattgattatctttgatagtatgatcccattttatttttaaa

SEQ ID NO: 1846 - DNA, 762 bp, Trifolium pratense
agtcagctctagatttggttgaattccaatcaatccttgttcgcctttctcttccaactaactatccacgccgccgatccttctccgattttactactttctttcagagtacaagaggtatcttatggctgcattcaaagcattttggaacagtccagttggtcctaaaacaactcacttttggggacctgttgccaactggggattcgtcgcagctgggttggctgacatcaataaacctccagaaatgatctctggcaacatgacaggagcaatgtgtgtttattcagcattgttcatgagatttgcatggatggtacagccacgcaactatctacttcttgcgtgtcatgcttcaaatgagactgttcaactctatcaacatacccgatgggcaaaggcagaagggtatctctcggggaagaaggataaagaagtttcatcacagtgaatgcaatgatttgaacaaattgtttttgaacttgacaatgtatgaataattgattgtcagaattgattgtaatttataagggctcgtggaaactgtaaaagattcataatttgcagagtttttgttattgtatggattacaaaggcttgatgattttaaaactggccagaagtctttaaacttatgcttcttttacgggacagtggtccgtaaacatgaagcatacgcgttcaagtaaaataaaccttattttgacgtgacgatgataaactcatgttatgtcttttgcagaaatttgaattggattttct

SEQ ID NO: 1847 - DNA, 667 bp, Allium cepa
ttccatcactcaaatcatggccgctccttacgttattatttcttacagcctccggcttcttccctgccgcgccacacattctttccctaagcaaaaacgacgtctccagattcttctccaaatcaaattagggtttcctcaataaactcaacacgttatcttggaactcgaaacgtcatcgacatcattgtcaaaccagtcatcaaacaaactcggattcatcagttcatggcagctttcagaaattttctcaacagcccagtgggcccaaaaactactcatttctggggtcctgttgcgaattgggggtttgtcgtagctggtttggtagacatgcaaaaacctccagaaatgatatcaggcaacatgagtgcagctatgtgtgtttactcggcactcttcatgaggtttgcatggatggttcaaccacgcaattatttgcttttagcatgccatgcctctaatgaaactgtccaactatatcaattttctcgttgggcaaaacatcaagggtatttggggaaaaaagaggcggaagtgcagcaatgatgatcggatgtgcatacatttttacaataaaatttgctcagctgggtaatctttgttcacaaaatatattttaagaaactgaacactcatattcccataaataaatgatacagttacc

SEQ ID NO: 1848 - DNA, 647 bp, Mesembryanthemum crystallinum
cctctcttcccttccggtgtttctctctctaagtcccttcacgccggcaagaattcttcatcgtgttctcttccaacaggtgatacatggcttctactttccgtgcgtttatgaacagtcctgttggcccaaaaacaactcatttctggggccctgttgccaattggggatttgtggtcgctgggcttgtggacatgaataaaccccccgaaatgatatctggcaacatgactgcagcgatgtgtgtttactcgggattgtttatgaggtttgcatggatggtccagcctcgtaactatctacttctagcatgccatgcttcaaatgagactgtgcaactgtaccaattctcccggtgggcaagggctaatgggtacttgtcagaaaagaaagaggaaactacatcaaagaaagaggaaagtacatcacaatgatttgagatttttcataggattgctgattttcagttgcaaacctgttgcttcttgtgtgagctattgaactattcgttttgtataccacctaagagcaaactggaggaaattgctccagaaatttgtcagctcatctaattttcattggtgttatattgttatgtctttcctcttgatgtcaataaatagtatcatatgactcgtaataacggt

SEQ ID NO: 1849 - DNA, 1636 bp, Medicago truncatula
gaaaactattctgtgggaccgtagctccttcacctatatctctctctcgcgcagatttggattccacaatcaatctttgtttgcctttctcttccaaaattcaacgtcgccgattcttctctctctgtccagttttacttccagtagaagtcgtatcttatggctgccttcaaagcattttggaacagtccagttggtcctaaaacaactcacttttggggacctgttgctaactggggatttgttgcagctgggttggctgacattaataaacctccagaaatgatctccggcaacatgacaggagcaatgtgtatatattcagcattgttcatgagatttgcatggatggtacagccacgcaactatctacttcttgcatgtcatgcttcaaatgagactgttcagctctatcaacatactagatgggcaagggcagaaggttatctctcggggaagaaggagaaagaagcttcatcagagtgaatgcattgatttgaacagattgtgtttgaactttacaatgtatgaatgataataattgaattgttagaattgattgtgatttacaagggctcgtggaaattgtgaaagattctgaatttgcagagtatttgtttttgtgaggattaaaagaagtcaacacaattaaaagcttgatggtttttaaactgacccatgagccgttaaacttatgtttgttttatgggacaaaaatatgttgtctttcatccaacaacatattctatttagcatggaacaaacattggttatggattagcaaaatgctgagttagcaacggattaacgtgtaaacatgcatttgcggattattggctgttgcgcaccgttggaacaaacatgaattttgtgtacactttcaaaattctcttcaattgtttcaaaccttcttcttccactagaatgtctgagagtgtgcaggtacaccacctcattcatccgaagaagactgttgacgacgaaagtgtcatactcaaaggtcattcaacgtcatcctttatatctaatcctagcaaacgtgcttaccctaattgctaaaccttaaacctaattcatttgggcgccaaaacatttgatccgttgattcaatgtcaattgaaatcaacggctgataaaccttctttaaaatttgttctttgaaaaatacgtattttgttttgttaaagaaaaaaatcagtttctaatgacaagtacacaccgctcaatacagagaccaaaacatttgacacttttttttttcctctccccttctctctctctcactgcgaccaacatctccagcgaaacagaaagaagccattgcaacttcttcttcctacgatcgatgtgttaactgttgggttcattgatttccaatatcatcaagaacgcacgctacatgattgttgctgaatcttcatttcgttcgatttcatggaggtttaggacaaggattttgaaggctttgtgtttagccatatcatctacttccaaaaacagaaccgattcgattccaactgaacatacatctctgttcccagacgaagtcctcaagaacatgcctcatattcaagaaggtgaattgagtttctatgcgactagaggctggggattgcacttcagaattttatcggaa

SEQ ID NO: 1850 - DNA, 717 bp, Sarracenia psittacina
ctccgattcactccggtcaacgatccaatccccctcctttttatctgcgacaaaccacggattttttcatcctcttctttccaacatctccggactccggtcggcgtcttccgataccgagatattttaccagttatcctacatggcttccttccgagcattcttgaacagcccagttggccctaaaacaactcatttttggggtcccattgctaattggggattcgtacttgctgggttagtggacacgaagaagccccctgaaatgatatctggcaacatgactggagcaatgtgtatttattctgcattattcatgaggtttgcatggatggtacagcctcgcaattacctgcttctagggtgccatgtctcaaatgagacggtgcagctatatcaattatctcgttgggcgaagggtaatgggtacttgggaaagaagaaggacgatgctgctgcatctgaataacttggtgctgctttccttttccagacaattgggctggctggtttgatggtggttcctaaagaagcaacttatttgtgaataaagtttttttaaattaattttatattttaattgtattaaggtactagacagaaccacccaaccacttaagcaaacgttggccgttgatgttttgtttgtttacttattccaccagttattatccaatattccttcaactgaagtcttcttggtcttctgggcagatg

SEQ ID NO: 1851 - DNA, 569 bp, Sarracenia psittacina
aagccctcgtcaaagaataacagctccgattcactccggtcaacgatccaatccccctcctttttatctccgacaaaccacggattttttcatcccacccttctttccaacatctccggactccagtcggcgtcttccgatactgagatattttaccagttatcctacatggcttcctccttccgagcattcttgaacagcccagttggccctaaaacaactcatttttggggtcccattgctaattggggattcgtacttgctgggttagtggacacgaagaagccccctgaaatgatatctggcaacatgactggagcaatgtgtatttattctgcattattcatgaggtttgcatggatggtacagcctcgcaattacctgcttctagggtgccatgtctcaaatgagacggtgcagctatatcaattatctcgttgggcgaagggtaatgggtacttggggaagaagaaggaagatgctgctgcatctgagtaacttggtgctgctttccttttccagacaattggactggctggtttgatggtggttcctaaagaagcaactta

SEQ ID NO: 1852 - DNA, 673 bp, Trigonella foenum-graecum
gcccaaaaatagttctgtgggaccgtagctgcttcacatagctcgcttcgcttcgcttgttctcagatttgcgattccaatccatcatatcatccttttgacttgtttgcctttctcttccataaaaaaatcaacgttgccgattcttctctgtcagtcgaagtggtatcttatggcggccttcaaagcattttggaacagtcctgttggtcctaaaacaactcacttttggggacctgttgccaactggggattcgtcgcagctgggttggctgacatcaataaacctccggaaatgatctctggcaacatgacaggagcaatgtgcatttattcagcattgttcatgagatttgcatggatggtacagccacgcaactatctacttcttgcatgtcatgcttcaaatgagactgttcagctctatcaacatacccgatgggcaaaggcagaagggtatctctctgggaagaaggagaaagaagcttcatcacagtgaatgcagtgcagtgatttaaacagattgtgtttgaactttacaatgtatgaataattgatcgttaaatttgattgtaatttataagggctcgtggaaactgtaaaagattcagaatccatagagtagttgtttttgtgattacaaaaatgtctacactatcaatggcttttaaac

SEQ ID NO: 1853 - DNA, 760 bp, Secale cereale
tcgttcctcattctccatctagtccaccaaacccccatccccatctctcctcccctaggctcgccttcgccgtcggccgggttccctctccgacacgccgccgtcgatacatccacccgaggcatggcgacggcgttcaaggcgttcgtgaacagccccgtcggccccaagaccacccacttctgggggcccgtcgctaactggggcttcgtcctcgcgggtttggttgacttgaacaagcctcctgagatgatatctggcaatatgacagcagctatgtgtgtgtattctggactatttatgaggtttgcgtggatggttcagccccggaatacttgcttctggcatgccatgcctccaacgaaaccgttcagctctatcatttattctcgctgtgctagggctcagggtagtctggattccaagaaagagccggaggcccaacagtaaagggtgtggtgtttctgaagtcggagcccggtgccatgattccgcagccagcctttcaataagtaaaatttagtttcctgaagctttgcaatgctcttcatgagaaaaaaaccctaatgaagtggaaatctctatttctacaatactcattcctgtaatgcagcgttacagctttcttgttcctgaatcatggttcatgacatattttttttctttttcaacaatgcacatagccagggttcaagttatccaccccagactcgctgcttgattgtactattgatttcaaccacgtccatagtatcttttg

SEQ ID NO: 1854 - DNA, 580 bp, Avena sativa
acccaccctccatctgctccaccaaccatctctcgcttccctaaacccgcctttgccgtcgctcgcatactggtcggcctccctctccggcaagccgccgtcgatacatccactccaggcatggcgacggcgttcaaggcgttcgtgaacagccccgtcggccccaagaccacccacttctggggccccgtcgcgaattggggcttcgtcctcgcgggcttggttgacctgaaaaagcctcctgaaatgatatctggcaatatgacagcagccatgtgtgtgtattctggactcttcatgaggttcgcgtggatggtacaaccccggaactacctgcttttggcgtgccacgcatcaaacgaaaccgtccagctctaccatttatctcgctgcgctaaggctcaggggtacctggacaagaagaaagagccggaggcccaacaatgaagtggaatatgttgtgtctgaacccagataaagtgtaactccagagtcgttctttcgaaataatcgagacctctttctgaagctttgcaatgctcatcatgtggccgtacagttttttgtgttacacttgggc

SEQ ID NO: 1855 - DNA, 463 bp, Capsicum annuum
aggatatttcatatatagcttgtcagagatggctgcattcaaggcatttttgaacagcccggttggccctaaaacaactcacttttggggtcctgtagccaattggggatttgtcattgctggactggtcgacacacagaaaccaccagagatgatatcaggcaacatgacctcagcaatgtgtgtgtattctgcattgttcatgagatttgcatggatggttcagccacggaattatcttcttctcgcatgccatgcctcgaatgagtcggtgcaactctatcaactatcacgttgggcaaaaagtcaaggatatatgcagcagaatgcagccaaagcagagtgatttacttttctttcttgtttatttttggacaaattttgctcgacgtttatgattgctttcatcaattgttgcaaaaatgttcataaagaagcatcaagacttttgcagtttgaatgg

SEQ ID NO: 1856 - DNA, 1299 bp, Musa acuminata
cgggattcaccgacctcttcttccagcggcgtcgggctctgttcgccaacttcagcgcgccgccgtcgggagctacgtctgctcaccttctgtcgtcgccggctttctccgaggttggctgttgcatcctctccctgcccacttatttccacgcggatgactcggcaatgttttagggtttctcgatcgtgattggattcggatattttatatcgattataataatggtgaattcttgatgatgcggcctttgggttttggcgatccgaagggtagagttgtataacatttttgggattgaggtagaagagattggtgcttctgatggcagcccttaaagctttttggaacagccctgtgggtccaaaaacaactcatttttggggaccagttgccaattggggcttcgttattgctggtttggtagacatgcagaaacccccagagatgatatctaggaatatgacttcagccatgtgtgtctactcagcacttttcatgagatttgcgtggatggtaaaaccacgtaactacttgcttcttgcatgccatgcctctaatgaatcagttcagctctatcaattatctcgttgggcaaaggcacaagggtaccttgagaagaaagagcctgaaggtcagcactaagctgttacatgagcttcttcaaaagatttctctgaataagaaggtgaggtacttgatcagaaagcatctccttgctatgattaatttgatgagaatttcctggtattttgttcagacaatgtctgaatctattttgcttattcaagatggctgtggtgctccttttttttttccctggtcctttctatatcaaatcatctaggttggctgtttttgacataaatggacctactcgaagctcaattgatcctatagacacctgagttcaatctggttgttgattcgtttaggatcagataaagttccccatgcagggagggatatggtaccgttgatgagcaaaacttttgctgcttgggaatgtaaaactacttggaaatatgactagtgttttttatgaagtattgtgattatgttaacaaaggtatgactgtcaccttcttgggcagcctttgtgagtttgctaaaattagcaaacacaatccacaagtctacggtaaatgggagattttggatagcatcagtgtgtatagatgcaatcttatgttaattatatagatgtgcttggttgatgcctaaaaaaatgcatcagtgtgtatcagttccatttacgaaaaattagggattcgtaatctcattcgatatatttttttc

SEQ ID NO: 1857 - DNA, 480 bp, Bruguiera gymnorhiza
gctctttccctggggctccgcatcacattcgatcatccgtcggttccaaggcttctccggcgatctactttccagctaattactggggaattcaagcagaagttacaatagatggcttcctttaaagcattttggaacagtccagttggtccgaaaactactcatttttgggggcctattgccaactggggattcgttgttgctgggttggttgacatgaagaagcccccagaaatgatttcagggaacatgactggagcaatgtgcatttattcagcattgttcatgaggtttgcatggatggtgcaaccacgcaactatctcctatttgcatgccatgcttcaaatgagacggttcagttatatcaattctcacgctgggcaaggggccaggggtacttgtcatcggggaaagaggaaagtccatcgcagtaactaaaaagccgcctctttgctgccctacccaattctcagcaggga

SEQ ID NO: 1858 - DNA, 518 bp, Ricinus communis
ccttattagtaatagcaacaaagccttttacgctattattattagctaaaactgatacctactctgaactcgaccgcacacaatcggcaattccaaaccattttcttcaccaatctctgtactaaaaacaccaaatcctcgcaacgctttctctctcatcctccgattccatccaccaccgtgctctccagcttctccggcgatctcaggtcagaggtattcaatatggcttcattcagagcattcttgaacagtccagttggtcctaaaacaactcatttctggggacctgttgctaattggggatttgttgctgctgggttggtggacatgaaaaaacctccggaaatgatttctggaaatatgacaggagcaatgtgtatttattcagcattgttcatgaggtttgcatggatggtacagcctcgtaactatctacttctagcatgtcatgcttcgaatgagactgtgcaactctatcaattttctcgttgggcaagggctcaagggtgagtatc

SEQ ID NO: 1859 - DNA, 678 bp, Cynara scolymus
gcggccatcatcatattcctgagtaggtggtgtccgatcagcagggtgttaaagacttcttctgccatctagtcgccggcgacgaggtgcttttaacagcaaaataatatatggcaccctttcgagcattcatgaacagtcctgttgggcctaaaactgctcatttctggggcccggtcgccaactggggatttgttgttgcgggactggtggatatgcagaaacctccagagatgatatcaggcaacatgaccggagcgatgtgtgtgtattctgcattattcatgaggtttgcgtggatggtgcagcctcgtaactatctacttctagcatgtcatgcttcaaatgagtcggttcagctctatcaattttcacgttgggcaaagagccaagggtattttcagcagaaggaagataaggccccatcaacttgaaccgcagctgttattttcatctcttccctggacattatctttgtgtggtaattttggttttagtttctttgaagcttaatataactattgaatcgaaacaaagttctgcattccccatctcgatcaccattgatggtgatactgacaccgatttgaccatcgatgtttttgcttttatattccttttattttgttcttcggtatctgattcaataaaaatccgacatgttcttgatttaccatc

SEQ ID NO: 1860 - DNA, 702 bp, Cynodon dactylon
gccgggggtctcgcagaatcctacgattcgttcccccgccgtgtcataagttaccacccccgaatcccgcgccgtcgttcttgcaatcggttctgacctcaactgctggttccagactttcggtcagccgccgcggggcagcacagattcggccatggcgacggcgctcaagacgttctggaacagccccgtcggccccaagaccagccacttctggggccccgttgcgaactggggcttcgtcatcgcgggtttggtagacatgaacaagcctgctgaaatgatatccggcaatatgacaggagccatgtgtgtatattctggactgtttatgaggtttgcatggatggtacaaccccggaactacttgcttctggcatgccatgcctccaatgaaagtgttcagctctaccagttatctcgctgggctagggctcaggggtacctggagaagaaagagccagaagcccaacagtaaagatggcctgcaacattgcagttactagtttcaatatgaagatttgaagctttgtaacatccatttttttatcttactttttttatgtataattcacatgacaatatgtggatatgtatgcctgcgggtattacaagttttttttctttgcgatttgcttcacctgcccatctgtctgaacaaatgacagttcatcagtatgtaataaaagttcgcaggttatg

SEQ ID NO: 1861 - DNA, 760 bp, Taraxacum officinale
cggggggttatgctccacccatcatattccatagtaggtagtcctccgaccagaagttctcaagctattctgtcaacgagtcggcgccgacgaggttttttaactagcaagaaggttatacatggctgcctttcgaaaattcctagacagccctgttggccctaaaaccactcatttctggggtccagtagccaactggggattcgttgctgcagggttggtggacatgcagaaacctccagagatgatatctggcaacatgacagcagcaatgtgtgtgtactctggattattcatgaggtttgcatggatggtacagccacgtaattacctgctgctagcatgtcatgcatcaaatgaaacagttcagatgtatcagttttcacgttgggcaaagagtcaagggtatttacagcagaaaaaagagaaggctccatcaacttgaacaggagcttcatttatacctggactttatatttgtgacattgtgtggtaattttggttttatttttatttttatttttactttttttgaatcatgatgtaattgttggatcaaaactaagctttcttggtgactgcgttgttgtacttgatcctcatcaatggtaatactgatgaggatttgatcgttgctgttactgatactgttactgttattgtcttttcttttagacatgttttttggtttatggatagttgattgaataaaaaaacaatgtttactcaaaaaaaaaaaaaaaggccacctcggcctcta

SEQ ID NO: 1862 - DNA, 428 bp, Solanum melongena
acgaccactaccaactaaaaagagcaccaatttatagacaatcgccaaaggaacccccagtttcagatctctcataaaggatatatcatatagcttgtcagaaatggcttcattcaaggcatttttgaacagccctgtcggccctaaaacaactcatttttggggtcccatagccaactggggatttgtcattgctggactggttgacacacaaaaaccaccagagatgatatcaggcaacatgaccacagcaatgtgtgtgtattctgcgttattcatgagatttgcatggatggttcagcctcggaattatcttcttctggcatgccatgcctcgaatgagtcagtgcaactctatcaactatcacgttgggcaaaaggtcaaggatatttgcagcagaatgcagccaaagccgagtgatttagtg

SEQ ID NO: 1863 - DNA, 693 bp, Nicotiana benthamiana
tagactttgcatcataacacaatcgccaatcgaagccactgttagaaccatccttcagtttcagatcttccattaaaggatatttcatatagcttgtcgcacatggctgcattcaaggcattcttgaacagtcctgttggccctaaaacaactcatttttggggtcctgtagccaactggggatttgtcattgcgggactggtcgacacacagaaaccaccagagatgatatcaggcaacatgacttcagcaatgtgtgtgtattctggattgttcatgagatttgcatggatggtacagcctcgtaattatcttcttctggcatgccatgcctcgaatgaatcggtgcaactctatcaactatcacgttgggcaaaaagtcaaggatatttgcagcagaatgcagccaaagcagagtgatttagtgttctctcttgttttatttttggacaattttcgcttgtcatttctgagcgctttcaccaagtgtcgcagaaaatattgcctttgataatccaagagctgaactagcagcctatttccaagtaaatcttagtactatcagtactgggacttttgggattcattatcatgtctataggaacttccacaataacatagcatatgtttaatgcacgacatgttattaaacttgcagtttgaacagactcttctttttcatgtaaagataaa

SEQ ID NO: 1864 - DNA, 597 bp, Avena sativa
gctccaccaaccatctctcgcttcccctaaactcgcctttgccgtcgctcgcatactggtcggcctccctctccggcaagccgccgtcgatacatccactccaggcatggcgacggcgttcaaggcgttcgtgaacagcccggtcggccccaagaccacccacttctggggccccgtcgcgaactggggattcgtcctcgcgggcttggttgacttgaacaagcctcctgaaatgatatctggcaatatgacagcagccatgtgtgtgtattctggactcttcatgaggttcgcgtggatggtacaaccccggaactacctgcttttggcgtgccacgcctccaacgaaaccgtccagctctaccatttatttcgctgcgctaaggctcaggggtacctggacaagaagaaagagccggaggcccaacagtgaataggagtacgctgtctctgaagccaagacgtgtgtaactccagagtcgttctttcaaactcaaaataatctgagatctgtttctgaagctttgcaatgctcatcatgtgaccgtacagtttatgtgttacactgggcagtggaaacctctctacctgtcatgt

SEQ ID NO: 1865 - DNA, 563 bp, Avena sativa
aactcgcctttgccgtcgctcgcatactggtcggcctccctctccggcaagccgccgtcgatacatccactccaggcatggcgacggcgttcaaggcgttcgtgaacagccccgtcggccccaagaccacccacttctggggccccgtcgcgaattggggcttcgtcctcgcgggcttggttgacctgaaaaagcctcctgaaatgatatctggcaatatgacagcagccatgtgtgtgtattctggactcttcatgaggttcgcgtggatggtacaaccccggaactacctgcttttggcgtgccacgcatcaaacgaaaccgtccagctctaccatttatctcgctgcgctaaggctcaggggtacctggacaagaagaaagagccggaggcccaacaatgaagtggaatatgttgtgtctgaacccagataaagtgtaactccagagtcgttctttcgaaataatcgagacctctttctgaagctttgcaatgctcatcatgtggccgtacagttttttgtgttacacttgggcagtggaaacctctctacctgtcatgt

SEQ ID NO: 1866 - DNA, 603 bp, Avena sativa
gctccaccaaccatctctcgcttcccctaaactcgcctttgccgtcgctcgcatactggtcggccttcctctccggcaagccgccgtcgcgtcgatacataaaactccaggcatggcgacggcgttcaaggcgttcgtgaacagccctgtcggccccaagaccacccacttctggggccccgtcgcgaactggggcttcgtcctcgcgggcttggttgacttgaacaagcctcctgaaatgatatctggcaatatgacagcagccatgtgtgtgtattccggactcttcatgaggttcgcgtggatggtacaaccccggaactacctgctttgggcgtgccatgcctccaacgaaaccgtccagctctaccatttatctcgctgcgccaaggctcaggggtacctggacaagaagaaagagccggaggcccaacagtgaagaggagtacgctgtctctgaagccaagacgtgtgtaactccagagtcgttctttcaaactcaaaataatctgagatctgtttctgaaaatttgcagtgctcatcatgtgaccgtacagaccctgtgttacactgggcagtggaaacctctctgcctgtcatgt

SEQ ID NO: 1867 - DNA, 1097 bp, Capsicum annuum
ttttttttaaagcacagaagcagatgacaataatataaataaggcacccatacagactataaaacagaggaaagcagaggaaagcacacagattcgtaataagcatggaacactgaatacggaatcataacaggaataaaaaataaaaaacccccaccaagtaattccctacactagcaaccaacaatgatgaaaaactaaaatccatcaacccgataacccgactccaccagccccaaccattttgtttgctctctacacacgtatcacgtgtcagaaagatgagaaaggaatctaagaaaaaatcagtctcaaatcttctagaacgagcctaggtgtcaccccaactgttcaatctcgtgtttctcggataagattgtacaattttgcacagagttggatgattttcattggttcttggaatgagtccgttttgcctaaatggcattagtccacctgttgtaaatttctccaaaaaaaaaatctaaagttggtacgttttgggctaaaaaatgaggcttgtcagagatggctgcattcaaggcatttttgaacagcccggttggccctaaaacaactcacttttggggtcctgtagccaattggggatttgtcattgctggactggtcgacacacagaaaccaccagagatgatatcaggcaacatgacctcagcaatgtgtgtgtattctgcattgttcatgagatttgcatggatggttcagccacggaattatcttcttctcgcatgccatgcctcgaatgagtcggtgcaactctatcaactatcacgttgggcaaaaagtcaaggatatatgcagcagaatgcagccaaagcagagtgatttacttttctttcttgtttattttggacaaattttgctcgacgtttatgattgctttcatcaattgttgcaaaaatgttcataaagaagcatcaagacttttgcagtttgaatggctctacacgttaataaaccattcagtgaaaaaggtaatgtttttttcggagtcggttgagaactgtatcttgcgtaactggtaaagttgtcatatgtttaggaggtcacgggttcgagttatggaaacaacctct

SEQ ID NO: 1868 - DNA, 744 bp, Panicum virgatum
tccccattctccagccactcgtcgcctccactaaatccttggcattcccccgttctccacccaattcctcgccctcgctcgtcgactcgtcggcctcgcccgccgccgccgttgacgaaagctgcgccaggtgatttcagttgccgcgggtatcggatttcgccatggcgacggcgctcaagtcgttcctgaacagccccgtcggccccaagaccagccacttctggggccccgtcgccaactggggcttcgtcatcgcgggtttggttgacatgaacaagcctcctgaaatgatatcgggcaatatgacagcagtaatgtgtgtgtattctggactctttatgaggtttgcatggatggtacaaccgcgaaattacttgcttctggcatgccatgcttctaatgaaagcgttcagctgtatcagttatctcgttgggctagggctcaggggttcctggagaagaaagagccggaggcccagcagtaaagatggaatgtaatgctgcaatcacttgttcaataaggaatttttttcaaaaagcatcaataaggaaattttgtttgtgaagcagtgtagatattgttcattctgtgaccatgaagtttctgcatgctacacaatatactgtggaaatctcaatgatacctgtgttacttcattacaagttttcatttgtgttacttttgctgcacatctttaggaaggcctgacctttttcaatgcgggattgcagtctattgat

SEQ ID NO: 1869 - DNA, 896 bp, Panicum virgatum
cctaatgctccccattctccaaccactcgtcgcctccaccaaaatccgtgctttcccccgctctccagtctccacccaattcctcgccctcgctcgtcgactcgtcggcctcgcccgcagccgccgtcggcgaaagctgcgccaggtgatttcagctgccgcggggatcgggttccgccatggcgacggcgatcaagtcgttcctgaacagccccgtcggccccaagaccagccacttctggggccccgtcgccaactggggcttcgtcatcgcgggtttggttgacatgaacaagcctcctgaaatgatatcgggcaatatgacagcagtaatgtgtgtgtattctggactctttatgaggtttgcatggatggtacaaccgcgaaattacttgcttctggcatgccatgcttctaatgaaagcgttcagttgtatcagttatctcgttgggctagggcgcaggggttcctggagaagaaagaaccggaggcccagcagtaaagatggaatgcaatgctgcagtcacttgtccaataagggatttttttttgaaaagcatcaataaggaaattttgtttctgaagcagtgtagatattgttcattctgtgaccataaagtttctgcatgctacacaacataccgtggaaatctcaatgatacctgtgttacttcattattacaagttttcatttgtgttacttttgctgcacatctgtaggaaggcctgacctttttcaatgctgcgggattgcagtctattgataactttttattatttggcactattcggcttagctggcaaatatatgtgattagttgtgccgaaattttgttgctgtgcatactacatcttcaattatatgaatacaaattaatataaataggtcaaattt

SEQ ID NO: 1870 - DNA, 618 bp, Taxus baccata
cgttcattccatacagaaattttattgggcgaggaggaggagggaatcaaacaggaaaggaacgaactctcctctgctcttactgaggtacatttggaacttaggatggcagcgacgtttcgggcctttttgaatagtcctgtaggccccaaaacaacccacttctggggtcccattgccaactgggggttcgtcgttgcaggcttggtggatatgcagaagccaccagatatgatctcagggaacatgactgcagcaatgtgcgtgtattctggattgttcatgagatttgcttggatggtacagccacgtaattatctgcttttggtttgccacgcctcaaatgaaactgtgcaactttatcagctttctcgatgggcttctgctaatgggtacctgccaaagaaagaggaacctgagaaacaatagaaatgactaaagtttgtttccctatttgggctagaattttaattgtggttaaatgtggcctttttaaattttggattcaacagtatttacacgctatgactaaaatgttgggatttgtgctgaaataccattgccatctgataaaattccaatgattaaaaaatacaagtttgtgtggtcacaaataat

SEQ ID NO: 1871 - DNA, 413 bp, Eutrema halophilum
tgtaggcgggtttcagtagatatggcggctacatcaaggttccaggcattcttgaacagtcctgttggccctaagacaacccatttctgggggcctatcgctaattggggttttgttgctgctggtttggtggatatgcaaaagccccctgaaatgatttctggaaacatgtcttcagcgatgtgcatttactctgcattgttcatgagatttgcttggatggtgcaacctcgcaactatttactacttgcgtgccatgcatcaaacgagactgtacagctctatcagctctcgcgttgggctagagcccaggggtatttatcctccacgaaagaagaggataaaccgtctcagtaaaaccaaaatgaggaaaggtgtctttaacgctgcttctgatgaacaacggatcatca

SEQ ID NO: 1872 - DNA, 755 bp, Allium cepa
ctccggcttcttccctgccgcgccacacattctttccctaagcaaaaacaacgtctccagattcttctccaaatcaaattagggtttcctcaataaactcaacacgtgatcttggaactcgaaacgtcatcgacatcattttctttatcgatctacaggcacgcagatataattctttccaccatcaatttgataccacacagttgtcaaaccagtcatcaaacaaactcggattcatcagttcatggcagctttcagaaattttctcaacagcccagtgggcccaaaaactactcatttctggggtcctgttgcgaattggggattcgtcgtagctggtttggtagacatgcaaaaacctccagaaatgatatcaggcaacatgagtgcagctatgtgtgtttattcggcactcttcatgaggtttgcatggatggttcaaccacgcaattatttgcttttagcatgccatgcctctaatgaaactgtccaactacatcaattttctcgttgggcaaaatatcaggggtatttgggcaaaaaagaggcagaagtgcagcaatgatgatcggatatgcatacattttacaataaaatttatcatttgggtaatctttgttcacaaaatattactggctacagtatcatttatttaatatttgaatgggaatatggtgcgttcagtttcatcaaatatattttgattatttcatccgagtattctggggtaattatcatcttatgagatttcactt

SEQ ID NO: 1873 - DNA, 637 bp, Allium cepa
tagttacgggggatcccgctgcatatataaaaaggaatacgagctagcccttgcttaccttcagcagccgctccaagtaatattctccttttcggggtctacggtctactctttcgattgattcatctattcatggcagcttttagaaattttctcaacagtccagtgggtccgaaaactactcatttctggggtcccgtcgcgaactggggttttgttgtagctggtttggtagatatgcaaaaacctccagaaatgatatcgggtaacatgagcgcagctatgtgtgtttattcggcactcttcatgaggtttgcttggatggttcgaccacgcaattatttgcttttagcatgccatgcctctaatgaaaccgtccaactctatcaattctctcgttgggcaaaatatcaagggtacttggggaaaaaagaggcagaagtgcagcaatgatgaaattgcttatcggacatgcatacattttacaataaaatcgatcagttgggtgatcttttgttcataaaatattactggttattgtgtcatttatttgatatttgaatgggggaatatggtgtgttcagtttgttaaagtatattttgattgtttcatatcgcacctatgagatttcttttt

SEQ ID NO: 1874 - DNA, 807 bp, Allium cepa
cctactaccctccgtgtgcctcggtcgagtctcacgaaaggacagtggtagtcacgacagagacggggggggcgccacacattctttccctaagcaaaaacaacgtctccagattcttctccaaatcaaattagggtttcctcaataaactcaacacgtgatcttggaactcgaaacgtcatcgacatcattttctttatcgatctacaggcacgcagatataattctttccaccatcaatttgataccacacagttgtcaaaccagtcatcaaacaaactcggattcatcagttcatggcagctttcagaaattttctcaacagcccagtgggcccaaaaactactcatttctggggtcctgttgcgaattggggattcgtcgtagctggtttggtagacatgcaaaaacctccagaaatgatatcaggcaacatgagtgcagctatgtgtgtttattcggcactcttcatgaggtttgcatggatggttcaaccacgcaattatttgcttttagcatgccatgcctctaatgaaactgtccaactacatcaattttctcgttgggcaaaatatcaggggtatttgggcaaaaaagaggcagaagtgcagcaatgatgatcggatatgcatacattttacaataaaatttatcatttgggtaatctttgttcacaaaatattactggctacagtatcatttatttaatatttgaatgggaatatggtgcgttcagtttcatcaaatatattttgattatttcatccgagtattctggggtaattatcatcttatgagatttcactt

SEQ ID NO: 1875 - DNA, 784 bp, Allium cepa
aaaaaggaatacgagctagcccttgcttaccttcagcagccgctccaagtaatattctccttttcggggtctacggtctactctttcgattgattcatctattcatggcagcttttagaaattttctcaacagtccagtgggtccgaaaactactcatttctggggtcccgtcgcgaactggggttttgttgtagctggtttggtagatatgcaaaaacctccagaaatgatatcgggtaacatgagcgcagctatgtgtgtttattcggcactcttcatgaggtttgcttggatggttcgaccacgcaattatttgcttttagcatgccatgcctctaatgaaaccgtccaactctatcaattctctcgttgggcaaaatatcaagggtacttggggaaaaaagaggcagaagtgcagcaatgatgaaattgcttatcggacatgcatacattttacaataaaatcgatcagttgggtgatcttttgttcataaaatattactggttattgtgtcatttatttgatatttgaatgggggaatatggtgtgttcagtttgttaaagtatattttgattgtttcatatcgcacctatgagatttctttttattgcaccttttttctgtacgtgcatatctcacattcacatatgttgaaccaaatattttagctcatgtattttatgacatacataaattaatttagaagaaaatgagggtcgatctggttgatttttgatggaatttagttggttctgatcaaagtttgtcctcatttaatatc

SEQ ID NO: 1876 - DNA, 540 bp, Populus trichocarpa
tcggattttttctccgatgttcttggcgatcgtctctctgaggtattcaagaggattcagttgttttcaatggctgcttacttcagaacattcttgaacagtcccgttggtccgaagacaactcacttttggggacctgttgccaactggggatttgttgctgctgggttggtggatatgaaaaaccccccagaaaagatttcaggaaatatgacaggagctatgtgtgtttgctcggcattgcttatgaggtttgcgtggatggtacagcctcgaaactatctacttctagcatgccatgcttcaaatgagactgtgcagctctatcaattgtcccgttgggcaaagggtcaggggtacttgccatcggagaaaaaggaggaaaccagatctccgtaacttgatgcaactgcttttgctgccctgtttccagttaattttatcgtcatttctgaagaaatttgttgtgatttcatgtttcgaatcccctggatcaacgttgttaccacatgtataaccatgcagcagcttgtttatctt

SEQ ID NO: 1877 - DNA, 761 bp, Musa acuminata
ctcgtgctcaacacgtgttatctatcggtccgcgtccgaccctcgggattcaccgacctcttcctccagcggcgtcgggctctcttcgccaacttcagcgcgccgccgtcgggagctacgtctgctcaccttctgtcgtcgccggctttctccgaggtagaagagattggtgcttctgatggcagcccttaaagctttttggaacagccctatgggtccaaaaacaactcatttttggggaccagttgccaattggggcttcgttattgctggtttggtagacatgcagaaacccccagagatgatatctaggaatatgacttcagccatgtgtgtctactcagcacttttcatgagatttgcgtggatggtaaaaccacgtaactacttgcttcttgcatgccatgcctctaatgaatcagttcagctctatcaattatctcgttgggcaaaggcacaagggtaccttgagaagaaagagcctgaaggtcagcactaagctgttacatgagcttcttcaaaagatttctctgaataagaagggagggatatggtaccgttgatgaggaaaacttttgctgcttgggaatgtaaaactagttggaaatatgactagttttttttatgaagtattgtgattatgttaacaaagatatgactgtcaccttcttgggcagcctttgtgagtttgctaaaattagcaaactcaatccacaagtctacggtaaatgggagattttggatagcatcagtgtgtatag

SEQ ID NO: 1878 - DNA, 702 bp, Brachypodium distachyon
ccaccaaccaaatcatcttcatcctccccaagcttctcgccgacgcctccgccctagcccgtcagctcgtcggcctccctccccgacccgccgccgtcgaacaatcgagcaggtgatttgcgcgccggcgagttcctctatggcgacggcgttcaaggcgttcgtgaacagccccgtcggccccaagaccacccacttctggggccctgtcgctaactggggcttcgtcctcgcgggtttggttgatttgaacaagccacctgaaatgatatctggcaatatgacagcagccatgtgtgtgtattctggactttttatgaggtttgcatggatggtacagccgcgcaactacttgcttctggcatgccatgcctccaacgaaactgttcagctctatcatttgtctcgatgtgctaaggctcaggggtacatagggaaaaaagagccagaggctcaacagtaaagaagccccagaatgctgcagacactcaatcaataaggattatttctttctgaagattgataatgctcaatctgtgatcatgcatttttctctgtactgcataaagagtacgcaaaatggaaacctctataaaacctatgtaccgagcatcacaatttcttgttccttaattctgatgctttgctacgcatctatcaaaaaacatgacattttctcagtgaacatagctgggttacaag

SEQ ID NO: 1879 - DNA, 1431 bp, Cocos nucifera
cacgccaagtgtctgaattcccacctacccgattccccttcttcatgacctaacgctctctctccgattccccttctccatgaccgctccctctccggtctccctccctcgcccgagcaagctttcattcccatcgaatcgagtctctggcgcctgcgccttctgatcagccttagccgactcgtctcttctatcctcagccttagccgactcgtctcttctatcatcagccttagctgactcgatctcgtcgtcccagcgccttgatctcggtattgaagcttgtttattgcaatggcggctttaaaagctttttggaacagcccagtgggtcccaagacaactcatttctggggacctgttgccaactggggcttcgttatagctggtttggtagatatgcagaaacccccagaaatgatctctggcaacatgactgcagccatgtgtgtctattcaggactcttcatgaggtttgcatggatggtgaagccacgaaattacctgcttctagcatgtcatgcctctaatgaatcagttcagctttatcagctgtcacgttgggcaaaagcccaaggatacttggataagaaagagccagagttgaaccagtaatttctaggagcttcttcgaaagtgttattgtgcaactcaataaaaggataatgtgtaactcaagcttcttattgatcagacagaaccagaatctttcatgctgaaccattattgcatgagaattacccccaggaagtcccattttattcgcaatagtctaatttactcatacatgatgctgttttttcttgcttctggaatcctattgagcttcttggattgaagaaccccttttgagtatgacaaggctccttgccagattcagatgcatgtattaagttgatcattcatgtggaatttaaccatttggagaccttgctctagtatgtcctgatcatctacttcatcttgacttatgatgaatgaagccacttgacagccggcctcgtgtctccagtccaggataatttgttcgtatcctctgcactcactcaataggaatttgagagcagatcttctcatgcttcaactggctgcctaaactttatcatcaacatatagtggcatattatgatctcgcccatggtcgggtctcttcaacctcttggcttcttcaaggagacagccagcattctcgcttgctacgcaatgtgaatcagcaacctaaattccggttgaatttttacgtatgttaatcttctgctttaggcatgtaatctagttagattgatgctatccctttggactagccttataacaaaccataacatacaaacatggaattattgcccattgagggttcgttcatgtttgttgaagcgtcatttcaaatagcatgtcatttggtgtggcaccaggattacgggagaggtgata

SEQ ID NO: 1880 - DNA, 1228 bp, Cocos nucifera
cacgccaagtgtctgaattcccacctacccgattccccttctccatgacctaacgctctctctccgattccccttctccatgaccgctccctctccggtctccctccctcgcccgagcaagctttcattcccatcgaatcgagtctctggcgcctgcgccttctgatcagccttagccgactcgtctcttctatcctcagccttagccgactcgtctcttctatcctcagccttagccgacgcgtctcttctatcctcagccttagccgacgcgtctcttctatcctcagccttagccgactcgtctcttctatcctcagccttagccgacttgtctcttctatcatcagccttggctgactcgatctcgtggtcccagcgccttgatctcggtattgaagcttgtttattgcaatggcggctttaaaagctttttggaacagcccagtgggtcccaagacaactcatttctggggacctgttgccaactggggcttcgttatagctggtttggtagatatgcagaaacccccagaaatgatctctggcaacatgactgcagccatgtgtgtctattcaggactcttcatgaggtttgcatggatggtgaagccacgaaattacctgcttctagcatgtcatgcctctaatgaatcagttcagctttatcagctgtcacgttgggcaaaagcccaaggatacttggataagaaagagccagagttgaaccagtaatttctaggagcttcttcgaaagtgttattgtgcaactcaataaaaggataatgtgtaactcaagcttcttattgatcagacagaaccagaatctttcatgctgaaccattattgcatgagaattacccccaggaagtcccattttattcgcaatagtctaatttactcatacatgatgctgttttttcttgcttctggaatcctattgagcttcttggattgaagaaccccttttgagtatgacaaggctccttgccagattcagatgcatgtattaagttgatcattcatgtggaatttaaccatttggagaccttgctctagtatgtcctgatcatctacttcatcttgacttatgatgaatgaagccacttgacagccggcctcgtgtctccagtccaggataatttgttcgtatcctctgcactcactcaataggaatttgagagcagatcttctcatgcttcaactggctgcctaaactttatcatca

SEQ ID NO: 1881 - DNA, 666 bp, Avena sativa
ctcctcgccgttgccctcgctcgtcaactcgtcgacctctctctccggaccgccgccgtcgaacaatctaggtgatttaagcgcaggcggggaagattctgacatggcgacggctttcaaggcgttcgtgaacagccccgtcggccccaagaccacccacttctggggacctgtcgctaactggggcttcgtcctcgcgggtttggttgatttgaacaagcctcctgaaatgatatctggcaatatgacagcagccatgtgcgtgtattctggactttttatgaggtttgcatggatggtacagccccggaactacctgcttctggcgtgccatgcctccaacgaaaccgttcagctctatcatttatctcgctgtgcgaaagctcaggggtatatagggaagaaagagctggaggctcaacagtaaagatgccccagaatgctgcagtcactcgttcaataagcaatttttttcctgaagatttttaatgctcattccggatgatacagttcatgtactgtactgcataaagagcttgtgaaacggaaacctctacaaaacatctgttccgaatttctcgtctgttaatcctgatgctttgatgcgcatttatcaaaacacatgccattctgtcaatgcacggagttggattacaattcatgtta

SEQ ID NO: 1882 - DNA, 547 bp, Allium cepa
cttctagccaatctcaggctccattttgttcctgaattttgaaaacctagattcatctattcatggcagctttgagaaattttctcaacagtccagtgggcccgaaaactactcatttctggggtcctgtcgcgaattgggggttcgttgtagctggtttggtagatatgcgaaaacctccagaaatgatatcgggcaacatgagtgcagctatgtgtgtttattcggcactcttcatgaggtttgcttggatggttcaaccacgcaattatttgcttttagcatgccatgcttctaatgaaaccgtccaactatatcaattctctcgttgggccaaatatcaggggtatttggggaaaaaggaggcagaagtacaacaacaataaatggatatgcatgcattttacaataaaatcgatcagtgggcataatctttgttcacgaaattttactggttgctgtataatttattttaatatctgaagggaatatggtgtgtacagcttcttaatatgtattttgattgtttcatttcacacctatgtag

SEQ ID NO: 1883 - DNA, 2371 bp, Brachypodium distachyon
taaagacaatgtttaatggatgatacgcctgcttaggcgtattcttgaaagaacaaattaagtcgatgttttaatatttctatttttttttgctatgtccatgattaatttagatgactagaggaactagaattttataatgaaacaacaggcaaaatatttaggcaaatgcaggtgtacctatggtggattagatattttatctcaaccgtcggatggagaagtagtagtcgtcattctccaactactccaccaaccaaatcatcttcatcctccccaagcttctcgccgacgcctccgccctagcccgtcagctcgtcggcctccctccccgacccgccgccgtcgaacaatcgagcaggtgatttgcgcgccggcgagttcctctatggcgacggcgttcaaggcgttcgtgaacagccccgtcggccccaagaccacccacttctggggccctgtcgctaactggggcttcgtcctcgcgggtttggttgatttgaacaagccacctgaaatgatatctggcaatatgacagcagccatgtgtgtgtattctggactttttatgaggtttgcatggatggtacagccgcgcaactacttgcttctggcatgccatgcctccaacgaaactgttcagctctatcatttgtctcgatgtgctaaggctcaggggtacatagggaaaaaagagccagaggctcaacagtaaagaagccccagaatgctgcagacactcaatcaataaggattatttctttctgaagattgataatgctcaatctgtgatcatgcatttttctctgtactgcataaagagtacgcaaaatggaaacctctataaaacctatgtaccgagcatcacaatttcttgttccttaattctgatgctttgctacgcatctatcaaaaaacatgacattttctcagtgaacatagctgggttacaagatcccttccagtttattgagccggccactgttgtttcattttatcctcgatttctcctcaagtcactggtttgcattgttctgagccgtgatgaacggtctgaatacttcctgagaaaaaggctggttcacttgaagaaacggcaaactacgaagggcaatggaaataagaagagggcctgatatcattagtcgtctattttggagtatcctggcccctgtctagagttccacagactcgactatgcagccctatgctcaacgacgtgcaactcggtcgactgagaaatagtaaaaaaaaagttttcccattgatagtgctcttaattatacagttaggctgtctgctatcgttagtcaacatggtttccaaggatcgggcgcagccgtggtcgacgtcgttgtcactgccacgacggctatacgtggtcttatctcatctcccttcctcagcacatctcggagtctcgggtcctccctcgatgtcccacacaagtggcatctaaagttaaagttccccatttgatcaaccaatcatgcgtgttggacagctactaagttaagcacttccgttttactactctattagcagtattgtgcttgtttagttagttgcctcaccggtcattgctcgacacatagcgtccgtcatcggatagttaaaaatgcgaccaattaatctaggacagtctcaaacaagcagacaattgttggggacaaatccagctaaactactcttggagttggagatgtatatacatcgacgacctaggataacctggtgtaagtgtaacccgatcgagtagttgtaaaacgcgcgaatcattgcattgctggttgccaactgatgccactctagtcttagaaatacagaagatagagccaggatgagcatctagttattgtggtagtaggaaccaggtaaatcaactccccgcgttcgtcaacgactcctcggcctccatatcctacctcaaacaaacccgaggtacatacatgctcccacactcccgctctccgtttttccaagcgcgcttgctgctgctgaaatcgattcttgtcactgaactaactactgattcgatatggcgtggccgagataatcgagcaggtggtcgatcttcactgccgcgggttggttaaggttccggttccgccatggcgacagcgttcaaggcgttcttgaacagccccgtcggccccaagaccacacacttctggggacccgtcagcaactggggattcatcctcgcgggtatggctgacatgaacaagccacctgaaatgatatccggcaggatgacagcagtcatgtgtgtgtattctggcctctttatgaggttttcatgggtggtggtgccccggaacatctttcttttggcgacccatgcctccaacgaaagcgttcagctctatcagtt

SEQ ID NO: 1884 - DNA, 468 bp, Cannabis sativa
ctaagttgctctctcgaataaaagcatataattattattaataaggaaagaatatttgatttgaggagttggtgggtgctgtgttagctctgttcaatacttcaatccgatcagatcatctactccggcgacccgacccattttctctgaacaaagtaaacggatatggcttcattccgggcattcttgaacagtccagttggtcccaaaacaactcatttttggggccctattgctaattgggggtttgttgctgcggggctagtggacatgcaaaaaccaccagaaatgatttctgggaacatgaccgcagcaatgtgtgtgtattcagcattgttcatgagatttgcatggatggtacagcctcgtaactatctgcttttggcttgccatgcttcaaatgaaactgtacagctttatcaattatcccgctgggcaaagggtcaggggtaggtttccgagagctct

SEQ ID NO: 1885 - DNA, 1310 bp, Cirsium arvense
gacgccgagttcttctgccgtctaaatctccggcgacgaggtgctttcacatcaaaataatatatggctgcctttcgagcattcatgaacagtcctgttggacctaaaacttctcatttctggggcccggtcgccaactggggatttgttgttgcggggctggtggatatgcagaaacctccggagatgatatcaggcaacatgaccggagccatgtgtgtgtattctgcattattcatgaggtttgcgtggatggtgcagcctcgtaactatctacttctagcatgtcatgcttcaaatgagtccgttcagctctatcaattttcacgttgggcaaaaagccaagggtattttcaacagggagataaggccccatcaacttgaagtgcaaccttggactctttctttgtgtggtaatttttgttttagtttctttgaagcctttgatataatcattgaatttaaactaagctctgaattcaccatcttgatcgtcaatggcgatactgacgctgatttggtcgttgattttttacctttttacactttttattgtgttattcggtatttgattcaataaaaatccgacatgttcttttttgattaagatgacagaaacctttctatttcacacgatgataacaaaaaagggtttgttgaagtagtatgtttttaagtcgatcatttacttaccttattgctgcaacaatcttgccatgcatcgatcatcatggaatcatgaagtttgcttttctgccagatgccatgtatgggtgcctaagaatttgcactccatagcatttgctcgcatggtcttgagaaagttgtaggcgcacatgtggaacgtttttccaactctccccaagcgcaggctttagagtacctccttctcccccaaccatatgatttataaccaccacagcaatgttgtgtttatcagccaactccttgagcaagtatccaacagaaaccatcaaagcatgtccttgtgcactgctgccccctagaattggagcaataagagatgaaactgagtcaacaattatcaaccgtacttggtatcctgtctgagatttcacatttagctttagctgatgaagaacattcagcaaggcataaatgtcaaaaacagcatggcactctatgtttctcattgcttgttgaaggattgcattgatcttgttctcggctgaaccagatatatgagtaattatttgctgaatgcgtgtagacgaaaatgagtttcctgagtcaagaaagacaacgctaccaaacttcatagccacattcgatgcaacttgaaagcaaac

SEQ ID NO: 1886 - DNA, 815 bp, Vigna unguiculata
caatatagtgaccacgtttgttaaatcaaaagcaataaaaggtcgttaccaacccttccttcagatttgactctccggcgctgtccttctcttctgcattcaaccggcgattctcatttcttcagttcttgaagtagcaccagtatttaatggcttccttcagagcattttggaacagtccaatgggtcccaaaactactcacttttggggacctgttgccaactggggatttgtggcagctggattggctgacatgaagaaacctccagaaatgatctctggcaacatgacaggagcaatgtgtatctattcagcattgttcatgagatttgcatggatggtacagccacgcaactatctactttttgcttgccatgcctcaaatgagactgttcaactttatcaattctctcgatgggcaagggcagaggggaatttgtctgctgagaaggaggaaacttcagctcagtaacatgatgatgacactttcctcggtgtagtgatttaaaagattttgcatttgaacttgtcgacgtatgaataagtgatcagtggtggtaacgagggccttgtggaaactgctaaggattctggccgagttgagcgtatttgagggcgtatgggtgggttttatatgtctaacatattaactgacccatgaatgtttaattttaaagcataacaaagatttgtctatttctgaaattcatttcaattacaaacttgaagttgagcgttgaggattgtattgtgactagttcttttgttgatgttattgagataaaaataataatttcataaaaaaaaaaaaaaa

SEQ ID NO: 1887 - DNA, 734 bp, Cryptomeria japonica
ggtataattgtcttgtgaaagacggggggattcgttctttcggcagcaggaaaggagggaaccctcgtttggttttacaggaggtaattttaagtgcatttggaacacagaatggcaacaacatttcggacttttttgaatagccctgtaggccccaagacaacccacttctggggtcctattgccaactggggatttgttgttgctggcttggtggatatgcagaagccaccagatatgatctcagggaacatgactggagcgatgtgtgtgtattctggattgttcatgagatttgcttggatggttcaaccacgcaattatctgcttttggcttgccatgcctcaaatgagactgtgcaactttatcagttttctcgatgggcttctgctaatgggtacctgccaaagaaagagggacctgagaaacagtaaaaaaatgttattctgttacctgttttttgttaaaattgaggtcaatgtggcctttttcttttagattctgtggtatataattattttgttatgatggaagtgttggtatgtgcactgagacaaaaaaatcccatctgataaaattacagtgatcaaaatatacgtttatggggtcagaaataacatgacaatcaatatacttgattcaactcattttgggcattccattttaactcgtgtccataaatgtccttttttccagagcctcttaatagaaaatggatgaatttacattgtgg

SEQ ID NO: 1888 - DNA, 852 bp, Festuca arundinacea
cgagccaaaatcatcgtcatcctcctccccaagctcctcgccgtcgccctcgctcgtcaactcgtcgacctctctccctgacccgccgccgtcgagcaatctaggtgatttgagcgccggtggggaaggttctgacatggcgacggctttcaaggcgttcgtgaacagccccgtcggccccaagaccacccacttctgggggcctgtcgctaactggggcttcgtcctcgcgggtttggttgatttgaacaagcctcctgaaatgatatctggcaatatgacagcagccatgtgtgtgtactctggactttttatgaggtttgcatggatggtacagccacggaactacttgcttctggcatgccatgcctccaacgaaaccgttcagctctatcatttatctcgctgtgctaaagctcaggggtatatagggaagaaagagccagaggctcaacagtgaagatggcctagaatgctgcagccacccttcaataagcaaaatttgtttttttttcccgaagattttcaatgctcattccggatgatacagttcctgtactggactgcataaagagcttttgaaatggaaacctctctaaaacgtctgttttaaatttctggtttgcgaatcctgtggctttgatgtgcatttatcaaaacgcatgccattttgttaatgcacagagttggattacaatccattttattcttgtggtgatgagcacaaggtgaacagttatttcgccttttatttttattctcgatatgtgattttaatggttttttctactcaagtctatggtccagattgttcttgtatttgatgtacgatcaaaaaaaaaaaaaaaaaaa

SEQ ID NO: 1889 - DNA, 777 bp, Festuca arundinacea
cattcatcatccccttccccagctcctcgccgtcgccctcgctcgtcaactcgtcgacctctctccccgacccgacgccgtcgaacaatctaggtgatttgagcgccggtgggttaggttctgccatggcgacggctttcaaggcgttcgtgaacagccccgtcggtcccaagaccacccacttctggggacctgtcgctaactggggcttcgtcctcgcgggtttggttgatttgaacaagcctcctgaaatgatatctggcaatatgacagcagccatgtgtgtgtactctggacttttcatgaggtttgcatggatggttcagccccggaactacttgcttctggcatgccatgcctccaacgaaaccgttcagctctatcatttatctcgctgtgctaaggctcaagggtatatagggaagaaagagccggaggctcaacagtaaagatggcccagaacgccgttgtcgctcgttcaataagcaaaaattgttttttctgaagattttcaatgctcatccaggatcatacagtttctgtactgtactgcataaaagtgcaaaatggagaccctacgaaacctctgttgcgagcatcagaatttatggtttctgaatcctgatgtttgacatgcgtttaccaaaacacatgacattttgctaaattacacttcatttaatcctcaatacgttgatgttatcttctttctgctcacgtccaagttgttctggtatttgatggacaatcacaagtgagtcacttcctgataatttg

SEQ ID NO: 1890 - DNA, 782 bp, Actinidia deliciosa
aaatatgttaaatacatactcctacattcatgaagagtaaaaaacactttctactaccaagacggcaggagtaacagacaaacagaaaagactctcggcagcagcgaatcacccctctcgtcaaagatccaaccaccctcctctcctctcctgttttcatctctcctcttttggctgcgaatttcaactctctctctctctctcatctccgtccatcgacctccggtaacgatatattttgattaccagctgtcacattatgtctgccttccgagcattcttgaacagtccagttggccctaaaacaactcatttttggggacctgttgctaactggggattcgtaattgctgggctggtcgacatgaagaaaccccctgaaatgatatctggcaacatgactggagcaatgtgtatatactctgcactattcatgaggtttgcatggatggtacaccctcccaactatctgcttccagcctgccatgcctcaaatgagaccgtgcagctctatcaattctctcgctgggcaaagggaaacgggtacttggggcagaagaaggacgaggctgcacctcagtaacttggcgctgcttttcttttctgttcttgtatttgacgatttttgtggtggtcgctcctgcagaagcaataatgatatgtgattaggattctagcagaaccaagcaaatcacttcaagtagatcttggattgctgttatgttgtttgtataattgtattgcaccggttgtgttacagtctatattacttgcaatgaact

SEQ ID NO: 1891 - DNA, 717 bp, Lolium multiflorum
aaacaagaatctaaaaaagaaacattccccaaatccccactctccatctgcgccaccaaacatctctcctccccctgaactcgcctccgccgtcgcccgtcaactggtcggccatcctctccggcaggcagccgtcgagtcatccgctcgaggcatggcgacggcgttcaaggcgttcgtgaacagccccgtcggtcccaagaccacccacttctggggacctgtcgctaactggggcttcgtcctcgcgggtttggttgatttgaacaagcctcctgaaatgatatctggcaatatgacagcagccatgtgtgtttactctggactttttatgaggtttgcatggatggtacagccacggaactacttgcttctggcatgccatgcctccaacgaaactgttcagctctatcatttatctcgctgtgctaaagctcaggggtatatagggaagaaagagccagaggctcagcagtaaagatggcctagaatgctacagtcactcgcgcaataagcaaaacttgttttttcttgaagactttcaatgctcattccggatgatacagttcctgtactggactgcataaagagcttttgaaatggaaacctctctaaaacgtctgttccaaatttctggtttgcgaatgctgtggctttgatgtgcatttatcaaaacgcatgccattttgttaatgcacagagttggattacaatcca

SEQ ID NO: 1892 - DNA, 783 bp, Lolium multiflorum
aactcgtcgacctctttccccgacccgccgccgtcgaacaatctaggtgatttgagcgccggtggggaaggttctgacatggcgacggctttcaaggcgttcgtgaacagccccgtcggccccaagaccacccacttctggggacctgtcgctaactggggcttcgtcctcgcgggtttggttgatttgaacaagcctcctgaaatgatatctggcaatatgacagcagccatgtgtgtgtactctggactttttatgaggtttgcatggatggtacagccacggaactacttgcttctggcatgccatgcctccaacgaaactgttcagctctatcatttatctcgctgtgctaaagctcaggggtatatagggaagaaagagccagaggctcagcagtaaagatggcctagaatgctacagtcactcgcgcaataagcaaaacttgttttttttttcctgaagactttcaatgctcattccggatgatacagtttctgtactgtactgcataaagagcttttgaaatggaaacctctctaaaacgtctgttccaaatttctggtttgcgaatcctgtggctttgatgtgcatttatcaaaacgcatgccattttgttaatgcagagttggattaaaatccattttattcttgtggcaatgagcacaatgtgaacagttctttcgcctttttatttgtattcttgatatgtgattttatcttttttctgctcaagtctatggtccagaatgttcttgtgtttgatgtacgatcacaagtgag

SEQ ID NO: 1893 - DNA, 1059 bp, Pinus pinaster
ggaaaggcaacccccggcgtacctctgagtattgtgaaaccatcacgatccttttgctctttggcagatctgaagggtactttaagtacagccgaatcaaggaatggcagcattgcgaacattttggaacagtcctgtcggccccaaaacaactcatttctggggtcccgttgccaactggggcttcgtcgttgctggcttggttgatatgcagaagcccccagatatgatatcagggaatatgactgcagcaatgtgtgtatactcaggattgttcatgagatttgcctggatggtgcagccccgcaattatttacttttggcttgccatgcctcaaatgaaactgtgcaactttatcagctgtctagatgggcttctgctaatgggtacctactaaagaaagaagaagccgagaagaaataaatgtttctgccacgtgatatttgcctttcattcctattctctgcaatatgccttttttattttggctgttgattatgatgaaaatgttggggtatttgctgaaataccaaatccttgtggtgcgattccagttatcaaaaaattaagtataggcacgatgctttcatattagtttggtaatttggtataaagctaggaattgcattagacaagcacaagaaaagttgacaatttgtagcttttagagaagtattttgtcctttttatcactcgtgagattttaaatcattttttcttgttttaaattcttgagcatttgaatcgtcttgtggattgattggcccaatgcaatgttagaaatttccaatcctgataagacgtttgaacacaaaatcaaatcaagctgaagattttagaaatccctattttctcgactctcaatatgtagaggttataaaatttgtaaggtttgctgaatgctttagagatacattgactaagcaccatgattacaggtgacatgcagtccctgtcagccaaagcatacctctggaatcaatcttaaaatgcaggttcctggtggcaggatatgctttagagactaaagtaccgtgaagaacccaaaaaaaaaaaaa

SEQ ID NO: 1894 - DNA, 680 bp, Avena sativa
gcctccccaagctcctcgccgttgccctcgctcgtcaactcgtcgacctctctccccggaccgccgccgtcgaacaatctaggtgatttaagcgcaggtggggaagattctgacatggcgacggctttcaaggcgttcgtgaacagccccgtcggccccaagaccacccacttctggggacctgtcgctaactggggcttcgtcctcgcgggtttggttgatttgaacaagcctcctgaaatgatatctggcaatatgacagcagccatgtgcgtgtattctggactttttatgaggtttgcatggatggtacagccccggaactacctgcttctggcgtgccatgcctccaacgaaaccgttcagctctatcatttatctcgctgtgcgaaagctcaggggtatatagggaagaaagagctggaggctcaacagtaaagatgccccagaatgctgcagtcactcgttcaataagcaatttttttcctgaagatttttaatgctcattccggatgatacagttcatgtactgtactgcataaagagcttgtgaaacggaaacctctacaaaacatctgttccgaatttctcgtctgttaatcctgatgctttgatgcgcatttatcaaaacacatgccattctgtcaatgcacggagttggattacaattcatgttattc

SEQ ID NO: 1895 - DNA, 1018 bp, Elaeis guineensis
cttctccatgacctaacgctttgtctccggtctccctccctctcccaagcaagctctcatccccatccaatcgagtctctggcgccggcgccttccgatcctcgattccttggttcttggctcgtctcttctatcatcaggcgactcgatctcgtcccagcgccttgatcttgcgccggcgatcttcgagccatttggcccccgacgtcccagattctttggttcgggttgcctccttaaggtactgaaggttgtttattgcaatggcggccttaaaagctttttggaacagcccggtcggtcccaagacaactcatttctggggacctgttgccaactggggcttcgttatagctggtttggtagatatgcagaaacccccagaaatgatctctggcaacatgactgcagccatgtgtgtctattcaggactcttcatgaggtttgcatggatggtgaagccacgaaattacctgcttctagcatgtcatgcctctaatgaatcagttcagctttatcagctatcgcgttgggcaaaagcccaaggatacttggataagaaagaaccagaggtgaaccagtaacttccaggagcttgttcaaaagtgttattgtgtaactcaataaaaggatagtgtgtaactcaagcttcttattgatcagacagcaccagaatctttcatgctgaaccattattgcatgaaaattaccccctgggagtcccattttgttcacaaacaagtccaatttactcatacatgatggtatgtttcgttgcttctggaatcctgatgagctgcctggatttaagaacccctttcgagtatgacaaggctccttgccagatttagatgcatgtattaagttgatcaaaccatttgttggcttcactctagtatgtcctgatcatctatttggcttatgatgaatggagccactggacagccaaccttgtttactaccaaaaaaaaaaaaactacgagactacgaccaacggacgaccaaccgaaggggaagg

SEQ ID NO: 1896 - DNA, 749 bp, Phalaenopsis aphrodite
ttcatctgatccttcctctcgcacagcgaagaagccgaagcggatgagacggtgacagcttcgttgtctgtacagctctcaataagtttggttcagaagcatcgcctgttgcgatggcagcacttcgagcattttggaatagcccggtgggccctaaaacaactcatttctggggaccagttgccaactggggttttgttactgctggtttggttgatacccagaagccaccagaaatgatatctggtaacatgactgcagctatgtgtgtttattcgggactcttcatgaggtttgcgtggatggttcagccgcgaaactacctccttctagcttgccatgtctctaatgaaacagttcagctctatcaactttctcgttgggcaaaggctcaagggtatctgtcaaacaaagagccagaaggacaaaagtagcttgtggcttgtgagtgatctgctgctgctgatgatgtttcattcaaggaacaaatgccaatttcttcctatatataaaatggcattcagtatttatgcaaatctttgtttctgaattcatcatttgatacggttacgcttttaagctcaaatggtggcattgaacaggcaatttcttaaaaacaggccataaaatcactatttgttagataatttcctaacttttgtattcagatttaccttttttttatcatttcgacagcctttcgagtaccagaaacaaagttttttctagtttattatgcttcttttttt

SEQ ID NO: 1897 - DNA, 667 bp, Phalaenopsis aphrodite
ctcgcacagcgaagaagccgaagcggatgagacggtgacagcttcggtgtctgtacagctctcaataagtttggttcagaagcagcgcctgttgcgatggcagcacttcgagcattttggaatagcccggtgggccctaaaacaactcatttctggggaccagttgccaactggggttttgttactgctggtttggttgatacccagaagccaccagaaatgatatctggtaacatgactgcagctatgtgtgtttattcgggactcttcatgaggtttgcgtggatggttcagccgcgaaactacctgcttctagcttgccatgtctctaatgaaacagttcagctctatcaactttctcgttgggcaaaggctcaaggctatctgtcaaacaaagagccagaaggacaaaagtagcttgtggcttgtgagtgatctgctgctgccgatgatgtttcattcaaggaacaaatgccaatttcttcctatatataaaatcgcattcagtatttatgcaaatctttgtttctgaatacatcatttgatacggttacgcttttaagctcaaatggtggcattgaactgtcaatttcttaaaaacaggccataaaatcactatttgttcgataatttcccaacttttgtattcagattcaccttttttatc

SEQ ID NO: 1898 - DNA, 663 bp, Platanus occidentalis
agtttagatcttcaagtattggaaggggggaacagtgtttagttctgaaatttttggacggccaggagaagtgtaactaagcaacagtcagttgtaaatggcagccttccgaagtttctggaacagtcctgtgggtcccaaaacaactcatttttggggccctgttgctaattggggcttcgttgctgctggattggtagacacacagaaacccccggaaatgatatctagcaacatgactgcagcaatgtgtgtttattcagcattgttcatgaggttcgcttggatggtgcagcctcgcaattatctgcttctggcatgccatgtctcaaatgaatcggtgcagctttatcagctctcgcgttgggcgaagtctcaggggtatttgcagaagaagaaagaggaagctgaaccacagtagtccgtagctaatgctttctcccccttgaacttggggcttttgcccagtcttctacagacactgttattatcttcttctttgtttcgatttgtgttctcccaatatggttacttctcttttgacttgagagaaaaaactggaagaccagttatgggtgaattgatttatttgtcatctgcccgtatcatttaataaaatgtgcctgtaaaatatttgttctactctttgaatgaaatattgct

SEQ ID NO: 1899 - DNA, 512 bp, Salvia sclarea
ctactagaccttggctgtcactcagattcctgttattttttgatgcttcattatagttttgggtgagaaggaagaagcttttgtgattctttgggcaacatcagtcgttttcttgcaaaacttggcttcgagcaccaaacgacgactttgtttcatcactctcgctgatacaattcagtcacccagaaatcttctctaagggctcctgagttgccgatggcttctttcaaagcatttctgaacagccctgttggtccaaaaaccactcacttttggggccctgttgctaactggggtttcgtcattgccggactagtagacatgaaaaaacctccagaaatgatttctggcaacatgactggagcaatgtgcgtatattctgcgctgttcatgaggtttgcgtggatggttcagccgcgcaactatctgttacttgcctgccatgcttcaaatgagacggtgcaactctatcaactctcccgctgggccaagggtcaagggtaaactccgta

SEQ ID NO: 1900 - DNA, 420 bp, Sciadopitys verticillata
gcaagaaccctcatttcgtttttctgcagatttctggtgtctacaaggtaatttaagtacatttggaaaatacaatggcagcgacgtttcgagcctttttgaatagtcccataggccccaaaacaactcacttctggggccctgttgccaactgggggttcgtcattgctggtctagttgatatgcagaagccaccagatatgatctcaggaaatatgactgcagcgatgtgtgtgtattccggattgttcatgagatttgcttggatggtgcagccccgcaattatctgcttttggcttgccatgcctcaaatgagactgtgcaactttatcaactttctcgatgggcttctgctaatgggtacctgcctaagaaagaggaacatgagaaaaagtgaagatccttaatatctgttctta

SEQ ID NO: 1901 - DNA, 447 bp, Tamarix hispida
ggggagacttgagccgttcagcccagaaagtctcctcaaatctccccctcgcttccggctccggctaatctcaatcgacggcctggtctttacggatagttcgatatggcagcttcatttcgagcatttctgaacagtccagttggcccgaaaacaactcatttttggggacccatcgccaattggggtcttgtcgtcgctggttcggtggacatgaataagcctcctgagctgatatctggaaacatgactacagctatgtgtgtttattcaggattgttcatgaggtttgcatggatggtacagccgcgtaactatttacttctagcttgccacgcttcagatgaggcagtgcaattgtatcaactctctcgttgggcaagggctcatgggtatttgtcagagaagaaagatgaaactcaaactaagactaatccagagtgaacc

SEQ ID NO: 1902 - DNA, 737 bp, Podocarpus macrophillus
tggttctcaacagggtgggttgcaagctgctccaattgcttctcccttttcagatttagtgcttccagtttttttgtgtggtttcagttcaataaaaccagcgcatttcaggatggcatcaacatttagggcttttctgaatagtcccatgggtcccaaaacaacgcacttctggggtcctatcgccaactggggcttcgtggttgctggtctggttgatatgcagaaaccaccagatttgatatcagggaacatgactgcagcgatgtgcatctattctggattgttcatgagatttgcttggatggtacaaccccgcaattatctgcttttggcttgccatgcctcaaatgaaactgtgcaactttatcagctttctcgatgggcttctgctaacgggtacctgtcaaagaaagaggaatctgataaaaagtaaatattgccagtgtcattccgttttcagagccttttacaaaatttacattgaagttcaatggtggtggatgcgtgtttatgtttttggattaaaatactgtgattgatgctgaaacacctgttatcaaactccaatgattggaaaatggtacgacagaagagattgatgttattttggtgttttcatttaatcgtaatgatttttataaagccttcaacaaaatttggataggaaattgcattttaggtaatatagagttttacttgggatttaatactattgatgacgatgatgaaaatgc

SEQ ID NO: 1903 - DNA, 1391 bp, Sorghum bicolor
ccaaccactccgcggaatcgtgcctagccagtcttcttcctccacggtccacggactccggccgcgcgcggcctcgctcgtcgtcgtcgtcgccggccggctccagcctctcgtctcagcctgccggccagccatgtcggcggcgttcaaggcgttcctgaacagcccagtgggccccaagacgacccacttctggggacccgtctccaactggggcatcatcctcgcgagtgtggctgatacacaaaagccccctgaaatgatatccggcaatatgacaggagttttgtgtgtgtattctgcactctttgtcaggttcgcatggatggtacgacctcagaactatttccttatggcaacccacagctgcaacgaggttgttcagctctaccagttgtctcgctgggctagggctcaaaagatatacagtagaagagaagaattatggaacaatttggggcagaaaaaatcttcaaatttattggatgccatgcgacgataccgccgggtgcacttgaactatttaatttttattaatccccattctccaactgcaactggacaagtactggtcctcttcccttccccttcttcatcaattcctctgtttcccccgttctccacctacctcctcgccctcgtcgacttgtctcttccgccgccgccgtcgacgagagctgcgctaggtgatttccgctgcttcccttctcccatggcgacggcgctcaaatcgttcctgaacagccccgtcggccccaagaccacccacttctggggccctgtcgccaactggggcttcgtcatcgcgggtttggttgacatgaacaagcctcccgaaatgatatccggcaatatgacagcagccatgtgtgtatattctggactctttatgaggtttgcatggatggtacagccccgaaattatttgcttctggcatgccatgcttccaacgaaagcgttcagctctatcagctatctcgctgggctagggctcaggggtacctggagaagaaagagccagaggcccaacagtaaagagggcatgcaacactgcaatcacttgttcaataaagaaactatgctgtggaaaacattcattctgttgtcaaagcttaaggatttgttcgtgaagtggtgtcgacagtgcctttagtgagcatgcagtttttgtatgtttgcaaaatatgctgaggaaattttatgattcctagtgctgttacaatcttctgcgtacttttctgtgcatttgccaaggcacatttggttttacattgcgttatgcaatgaatttccccaactattcagcatattgctgccttcttactatttggcactatttgttttacctggctcatgtgcccaaaatgcttagtaaaagatcagtcgttgc

SEQ ID NO: 1904 - DNA, 589 bp, Linum usitatissimum
accactcagtctcttacatcctccggcgatatcccccctcagtggtgaaaaatggctgccctgaaatctttctggaacagtcctgttggtcccaagacaacacacttttggggacctattgcaaactggggatttgttgctgctggtttggtagacatgcaaaaacccccggagatgatctccggaaatatgactggagtgatgtgtgtttattcagcattgtttatgaggtttgcatggatggtgaaaccgcgtaactacctccttttagcatgtcatgcttcaaatgagggtgtccaactctatcaattttcacgttgggcaagagctcaggggtacttgtccgaggagaaaaaagaggtggcctaatggactacccttgacatctgcaattcgctgctgctgctgctgctgcatttttgtttttgttttgcttctctgaactcacgttgcttgtattgaatgcttgagttgagagatcattgggctcagaactctttatagtttatgtttctgattgtgtttatgaccatttgttggagaaataacatgtacagtgcataatgacgaataaaaatttggctctttt

SEQ ID NO: 1905 - DNA, 711 bp, Linum usitatissimum
ggcaccaatcaactgttctttctgctttttggttttttcccctcgtgttttgctttcagtcggacccaacaaccaaactccgtctcttacatcctccggcgacatccccctcagtggtgaaaaatggctgccctgaaatctttctggaacagtcctgttggtcccaagacaacacacttttggggacctattgcaaactggggatttgttgctgctggtttggtagacatgcaaaaacccccagagatgatctccggaaatatgactggagtgatgtgtgtttattcagcgttatttatgaggtttgcatggatggtgaaaccgcgtaactacctccttttagcatgtcatgcttcaaatgagggtgtccaactctatcaattttcacgttgggcaagagctcaggggtacttgtctgaggagaaaaaagaggtggcctaattgactagccttgatatctgcaattcgctgctgctgcatttgttttagtgatttcatttttttcttctctcattctctgaactcacgttgcttgtattgaatgcttgagttgagataatttggttcagaactctttcgagttgatgtttctgactgcgtttatgacgatttgctggagaaataacatgtatagtgcataatgacgaataaaatttggctcttttcatgcttcatttgcaattttggaagtgtatttcctattttgacttt

SEQ ID NO: 1906 - DNA, 728 bp, Daucus carota
aattcatctgttcctcttgtgacttgtctacgatccagaccaaaattctcgtactactttttgtgcagggtagtctgacgagcagactcatatggcttccttcaaggcatttttgaacagtccagttggccctaaaacaactcatttttggggtcctatagccaactgggggtttgttatctctggcctggtggacatgcagaagccagctgaaaatatatcaggcaacatgacaggagcactgtgcatatactctggattatttatgagatttgcttggatggttcagcctcgcaactatctacttcttgcatgccatgcctcaaatgagactgttcaattgtaccagttctcccgttgggcaaagagtcaggggtacttgcaagggaaggacgacaaggctgtatctcagtgatcttggccgctttcttctcctgtgcatcatgtattctggagctttccactcagaaaatagcgtgaattgttttcaattaaaagcagcaggaatgaaactgatctggtcatgagtaaatcagtgcattgttacattattgtttgaattgtattatgtgatttcgtttatgaaagcagcaaagagttttaaagaaatactgttgaacagctaaaaataatttcaccacttatggtgtactaggtcatccccattgcggacttttaactctaacctgtggttaaatcttgtttttagtgttacttccagttttgaa

SEQ ID NO: 1907 - DNA, 727 bp, Daucus carota
aattcatctgttcctcttgtgacttgtctacgatccagaccaaaattctcgtactactttttgtgcagggtagtctggcgagcagactcatatggcttccttcaaggcatttttgaacagtccagttggccctaaaacaactcatttttggggtcctatagccaactgggggtttgttatctctggcctggtggacatgcagaagccagctgaaaatatatcaggcaacatgacaggagcactgtgcatatactctggattatttatgagatttgcttggatggttcagcctcgcaactatctacttcttgcatgccatgcctcaaatgagactgttcaattgtaccagttctcccgttgggcaaagagtcaggggtacttgcaagggaaggaagacaaggctgtatctcagtgatcttggccacttttcttctcctgtgcatgtattctggagctttccactcagaaaaatagcgtgaattgttttcaattaaaagcagcaggaatgaaactgatctggtcatgagtaaatcagtgcattgttacattattgtttgaattgtattatgtgatttcgtttatgaaagcagcaaagagttttaaagaaatactgttgaacagctaaaaataatttcaccacttatggtgtacaaggccatccccgttgcggacttttaaccctaacttgtggctaaatcttgttcttagtgttacttccagttttgaa

SEQ ID NO: 1908 - DNA, 3625 bp, Petroselinum crispum
gagtcgtcgttcttacagaccaaaactcgcaacttcttgtaagaacctatcctcacatatacttacatacatgtatttaatctgaattttattaaattaatctttattctagttgttaattacgatatttttgttaattattgtaattaggttatttatgtgtgtttttattgattgtggattgtgatatgcaactttgagtatgctattgaattgattaggtgatttaggtgacgtcactctatccgcgcttaaagtaactttttaaggacttttattttgtaggacagtacaattagcttttgttaagtgtgtaatttttgatttttgtatgattttaatttacggacttgttagtgggatacgaagagggcgagtaagtgtttacggaaaatgattacgatctttgtgaatgttgttggtatttcgttgtaaggacagtataatgatatgaaatgttttcttttggatgattaatataagcattactttctacccttttgcaaatttatggataaatctaggtttaataacccgagtattaccggaatcagttattgtgtaagtatataaattccgataagaagtattggccacttacgttcaaatattactggatgtccattttggttttttggtttgattggatgatgcaatacgcacatcttcccctcttcatccttaagcagatagcttatgacaagttatagcaaatattaaagtgttggtggctcccttttatgtcaattaaaaggcgagctttcgtgatgagcccgttagattaaagttccatatactttactttcagtcagtaaggatatctggcaacaagagaaaatgaatcaaatgttgttctagaggatacttttagtttctcgttgatttagtaaggctatgctccgttcttttacactccctttttgcaatgtatgctaacactcgagtactgagtcggcatatcctggttgaccaaggcaagtagcaacttctttacttttgttgtagtcagcacagataaaaggttaatacagtggagaaagctaaaagggcttgagaaaattttagtcgagatataattgccactggttacgattcattccactaaatgcctctggtaacccatttcagtgatgctcaatacgtcgacctatagaaagatctcggttgattaataattttgtttgaacatgacaattgggaggtggaggacttttcaattttcctatggctcgatacactagggtttaagttcacttatttttaatatttgctttaactataatttttctattccaacatattaataccacttggtatcattttacaggggggggggggggggggggggggggggggggggggtgtgtgttttagttacatttcattaggtgttattaaaatcatgaattcaagtgtgtccacagagccaaaagaaggaaaggagtttatactattaagagataagccattctcttctatttcatgttattctttgtggagaggatcatatgttcacttgagactaaaagaagttaaactggaatctttatgtgaagatgaagtgactgttattgtttctcacaatggttttgtagatgtttgctacctgtttctcgaattatttttgtatatgttggtgcggagaagattttatttaaattatatattattatatagacatgagtctatttatattatcaaattaaggacatactagaattgagatgcatgatagtagataagtattacgtagtagttactagttagaactaatttcctgttatttagtagtttgttctccaagttttaggatctcaaactaaacaatttcaatcttcatttttagagagagttgtatattatgaattgttgaatattgaaatatgcgtatatattgtgtccttaccgatcctttgtggagataatgcttttttggatttcgtcctacataaaatgtctattctgttttaagtacaagtcatcatctggtggtgtttttgatctttatttatgcgatctaacggtaaaaagacacttttgagtttttgtgtatttgtaccaagtctttatttgtgattaatatgtgcttcaatctaccatgtgattatagatggtcacttgttttcccctctggtacacccgctcaaatgtccccttgtattgtggggcaggaaatactagatatatattaaacactataacgactttggtctataatattgtaggaagttgattcattaaacaaatagatgcccaatatctaactttgaaaagacatttttgcacagctaatcaaaccccctatctaaaaacattattctatcgccttgtacaacgtagtctttcattattagttcatcctgttcctctcttgtctgcgatcggagtcgtcgttcttacagaccaaaactcgcaacttcttgtagtctgagcagcagacataaatggcttccttcaaggcatttttgaacagtccggttggccctaaaacaactcatttctggggtccaatagccaactggggatttgtgatctctggcctggtggacatgcaaaagcctgctgaaaatatatcaggcaacatgacaggagcactgtgcatatactctggattatttatgagatttgcatggatggttcagcctcgcaactatctacttcttgcatgccatgcctcaaatgagactgttcaattgtatcagttctcccgttgggcaaagagtcaggggtacttgcaagggaaggaagacaaagctgcaactcagtgattttggatgctccttttctcctgttcatcatgtattgtggagcttaccacctagaacaatagtgtgacttgttttaattaaaagcagttctgagctggtcactgagtaaatcagttgattcttacgttattgtttgaattcgattgtttgatttcgtttattgaaagcaaggacgagctgaaaagaaatacctttacgcaaccgaaaataatgtcaccactgttggtgtattatcccctccctattgtgttgacttcgaactcttaaattgtggttaattcttgctctagttacttccacttttgaactataatgtacaagtagttcctttaaatattctctaattagaaaaatatataaggtacaagagccaggtaatttgcctagcgaaatttggaccaaatctgattgaaatattagatggtttagtttctttctgaagaagggtcatttttacctgtacagttgactacatttgtagtcataagataagttggaagttagaataagtaatgcaaatcccattttattacagctaacatttaaatgtcggagaaagttatctttgtgcgagtccagctcgtgattatcaccgtcctggtatgacagttcaaaaccatgatttcatcaaactgttattagtttagagttctgattgaaatgtggctggtgttggtttgtacaatgagtcagatctatgatttcttctttaacgggtgtcgcagattcttcggtgctggttcgttctaaacgtgccataattgggacacagattcacattgtaaagagtataattcaacttaaaacagaattatatgacttcgaatgttttcttgaatagtcgaaaaatttatatt

SEQ ID NO: 1909 - DNA, 574 bp, Bupleurum chinense
ggggccttccattgatatgacacaggcttattaaaaactgtaggctgtagctcatagtcgagtgagaaaaatcgatccaaacggttcttaaagattgtgcgaaagtatataattattaccaacagcagaggaccctccctagtcacttttattctgcatagcaggctcatatggcttccttcaaggcattcttaaacagtccagttggccctaaaacaactcacttttggggtccaattgccaactggggatttgtgatctctggcctggtagacatgcaaaagccagctgagaatatatcaggcaacatgactggagcattgtgcatatactctggattatttatgagatttgcatggatggttcagcctcgcaactatctacttcttgcatgccatgcctcaaatgagactgttcaattgtaccagttctctcgttgggcaaaaagtcaggggtacttgcaagggaaggaagacaaagctacgtgaaaatgatctgattttattctctcgtcttttcatctattgtggagcctaccacacaaaacgacagcgtgaattcactgatttgtttt

SEQ ID NO: 1910 - DNA, 547 bp, Bupleurum chinense
aggctgtagctggtagtggtgtgagaaaaatcgatccaaacaggttcttaaagattgtgcgaaagtatataattattaccaacagcagaggaccctccctagtcattttttttttacacagattttgaatagcagactcatatggcttccttcaaggcattcttaaacagtccagttggccctaaaacaactcacttttggggtcctattgccaactggggatttgtgatctctggcctggtcgacatgcaaaagccagctgagaatatatcaggcaacatgactggagcattgtgcatatactctggattatttatgagatttgcatggatggttcagcctcgcaactatctacttcttgcatgccatgcctcaaatgagactgttcaattgtaccagttctcccgttgggcaaagagtcaggggtacttgcaagggaaggaagacaaagctacatgaaaatgattttttctgattttattctctcgtcttttcatctattgtggagcctaccacacacaaaacgacagcgtgaattcactgattt

SEQ ID NO: 1911 - DNA, 526 bp, Bupleurum chinense
tagtcgtgtgagaaaaatcgatccaaacgggttcttaaagattgtgcgaaagtatataattattaccaacagcagcagaggaccctccctagtcacttttattctgaatagcagactcatatggcttccttcaaggcattcttaaacagtccagttggccctaaaacaactcacttttggggtcctattgccaactggggatttgtgatctctggcctggtcgacatgcaaaagccagctgagaatatatcaggcaacatgactggagcattgtgcatatactctggattatttatgagatttgcatggatggttcagcctcgcaactatctacttcttgcatgccatgcctcaaatgagactgttcaattgtaccagttctcccgttgggcaaaaagtcaagggtacttgcaagggaaggaagacaaagctacgtgaaaatgatttcttctgattttattctctcgtcttttcatctattgtggagcctaccacacacaaacggacagcgtgaattcactgattt

SEQ ID NO: 1912 - DNA, 679 bp, Chelidonium majus
gcaaatcatcatcagggggtcatctgaactagggtttctgagagctgggcgatacgagtttctcctcccaatccgcacatttttctagataacagtgcagaaatcagttgaaaatggcagcttttcgagctttcttgaacggccctatgggtcccaaaacaacacatttctggggccctattgccaattggggattcgttattgctggattggttgatacacagaaaccccccgaaatgatatctggcaacatgactggagcaatgtgtgtctactcgggtttgttcatgaggtttgcatggatggtacagcctcgcaactatctgctcctagcatgccatgcctcaaatgagactgtgcagctttatcagttctctcgttgggcaaaatctcaggggtacctggagcagaaaaaagaggaagctaagccagagtaacttctacctgcatgatccaatctttttctccaaaagttgcaattgttttgggctcgatcttctgcaaacagtaactgcttgctttttctgtgtaagctttttctggtacaacttcgaattgaagttgttcctgagtgttgttccttattttggttagcagaagaacagccgagcagactcatcaaatcttggatttcctttttcatttacctttctcacctaaataagttgccagtgtaaac

SEQ ID NO: 1913 - DNA, 789 bp, Distylium racemosum
ggaaaccccatttatatatagagagaggagggggtcttgtccacaggaggagaccgctcttcagaaacaaattgaagtacgtttggagcataggatggcagcaacatttcgagcctttctgaatagtcctgtaggccccaaaacaactcacttctggggccctattgccaactggggatttgtcattgctggcttggttgatatgcagaagccaccagatatgatctcagggaacatgactgcagctatgtgcgtgtattctggattgtttatgagatttgcttggatggtacaaccccgcaattatctgcttttgggctgccatgcttcaaatgaaactgtgcaactttaccagctttctcgatgggcttctgctaatgggtacctcccaaagaaagaggagcatgggaagcactgattgttgccctgtccgttgtttccttgttctctgagcctaagccactactgagacaggagttgcattgtgattaatatgacaattttcttttggattcaatattagtcatttgttgtgatgaaaacaattggtgtatgctgaaatcacggtccatttgataaaattccagaggctgaaaagtagaaatcaaggtaaacaaataattcagattattgtgagatttcattaaaagctcatgtccattgttagcctttttggagagccttaagaaaaatttggatagaagttacattgtggtcaatatggccttctgtttttttgaattccattgtattgatgattattatgttaatgctgggatatgcgctgaa

SEQ ID NO: 1914 - DNA, 390 bp, Lupinus angustifolius
agtggttgaaaccagagcagtaagccatattctgatcacacgtgtgagatttgaagtagtaccagtgtcagatggcatccttcagagcattcttgaacagcccagttggtcctaaaacaactcacttctggggacctgttgctaactggggatttgtggcagctggattggctgacatgcaaaaacctccagaaatgatctctggcaacatgacaggagcgatgtgtgtctattcagcattgttcatgagatttgcatggatggtacagccacgcaactatctacttcttgcatgccatgtctcaaatgagggtgttcaactctatcaactctcccgatgggccaaggcacaggggtaagcagctgagcattggagctaaaacaaaacta

SEQ ID NO: 1915 - DNA, 668 bp, Solanum tuberosum
atttcaattcttatttggcaactatacactagtacgccattggcttaccaaaaattgaccatatattatactatatacacacaagtaactgataatcatcgccattttctcggagcaacccacttttcagatctctgattaaggaaatccacacagtgtatcgcgtatggctagcttcaaggcatttttgaacagtcctgttggccccaaaacaactcatttttggggtcccataggcaactggggatttatcattgctggactcgtagacacacagaaacctccagaaatgatatcaggcaacatgacatcagtaatgtgtgtgtattctgcactgttcatgagatttgcatggatggtacagcctcgtaattatctactaatggtatcccatgcctcgaatgagaccgtgcaactttatcagttatcacgttgggcaaagagtcaaggatatttgcagaagaaagcagacaaagcagagtgatctagtgttctttcctgtttaattctggacatgtacatgtatacttttggtaattttcgatatctctatttgcacagattattgtccttgatcatccaagagctgaactaggagctcaaattattacatatgccacagtaaatagcatgatttgaatggcaagaaatgtaagtatggaagaatt

SEQ ID NO: 1916 - DNA, 871 bp, Pseudotsuga menziesii
tacatagaataatgatgcaatcattccatcgttctgtcaaggtacatattgtagcggtttttgtggagcgagaaggaaaaacagtgccttttgttcatctgcgtttcgggaaaccattgcaatcctttgtttctcgcgcagatctgaagggtaatataagtacggttgaatcaagggatggcagcattacgaactttttggaacagtcctgtaggccccaaaacaacgcatttctggggtcctattgccaactggggctttgtcgttgctggcttagttgatatgcagaagccaccagatatggtatcagggaatatgactgcagcaatgtgtgtgtactcaggattgttcatgaggtttgcctggatggtgcagccccgcaattatctacttttagcttgccatgcctcaaatgaaactgtgcaactttatcagctgtctagatgggcttctgctcaggggtacctaccaaagaaagaggaagctgagaagaaataaatgttgttgccatccaatatttgtacttcattcccattccgggcaatatgccatttttattttggcttcaagaacattattgattatgatgaaaatattggggtattttttgaaataccaacttcttgtggtgataatgatgctatcgtattagattggtatatgggtttaaagctaggaattgcataagaccggcacaagaaaagataagcaatttatagcttctagagaagtattttgtccctattattactcgtgagactttgtgtcgttttctctgttttaggttcttgagagtttaaatcgtgttgttgttatcagctccaatgaaatgtcagagaaatttccaaccccaataagatgtgatttgaac

SEQ ID NO: 1917 - DNA, 718 bp, Rhizophora mangle
cccttctagttaaccgccgagcccgtctctctggctctgcatcatattatcactggtcggttccaaggcttctccggcgatctactttcctgctaattattggggaattcaagcagaagttacaatagatggcttcctttaaagcattttggaacagtccaattggtccaaaaactactcatttttgggggcctattgccaactggggattcgttgttgccgggttagttgacatgaagaagcccccagaaatgatttctgggaacatgactggagcaatgtgcatttattcagcattgttcatgaggtttgcatggatggtacaaccacgcaactatctcctatttgcatgccatgcttcaaatgagacggttcaattatatcaactctcacgctgggcaaaaggccaggggtacttgtcatcaggggaaaaggaaagtccatcacagtaactaaaaagctgcttctttgctgccatgcctaattttcagcagtgattgcaatttctccagaatttatttacttctgcaatcaaactcttttgaaacagcttgcatttgattctattatttgtactgcatcatagccatcgagcagattatgactacgtgaagctttggtttgtcaaaatgttaattatgagggttttggtggcttcttgatgctgtgtaaggactagaaacctgtaatagaggaataacagaaatgcatgccacca

SEQ ID NO: 1918 - DNA, 620 bp, Sequoia sempervirens
aaaggaaggaaccctcgtttggttttaccggaggtgattttaagtacatttggaacatagaatggcagcgacatttcggacatttttgaatagccctgtaggccccaagacaacccacttctggggtcctattgccaactgggggtttgttgttgctggcttggtggatatgcagaagccaccggatgtgatctcagggaacatgactgcagctatgtgtgtgtattctggattattcatgagatttgcttggatggtacaaccacgcaattatctgctattggcttgccatgtctcaaatgaaactgtgcaactttatcagctttctcgatgggcttctgctaatgggtacctgccaaagaaagagggacctgaaaagcagtaaaaaatgttattgtgttaactgttttagttagaattgtagtcaatgtggcccttttatttttgaatctgtggtatttgataatttttctatgatggaactgttggtatgtgcactgaaagacgaatctcatctgataaaattacagtgatcaaaatttacaagtttatgggctcacaaataatattgcactcaatgtacttgattcaactcatttggcatttccatttaacttgtg

SEQ ID NO: 1919 - DNA, 457 bp, Glycine max
gaactgcttaagcaacactatcaacatatggcttctaatttccgagcattcttgaacagtcctgttggtccaaaaacaacacatttctggggacctattgccaattggggatttgttgctgccggtttgatagacatgaaaaaacctccagaaatgatctctggcaacatgacagcagttatgtgcgtctattcagcattgttcatgagatttgcatggatggttcaaccgcgaaactatctgcttcttgcttgccatgcatccaacgaggccgtacaaatacgccaactcacccgttgggcaaaggggaatgggtacctttctgtgaagaaggaaggagcttcgtccaagtaacttgatgctgaatttgcttctttttcatggggctccaaatatcacaatttgcattaaattgattattcatgtagatgatgaatttgtttcttataaccaaaat

SEQ ID NO: 1920 - DNA, 926 bp, Papaver somniferum
ttgtagcagaagaagtgaggtagtggaagtaagagtttgcataccatctgcgaatttgaaggtgtgcaggatttagtagctaatggcggcctttaaagcgttcttgaatagccctgtgggtcctaaaacaactcatttttggggtcctattgccaactggggattcgttgcagctgggttagttgatatgcaaaaacccccagaactgatatctggcaacatgactggagcaatgtgtgtctattcgggtttgttcatgaggttcgcatggatggtacagccacgaaactatctactcctagcatgtcatgcctcaaatgagactgtccagctctatcaattctcgcgatgggctaaagctcaagggtacttggagaacaaaaaagatgaagttaaaaaaccagaggaagctaaaaaaccagagtgacttgaactaaatcagccggttcttgcttgaatttgatcaaatgttctcattttcttctacctagcgattttgcatttaatcttctcttgggtgcaactagtaatgttgaagttgaccttgtattcttgttaattaatttgcttagcaaaagaatcgcagctgagcaaacttttctcccaatcttttaatcttctagatcttcttgacgtttaccagctccatcctaataaattgtcaatactatcaaccaagctgtgaagtctttctttttttctgcctgcaaaaaatctatttgtattgaaacaaggcacaaaagaaatgtgctaaaagagcatatgataagctttatttatatttgtatttgtttatttttttattttcaagttgcgagatagttttatttttcttgtggtgacctctggtcagtcagtaatgatttggccgtatatataagttataacacacaacattggggattagggtgaaaaaaaaaaaaaaa

SEQ ID NO: 1921 - DNA, 481 bp, Triphysaria pusilla
atcaacgcacagtgagaaaaaaaatccgttcaaggctcgtttgtttgctgacacatcaatggcttcttccttcaaagcattcttgaacagtcctgtcggacctaaaacaactcatttttggggccctgtagctaactggggatttgtcattgctggactggtggacatgcaaaaacctccggaaatgatatccggcaacatgactgcagcaatgtgcgtatattctgcgttattcatgaggtttgcatagatggttcagccccgtaactatctgttacttgcatgtcacgcttcgaatgagtctgtgcaactctatcaattcacccgttgggccaagggccaagggtaaatctcgacaaagctgttttctgtttctttctttctgtccgtttttctctcttttttatttgtgtcatgttgtaacactatgttaagggaaaccggtaatagcttaatctgtgtgcaaactcatttcataggt

SEQ ID NO: 1922 - DNA, 655 bp, Persea americana
gctggcttgctctcttctattcttcttccgagagaaagagaagtcgtcaacgttctcggggccatctcacagaatcatttctgcaaattcttcgttcctagggaacttgtacataacagtcgagatgtcagccttccgagctttctggaacagccctgtgggtcccaaaacaactcatttttggggtcccattgcgaattggggattcgttgctgctggattggtggacatgcaaaagcctcctgagttgatatcaggcaacatgactgcagtaatgtgtgtttattcgggacttttcatgaggtttgcatggatggttcaaccacgtaactatcttcttcttgcttgccacgcctctaatgaaacggtgcaactctatcagctctcacgttggggaagggctcaagggtacttgcagaagaaagaggaagctgaaaaggcctagtctcctttagatgcattttgagttggcacatctgtagccaatgctttcttatggacaccattgaatcagttgtaacttcacccattgcattgtcttcttatagagtcctttgctttgactgtttgaaatttcgtggttttattcaagaaatgagtttgaacgtgctttaccatattcgcaaattaatgctgaaaaatattgtcttccctg

SEQ ID NO: 1923 - DNA, 792 bp, Musa acuminata
cgtaattcgacttctcgttcacccattcgccgaccccgtcctccaaggagcgcctccgctgcagccggctctcctcctccatctcgggctcgatagttctataaattggttccatgcccaattgacctcggtttagtcgatagttctagaaatgacaccaaggaaaggattttgattgggtgcttctatagattcaaggaaaggattcgatccctaaagctcgtcttcggctttcttcgaggtagaagagattggtgtttacaatggcagcctttaaagctttttggaatagccctgtagggccaaaaacaactcacttttggggaccaattgccaattggggatttgttgctgctggtttggtggacacgcaaaagcccccagagatgatttctcggaacatgactgcagccatgtgtgtctactcaggacttttcatgagatttgcatggatggtacagccacgtaactacttgcttcttgtatgccatgcctctaatgaatcagttcagctgtatcagttatcacgttgggcaaatgcacaagggtacctggagaagaaagagcctgaaggacagcattaagcttttagatgcgctgcttcaacaaattcgcaataagaaattgatgtgtcgtgttctaacagcatcaaattgctatagaattgatgagaacttccttggaaacatcatttattcagaccatttgattgaatctgtgctttgatttgaatgaatgaactctttttatctgaaatcacacaagtcagttgctgttgatataatattcacc

SEQ ID NO: 1924 - DNA, 870 bp, Phaseolus vulgaris
gtgaaacgcaatattgtgatgccgtttgaagacgtgtatgttgttccaacaaaagcaataaaatgtgattacaaacccttccgttcagatttgacttgcttccggcgctgccattctctttcaaaatcaacggcggcagcgattctctcactccgtctatcttcaatttcacttctcgaagtagtaccagtattgtatggcttccttcagagcattttggaacggtccaatgggtcccaaaacaactcacttttggggacctgttgccaactggggatttgtggcagctggattggctgacacgaagaaacctccagaaatgatctctggcaatatgacaggagcaatgtgtatctactcagcattgttcatgagatttgcatggatggtacagccacgcaactatctactttttgcttgtcatctctcaaatgagtctgttcaactctatcagttctctcgatgggcaagggcagaggggcctctgtcggctaagaaggaagaagcttcatctcagtaacacgaagctaacactttcctgggtgtagtgatttgaaagattttgcatttgaacttgccgatgtatgaataagtgatcagtggttgtaagaagggccttgtggaaactgtaaaggattctggccgagttcagcagatggccaaattatttgaaggcttatgggtgggttttatatgtctaacatattgactgacccatgaatgtttagtcttaaacatttgtctattatatcatgccaaaattcagttcaattacaaactacaaagttgagggttaaggattgtactgtgactattttttgtttgttaatgttcttatgagataaaaataataattgcatgcattaaaaa

SEQ ID NO: 1925 - DNA, 410 bp, Flaveria ramosissima
ggtggtctccaaccagagtgtcgtcgagccttccacccaatctgacgttagtcgccggcgacgatcatttcagaggtgttttagcagcaagcaatatatggcttcctttcgagcattcctgaacagtcctgtcggtcctaaaactactcatttctggggtcctgtagccaactggggatttgttgccgcggggctggtggacatgcagaaacctccagagatgatatccggcaacatgactgcagccatgtgtgtgtattctggattattcatgaggtttgcgtggatggtgcagccccgtaattatttacttctagcatgccatgcctcaaacgaaacggttcagatgtatcaactttcacgttgggcaaaacatacaagggtatttgcagaaggaagacaagtctgca

SEQ ID NO: 1926 - DNA, 654 bp, Gnetum gnemon
catttccgatctcttttcttagtgtgcttttctaaattcgattgaagtgctgatttccttccaatcctgacgggtaacaacaaacgaggggcaacaggttttttgcggcaaaggagaatttgcgagaagatggcagcaacttttaaagctttcttgaacagtcccgttgggcctaaaaccacacatttttggggccccgtcgccaattggggtttcgtagttgctggtttagctgatatggagaaaccgcccgacatgatatcagggaacatgacgacagcaatgtgtatatactcgggcttgttcatgagatatgcttggatggttcagcctcgcaattatcttcttttagcatgtcatgtctcaaatgaagctgtgcagttatatcagttgtcacgctgggcttctgctcgtggggatcaatcaaagaaggacgttgctacggagaaataatctgtgtgtgcattgacattatatgatccgaaatttctgtttgtcaaaacattgaacgtggggttcattgttttcttccaaattttcatctggaagttaaaggattgacatgttctgatgctttgattctgaagatgaaatgttcaagtttacatatgaattattttttcctctcaataaacccttaaaattatattttcc

SEQ ID NO: 1927 - DNA, 390 bp, Lolium multiflorum
tcgccctcgccctcgctcgtcaactcgtcgacctctttccccgacccgccgccgtcgaacaatctaggtgatttgagcgccggtggggaaggttctgacatggcgacggctttcaaggcgttcgtgaacagccccgtcgggcccaagaccacccacttctggggtcccgtcgcaaactggggcttcgtcctcgcgggtttggttgatttgaacaagcctcctgaaatgatatctggcaatatgacagcagccatgtgtgtgtactctggactttttatgaggtttgcatggatggtacagccccgaaactacttgcttttggcgtgccatgcctccaatgaaaccgtccagctctaccatttatctcgctgcgctaaggctcaggggtat

SEQ ID NO: 1928 - DNA, 589 bp, Solanum lycopersicum
aagatcatattataatactatatatacatacacaagtaaccgataattgaagccattttttgggagcaacccacttttcagatctctgattaaggcaactccacacgttgtatcgcgtatggctagcttcaaggcattcttgaacagtcctgttggccctaaaacaactcatttttggggtcctataggcaattggggattcatcattgctggactcgtagacacacagaaacctccagaaatgatatcacgcaacatgacttcagtaatgtgtgtgtattctgcactgttcatgaggtttgcatggatggtacagccgcgtaattatctactaatggtatctcatgcctcgaatgagactgtgcaactttatcagttatcgcgttgggcaaaaagtcaaggatatttgaagaagaaaacagataaagcagagtgatctagtgttttttcctgtttaattctggacatgtctatagttatggtaattttcgatctctctgtttgcacagattattgtccttgaatggcaagaaatgttagtatggaagaatttaatatatttgtgatttcaccccgtgcaaggttcatt

SEQ ID NO: 1929 - DNA, 607 bp, Amorphophallus konjac
ggggtgtggaggcggcgatggcgtccaccttccgggcgttcctgaacagccccattgggccgaagaccacccacttttgggggcccgtcgccaactggggcttcgtcatcgcgggattggttgatatgcagaagcctccagatgtgatatccggcaacatgactgcagcgatgtgtgtttattcagggctgtttatgagattcgcatggatggtccagccacgcaactatcttcttctggcatgccatgcctctaatgaaacagtccaactctatcagctcagtcgctgggccaaagtccaggggtacacaccaacgaaggagcaagagaaaaaggagtagcttcacgatgaactcttctccttgtatgtttgaactgcttcgtacggatgcactttcatttctgaaacactaaatttatgaaaccttcatgcggttttctccttatgtgagctttgtttgtataaagatgagggatttcctcatctttgttttaacccccaagtttgctgcatttttctgggtgaccaattatgagcatttcagtttcaaatctgtggtcagcttgatccttcccccttttataatccagagtatggtataccgag

SEQ ID NO: 1930 - DNA, 1072 bp, Gossypium raimondii
ccaaaagaaaatttaataaaataatccatctcgaaaaatgtagccacgtgatatgaagaacagttcctcaagtctcaactgaaaagtaagtttgaagtagggagcaggttatctgcactgcaccacgtttcgaacaacccaacaagaaaaatcaccccaacccatcagatcccaaacagcggttcggctcctcccttggaatggaacacttctagatctactccttggaacaagttatgaaaatggctatatctcttgtactgagtcgactcattctcttcctcactctcacctgctttgcagccgtctcatcatctactacgaccacaacaactctaaaacggcactctgggtttctctactctagaacccgaggaaaatgcactcctcagttctggagcagcaggagagaggcgtggccaaggatggtcccacagggatcaacggtatcgaacgtattcgggtcgagagcgagtgagcggtacagatcggatatgacattgttggaatcaagggctgtgaatgaagaagggaacgtgttcaatgagctgctgaagcaggcgagtgctgcattgctgaactcgtatgcgaggaaagggttcccttactcggcgtgggaagtgaagactctgatgattcaagggttggtctcggaatatgccgcagcacgcctaaccagacgcttttccgttgccaatgatgcttgtatttagtagtattcgggttgatactagcttaaaaggcgataggagaagctagttttgcttgaagcagtacgactctgttctttttatttttagtttgtcaatttggtagattatcgcaaattaaatgtgaattcgatgaaagatatttctcattggtccttttaggcgctcatgcatgtcgaggtattgaaggattattgggaacttaatattgctggtgtactgtgttgattcttccagcttcccttgacccgaaatcagctttattcttcatgtttttgcttaaatctcatggtgcatattgtttcttctaatacattttgcttcatttcgtattgcaataagtgaggggcctggcagggtcc

SEQ ID NO: 1931 - DNA, 975 bp, Pennisetum glaucum
tgggcggcggatgaggaggcggtggtggtgggcgcgccgccgttctcttccgtgccatgaaacggcggcgcggacgatcggcaggggcggagaacgaagggctagctagctggaggatcaagagagagagagagagagagagagagagatgggttctccagcgccgctccgccctctcgctctcgcctgcttcatcttcctctgttcatccttctgggcagcaaatgggatgtacggtagggttgatgctgcggcggcggagggggagagcaggaggaggatggggctgcacaccgacgggagccgcggcgacgcgcacgcgtggccggggtacctctacacccgagcagttgggaggtgcacaccccagttctggagcagtggagctgagccgtggccaaacatcgttcctcaggaagcagctgtgtcaaaggtctttggctccaggtctgttgagagatacggaccacgcctcaccctgctggaagctaccatgagaaccgatgacatcggtggcactgcctttgtgaagcttgtgaagcaaggaagcgctgctctcctcaatgcctacacaaggagaggtttcccttttgattcatgggaggtgaaggccttgctgttagaggcgttagtgtctgaggaagctgctgcagtccaggcagagcgatttgagcaggcaaatgagtcctgcgtttgatggatgaaccatgaagtgctggagcttctggccctgcttggaagctgtatcaaaaggtcattggtgtattgtgtttgtagtaggtcaccacttctgtgactttgggtgttgagttctctgaggcagctctcttcctatgaatattttttctttagatgcgggttaatggcgtttatgtaatgttatgcgcattgatgtgtaggccctaatgtatgcattgtactttatggcaccgctgtgctatcatgctcctgatggtaccttctcaactggccatg

SEQ ID NO: 1932 - DNA, 962 bp, Saccharum officinarum
gtcgacccacgcgtccgcaaactgggctccataaagttctgtcgcctcgcctgtagcctgtaggatagcagcaggcagcggctgaggagagagagagagaggatggattctcaagcgccccttcgtcctctagctttcgcctgcttcatcttcctttgctcgtccttctgggcagcaaatgggatgtacgctagggttggtgcggcggcggcggcggagggggagagcaggaggatgcggctgcacacggacgggagccgcggcgacgcgcacgcatggcctgggtacctctacacccgagcagttgggagatgcacaccccaattctggagcagtggagctgagccatggcccaacatcgtccctcaggaagcggcggtggcaaaggtcttcggctctaggtccgtggagaggtacggaccacgcctcaccctgctggaagctactatgaggaccgacgacattggtggcagcgcctttgcgaagctcgtgaagcaagggagcgctgccctcctcaacgcctacacgaggagagggtttcctttcgattcctgggaggtgaaggccctgctgctagaggcgctggtgtccgaggaggctgccgtggtccaggcagagcgatttgagcaggcgaacgaatcctgtgtttgatgaatgaaaatgaattgatggtggcgccctgcttggaagctgtatcagaacttagaagggggcgtagagtagcagtgtattgtgttcgtatggtcaccacttctgtgacttcggcttagaggtttctgaagccgctactctctcttgatcggcatgtttctctagctgccggggtttgtgtaatgttgttgtgtgcactgatgtgtaagttctaatgtacgggtcgtaattttaatgttccaatgttaatggaagttcaatgttgtcaaagcaaaagaacactatataaaaatggaacaaagcaaactaaa

SEQ ID NO: 1933 - DNA, 1023 bp, Sorghum bicolor
ccttccaaggagccgatctcagagcacacagaacagtgtccgcatttcaaactgggctccataaagttctgtcgcctgtaggatagcagcaggcagctgcggagagagagagagagagagaggagagagagagagagagagagagagagagaggatggattctctagcgccgcttcgtcctctagctctcgcctgcttcatcttcctttgctcattcttctgggcagcaaatgggatgtacgctagggttggtgtggcggcggcggcggatggggagagcaggaggatgcggctgcacaccgacgggagccgcggcgacgcgcacgcatggcctgggtacctctacacccgagcagttgggagatgcacaccccaattctggagcagtggagctgagccatggccaaacatcatccctcaggaagcggcggtggcaaaggtcttcggctctaggtccgtggagcggtacggaccacgcctcaccctgctggaagctactatgaggaccgacgacatcggtggcagcgcctttgtgaagctcgtgaagcaaggaagcgctgctctcctcaacgcctacgcgaggagagggtttcctttcaattcctgggaggtgaaggcccttctgctcgaggcgctggtctccgaggaggctgccgtggtccaggcggagcggttcgagcaggcgaacgaatcctgtgtttgatggatgaaaatgaaatgaaatgatggtgcgctgaagcttgtccctgcttgggagctgtatcatcaggaaggggggcgtggagtagctgtgtattgtgttcgtacttcgtagttggtcaccacttctgtgacctttttttttggtgttgaggtttctgaagcagcttctcttggtcggcatgtttctctaactgccggggtaagtgtaatgttgttgtgtgcactgatgactgatgtgtactaggttctaatgaacgtatcgtaattttccaatgttaatggaagttctgtgttgtcgtacgcaccgtcgtgctatcgttc

SEQ ID NO: 1934 - DNA, 874 bp, Zea mays
aaactgggctccataaagttctgtcgcctcgcctgtgacctgtagggtagcagcaggcagcggaggggagagagagagaggggggatggattctcaagcgccgcttcgtcctcctctagctttcgcctgcttcatcttcctttgctcatccttctgcgcagcaaatgggatgtacgacagggttggtgcggcggcgtcagatggggagagcaggaggatgcggctgcacaccgacgggagccgcggcgacgcgcacgcgtggcctgggtacctctacacccgagcagttgggagatgcacaccccaattctggagcagcggagccgagccctggcccaacatcgtcccacaggaagcggcggtggcgaaggtgttcgggtctaggtccgtggagcgctacgggccgcgcctcaccctgctggaagctaccatgaggaccgacgatgccggtggcagcgccttcgtgaagctcgtgaagcaagggagcgccgccctcctcaacgcctacgcgaggagagggttccctttcgactcctgggaggtgaaggccctgctgctggaggcgctggtgtccgaggatgccgctgtggtccaggcggagcggtttgagcaggccaacgagtcctgcgtttgatcttcgatggatgaagatgcaacgatggtgccgctgtagtatcgtgttcctggttggtcaccacttctgtgactttggcgttgaggtttctgaagccgcaactctgtccaagtcggcatgtttctctagatgccgggctttgtgtaatgctgtgtgcactgatgtgtagtaggttgtaatctacggaccgtgattttttttttactatttcaatggtaatggaagttctatgttgtcgca

SEQ ID NO: 1935 - DNA, 963 bp, Panicum virgatum
ttctccggcgccgcgccgtcctctagctcttgcctggttcatcctcatctgttcatccttctgggcagcaaatgggatgcacggtagggtccgtgtggcggcggcggaggagggggagagcaggaggatgcggctgcacaccgacgggagccgcggcgacgcgcacgcgtggccggggtacctctacacccgagcagttgggagatgcacaccccaattctggagcagtggagctgagccatggcccaacatcgcgcctcaggaagcagctgtgtggaaggtctttggctccaggtcggttgagaggtacgggccacgcctcaccctgctggaagcaaccatgagaacagacgacatcggcggcagtccctttgttaagctggtgaagcaaggaagcgctgctctccttaatgcctacacgaggaggggtttccctttcgattcctgggaggtgaaggccttgctgttagaggcgctagtgtttgaggaggctgctgcggttcaggcagagcgattcgagctggcgaaccagtcttgcgtttgatggatgaaatgatgatgatgctggagcttctgtgtccctgcttggaagaatggaagctgtatcagaactcagaagggcgatagtgtattgtgtttgtagtaggtcaccacttctgtgactgggtgttgaggtctctaaaaatattaaaatctgcagtccatggttatgtgcactgatggtttttacgtgcactgatgtacgtatgcattgtacttgtggttttgcagcgtcaatggaactatgtaagttctatatagtctcaccgatgcgttatagtgttcctgaagcaacctggtacttcttcagctcgtcatggaaccaaaaaatctgattacgaacaaggagataaactgataaataaagtgcagtgtgtttagagcatctccaagagctcttgtatctataaatagctaaaattc

SEQ ID NO: 1936 - DNA, 3584 bp, Zea mays
acgggatcgcacagccccaactaaactccgcccgccggtggttgcggatcgagggcaccgcgttcgcatgctcgccggtcatggctccagtgcatgcccgccgttccccggtatataggactcccgcaaggcgccccagcactcccgtaaacgcgtgtcgcgcccgtcgccaagcaaacaccacgacgcgcgcgccgtgctctctggcgagccaagagccagtgcattttgctcgcaccccgatcgcggccgggacagcgcgctcgccgtaggtgcatgcgtgcgtgtgcgacctcgcttcctgcccctgaggcctcgcctgcagctagctccaaagcagcaggcgcaccgcgcacccccggtgcggcgcgagcgcatgcatgagcgtccgcgcaatgtctctctgccgccccgcgttccgagcagagtttccccgctaatatccagcgagacggcctgttcctgagcagctgattcgtcgtttgggttgcccactgccggggccatggatcagcagcggaggagcagcatcaggttgtacgggtccaacgcctcgtcccggtcggggtccttcgacttcgaacacgaccaggacaaggaacgcgctgaccagcccagcgacggcgaccgccgggaggtcgtcgtgaagatcgacgccgagccgcactcgccggtctccctccacgcggccggaggcatgtccgggcacagctccgcggtcagcacgccgcgggccggcggcgcggtgagcatgctcgcggcgtctgcgtccggctcgagcgcgtcgacctccagcgctgggggcgatgcgccccgctccggcgagtcgttcagtttcaagaaccgcacgccgcagtcttcggccggcggcggggagtccagcgaagatccgccgagccgcctcattggcagcttcctccggaagcaggcggccgctggcggcgagctgtccatcgaccccgacttcgaggtggacgagatgagaaggccgccacgcgcgccgacatctgtcaacgcctccagggagctgcgcgtctcgttccaggatccccggaaacggttctccccgtccacgtcgtcggcgtcctcctcctcctacgacgccagccacaaccggaaccagagcaccatcgacttggacactgccgaggtgctacgctgcacgtcgacgtccaccggttcctccctgctggcgcgcagcaagacgcgatctcggctaatggatcccccgccaccgtcgacgtcgagcgcccccgccagcgaggtggatccccgaaagtcatttgtctccaaggggctgccgcccaagtccggccagctccggtcgggtcttatcggcaagtcggggctcattggcaaatcagggcccatcggcaagtcaggtgccttcgaggatgaggacgacgacccgttcatggacgagggcatgacctcggacttcaagcgcgacaccatggactgccttctcatcatggagtgggtgagcctggtggtcatcgtgggcgcgctcatctgcagcgttaccatacccagcctgtccataaagaagctctcggggctccacctctggaagtgggagctcctcgtgttcgtgctcatctgcggccgcctcgtgtccggctgggtcatccgcatcgccgtcttcttcgtcgagcgcaacttccttctgcgaaagaaggtgctctacttcgtgtacggcgtgcggcgggccgtgcggaacgtgctctggctgggtgtcgcgctcgtgtcctggcacctcctgttcgacaaggccgccaagcgggagacgcacacgctggtgctgccctacgtcaccaaggtgctgtgctgcctcctcgtggccaccgtgatccgcctcatcaagacgttgctgctcaaggtgctcgcctcgtccttccacgtctccacctacttcgacaggatccaggaagcgctcttcaaccagtacgtcatcgagaccctctccggcccgccgctagtggacgagagccggatgatggctgaggtgcagaggctccagagcgcgggggcgtccatccccagtgagctcgaagcgacagcgatgccgggcaagtccgggccactgcccaagagtgggcgcctcacgacggccacgtccaggcgggaaggaggaggggccagcaagcagctgcataggcagaaaacagagcgccatctggatgacggcatctcgattgaccagctccacaagctcagccagaagaacatctctgcgtggagcatgaagaggctgatgaagattgttcggtacggggcgctgacaacgatggacgagcagctcaagcatgcaacgggcgaggacgagctggccacggagatacacagcgagtacgaggccaaggttgctgccaagaggatcttccagaacgtcgccaagcctggatccaagcacatatacctgtcagacttgatgcgtttcatgagacaggaagaagctctaaaggcgatggatcttttcgaaggagcgcaggagcacaacagggtcagcaagaggtcactcaagaactgggtggtaaacgcgttcagagagcgcaaagctctcgccctgacgctcaacgacaccaagaccgcagtgaacaagctgcaccagatggccaacgtcgtggtcgcgctcatcgttctcgcgctctggctcctcatcctggggatcgcgacgtccaagttcttcgtcctgctcagctcgcagctgctcgtggcggtgttcatgttcgggaacactctcaggaccatcttcgaggcgatcgtgttcctgttcgtgatgcatcctttcgatgtcggcgaccgatgcgaagttgatggaatgcaggtggtcgtggaggagatgaacatcatgacgacgatcttcctccgatatgacaacctcaaggtgtactatccaaacagtaagctagcccagctaccgatcatgaattactacaggagtcctgacatgggagattcggtggacttcactgttcatgtcgcaacgccggtggagaaactgtccctcatgaaggagagactgatgcattaccttgacaacaagaaggagcactggtaccctggctccatggtggtcctgcgcgacgtggacgacacgaacaagctgaaggcctccatctggtgtcgccagacgatcaacttccacgacatggggatgaggttcgagcggagagagctgctgctccaggagatgatcaaggtcctgagagacctcgagatcgagtaccggatgctgccgctcgacatcaacgtccggaacgcgcctgccatccagtcctcaaggatgccgtcgacatggacgtttagttattgagatgagatgagatttgtgctgctagaggtagtagttcctgagtgagttgagctgtgacagcgttctgacgagaggcggcaacaggttttgctgtcgctgcagccatcacttgagctttttcctgtagttattgtgttgttggtccaagtactccatagttatctttagtccatctcagatatctttagttcatctcagttatattacctgatgcttgtcattctattacagatggtattgaataattgatttcatcacttggtaatga

SEQ ID NO: 1937 - DNA, 4076 bp, Sorghum bicolor
gcataaaagatggccaaaaatagccactgctagatgcttgcccacccgagctaagcaccaggatcgcacagcctcagctaaactccgccgccggtggttgcggggggcacgccaggccgccaccagccacggctccactgcatgcccgccgttcccccccggtatatagacgtagtactcccgcgagcgctccccagcgctcccgtaaacgcgtgtcgcgcccgtcgccaagcaaacaccgcctggcaccaccgacgcgcgcgccgtgctccccggcgagccaagagccactgcattttgctcgtccccccgatcgcgcggcctggggcagcgcgctcgccggaggtgcatgctgcggtgcgcgcgtatgcgccttcgcgtcctgtcccctgacgcctcgcctgcagctaccagctagcaccaacgcagcaggcgcgcccccgcccccgcccccgcgcggcgcgcatgcatgagcgtccacgcatgcctgcccgccacccccccccccccgcgctaatatccagcgagccggcctgtccccgagcggctgattccttcgcgtttgcccactgccgggggccatggatcagcaccggagcagcagcctcaggtcgtacacgtccaacgcctcgtcccgggcggggtccttcgacttcgaccacgaccaggacaaggaacgcgccggcctgaccggcggcggcgaccgccgggaggtcgtcgtcaagatcgacgccgagccgcactcgcctgtctccctccacgcgcccggcggcgtgtccggccacagctcagcggtcagcacgccgcgggccggcggcgcggtgagcattctcgcgccgtccgcgtccgggtcgagcgcgtcgacctccagccccgggggcgacgcgtcccgctccggcgaatcgttcagtttcaagaaccgcccgccgcagtctccggccggcggggagtccagcgaagatccgcccagccgtctcattggcaacttcctccggaagcaggcggcggctggcggcgagctgaccatcgaccccgacttcgatgtggacgagatgagaaggccaccgcgcgcgccgacgtctgccaacaacgcctccagggagctgcgcgtctcgttccaggacccccggaaacggttctccccgtccacgtccacggcgtcctcctcctcgtacgacggcggcgacaaccggaaccagagcaacatcgacttggacactgccgaggttctacgctgcacgtccacgtccaccggttcctccctgctggcgcgcagcaagacgcggtcgaggctaatggatcccccgccgccgtcgtcgtcgagcgccggccccgccggcgagggggatccccgaaagtcatttgtctcaaaggggctgccgcccaagtccggccagctccggtcgggtctcatcggcaagtcgggtctcatcggcaagtcggggcccatcggcaagtcaggtgccttcgacgatgaggacgacgacccgttcgtggacgagggcatgacctcggacttcaagcgcgacaccatggactgcctgctcatcatggagtgggtcagcctggtggtcatcgtggccgcgctgatctgcagcgtcaccatacccagcctgtcaaaaaagaagctctcggggctccacctctggaagtgggagctcctggtgttcgtgctcatctgcggccgcctcgtctccggctgggtcatccgcatcgccgtcttcttcgtggagcgcaacttcctgctgcggaagaaggtgctctacttcgtctacggcgtgcgcggcgccgtgcggaacgtgctctggctcgggatcgcgctcgtgtcctggcacctcctgttcgacaaggacgccaagcgggagacgcacacggtggtgctgcagtacgtcaccaaggtgctgtgctgcctcctcgtggccaccgtgatccgcctcgtcaagacgctgctgctcaaggtgctcgcctcgtccttccacgtctccacctacttcgacaggatccaggaagcgctcttcaaccagtacgtcatcgagaccctctccggcccgccgctagtggacgagagccggatgatggctgaggtgcagaggctccagagcgcgggagcatccatccccagtgagctcgaagcgacagcgatgccgggcaagtccgggccactgcccaagagtgggcgcctcaccacggtcgcgtccaagcggggaggaggagcaggggccagcaagcagctgcataggcagaaaaccgagctgcatctggatgacggcatcccgattgaccagcttcacaggctcagccagaagaacatctctgcgtggagcatgaagaggctgatgaagatcgtccggtacggggcgctgacgacgatggacgagcagctcaagcatgcaacgggcgaggacgagctggcgacagagatacacagtgagtatgaggccaaggttgcggcaaagaggatcttccagaacgtcgccaagcctggatccaagcacatatacctatcagacttgatgcgcttcatgaggcaggaagaagctttaaaagcgatggatcttttcgaaggagcgcaggagcacaacagggtcagcaagaggtcactcaagaactgggtggtaaacgcattcagagagcgcaaagctcttgccctgacgctcaacgacaccaagaccgcagtgaacaagctgcaccagatggccaacgttgtggtcgcgctcatcgtgcttgcgctctggcttctcatcctggggatcgcgacgtccaagttcttcgtcttgctcagctcgcagctcctcgtggcggtgttcatgttcgggaacactctcaggaccatcttcgaggcgatcgtgttcctcttcgtgatgcatcctttcgatgtcggcgaccgatgcgaagttgatggaatgcaggtggttgtggaggagatgaacatcatgacaacgatcttcctccgatatgacaacctcaaggtgtattatccaaacagtcagctagcccagttaccgatcatgaattactacaggagtcctgacatgggagatgcggtggacttcacagtccatgtcgcaacacccgtggagaaactgtccctcatgaaggagagactaatgcattaccttgacaacaagaaggagcattggtaccctggctccatggtggtcctgcgcgacgtggacgacacgaacaagctcaaggcctccatctggtgccgccacacgatcaacttccacgacatggggctgaggttcgagcggagagagctgctcctccaggagatgatcaagatcttgagagacctcgagatcgagtaccggatgctgccgctcgacgtcaacgtccggaacgcgccgaccatccagtcctcgaggatgccgtcgacatggacgtgtaattactgacatttttttttttttggtttgctggatacacatcaggctttgttatgagatcgtgctgctagatcgaggtagtagtttcctgagtgagttgagctgtgacagcgtgctgagacgagaggcaaacaggttttcgctgtcgctgcagccatcacttgtgctttccctgtagctaattgtgtcgttggtccctaactcccatagcttaatttggtgctcatgataagtgaacttcttctgctagagagaataatgttgattatctagcttatttaaaagactgaatttctcaagtttccacatcaaaatatgccatatatgtatgccgttctcgaaacagaagcattggtttctgtcagacgaatagcgcaactgttctgcagaaaacatacctgacggagtgacggcaacgcaatgcatgttgaacacaactgaaacacacaacaatcatcagataatatggtggcgtcttttagtttatgtcacctgttgttgctctcccttcgccggccgtgtccggagcagcagcagctgctgcagccgggagcgcacgcgcacctgcggccacacgagcaccggatggcgaggttggcttgcttccgcacgtacgcgcgccacgcgcgaacgcctgcagcttcaccaggctcctcaggtcgcggaacgcttgcctcgcctgatcaa

SEQ ID NO: 1938 - DNA, 3506 bp, Zea mays
cgcgcccgtcgccaaacaaacaccggctggcaccacgacgcgcgcgccgagctcaccggcgagccaacagccactgccttctgctcgcccccgatcgcggacgggacagcgcgctcgccgcaggtgcatgcgtgcgtctgcgcctttgcgtcctgcccggctgcctcctgaggcctggcctgcagctagctccaaagcagcaggcgcgctcccgcccggtccgcgacccggcgcggcgagcatgcatgagcgtgcacacatgcctgcctgccggcccgcgttccgaaccgactcccccctctaacatccagcgagccggcctcggtctgttcccaagcggctgattcgtctgggttgcccactgctgcccggggccatggatcagcagcggaagagcagcctcaggtcgtacgggtccaacgcctcgtcccagtcagggtccttcgacttcaaccacgaccaggacacggaacgcgccggccagcccggcggcgacgaccgccgggaggtcgtcgtcaagatcgacgccgagccgcactcgccggtctccctccacgcggccggcggcgtgtccgggcacagctccgcggccagcacgccgcgggccggtggcgcggcggtgcgcattctcgcgccgtctgcgtccgggtcgagcgcgtcgacttccagcgtcgggggcgacgcgtccggctccggcgaatcgttcagcttcaggaaacgcccgccgcagtctccggccggcggggaccccggcgaggatccgccgagccgcctcatcggcagcttcctccggaagcaggcggcggccggcggcgagctgtccctcgaccccgacttcgaggtggaggagatgagaaggccgccacgcgcgccgacgtctgtcaacgcctccagggagctgcgcgtctcgttccaggacccccggaaacggatgtccccgtccacgtcgtccgcgtcgtcctcctcctacggcgccggcggcgacagccggaaccagagcaccatcgacgtggacgctgccgaggtgctgcgctgcacgtcgacgtccaccggttcctccctgctggcgcgcagcaggacgcgatctcggctgatggatcccccgccaccgtcgacgtcgtcgagtgcccccgccaacgagggggatccccgaaagtcatttgtctcgaaggggctgccgcccaagtccggtcagctccggtcgggtcttatcggcaagtcggggctcatcggcaagtcggggcccatcggcaagacaggtgcgttcgacgatgaggacgacgacccgttcatggacgagggcatgacctcggacttcaagcgcgacacgatggattgccttctcatcatggagtgggtcagcctggtggtcatcgtgggcgcgctcatctgcagcgtcaccatacccagcctgtcggtaaagaagctctcggggctccacctctggaagtgggagctcctcgtgttcgtgctcatctgcggccgcctcgtctctggctgggtgatccgcatcgcagtcttcttcgtcgagcgcaacttccttctgcggaagaaggtgctctacttcgtgtacggcgtgcgccgcgccgtgcgcaacgtgctctggctgggtgtggcgctcgtgtcctggcacctcctgttcgacaaggccgccaagcgggagacgcacacgctggtgctgccctacgtcaccaaggtgctgtgctgcctcctcgtggccaccgtgatccgcctcgtgaagacgctgctgctaaaggtgctcgcctcgtccttccacgtctccacctacttcgacaggatccaggaagcgctcttcaaccagtacgtcatcgagaccctctccggcccgccgctagtagacgagagccggatgatggctgaggtgcagaggctccagagcgcgggagcatccatccccagtgagctcgaagcgacagcgatgccgggcaagtcccggccactgcccaagagtgggcgcctcacgacggtcgcgtccaagcgaggaggaggaggagcagcagcagccagcaagcagctgcataggcagaaaaccgagcgccatttggatgacggcatctcgattgaccagcttcacaagctcagccagaagaacatctccgcgtggagcatgaagaggctgatgaagatcgtcaggtacggggcgctgacaaccatggacgagcagctcaagcatgcaacaggcgaggacgagctggcgacagagatacacagcgagtacgaggccaaggttgcggccaagaggatcttccagaacgtcgccaagcctggatccaagcacatatacctgtcagatttgatgcgtttcatgaggcaggaagaagctctgaaggcgatggatctcttcgaaggagcgcaggagcacaacagggtcagcaagaggtcgctcaagaactgggtggtaaacgcgttcagagagcgcaaggctcttgcgctgacgctcaacgacaccaagaccgcggtgaacaagctgcaccagatggccaacgtcgtggtcgcgctgatcgtgctcgcgctctggcttctcatcctgggcatcgcgacgtccaagttcttcgtcctgctcagctcgcagctcctcgtggcggtgttcatgttcgggaacacgctcaggaccatcttcgaggcgatcgtgttcctgttcgtgatgcaccctttcgacgtcggcgaccggtgcgaggtcgacgggatgcaggtggtcgtggaggagatgaacatcatgacgacgatcttcctccgatacgacaacctcaaggtgtactacccgaacagccagttagcccagctaccgatcatgaattactacaggagccctgacatgggagattcggtggacttctccgtccatgtcgcaacaccggtggagaaactgtccctcatgaaggagaggctattgcattaccttgacaacaagaaggagcactggtaccctggctccatggtcgtcctgcgcgacgtggacgacacgaacaagctgaaggtctccatctggtgccgccagacgatcaacttccacgacatggggatgaggttcgagcggagggagctgctgctccaggagatgatcaaggtcttgagagacctcgagatcgagtaccggatgctgccgctcgacgtcaacgtccggagcgcgccgaccatccagtcctcgaggatgccggcgacatggacgtttaactactgagatcttggctggatagtggataccatcaggcttgttgtgagattgtgctgctagaggtagtagtagtagtagttcctgagtgagtgttgagctgtgacagcgtgctgatgagatgcaacaggtttttgctgtcgctgcagccatcacttgctcttcccgccctgtagttgttgtgttgttggtccatactccgtagtttggtgcttgtaattagggaacttcttctgctacagaataactttgttggattatctagcttacttcaaagattaaacttctgaagttattacatcaaaatatgcca

SEQ ID NO: 1939 - DNA, 3459 bp, Oryza sativa
gggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcgacttcgagcacgaccaggacccggaccgcgaccgccgccacgacgacgcccaccgccgcgaggtcgtcgtcaagatcgagcccgaggcccacgtgccggtggacctccacgccggcggcagccacgccgccaacgcgccgggcgctggcggcgtggcggtggggggcgtggtcccggggtccgggtcggtgtcgagcgcgtcgtcctcgccaggcggtgggggcaacggcgagtcgttcagcttcaagaaccggccgccgcagtcgcccgcgtctccggcgatgagcgtcggcggggagggcagcgacgacccgcccacgcgtctcattggcagcttcttgcgcaagcaggcggcggccggcggcgagctggcgctcgaccctgacctggagatggaggagatgaggaggccgccgcgcgcgcccacgtccatgaacgcctccagggagctccgcgtctcgttccaagacccgcacaagcggttctccccgtcgacgtcgtcggcctccacctcctcctacgccggcgacagcaggaaccaggcttgcagcacagcggaggcggccgaggtgatccgctgcacgtcgatgtccaccggaaacaacctgttggcgcggagcaagacgcgttcccggctaatggatcccccgccgccgacgatcagtcaccccaccgaggcggagcgcaacgaccgcaagtcgttcgtcggcaaggggccgcccaagtcagggcagctccggtcgggcctcatcggcaagtcggggctcatcggcttgtcaggccccatcgggaagcccggcgccttcgacgacgacgacgacgacccgttcgtggacgagggcctcgccgccgacctcaagcgcgacacggtcgactgcctcctcatcctggaatgggtcggcctcatcgtcatcatgggcgcgctcgtctgcagcctcagcattcgcagcctcgccaacaagaagctctcgggtctccacctctggaagtgggagctcctggtgttcgtcctcatctgcggccgcctcgtctccggctgggtgatccgcatctgcgtcttcttcgtggagcgcaacttcctgctgcggaagaaggtgctctacttcgtctacggcgtgcgccgcgccgtgcgcaacgtgctctggctcggcctcgcgctcatctcgtggcacctcctcttcgataaggacgccaagcgtgattcccacacgctggtgctcccttacgtcaccaaggtgctctgctgcctcctcgtcgccaccgtgatccgcctcgtcaagacgctgctgctcaaggtgctcgcctcctccttccacgtctccacctacttcgaccggatccaggacgcactcttcaaccagtacgtcatcgagacgctctccggcccgccgctggtcgacgagagccgcatgctcgccgaggtgcagaggctgcagagcgccgggatcaacatccccagcgagctcgaagcaacggccatgccgagcaagccgcccatgccggccaagagcgggcgcctcacggtgaacccgtcgaagcgaggaggagcaggaggtggggccaacaagcagctgcagaagcagaaatccgaccgccattgcgacgacgggatcacgatcgaccagcttcacaggcttagccagaagaacatctcagcttggagcatgaagaggttgatgaagattgttcgttacggggcgctgaccaccatggacgagcagatcaagcatgcaaccggagaggacgagctggccacgcagatacacagcgagtacgaggccaaggttgctgccaagaggattttccacaatgtcgccaagcctcactccaagcacatatacttgtcggatttgatgcgtttcatgaggcaggaggaagctctgaaagcaatggatctttttgaaggcgcacaggagcacaacagggtcagcaagaggtcactcaagaactgggtggtaagcgcgttcagagagcgcaaagctcttgctctaacgctcaacgacacaaaaactgcagtgaacaagctccaccagatggccaatgttgttgttgtggttattgtgattgcactatggctttccattctagggatcgcgacgtcacgcttcttcgtcttcatcagctcgcagcttcttgttgcggttttcatgtttggcaacactctgaagaccatctttgaggcgattgtgttcttgtttgtgatgcatccttttgatgttggcgatcgttgtgaagttgatgggatgcaggtagtcgtcgaggaaatgaacatcatgacgacaatcttcctccgatacgacaacctgaaggtctattatccgaacagccagctcgccatccaaccaatcatgaattactacaggagtcctgatatgggagatgcagtcgatttctctgttcatgtcgctacgcctgtggagaaactggccctgatgaaggaaagactaatgcattaccttgacaacaagaaagaacattggtaccctggatccatggttgttctccgtgacgtggatgacacaaacaagctaaaggtatccatatggtgccgtcacacgatcaacttccaagacatggggatgagattcgagaggagggagctattgctccaagaaatgatcaagatcttgaaagatctagacatcgaataccggatgttgccactcgacatcaacgttcggaatgcgccaatgatccagtctttgaggatgccatcaacatggataacgtattaattcttcttgaaatgcagtaccaagttaaacatgcctgatcagttcagtgatgagattatggtttgaagttgctaggtaggcagccgtatttcttgagtaaggtgacgtagtactgtaactgaagtgcccttctcctttcctccatctccttcttgccaagggcatattcggttgagtggattgagctgtgacagcttgccaaaatagcaagaggccgtcttactgtccttgcagccaccgcttgtgctttcctgtaactgtagtgttatgtgtttgggtacttcttatgagaactttagacatgttgctacttaataattttgatgacttaatgcatcaaaagatgaatgcaattttgacagcaaaatacaagaatatcgatctaaatat

SEQ ID NO: 1940 - DNA, 798 bp, Pennisetum glaucum
ccggagcctccagaccgccgccggccgtaggaacccatcgggcagacgtctgcaggaagattatgcaatccagttttattcacgttgcggattcagcttgaagtagaactattagcacttgtgctgtatctggtgaagggttgcacgaggggattgattgatctttcgataatactgccaacaaaaggaagcaaaggcgcatcgctgagaagcgtcggggatgcagatccgcgtgcgttgcgggtgtggtgattcgtcttgcccggagtgggctgtcgttgagcttcagggcatggtgcaaccgcaggcatccttctctggtgacattcgtgggctccacatcggccgcctctgctccgccccttccccatcctcatccaagggagggtacacattcacggtggggtaccatgaactcgccgggacgaaggtgagcctgaagaagcccctgctggtgctcaggaagaagaaggtgaccggtggtgctgcggatcaggagccaccaatggcggcgggggaggcggagctggaggtgattggcatcatccggcacaagatcctcttcaaggaccgccccaaggccctcatctcaaagccgccgaccaaggagaagaaggccttgcagccagcagcaaattgatgccattcctgggaacggccagcagtgttgcagcaacttggtgcagttatgccagcgattccgtggaccttgagaatctgaaactccattggtttgtcagtgtgcgtccaaggttttttctgaacatgccattgccattgttctagtcaggatggggc

SEQ ID NO: 1941 - DNA, 1072 bp, Panicum virgatum
gggaacccactgccttttcttttccctggcgttggcgccaactaaacaaaacaccagagggggaaggcgggaaagcaagcagcaatttggcgccaagcggcaacgcgcggaaagatctcgcgttttcccccctttcctattccttctcatttgcgcttgcttgcatttgcatcccgtcttaggggaagcggcgaagcggcggagatggagatccgcgtgcggtgcggatgcggcgattcgtcgtgcccggagtgggccgtcgtggagttgcagggcgtcgtgcagccgcaggcatccttctccggcgacatccgggggctccacatcggccgcctctgctccgccccctccccgtcctcttccaagggagggtacaccttcacggtggggtaccatgaactcgccgggacgaaggtgaccctgaagaagcccttgctggtgctcaggaagaagaaggtggctggtggtgctgcggatcaggagccaccgacggcggcggaggtggagttggaggtgattggcgtcatccgtcacaagatcctcttcaaggaccgccccaaggccctcatctcgaagccgccgaccaaggagaaaaaggccgcgcaggcagcagcaaattgacgccatttctgggaacggccaagcagcaacttgatgcagccgtgccggcgatttcgtggaccttgttttagtcacattcaggcgaaattcgacgccgtgttctgtgtggttgggcttgtttggatggcaccctgggaaagttgcctatgccaggcagctcatccaggccctcgatttcgtgcgcctggggccacgatggctgcctgggtgaggccttcatccactgcctgtttctgtctgttgctttctgtcactaagatatttccatatcaccggcagtactgaatcacggctggtaaatgtaaaacatgtcagcgttcgtcttgaagcatatcaggggaagtggttacaaggaaagctaacatttatggtccattccattccatggtaggatcctatgattgctgttatgagaaacactactgccaagtgaactgctcgtctttctcca

SEQ ID NO: 1942 - DNA, 934 bp, Panicum virgatum
gaagtgatccccagtttctctgcctttttcccccggcgttggcgccaactaaacaaaacaccagggcgggaaagcgagcggcaatttggcgccaagcgcgcggcagcgcgcgcaaagatctcggggcccccaatttcctattccttctcgtttgcgcttgcttgcgtctgcatccgtctttggtgaagcagaggcgtcgccgagcagcggcggagatggagatccgcgtgcggtgcgggtgcggcgattcgtcgtgcccggagtgggccgtcgtggagctgcagggcgtggtgcagccgcaggcatccttctccggcgacatccgggggctccacatcggccgcctctgctccgccccctccccatcctcttccaagggagggtacaccttcactgtggggtaccatgaactcgccgggacgaaggtgaccctgaagaagcccctgctggtgctcaggaagaagaaggtgggtggtggcgctccggatcaggagccaccgatggcggcggaggtggagctggaggtgattggcgtcatccgacacaagatcctcttcaaggaccgccccaaggccctcatctcaaagccgccgagcaaggagaagaaggccgtgcagcaagcagcaaattgacgccaattctgggaacggccagcagcagcttgatgcagccgtgccggcgatttcgtggaccttgttctagtcatgttcaggcgaaattcgatgccgtgttctgtgtggttggttgatgcattgtatgtttctgcatacagtttaaggatgtaccacccttgtactgtttctgtcactaggatatttccatatcagccgcagtactgaatcacggctggcaaatgtaaaacatttcagtgttcgtcttgaagcaaatcaagggaaagctaacatttattgtccattccattccatgatagtag

SEQ ID NO: 1943 - DNA, 895 bp, Sorghum bicolor
gcgcgaaccaccgggggaaatggcgggaaagctagcggcactttggcgccaatctgagaaacgtgaaaagggacccatcccctcttttgcctgtttatcgcatcctattgctctcctctgctcggccggcgaagggaaggggatcgaatcgaaatcgaagcgaagcagaggggcggcgatgcagatccgcgtgcagtgcgggtgcggcgagtcgtcgtgcccggagtgggccgtcgtggagctgcagggcgtggtgcagccgcaggcctccttcgccggcgacatccgcggactccacatcggccgcctctgctccgccccctccccgtcctcatcttccaaggcagggtacaccttcacggttgggtaccacgagctcgccgggaccaaggtgacgctcaagaagcccctgctggtgctccggaagaagaaggtgaatgctggttgtggggaacaagagccaccggcggcggcggaggaggtggagctggaggtgattggcatcatccggcacaagatcctcttcaaggaccgtcccaaggccctcatctcaaagccgccaaccaaggagaagaagaccgtgcagccagcagcaaagtgacgccacgccagcaacttcatgccccttgagaatctgaagctcccttggtttggctgtgtgttccctgaatattgccactgttctagttatgactggtttggttgatacgttgtccgttgtacaagtttaacgatgtttcctccaaaaaaaaagaggttaaggatgttcacttgtattgtctgtttctttcttggtgtttaaagtctgagtcattgcaatattcccatgtcaccgtcagcattgaatcgcagctggtacaacatttgggtattcatctcgactgtttaagcaaat

SEQ ID NO: 1944 - DNA, 524 bp, Zea mays
gctttgctcattctcgtgctcggcaggggaacggtgcgaagcggaggagcggcgatgcagatccgggtgcagtgcgcgtgcggcgagtcgtcgtgcccggaatgggccgtcgtggagctgcagggcgtggtgcagccgcaggcctccttcgccggcgacatccggggactccacatcggccgcctctgctcctccccttccccagcctccgcctcgtccaaggcagggttcaccttcacggtggggtaccacgagctcgccggcacaaaggtgacgctcaagaagcccctgctggtgctcaggaagaagaaggttaatgctggtgctcaggaagaagagccaccgacggcggcggaggtggagctggaggtgatcggcatcatccggcacaagatcctattcaaggaccgccccaaggccctcatctcaaagccgccaaccaaggagaagaaggccgtgcagccagcagcaaagtgacgcgacgccagcaactccgtgccccttgagaatctgaagctctcttg

SEQ ID NO: 1945 - DNA, 668 bp, Saccharum officinarum
ctcctctgctctgctcagccggagaaaggaagggaagggaagcaaagagccggcgatgcagatccgtgtgcagtgcgggtgcggcgaatcgtcgtgcccggagtgggccgtggtggagctgcagggcgtggtgcagccgcaggcctccttcgccggcgacatccggggactccacatcggccgcctctgctcagccccttccccagcctccgcctcttccaaggcagggtacaccttcacggtggggtaccacgagctcgccgggacgaaggtgacgctcaagaagcccctgctggtgctcaggaagaagaaggcaaacgctgtctgtggggaacaggagccaccgccggcggcgacggaggtggagctggaggtgatcggcatcatccggcacaagatcctcttcaaggaccgccccaaggccctcatctcaaagccgccaaccaaggagaagaagaccgtgcagccagcagcaaagtgacgccacgccagcaactccatggccctgagaatctgaagctcccttggtttggctgtgtgttccctgaatattgcgactgttctagtcatgactgctttggttgatacgttgtccattgtacaagtttaaggatgtttcctctcaaaaaaaaagtttaaggatgttcacttgtcccaaaacaaaacac

SEQ ID NO: 1946 - DNA, 978 bp, Pennisetum glaucum
ttcccatcacgtcttccgagttccaaagcaccaaccttcttgctcaggcggcacgcgacgcagcgaaatcctctctgctaagttcacaagaagattcggcggcgttccggcgcggccggagtttccgcgatcaggcacagggggatggggaactgtctcgagcggtctcgccgcggtcgctccggcggcggaggtggctccgtgcattactccaggacgaaccccgtgtgggtggaggaggaagtgggcaggaaggaggaggaggaggaggcggcggctgcgcgcaagggcgagagcgcgccggcggccacgacggaggtgaagatcaggatcacgaggaagcagctggaggagctgctgcggcgcgtcgagggcggcacggagagcggcgacggcgtgccggtccgggacgtcatctcggagctcctgtacgtggccagcaccagctccaacttccggcacaggggcgacgacgaggggcagtggcggccgtcgctgcagagcatacccgagtgagatcgaatccatgctacctgttggctgttgctgcatcatctcatctgcagcaacaacacttccagcatgttgtcctaatcgttgccagtcctactatgattctgtcgcgccttgatactatcatcatagcaagtagaactgcagtattagcatatatagtatccattgggtgtccatttgtttaggccttgggtgaagacgaacatgagcttgagatagactatatgcatagagtaaattaaaatatggtgcttaattaattgagtagtgtatgtgaaactagtagctagtatgagggtcacttccgatccattgcttgctgtatgattttggacattggggtcgcacaattgtgtacatactgttattactgttcagtttgctactatgtcagctctcttgacacctttcctatgtcttcggttctcggactcgtggaggaggatcttttttatgaaattg

SEQ ID NO: 1947 - DNA, 1104 bp, Panicum virgatum
ccctgcttggcaaattaaacacgattcctcgcgtttcacaccttgcgccaacgccaaagccccgacccggcccgcccaaacacccgacgcgcgccagcgcgatgacgtggtcggcccgcccacgggcccgtcatccacgacccgatcgcggccatacacgtgtctcgtcgtcgtcgtcgtccgtttccttcttccctccctctccgtccgccgtgcctataactacgccaccgcggccgccctcgcaaacgatctgccattcccatcgcatcttccaagcaccaatctctttttttgccccagatcgtacacgaaacgaaattctctgctgagttcgcgcgcggcgttccggcggcccgacttgcatgcttgccgcgatcgggcagaggagatggggaactgtctcgagagttctcgtcgcggtagctgcggcggcggtggcggcgccgccgtgcattattccaagacgcgcgccgtgtgggtggaggaggaggaggtcggcaggaaggaggaggaggcgcgcaagggcgagagcgctccggcggcaggggcggcggcgaccacagaggtgaagatcaggatcacgaggaagcagctggaggagctgctgcggcgcgtcgaggacggcaaggaaagcggcgacggcgtgccggcccgggacgtcgtctcggagctgctgatcgtggcgagcaccagctccaacttccggcacagggacgaggggcagtggcggccgtcgctgcagagcatacccgagtgagcttgttgctacatctacgacgataccccagcatgatgtcttattgttgttactcctattgccctattggcttcatatatactatcataggcatagcacctagtaggctagtagtagtgcagtagcatagtattcattgggtatttgggtgtacatttgtataggtttggatcaataatacatgagttcgagataggctatgtattagttgtgtggtgcttgtgaattgagcaactagtggctaggagggcctcttccattgcttgctgtacgatttttttggacactggggtcgcacaattgcgtacatatatagtactatctattactattattattcagtt

SEQ ID NO: 1948 - DNA, 1407 bp, Panicum virgatum
ttcttccctccctccccgtccgccgcgcctataactacgccaccgcggccgccctcgcaaacgatcttgccattcccatcgcatcttccaagcaccaataatctctttttgcccagaccgcacacgaaacggaatttctctgctgagttcgcgcgcgcgaggattcggcgttccggcggccggaccttgcttcccgcgatcaggcagaggagatggggaactgcctcgagaggtctcgtcgcggtagctgccgcggcggtggcgccgccgcgcattattccaagacgagcgccgtgtgggtggaggaggaggtcggcgggaaggaggaggaggaggaggaggaggcgcgcaagggcgagagcgctccggcggcgaccacagaagtgaagatcaggatcacgaggaagcagctggaggagctgttgcggcgcgtcgaggacggcaaggaaagcggcgacggcgtgccggcccgggatgtcgtctcggagctgctgatcgtggcgagcaccagctccaacttccggcacagggaggaggggcagtggcggccgtcgctgcagagcatacccgagtgagatcgaatccatgctactcgttgctacatctacgacgataccccagcatgatgtctcattgttgctactcctatattagcttaatatactatcaatctgtcatagtattgctgtagcatagtattcattgggtgtacatttgtttaggtttggatcgatcaataatacatgagctcgagataggcaatacatagggattaaatttaaacttgtgcttagttgtgtggtgtttgtggattgtgcaactagtagctaggagggcctcttccattgcttgctgtatgattttttggacactggggtcgcacaattgtgtacttattattattattattattattattattattattattattattattattattattattattattattcagtttgctacttatgtcagctctcttggaaccatccaatattttctgtttttgaacgagcatctatctaggatattttgatgaaatcgttccggttagcgtagaaactctcgcgttccaatttccaaatgatgaaatgaacgaactagctaggtgatgaccaattcggaaacctcgtgttgtttgtgtagttctctagctagaaactagaaagacctaaacacagtgccaaatccagtgatgatgaaggaagctaaggcgaagtaggagtgttggcatgcagtagaatcccctgctgtcatgctgtgcctatcctctgtttatattgtcttaggcatgtagcactttgtaaagcaagtggggggcgtggctgccccagcagctggccagctgctgcggttgtgtggaagctggagatgagagtggttgtctggttgagatgaccg

SEQ ID NO: 1949 - DNA, 644 bp, Pennisetum glaucum
cgggctgctaaatggcctgaatagtgccggggcctagatagaactctttgccaaaagcaattctttctcctctgcagccgacggcgagcgcgatgccgaacgcggggctgcgcgcgtaccgcgaggtgctccgcctggtgcggcggctgccggcggagacgcggctctactacgccaagtacgcccgcgagaacttcgtcaactaccgcgacctctccgccgacgatgacctcgccgccctcctccgccgcgcctacacccactcgtcatgggtcctctccaagtactcgatcgatggggagaaggctgcggcgcggctcaaagatctcggcgacggccgccccgccgggcagtgacgtacgcgcgcaaggtgttcgaccatatgccgctctgcgcttaaggcttcagtttagcgtttgcttgtgttcgtgcttgtgcttgtcagggacctgcattattccgtgtcgaactgtgaacagatttgcttaaggttttgggtttgctttaatttgacacggcgtgtaggcatgattctgatcaccacaaaatatgaaagacagacacagacatgatgggacgattatggtggaaacatgtatgcggactgatcattattagaagtccgaatcaatggcttgacattt

SEQ ID NO: 1950 - DNA, 758 bp, Panicum virgatum
cgggccgcgaaatggggtagagtaggcaggccagcctgggaaaagtagtgcccttgacactctttgcttgaagcgaagcagcaatcagcagcagcagctcgccccgggcccccggcggtgtgcggcgatgccgaacgcggggctgcgcgcgtaccgcgaggtgctgcgcctggtgcggcggctgccggcggagacgcggccctactacgccaagtacgcccgcgagaacttcgtcaactaccgtgacctctccgccgacgacgacctcgcggccctcctccgccgcgcctacgcgcactcgtcatgggtcctctccaagtactcgatcgacgcggagaaggcggcggcgcggctcaaggctctcggcgacggccacgcggggcggtgacgcgcgcaaggtgttcgaccctatgccgctctacgcctgaggcttcagttagccttcaattttgtgcttggtttggcaggcgcttgcattactccgtcttgaataaatctgctcaaggttttggttgctttgatcccgactacaagttctatggccagatgcacacgtagttatctttgtctgtccgccctttttcaattcatttcaactttgccggcttcgtgttcgccatctttatttccttcgtggtatccagctacatggataacgtgcgcttgagcttgatcctggacatgtttatcttgtgcataagttctggattgccatattccggatcatagatgagtatgttaggatgtcattttctccg

SEQ ID NO: 1951 - DNA, 1386 bp, Panicum virgatum
aaaaaaaaaatactcgcaatcagcagcagctcgcctcggcggtgtgcggtgatgtcgaacgcggggctgcgcgcgtaccgcgaggtgctgcgcctggtgcggcggctgccggcggagacgcggctctactacgccaagtacgcccgcgagaacttcgtcaactaccgcgacctctccgccgacgacgacctcgcggccctcctccgccgcgcctacacgcacgcgtcatgggtcctctccaagtactcgatcgacgcggagaaggcggcggcgcggctcaaggctctcggcgacggccacgcggggcggtgacgcgcgcaaggtgttcgaccctatgcccgctccacgcctgaggcttcagtttagctttgacttatgtgcttggtttggcaggcgcttgcattgcattactccgtcttgaataaatttgctcaaggttttgtttgctttgatccccgactccaagttctatggccaggatgcacacgcagttgtctgtctgccgcccttttttcaattcatttcaacaccatctttatttccttggtggtatccggctacatgaacgacttgtggttgatcttggacatgtttatctggtgcatgagttctggattgcgatattcgggatcaaagatgagtatgttaacatgtttttgatgaatgagaaacagtattagccctagtagatggagtactcgtctaagttttaggttttcctaatcgttcaaaaaatagttttaggttttcctgtaccgagtttttcggtgttagggttctggagttcccttcttttctcaggcatggcaagaacttaccaaatttggtttatccatagcaaggtttgcgaggtgttgacgatcccggattcttcaccactcggacgagtatttaccaaatttccaaaggcaacaccaacattggagtcacctatggcgccccatccggaatcaacttaatgatcttctcctagatgccaaccaccaaataaacttgcctaatacactatacgacctttgaattccaaacttgaaagaattggatgtgaacaaatcttttggaacaactgcagttcaatcaatcaaacaggtaccccatcccggagattttgctgaaagcctccaacttcagggatttgcacgtccaaataaagcatacacacagctggcgtagagaaacagacaagcaataccaacacagggaagcagagcaccacaaattgtctagttccttaagaggccactatggaagaacaagctccttagatcaggttgacttaccaagacaggaactggcagcaggacaaccctagactaatagaaacggtcacatattctttacatactattagtctaggtttgtcttgttctttgcaacaacaatggt

SEQ ID NO: 1952 - DNA, 681 bp, Sorghum bicolor
cgaaattagacaaagggtaagtggtttcaggcggatgcgagctggcaccgtgcagaacgacacacggatctctcagcagctccattgggtttttggcttgtgcgtggagtacatacccgcagcaagcaatcagcagctcgcgccgccgcctcctccgcctccggcccacgtaggtagacgcactgccgcaaacgatggccagcgcggggctgcgcgcgtatcgtgaggtgctgcgcctggtgcggcggctgccggcggagacgcggccctactacgccaagtacgcccgcgagaacttcgtcaactaccgcgacctctccgcggacgacgacctcgccgccctcctccgccgcgcatacacccactccacatgggtcctctccaagtactcgatcgacgcggggaaagcggcggcgcggctcaaggatcttagcgacggccacgccgggctgtgacgcccgcaaggtgttcggtcatatgccgctcttggcttgaggattcagttcagcgtctttgtttttggcaatcgcattactctgcttaaggttttggttactttgatcgctactttgacgttgttgtattgaagctcactactcatgctcgttcatcgtctccctgctctcatgcctccgtgcctattgcctacccttttcttttcaattcaattcaactttgcgc

SEQ ID NO: 1953 - DNA, 2710 bp, Sorghum bicolor
ctcgtgttctttgaaagaaaatatctgcgcatgcttgagatgctccgagcattgggtccagatgtgtgatccttgacgaggaaaaagcggtgcagccgtgcaggacagggctgcgccagcccgggccgatggtagagatgaaggagtgcttgaccaccccaccgccgtgccaacaacagcaatccgtgctaggccgttttgctttgcggcccgtttgccccaccaaccgcccgtatccatcgtcgtccgtcgcgtcgcccggcaggcagagaaagagaaaaaactagatagacaaggccaggggtcagccacgcacggccacacacggcagctgccccgtataaaccaccccccgcgccgcgcaatttgctctctagctgagactgtcagctcagctctcccctccccgccggccggccggatccaccaaccccccccccccccccctcccccacctaccactaccacaccggaccagaccagaggcagcgggagaaaaaagcagccacccccgctcttcgcccgggaacacgggggggaacagaacagcccgaccggccaatccaatccacgcgcccgcctccatggaggccgccgccgtgctcgacgccttctccgccgcgccgcgccacaagctgcgcccggcagcctggtggagatccacgcgcctcgcgtcgcaggcgtgccgcgccaccgccccattcgcccgcgccgactggcagaccgcctgcgccatcctcgctagcaacagcagcacgggcggcggcggcggccacgacgccagcagcagcagcaacaacaggcagccagcgccgcgggtgaacggccagaagcccctgcccgcgcccgcgcccgcgccagccctggaggaggcgacgccgacgcccaccgagctggatctggtgcctgtgtccaacctcccccgcccgctcagcatcagcgacctttccccggcgcccatgcacgggtcgcagctccgcgtggcgtaccagggcgtcccgggcgcctacagcgaggccgccgccgccaaggcctacccgggctgcgacgccatcccctgcgaccagttcgaggtggccttccaggccgtggagctctggatcgccgaccgcgccgtgctccccgtcgagaactccctcggcggcagcatccaccgcaactacgacctcctcctccgccaccgcctccacatcgtcggggaggtccagctccccgtccaccactgcctcctcgcgctccccggggtgcgcagggagctgctcacccgggtcatctcccacccgcaggcgctggcgcagtgcgagctcacgctcaacgccatgggactcaacgtcgcccgcgaggccttcgacgacaccgcgggcgccgccgagcacgtcgccgcgggcgggctaagggacaccgccgccatcgcgtccgcgcgcgccgcggagctctacggcctccaggtcctcgccgacggcatccaggacgacgccggcaacgtcacccgattcgtcatgctggcgagggagcccatcatcccgcgcaccgataggcccttcaagaccagcatcgtcttcgcacacgacaccgacggcacctccgtcctcttcaaggtgctctccgccttcgccttccgcgacatctcactcaccaagatcgagagccgaccgcaccgccaccgtcccatccgcctcgtcgacgacgccaacgtcggcaccgccaagcacttcgagtacatgttctacatcgacttccaggcatccatggccgacgtccgcgcgcagaacgcgctcgcggagatccaggagttcacatccttcctcagggtgctcgggagctaccccatggacatgacgccgtgggacgccgcgctctcctcttcctctcgcgccgacgataccagccagcactactagctagtgattgggtcagccaaccaaaccaaggatccaccaattcattcgacggacaagaaatgttgctttttaatcagtcagtcatcagtcatcacaggaatgcgcaagaaacgttgcatctgcgtgcatcctgcatctgcgtgctcctagttgctccgaatttcgtgaccaaattcgtagaaacggagaaggggctcctgttgtatgtatgctggggatgtatgtaagtacagtgtattctttcttctttacaaacctactctctatcttgcaacaaaccaaatcaagtgaacccatcaaaaccatctcttctttttttgcaacaaacaagcatggcgttaccgttgttgttgcctcttgggacttgccgagttggcaattactatacatttgggctttgtttacttccatcaaaaaatttatcgaatctttaaacacatacataaagtactaattacatagtttggttggaatcaacgagacgaatcttttgaatatagttagtccataattgaataataattactacaaataaataaaagtgtttcagtatggtgaaatttttcgcttcgccaactaaacacggccttgggaggaaggaaggaagcaacgatccggaaagactcgaatcgaggatggagacgagggcggcggcgcggttggtatgattctgactcggtgcatggattccataagcggcaggtgggttgggtagtctagtccgatttggtatcctcgtcaagcggtgaagtgcttggttttctcgagacaaaccaaggccttgtgttccgaaaagatttcagatgttg

SEQ ID NO: 1954 - DNA, 2133 bp, Zea mays
tgactgactgattaaaaagcaatgaattggctctacgcccaatcactagtactggctggcgcgagaggagagcgcggcgtcccacggcgtcatgtccatggggtagctcccgagcaccctgaggaaggaggtgaactcctggatctccgcgagcgcgttctgcgcgcggacgtcggccatggacgcctggaagtcgatgtagaacatgtactcgaagtgcttggcggtgccgacgttggcgtcgtcgacgaggcggatggggcggtggcggtgcgggcggctctcgatcttggtgagggagatgtcgcggaaggcgaaggcggagagcaccttgaagaggacggaggtgccgtcggtgtcgtgcgcgaacacgatgctggtcttgaacggccggtcggtgcgcgggatgatgggctcccgcgccagcatgacgaagcgggtgacgttgccggcgtcgtcctggatgccggcggcgaggacctggaggccgtagagctcggcggcgcgcgcggacgcgatggcggcggtgtcccggaggccccccgcggcgatgtgctcggcggcgcccgcggtgtcgtcgaaggcctcgcgggccacgttgaggcccatggcgttgagcgtcagctcgcactgcgccagcgcctgcgggtgggagatgacccgggtgagcagctcccgtcgcaccccggggagcgcgaggaggcagtggtggacggggagctggacctccccgacgatgtggaggcggtgccggaggaggaggtcgtagttgcggtggatgctgccgccgagggagttctccacggggagcacggcgcggtcggcgatccagagctcgacggcctgaaaggccacctcgaactggtcgcaggggatggcgtcgcagcctgggtaggccttggcggcggccgcctcgctgtaggcgcccgggacgccctggtacgccacgcggagctgcgacccgtgcatgggcgccggggacaggtcgctgatgctgagcgggcgggggaggttggacacgggcaccagatccagctcgtccggcgtcggcgtcgcctccagggctggcgggggcttctggccgttgacccgcggcgctggctgcgcgttgttgttgctgctggcatcgtggccggcgccgcccgtgctgttgctggcgaggatggcgcaggcggcctgccagtcggcgcgggcgaatggggcggtggcgcggcacgcctgggacgcgaagcgcgtggatctgcaccaggctgccgggcggagctggtggcgcggcgcggcggagaaggcgtcgagcaaagctgcggcgtccatggagacgggcgcgtggattggattggattggcccggcggtttggtcccccccgccccgtgtggccgtgttcccttcccgggtcgtggtggctgcttttttttctcacaccgccagctctggtctggtctggacgtctggtttgttaggtaggtgggaggggttaggtgggggagtgggagggggagcggagcggagccggaggcagcctcgtgccgatgcgttgcgcggcgcggggtggtttttacggggcaggtgccgtgtgtgttcacttctctgcctgcgcggcgacgcgacggacggatggatggatacggcagatggcaaagcaaaacatcgtcgccgactcgccgtggagtgatcaaacactcctccatctctaccaacggcccgtgctcgaagccatccagcaaaagccttgtggcctggcctccgtcttcgccgcgggctataggagcagccaccggccatcgcttcctggtgcacggagctgctacagctctcaagcttatttgtctatcttataggcgctttattttccctcatctcaaaatggatattattgttttgattgcgaagatttgtgttggcctctgaatatgaaggtgatgggaggtgcccttccttcgtatacgcattgctgacacgccgatgctactagaggtgaaaaattgtcagaaaacactaaaaccattattgttttcattttcttatcgaaaacggtaactccggaaacgaaaacgatatcggtattttaaaaatattaaaaacgaaagttcgatacagaaaatacatcggcgtcgatcagaatctaaaataca

SEQ ID NO: 1955 - DNA, 2702 bp, Zea mays
tcatattcagaggccaacacaaatcttcgcaatcaaaacaataatatccattttgagatgagggaaaataaagcgcctataagatagacaaataagcttgagagctgtagcagctccgtgcaccaggaagcgatggccggtggctgctcctatagcccgcggcgaagacggaggccaggccacaaggcttttgctggatggcttcgagcacgggccgttggtagagatggaggagtgtttgatcactccacggcgagtcggcgacgatgttttgctttgccatctgccgtatccatccatccgtccgtcgcgtcgccgcgcaggcagagaagtgaacacacacggcacctgccccgtaaaaaccaccccgcgccgcgcaacgcatcggcacgaggctgcctccggctccgctccgctccccctcccactcccccacctaacccctcccacctacctaacaaaccagacgtccagaccagaccagagctggcggtgtgagaaaaaaaagcagccaccacgacccgggaagggaacacggccacacggggcgggggggaccaaaccgccgggccaatccaatccaatccacgcgcccgtctccatggacgccgcagctttgctcgacgccttctccgccgcgccgcgccaccagctccgcccggcagcctggtgcagatccacgcgcttcgcgtcccaggcgtgccgcgccaccgccccattcgcccgcgccgactggcaggccgcctgcgccatcctcgccagcaacagcacgggcggcgccggccacgatgccagcagcaacaacaacgcgcagccagcgccgcgggtcaacggccagaagcccccgccagccctggaggcgacgccgacgccggacgagctggatctggtgcccgtgtccaacctcccccgcccgctcagcatcagcgacctgtccccggcgcccatgcacgggtcgcagctccgcgtggcgtaccagggcgtcccgggcgcctacagcgaggcggccgccgccaaggcctacccaggctgcgacgccatcccctgcgaccagttcgaggtggcctttcaggccgtcgagctctggatcgccgaccgcgccgtgctccccgtggagaactccctcggcggcagcatccaccgcaactacgacctcctcctccggcaccgcctccacatcgtcggggaggtccagctccccgtccaccactgcctcctcgcgctccccggggtgcgacgggagctgctcacccgggtcatctcccacccgcaggcgctggcgcagtgcgagctgacgctcaacgccatgggcctcaacgtggcccgcgaggccttcgacgacaccgcgggcgccgccgagcacatcgccgcggggggcctccgggacaccgccgccatcgcgtccgcgcgcgccgccgagctctacggcctccaggtcctcgccgccggcatccaggacgacgccggcaacgtcacccgcttcgtcatgctggcgcgggagcccatcatcccgcgcaccgaccggccgttcaagaccagcatcgtgttcgcgcacgacaccgacggcacctccgtcctcttcaaggtgctctccgccttcgccttccgcgacatctccctcaccaagatcgagagccgcccgcaccgccaccgccccatccgcctcgtcgacgacgccaacgtcggcaccgccaagcacttcgagtacatgttctacatcgacttccaggcgtccatggccgacgtccgcgcgcagaacgcgctcgcggagatccaggagttcacctccttcctcagggtgctcgggagctaccccatggacatgacgccgtgggacgccgcgctctcctctcgcgccagccagtactagtgattgggcgtagagccaattcattgctttttaatcagtcagtcatcacaagaaacgttgctttggttctttttatacacttctctctcctgcatgctttttctttgcttcgaattcggtgaccaaactcgcagaaggggctcctgtttaatacgtatggtaagtacagtgtattctttcttctttacaaacctactctctaccttgcagcaacaatcaagtgaaccaatccaaaccatcacttctatttttttgcaacaaacaagcattgctgcctgaatctgtatgagcagcacccaaaaatgatccatggccatggaaggagcttggtgtttctgttgttggtgcctcttgggacttgccgcctagttggcgtttacatttttttgattgccttgtccttcaattacaagctatactatctaaacccacgcacacctactctgagcttagaactacaatctataacgaaaataactaaaatacaaacacgcagctgagagacaccgaaggcggcctccaatgatggtaagcacctccaatgatgatgagcacgtttctctgactattatagtacatctatccataagacaacactacaaaaaaatagaaaagctttaagagcttgtttggttagttcttagtagaactaggttgatttaaatctcaaacaattcaatttttttaagtttttttaatcccatctaatttatgtataatgggaataaccgaacactgttccagacaaaaaaaaaacctgggtgagccagcgctcgaatcccagctggctgcgtttacatttgggaggaagtctgggagacaacggcggcgg

SEQ ID NO: 1956 - DNA, 605 bp, Pennisetum glaucum
ttcctcatcttcttctccggatcacactcacacagcagtgcgtggtagccgagaggcagcgggagcagagccatgctggaagggaaggcgatggtggaggacacggacatgccggcgaagatgcaggcgcaggcgatggcggcggcgtccagggcactcgaccgcttcgacgtcctcgactgccggagcatcgccgcccacatcaagaaggagtttgacacgatccacggaccggggtggcaatgcgtggtgggctccagcttcggctgctacttcacgcacagcaaggggagcttcatctacttccggctcgagtcgctaaggttcctcgtcttcaaaggggcggcggcgtagcgtagcatagaatagcataagcaggctcgtaacatccacggccaggacaaccagattcaccgctgctatcttctcctccggcttttgtggagggcgactcggtggcgcggcgggcgggcgggcggcgtgtgcgtgcgtatgtgaaattggctggctgtatacgctagtacatgtactgtatgtaaccatgggcaatacagctacctgcctgcaaactgctcgtgtacgaaatccagacggctgaataccgg

SEQ ID NO: 1957 - DNA, 1007 bp, Panicum virgatum
ataatttggaacggagagagtagtaacgatcacagcagcctgttcaaaatcgctagacgcgtgcttttccacagcaatgtgatgctaactgagatgaagccatcaagcattcaagctcgctcgccgtcgccgctgaacgaaccggagtcgccagcacgtcagcttgacgcggatcggcgggtgcatgtgggcggcggacggcaccccgcgtctcccctccctctccggctgtataaaaaaggacggggagggatggaggcacaggcagcagtggatccgcgcacgcctctccctcccgagtgttcttcttcttcttcaggtcccgaagcggcggcgcgtgctaccggagagcaggacgcgagacaccatgctggaagggaaggcgatggtggaggacacggacatgccggcgaagatgcaggcgcaggcgatggcggcggcgtccagggccctcgaccgcttcgacgtcctcgactgccggagcatcgcggcgcacatcaagaaggagtttgacacgatccacggccccgggtggcaatgcgtggtgggctccagcttcggctgctacttcacgcacagcaaggggagcttcatctacttccggctcgagtcgctcaggttcctcatcttcaaaggggcggcagcctagcccaggtgcagcacgttctcttttcctccggcttttgttgagcaaagcctacctagggaggcgccgcggcgggcggtgtgtgcgtgtctgtatgaaattggctcgctgtatactatgagggtaggatgtaacatcggcaagattgcagaacggtggatttcatcgctggtcgaattgcttctttgtgtacgatgaaatccaggtgtatgaatttggtggtgtataaatggaaatttgaaaatattggggataattcaaatccaatcttagcagcgaagcacgcccggcaggattagagttgcagtcctttgcagcttgtcttcaggaaacgcaaaaataaataaaggaaaatgaaaga

SEQ ID NO: 1958 - DNA, 1065 bp, Sorghum bicolor
acgcgcacatctcgtcgtcgtcgtgtcttcagaattcagatcgcacgttctcgctgagagccctcgtgccgtgctagcagtagcagtaccatatgttggaagggaaggcggtggtggaggacaccgacatgccggcgaagatgcaggcgcaggcgatgtcggcggcgtccagggccctggaccgcttcgacgtcctcgactgccggagcatcgcggctcacatcaagaaggagtttgacgcgatccatggccccggatggcaatgcgtggtcggctccagcttcggctgctacttcacgcacagcaaggggagcttcgtctacttccgcctcgagtcgctcaggttcctcgtcttcaaaggggcggcagcatgacaagcgcccaacgacaggtaagatcacgaccaggcgaagcaggaggtggaggattccccccccaccggctttaatttgtggagggcgacgaggtggcacggcggctgctgctgctgctgctggcgcgtgtgtgtgtgtgtgtgtggatatttcctcgctgtaggagtacgatggtaccagtaggcagtagatttgaaacatcgttggagattggaaacagtggaattcatcgctggtcaaattgctttttttgtaagacggatgaatttggtgataatggtgtatggatgaaaaaattttgaatttatttggggttattctagcaggagcaaagcagaccacgaaaaagaaattgtgcgggaaaaacaattccgacctgctggattcgatccatctacagaaacgaaaaagaaaatgtgaaaaaaattccgacctgccggattcgaaccagcgacctaaggattgatctgcacacactacagtcctccgctctaccaactgagctaaggtcggatgtgctctttggctggaattattcttatttagacttgcagtagtcaatgacccttactagcagtaggcaacgaccattactagttgacatggaggcgtacaatctgtgcgttctgcaaatatcgaatgcattgagatgtgtgtttcaatacgaatacagtgatgaaggaagtgggag

SEQ ID NO: 1959 - DNA, 696 bp, Zea mays
acgcgcagtcttcttcagaattccctgatcacgttccaggcagctgagagcccgcgtactagccggacaggaggcgacagcgacaccgcgagacgtgccatcatgttggaaggaaaggcggtggtggaggacaccgacatgccggcgaagatgcaagcccaggcgatgtcggcggcgtccagggccctggatcgcttcgacgtcctcgactgccggagcatcgcgtcccacatcaagaaggagtttgacgcgatccatggccccggatggcaatgcgtggttggctccggcttcggctgctacatcacgcacagcaaggggagcttcatctacttccgcctggagtcgctcaggttcctcgtcttcaaaggggcggcagcatgatgacaagccccacggctaacatcgcgagttcacgaccaggcaaagcaggtggaggatgggtttttttttcaccggcctttgtggacggcttgcctcgctgtatacgatatcaccatggtaataccaaccagtagattgaaacgttgtgggagattatattggaaacaatggaatttcatcacttgtcaaatagcttttgtgtacgaaatctagatggatgtaaatttgaaatcatttggatttggaaactggtcaattagtatcgctcgtgaacgaaatctagacggatgaatctgtcgatcgttactggtg

SEQ ID NO: 1960 - DNA, 692 bp, Hordeum vulgare
gcatcgcatcatctatctctctctctctctctctctctctctctctagccataccttgtccccagccaatcatacagtgaggcgcgtgcgagcagagcttctagcagcagcagagagaaggaacaggagcgagcaggatgctggaagggaaggccacggtggaggacaccgacatgccggccaagatgcagctgcaggccacgtcggcggcctccagggccctcgaccgcttcgacgtcctcgactgccggagcatcgcggcgcacatcaagaaggagttcgacacggcccatggcccggggtggcagtgcgtggtcggctgcagcttcggatgctacttcacgcacagcaaggggagcttcatatacttcaagctcgagtcgctcaggttcctcgtcttcaaaggcatgtcggatgaccaagagcagccgctgccgctgccgccgtgctgatctctgatctgctgctccccggatttaacggccgtgttggctactcgatgattacgggggcggctgctggccggtgctggcatgaagctgaaatgcgccaatgtaacttttgcttgattcagtttgcaccgcagttcgcgactacggtctgaagctctctgaatgcgttggattcgtggaattgattttcaagcatgatgttccactttgattcagacgaatacagataaattgattcag

SEQ ID NO: 1961 - DNA, 714 bp, Oryza sativa
atctttgtgcattcatttcgagcattgcaacagagaaggctgggcaggaaggagtcacaagagacgaccaccatgttggaagggaaggcgatggtggaggacaccgacatgccggtgaagatgcagctgcaggcgatgtcggcggcgtacaaggccctcgaccgcttcgacgtcctcgactgccggagcatcgccgctcacatcaagaaggagtttgacatgatccacgggccgggatggcagtgcgtggtgggcgccagcttcggctgctacttcacgcacagcaagggaagcttcatctacttcaagctgggggcgctcaggttcctcgtcttcaaaggcgcagcatcgtagcagatgagctgaaagcgacatccacgagtcgagaagctaacatgcatctgattcggaataatcaatcagaataaccagcgggcgctacaagtttactctcccggtttttgatgacgacgacgaggcggcgtcggctggcacgatacatggagcgtgaattgtactcgcacgatagcacagtagaaaattggaagtagggtgtgcaaaagattggaattgctggtcaaacatgcgattccacttggtgttgtgtaatgtttttctagaatgacttggtttcccttgtagtacataattggatcgagagcaacagggctcgagtttattcagaatcggtatacgaattgctggagttgctgg

SEQ ID NO: 1962 - DNA, 936 bp, Brachypodium distachyon
tcagccaagagaacgaacactccctactcgttttatttcagaacgaggaaaataaaaatcagcatctccagttccagaaatcaatcagagctccaacctgtgcctctagtgttttatccggtacaactcgcttccgttgagctggtcgttagcacgtcatgttgacgtggacgcatgaccctatccggcagccgcctacaaaagggtaaggaacgcgcagatctgctcgcatcatctcgactctctctacctccgtctcgtttcgaacctatcatacagagagagcagcacagggaggaggaagggaaaaaatgctggaagggaaggcgacggtggaggacacggacatgccggcgaacatgcagctgcaggcgacctcggcggcgtccaaggccctcgaccgcttcgacgtcctcgactgccggagcatcgcggctcacatcaagaaggagtttgacgccgtccatggcccaggatggcaatgcgtggtcggctgcagcttcggctgctacttcacgcataacaaggggagcttcatatacttcaggctggagtcgctcaggttcctcgtgttcaaaggcgccgcagaaaaataaaatagggacctcggccatatatagcaggcttagcagcaaccagctgcgctgctgcggggagcgtcttctctttgtggtctcttgatctcttgatggtttacggtgcggcggttactatgaaagcgaaatgtgcttgcaagattagatgcagctgccagctgcctggtgcgaccgcgctgcagttcgcgagtagggcgtgaaagcgttgaagcgtgggattgattttacaacttggttgtacatacatcgaaataatttgccgaattgttctcttggatcgagaaataatttgtttggtttgttgtagcacgcctattgttcgtacctcatttttttttat

SEQ ID NO: 1963 - DNA, 955 bp, Brachypodium distachyon
tcagccaagagaacgaacactccctactcgttttatttcagaacgaggaaaataaaaatcagcatctccagttccagaaatcaatcagagctccaacctgtgcctctagtgttttatccggtacaactcgcttccgttgagctggtcgttagcacgtcatgttgacgtggacgcatgaccctatccggcagccgcctacaaaagggtaaggaacgcgcagatctgctcgcatcatctcgactctctctacctccgtctcgtttcgaacctatcatacagagagagcagcacagggaggaggaagggaaaaaatgctggaagggaaggcgacggtggaggacacggacatgccggcgaacatgcagctgcaggcgacctcggcggcgtccaaggccctcgaccgcttcgacgtcctcgactgccggagcatcgcggctcacatcaagaaggagtttgacgccgtccatggcccaggatggcaatgcgtggtcggctgcagcttcggctgctacttcacgcataacaaggggagcttcatatacttcaggctggagtcgctcaggttcctcgtgttcaaaggcgccgcagaaaaataaaatagggacctcggccatatatagcaggcttagcagcaaccagctgcgctgctgcggggagcgtcttctctttgtggtctcttgatctcttgatggtttacggtgcggcggttactatgaaagcgaaatgtgcttgcaagattagatgcagctgccagctgcctggtgcgaccgcgctgcagttcgcgagtagggcgtgaaagcgttgaagcgtgggattgattttacaacttggttgtacatacatcgaaataatttgccgaattgttctcttggatcgagaaataatttgtttggtttgttgtagcacgcctattgttcgtacctcatttttttttatgtccccgtcgatcttagac

SEQ ID NO: 1964 - DNA, 542 bp, Lolium multiflorum
gcaccaatcatagagagctcccgcagcacaggaaagaggcgagcgaaaatgctggaagggaaggcgacggtggaggacaccgacatgccggcgaagatgcagctgcaggcgacgtcggcggcgtccagggccctcgaccgcttcgacgtcctcgactgccggagcatcgcggctcacatcaagaaggagtttgacacgatccatggcccggggtggcaatgcgtggtcggctgcagcttcggctgctacttcacgcacagcaaggggagcttcatatacttcaagctggagtcgctcaggttcctcgtcttcaaaggcgctgcggatgaacaaccacggcggtgctaatcagctgcggccgaactcgcccgtcctcatcctggtgatttcggggcggcagctagtactagcatgaacatgaaatgtaccaaccaatatggtcctgcattgcaagtagggtgtgtgaatacgttgaattcgggaattggtctgagatgataatgaactttcgctgtacaatctccgtttcagaatttcagatg

SEQ ID NO: 1965 - DNA, 457 bp, Avena sativa
gcagaggaaagaggcgaagcgacgaaatgctggaagggaaggcgacggtggaggacaccgacatgccggcgaagatgcagctgcaggcgacgtcggcggcgtccagggccctcgaccgcttcgacgtcctcgactgccggagcatcgccgcccacatcaagaaggagtttgacgcgatccacggcccaggatggcaatgcgtggtcggctgcagcttcggctgctacttcacgcacagcaaagggagcttcatatacttcaagctggagtcgctcaggttcctcgtcttcaaaggcgcggcggatgaacagccacggccgtgctgattcagctgcggataatgaatgattgacacggggcggaatgcagctatagtagcatgaaagcgaaatgtaccaaccaatctgggaaagatgtaaacctggtggaagcttccgttgcaattggcaagtgggct

SEQ ID NO: 1966 - DNA, 701 bp, Secale cereale
ctgtcccgacccgacccaatcatacagtgcggcgcgtgcgactgcgagcagagaaggaaaggagcgagcaggatgctggaagggaaggcgacggtggaggacaccgacatgccggccaagatgcagctgcaggccacgtcggcggcgtccagggcgctcgaccgcttcgacgtcctcgactgccggagcatcgcggcgcacatcaagaaggagttcgacacgatccatggcccggggtggcagtgcgtggtgggctgcagcttcggctgctacttcacgcacagcaaggggagcttcatatacttcaagctcgagtcgctccggttcctcgtcttcaaagggatggcggatgagcagccactgccgtgctgatctgctgtgcgcctatttaacgcccgtgtggactacttgatgattacgggccggcagctagtagtgtgaacagttccctgaaatgcaccaatgtaactctgaatgcgtttgttgaatggtgtggaattgatcttcaaacatgatgttccaccttgattcaggcgaatacagataaattgatcttccaacagtatattggtgaagaattgctgcagaatcagttggtttctggccgaaagatactcgtaatgtaactcgcctgtaagtgactgctaattcctttttggctggaagaaatatatagaacaaaaataaattatcaacgaaat

SEQ ID NO: 1967 - DNA, 768 bp, Triticum aestivum
tccatcatcatctcctctacccagccagacctgtcccgagccaatcatacagtgcggcgcgtgcgactgcgagcagagcttctagcagagaagggaaggagcgagcgggatgctggaagggaaggcgacggtggaggacaccgacatgccggccaagatgcagctgcaggccacctcggcggcgtccagggcgctcgaccgcttcgacgtcctcgactgccggagcatcgcggcgcacatcaagaaggagttcgacacgatccatggcccggggtggcagtgcgtggtgggctgcagcttcggctgctacttcacgcacagcaaggggagcttcatatacttcaagctcgagtcgctccggttcctcgtcttcaaaggcatggcggatgagcagccgctgccgtgctgatctgctgcgccctctcctgttttaacggccgtgtggactactcgatgattacggggcggcagtactgcctactagtctgaaacagttccgtgaaatgcaccaatatgatatgctgtaacttgattcagcttttgcaccgcaattcgcgagtgtggtctgaaactctgaatgcgttgaatggtgtggaaatgatcttcaaacatgatgttccactttgattcagatgaatacagataggttaattcagtatattggtgaagaattgctgcagaatcagttggtttttggccgaaagatgctcttcaatgtaacttgcctgtaaacgtggtccttttcggctggacgaaagatataaaaaa

SEQ ID NO: 1968 - DNA, 539 bp, Festuca arundinacea
ggcacgaggcttcgaaccaatcatacagaggctcgcgtactcgcagagcagcacagggaagaggggagcgaaaatgctggaagggaaggcgacggtggaggacaccgacatgccggcgaagatgcagctgcaggcgacgtcggcggcgtccagggcgctcgaccgcttcgacgtcctcgactgccggagcatcgcggctcacatcaagaaggagtttgacacgatccatgggccgggatggcaatgcgtggtcggctgctacttcacgcacagcaaggggagcttcatatacttcaagctggagtcgctcaggttcctcgtcttcaaaggcgccgcggatgaacaaccacggccgtactgatcagctgcgccgaacgcccgtcatcctggtgattacggggccgcagctaataggattgaacgagaaatgtgccaaccaatatggcgaagatgtaacatggtagaagcctgcattgcaatttgcaagtaggtgtgtgaatatgttgaattggggaattgatttgagatgatgatgaact

SEQ ID NO: 1969 - DNA, 706 bp, Prunus persica
atgggtgattctctgcatataaaaattgaaataaaggagaagtcaaagccaaagagaatcatttcctccttgaagataagaactaccaaatcctacaaaatcccaactgggttttcttcttcaggcacaaaaacagagagagagagagagagagagagagagaggcagagagaagaaaatatgttggaaggcaaagctttcgtggaggacacagacatgccagtgaagatgcagatgcaggccatggctgctgcttctcaagctctggatctttatgatgtctttgattgcagatccatcgctgcccacataaaaaaggagtttgacatgagatatgggggcggttggcaatgtgtggtgggctcaaactttgggtgtttcttcactcattcaaaaggaagcttcatctactttacacttgagagtctcagcttccttatcttcaagggggcttcttctccttcctcctcacccgaaggctaacgcagtgtttggcagaaaagaaaagaagttggagattcagaaaggctgtacatgttgcttttttgtttccttttttttttgggtttttctggttttcctgaactgggtgggttttgcaatggtgatgtttaggctaggctatgctaggtaggtactgtttttttgtgatcaagtgctttgtaatgtttttctatgcaatgcaatgtgatatagcttttagctt

SEQ ID NO: 1970 - DNA, 3122 bp, Panicum virgatum
aacttctccttctgattatgcctggaaaaacttgaactctttatcttaagttacaggcttagaaggagcacagaatatgtacgtagcatattgtccttgcgtccaacttaatctttaattttttagcaaaaaaataataagaatttagtctgttttctaaagctcgatctttaaactttataaatttaatttttgatcctctaccagttatacacaaatggatttttgttggtgactagatgacagttaacatgatcggtattcggtacacgttcagtaagaaaaacttcaggtttcgcaaaaaaaaaagtcagaaacgtttgaggacgtcatatatcaccatttcctcgaaagatgaggggcaaatatgaaaaagtgaaacccggacgccgcccaccccacagcggcgcccgccgcgagcccacgacggcaatctcccgttcacccgtccgcgttccggatcactctctcgactgccactggtccacttcgctcctccgcttcctccccgttccgccgccgagatatttcatacgaacccctcacttggccatgccgctgctcgccgtcgcctcctccacccgcgccgcggcggtgcggccgctgcgcgcctcggcggcctcgggcgaggcggtcccgtcgcccgctgcggctgcggcggagaccgcggcgcggaggcccgtgaaggtgatcctgccgaagaagaagccgcagaagtggtcgacggggatggagcccggggagtacggcggcgggccggccaccatcaagccgcgcaagtactggtgggggaaggaggaccgcgaccccgtcggcaacaccgacgacttcatctggaacaaggacttcctcccccacatggagcgcgtcatcgccaacggcggcgccagcgcggagcccaccatcacccgccttactccggtcgatgaggaggagtcgggatttctgagcatcaaccgtgcaatgagccttgacagtgtggaggttgacctgagcaaggagcttcaagcgccgaccaggccaatcctgcaaacccaggttgaggctgccaggagaggccgggcctttggtgctgaggctgtgaatggtgccacctctgctagatggaggctagtcccgactcgccgggagcaggcaaagtggaacagagctgccaaggctgctactggtggcagtgatgttatactaagggagtccaagtcaagagtgcagcaaggggaccctaaggtattggcagctaggtccagagaggaatacctaaagttaaaacaaagattgcagctgctcactttaggcgttggtggtgttggtgtagtctctgcttatgtttcatactctcctgaaattgctgccagctttggtgcagggttgattggatcattggtgtacctccgcatgcttggaaccagtgtagattccctagcaggtggaactggagagactgtcaagagtgctgctgcacaaccaagattgcttattccagtgttacttgtgatgatgtacaacagatggaatgagatattagttccggattatggcttcatgcacctggagttgataccgatgcttgttggattttttacctacaagattgctacgttcgctcaagcaattcaagattcgatacctacagttggaaatcgtgaggtctgaacagtgcctttgtgaacggaagatacatgtcgttaccctaatccctgagggaagattggtcagtggtcacccagatagtaaggttggtttaaaaggatctgatctggcgtcatcaccaagtagatgagatgctcattaaggatgccatctgaaaatctttagtggaatagtggttaacaacatattttatacaaatgttctactacgacccaaggtggtaaacaggtgatgtggccatattcactccatgctgttaatacgtagatcatcaatgttgtacagatttacaacttgggaactttaccacgatgacagcatttagcaggatgaacaaagtggtatacagttcatagaccacgaatgaatgtaagtaatgccggctgtcagttttcttgttttaaacaaagccacaccttgcaaatgcaataatcatcgagaaactcgttatgtttatggcaaatgttcatatactgtctgttaggcacgagctatgcactgtgtgttttacacttggacttgcaccagatcttgttgactggtactaaatgtaagcagtatatgcttaacgttgaagagaacaagtaaacggcaatagtcagtaacagtaaagctatcacctctacagctccaccaccactagccggaatggacatctgaaccgtggcagcttttccatcagagcaagtattatattataagtattatatttgattgtaagtcggctaaatgatgaggtggaggagagaagagatgagagagaagagaagcgggctgaagcttacagccagtttggacacaagaactaagaaaatctgtgagagagacaagtgggtcaaatattaattgtgaagagaggtgggctaaggccgtgtccaacgacactggtgaaattgccgactgactggagctattaaaacaataaaaaattgaaacaacatcccttccccgctcaagttttgcgttccgctctcacataccttgctataggttagcgacgagataagagccggtacatcaattttcacggttcctccctctttcagctcaccttaagccagcgatatcttgctttgttggaggaggcctaagagaaggctgcaaggatttttacagctatcaagctggttgtattattagccttactctcaaggtttggggctgaaaatggaaatataaggcttaccttttcttgggacaacacaattcacataattcgagactcgtttaggaaatcagaactacggcatttcccagagatgtcctgaaactccacacaagatcatttattccaaaagtgcccggtagtgataacaacagcttctacctaccccttccgattcccattcaagtttccagatctgcatcaacctgcctgccgctgaatgttgtcacagatttcacatgatccagcattcattgaatgtcacctgcacatactagtattaactgaactgcaccgcggagggtaa

SEQ ID NO: 1971 - DNA, 1889 bp, Panicum virgatum
ctggagccaaagacacgactagatgacagttaacctgatcggtacacgttcagtaagaaaagtttgaggacgtcatatatcatttccttgaaagatgaggggtaaatatgaaaatgtgaaaccaggacgcgaccccccaggcccccgccccacggcggcggccgccaggcgccagacgccacgagcccacgacggcaatctcccggtcacccgtccgcgttccggatcactctctcgactgccactggtccgcttcctcccctccccgctcttccccgcgttcccccgccgagatatttcccacgaacctcctctcctcctggccatgccgctgctcgccatcgcctcctccacccgcgccgcggcggtgcggccgctgcgcgcctcggcggcctcgggcgaggcggccccggcgcctgccgcgactgcggcggagaccgcggggcggaggcccgtgaaggtgatcctgccgaagaagaagccgcagaagtggtcgacggggatggagcccggggagtacggcggcgggccggccaccatcaagccgcgcaagtactggtgggggaaggaggaccgcgaccccgtgggcaacaccgacgacttcatctggaacaaggacttcctcccccacatggagcgcgtcatcgccaacggcggctccaacgcggagcccaccatcacccgccttactccggttgatgaggaggagtcaggatttctgagcatcaaccgtgcaatgagccttgacagtgtggaggttgacctgagcaaggagcttctagcgccgaccaggccaatcctgcaaacccaggttgaggctgccaggagaggccgggccattggcgctgaggctgtgaatggtgccacctctgctagatggaggctagtcccgactcgccgtgagcaggcaaagtgggaaagagctgccaaggcagcaactggtggcagtgatgttatactaagggagtccaagtcaagagtgcagcaaggggaccctaaggtattggcagctaggtccagagaggaatacctaaagttgaaacaaagattgcagctgctcactttaggcattggcggtgttggtgtagtctctgcttatgtttcatactctcctgaaattgctgccagctttggtgcaggcttgattggatcattggcatacctccgcatgcttggaaccagtgtagattccctagcaggtggaactggagagactgtcaagagtgctgctgcacaaccaagattgcttattccagtggtacttgtgatgatgtacaacagatggaatgagatattagttccggattatggcttcatgcacctggagttaataccgatgcttgttggattttttacctacaagattgctatgttcgctcaagcaattcaagattcgatacctgcagttggaaatcatgagatttgaacagtgcccttgaatggaagatacaggtcgttgccctaatccctgaggaaagattggtcagtggtcacctagtagatagtaaggttggtttaaaaggatctgatctggcgtcatcaccaagtagatgagatgctcattaaggatgccatctgaaaatctttagtggttaacatcatattttacaaaaatattctaccacgacccaaggtggtaaacaggtgatgtggccatatttattccatgctgttaatacgtagatgaatgttgtacagactcacaacttgggaacattaccagtttaccacgatgacagcatttagcagggcaaacaaagtggtatacagtttatagaccgcaaatgaatgtaagtaatgcagactgtcggtttacttgttttaaacaaagccacaccttaccttacaaatgcaataatcatcgagaaactcgttatgtttatgacaaa

SEQ ID NO: 1972 - DNA, 1491 bp, Echinochloa colona
cgcctcctccacccgcgccgcggcggtgcggccgccgcgcgcctcggcggcctcgggcgaagcggtcccggcgcccgccgcggaggccgcgggggcggggcggaggcccgtgaaggtgatcctgccgaagaagaagccgcagaagtggtcgacggggatggcgcccggggagtacggcggcgggccgtccaccatcaagccgcgcaagtactggtgggggaaggaggaccgcgaccccgtgggcaacaccgacgacttcatctggaacaaggacttcctcccctacatggagcgcgtcgtcgccaacggcggtgccgccgcggagcccaccatcacccaacttgctccggtggacgaggaggggtcggggtttctgagcatcaaccgtgcaatgagtcttgacagtgtggaggttgacctgagcaaggagcttcaagcgccaaccaggccaatcctgcaaacccaggttgaggctgcgaggagaggccgggccattggtgctgaagctgtgaatggtgccacctctcctaggtggaggctagtcccaacgcgccgggagcaggcaaagtgggacagagcagccaaggcagctaccggtggcagtgatgttatactaagggagtccaagtcaagagtgcagcaaggggaccctaaggtattggcagctaagtccagagaggactacctaaagttgaaggaaagattgcagctgctcactttaggcattggtggcgttggtgtagtctctgcttatgtttcatactctcctgaaattgctgccagctttggtgcagggttgattggatcattggtgtacctccgcatgcttggaactagtgtagattccctagcaggtggaactggagaaactgtcaagagcgctgctgcacaaccaagattgcttattccagtggtacttgtgatgatgtataacagatggaatgggatattagttccagattatgggttcatgcacctggagttgataccaatgcttgttggattttttacatacaagattgctacgttcgctcaagcaattcaagattcgatacctacagttggaaatcgtgaagtttgaacactgtcctggtgaatgaaaatataggtcattaccctaatccctcagggaagattggtcagtggtcacccagatagtatggtttagaagaatctgatctggcgccgtcaccaagtagatgagatgctcactgaggatgccatctgaaaacttttggtggttaacaacatatttcacacaaatattctactatgccgcaaggtggtaaaaaggtgatcttgccacattcattccatgttgttaacatagaacatcaatgtacaaattcacaacttggaaactttaccacaatgacattccaatcgtattgaatttatatttagcaggacaaacaaagtggtatagcataaataatgcaggctgaatataaataatacaggctgccagtatatacttttaaagaaagtcac

SEQ ID NO: 1973 - DNA, 1430 bp, Zea mays
tccggagaatttgagagccccctcctggtcatgtcgctgctcgccgtcgcctcctccacccgcgccgcggcagtgcggccgctgtgcgcctcggcggcctcggacgaggcggtgccggcgcctgctgtggcggataccgcagggcggaggccggtgaaggtgatcctaccaaagaagaaaccgcagaagtggtcgacggggatggcaccgggtgagtacggcggtgggccggccaccatcaagccgcgcaagtactggtgggggaaggaggaccgcgaccccgtggggaacaccgacgacttcatctggaacaaggacttcctcccccacatggaacgcgtcatcgccaacggcggcgccgatgcagaacccaccatcacccgccttgcgccggtggatgaggagggggagtccgggtttctgagcatcaaccgcgcaatgagccttgacagcgtggaggttgatctgagccaggagcttcaggcgccgaccaggccaatcttgcaaacccaggttgaggctgcctggagaggacgggcaattggtgctgaggctgtgaatggagccagcgctcctagatggaggctagtccctactcgcagggagcaggcaaagtgggacagagcggccaaggcagccactggtggaagtgatgttatactaagggagtcaaagtcaagagtgcagcaaggagaccctaaggtattggcagctcggtccagagaagactacttacagctgaaacaaagattacagtggttcactttaggcattggtggcgttggtgtaatctctgcttatatttcatacactcctgaaattgctgtcagctttggtgcagggttgattggatcattggtgtatctccgcatgcttggaaccagtatagattccctagcaggtggaactggagaaactgtcaagagtgctgctgcacaaccaaggttgcttattccagtggtacttgtgatgatgtataacagatggaatcagatattagttccggattatggtttcatgcagcttgagttaataccaatgcttgttgggttttttacctataagattgctacattcgctcaagcaatccaggattctatacctccagtcggaaatcgtgaaggttgaaaagtgtcatgttgtatataaacgaaggtggtagccatggtccctggtcagtggtcacccagatagtaaggtatgtatagaagaatctggtctggtgtcatcgccaagtagatgagatgctcgttgaggacgccatttgaaaatctcgagtgcttaactatgttctgcacaaatattttgacgaaaggtgatgttaccacattcattccatattacacgcagatcatcagtgtataaatttacggctccgaacttttaccacaacgattaattgacaaaacaattgtatgattgaattcaca

SEQ ID NO: 1974 - DNA, 1602 bp, Sorghum bicolor
ccggttcagccgtcccagttccggatcactctctcggctgccactggtccgcttcccctccgcgtctgcggcttcccctctccgctcttcccccgccgagatatttcccgagactctgagagcggagccacctcctcctggccatgtcgctgctcgccgtcgcctcctccacccgcgccgcggcagtgcggccgctgtgcgcctcggcggcctcgtcgggcgaggcagtgccggcgccggcgactgctgcgacgacggaggccgcagggcggaggccggtgaaggtgatcctgccgaagaagaagccgcagaaatggtcgacggggatggcgccgggcgagtacggcggcgggccggccaccatcaagccgcgcaagtactggtgggggaaggaggaccgcgaccccgtggggaacaccgacgacttcatctggaacaaggacttcctcccccacatggagcgcgtcatcgccaacggcggcgccgatgcagagcccaccatcacccgcctgtctccggtggatgaggaggagtccgggtttctgagcatcaaccgcgcaatgagccttgacagtgtggacgttgatctgagccaggagcttctggcgcccaccaggccaatcttgcaaacccaggttgaggccgcctggaaaggacgggcaattggcgctgaggctgtgaatggagccaacactcctagatggaggctagtcccaactcgcagggagcaggcaaagtgggacagagcggccaaggcagctactggtggaactgatgttatactaagggagtcaaagtcaagagtgcagcaaggggaccctaagttattggcagctcggtccagagaagactacttaaagctgaaacaaagattacagtggctcactttaggcatcggtggcgttggtgtaatctctgcttatatttcatactctcctgaagttgctgccagctttggtgcagggttgattggatcattggtgtatctccgcatgcttggaaccagtgtagattccctagcaggtggaactggagaaactgtcaagagtgctgctgcacaaccaaggttgcttattccggtggtacttgtgatgatgtataacagatggaatgggatattagttccggattatggtttcatgcaactgcagttaataccaatgcttgttgggttttttacctataagattgctacgttcgctcaagcaatccaggattctatacctgcagttggaaatcgtgaaggttgaaaagtgtccttgttgtatataaacaaaggtgatagccctgatccctggtcagtggtcacccagatagtaaggtctgtatagaagaatcttgatctggtgtcatcaccaagtagatgagatgctcgttgaggatgccatttgaaaatctttagtgcttaactataatgttttgcgcaaatgttctgacgaaaggtggtgcaaggtgatgttaccacgttcattccatattgcacgcagatcatcaatgtataaatttacggctccaaacttttaccacaatgattaattaacacaattgtatgattgaattcacatttagcactgaatgcaaattatgcaggctgcaagtaca

SEQ ID NO: 1975 - DNA, 2397 bp, Oryza sativa
caaatggcttcggatgaggatttcatgcccagtatgcaaatctgaggtgatctgacaggagtccatacaattggcaagtaattttttttttggaatagcatgacaaaccgtgtccatacggaccaccatcggaaatattttttggaatagcatgaatatctgtttaagccgtctcttttttttaccaatagaaagcgttgttacttgtaacctgttagctgttactgccggtgccgcagtgtgtaaatagcacggtagtgtgtgctgctttctgctctttcatggatctctatgaacatgagatatttgaaagctgtggagtattttacgctgcgagaagaaaagaaaggcatttcataatatcttgtgttccttgttgtatacgttggtatacccctctacagggaagacaagtggcaattatcgctttttattatttttagttccagagttccactgactcaattttacaaaaccgcctcaaatttaaactcaactatacaaaactgctccaatttaaactccaattcggcgcgattcggagctcagaacgcaaccgttcgcgtatataataaactgagacgcagctcgcgacgccacgaggtgtgtctctctcccgttcacccgtccgtatccttcccggatcactctctccactctccgctccccaccgcgcgagagatattttcgcgcgccatgtcgctgcccgccctcgccgccggccgcgccgcctccgtgcggccgccgcgcgcctcggcggcctcgggggaggcggctgctgctgcggcggcggatcagccggcggggcggaggccggtgaaggtgatactgccgaagaagaagccgcagaagtggtcgacggggatggcgcccggggagtacggcggcgggccggcgacgcccaagccgcgcaagtactggatggggaaggaggaccgcgaccccgtgggcaacaccgacgacttcatctggaacaaggacttcctcccacacatggagcgcgtcatcgccaacggcggcgcagacacgccccccaccatcacccgcctcaccccggtggatgaggacacggaatcagggttcctaagcatcaaccgcgcaatgagcctcgacagtgtggatgttgatctgagcaaggagcttcaggcgccaaccaggccaatcttgaaaacccaggttgaggctgcctggagggggcgggccattggagctgaggctgtcaacggtgttgcgtctcctagatggaggctagttccgactcgccgggaacaagcaaagtgggaccgagcagctaaggcagcaactggtggcagtgatgtcatactaagggaatcaaagtcaagagtgcagcaaggagaccctgaggtattggcagctaaatcaagggagcaatatctagagttgaaacaaagattgcagttgtttactttaggcattggtggcattggtttggtctccgcctatttttcctactctcctgagattgctgcaagctttggtgcagggctgattggatctgtcctgtatctccgcatgcttgggaccagtgtggattccttagctggtggaactggagaaactgtgaagagtgctgctgcccaaccaagactgcttattccagtggcacttgtgatgatgtataaccgatggaatgagattttagttccagattatggcttcatgcacctggaattgatacccatgcttgttgggtttttcacctacaagattgcaacatttgctcaggcaattcaagaatctatacctgcagttgggaatcgtgaatcttgaacatagttctggtgaatagaattaaaggtagttgccctgaggaagataggtcacggagatactgaggccaaggttttataagaatctgatctggggatattaccaagataagatgcacactcagtcattgaggagcgagaattctccatgacatctgttacactctcatttgttcaaaaagatgattggcaagaggtcaagtacacacacctaccccgtacattccatttattgcacgcctacggactacagcaactctcagcattgtcacaggtaccacatgaacacatgatctattgaatgacttatggagtaattaactgtgaatggtgcagagccaaaacatgggcaaccaaaagaactcaagaagacgaagatttcaataaatcacggctcaatctgccactctgattcatcatctcattgcctcgaggcctgctgctgctgctagtagtagtagtacattcatttgaactgcctaccaattttgaaagcacccaaatttccaaatttccttttcttatctctttcgttgctggcctcatccatttggccaccaaaagaatcctaaaatggtatctccaaaaaagaaaaacagaaacctac

SEQ ID NO: 1976 - DNA, 1558 bp, Brachypodium distachyon
attccccacagagatatttcgcggccgccatgtcgctgctcgccgtcgtacccagccgcgccgcggccgtgcgacccccgcgtgcctccgcggcctcgggagaggcggcggcagtgccggacctgccggcggcgcggaggccagtgaagattatactgcccaagaagaagccgcagaagtggtcgacggggatggagccgggggagtacggcggcgggccgacgacggtgaagccgcgcaagtactggatggggaaggaagaccgcgaccccgtgggcaacaccgacgacttcatctggaacaagaacttcctcccccacatggagcgcgtcatcgccaacggcggcaccgacacgccccccaccatcccccgcctcacgccggtggacgaggacgccaactcagggttcctaagcatcaaccgcgcaatgagccttgacagtgtggaggttgatctgagcaaggagcttctggcgccgaccgagtcaatcttgaagacccaggtcaatgctgcccggcgtggtagatcgattagagctgaggctgtcaatagatccaccttcattagatggaagctagccccgactcgacgagagcaggagcaatgggaccgagcgaccagggcaaccaccggtggcattgatgttatactaaaggaatcaaagtcgaaagtgcagcaacaaggggaccccaaagttttggcagctgaggccagagaacaatatctaaagttgaaagaaagattgcagctccttactttaggtattggtggcattggtgttgtttctgcttatgtttcatactctcctgaaattgctgtgagctttggtgcggggctgattggatcgttggtgtatctccgcatgcttggaaccagtgtggattctctagctggtggaacaaaagcaactgccaagggtgctgtggcgcagccaagattgcttattccaatggttctagtgatgatgtataatcgatggaatgcgatattagttccagattatggcttcatgcacctagaattgatacccatgcttgttgggttttttacctacaagattgctatgtttactcaagcaattcaggaatccatacctgatgttggaaagcgtgaagtttgaatgctgttctggtgaatagaaaaaataaatagaagattgttgccctgagagaagatcggttaccatttaccaatatagtaaggtccgtttttgaagtatctaatgtgatgatggcgccaagcacataaggtgcccattaaggagactgtctgaaaatcttgactggttaacattattccactgaatgtttactatgactgcacaacaggaagttggtaaatatgcatgctattgaattcatcttagaaacaaacttaaatcatgaatagttttgtaaagtgcgcatctgaaaacggttaggtcattggccaccgaactttatggttgaattctataaggaggtcaggactttggatcaaaactgaatgtttgtaaataatgcaggttgtcagtatagtcatttcaaaagaaattcattgctcgtgaagctctaggcg

SEQ ID NO: 1977 - DNA, 1578 bp, Brachypodium distachyon
ggcctctccctcctctttgcattccccacagagatatttcgcggccgccatgtcgctgctcgccgtcgtacccagccgcgccgcggccgtgcgacccccgcgtgcctccgcggcctcgggagaggcggcggcagtgccggacctgccggcggcgcggaggccagtgaagattatactgcccaagaagaagccgcagaagtggtcgacggggatggagccgggggagtacggcggcgggccgacgacggtgaagccgcgcaagtactggatggggaaggaagaccgcgaccccgtgggcaacaccgacgacttcatctggaacaagaacttcctcccccacatggagcgcgtcatcgccaacggcggcaccgacacgccccccaccatcccccgcctcacgccggtggacgaggacgccaactcagggttcctaagcatcaaccgcgcaatgagccttgacagtgtggaggttgatctgagcaaggagcttctggcgccgaccgagtcaatcttgaagacccaggtcaatgctgcccggcgtggtagatcgattagagctgaggctgtcaatagatccaccttcattagatggaagctagccccgactcgacgagagcaggagcaatgggaccgagcgaccagggcaaccaccggtggcattgatgttatactaaaggaatcaaagtcgaaagtgcagcaacaaggggaccccaaagttttggcagctgaggccagagaacaatatctaaagttgaaagaaagattgcagctccttactttaggtattggtggcattggtgttgtttctgcttatgtttcatactctcctgaaattgctgtgagctttggtgcggggctgattggatcgttggtgtatctccgcatgcttggaaccagtgtggattctctagctggtggaacaaaagcaactgccaagggtgctgtggcgcagccaagattgcttattccaatggttctagtgatgatgtataatcgatggaatgcgatattagttccagattatggcttcatgcacctagaattgatacccatgcttgttgggttttttacctacaagattgctatgtttactcaagcaattcaggaatccatacctgatgttggaaagcgtgaagtttgaatgctgttctggtgaatagaaaaaataaatagaagattgttgccctgagagaagatcggttaccatttaccaatatagtaaggtccgtttttgaagtatctaatgtgatgatggcgccaagcacataaggtgcccattaaggagactgtctgaaaatcttgactggttaacattattccactgaatgtttactatgactgcacaacaggaagttggtaaatatgcatgctattgaattcatcttagaaacaaacttaaatcatgaatagttttgtaaagtgcgcatctgaaaacggttaggtcattggccaccgaactttatggttgaattctataaggaggtcaggactttggatcaaaactgaatgtttgtaaataatgcaggttgtcagtatagtcatttcaaaagaaattcattgctcgtgaagctctaggcg

SEQ ID NO: 1978 - DNA, 1424 bp, Pennisetum glaucum
ccgttggcgatgacgcgctccatgtaggggaggaagtccttgttccagaagtggtcgacggggatggagcccggggagtacggcggcgggccggctaccatcaagccgcgcaagtactggtgggggaaggaggaccgcgaccccgtgggcaacaccgacgacttcatctggaacaaggacttcctcccctacatggagcgcgtcatcgccaacggcggcgccgccgcggaacccactatcacccgccgtgccccggtggacgaggaggggtcaggatttctgagcattaaccgtgccatgaaccttgacagtgtggagattgatctgagcaaggagcttcaagcgccgaccaggccaatcctgcaaacccaggttgaggctgccaggagaggccgggccatcggtgctgaggctgtgaatggtgccacctctgcaagatggaggctagtcccgactcgccgggagcaggctaagtgggacagagcagccaaggcagctaccggtggcagcgatgtcatactaagggagtccaagtcaagagtgaagcaaggggaccctaaggaatcggcagctagggccagagaggactacataaagttgaaacaaagattgcagctgctcactttaggcattggtggcattggtgtagtctctgcttatgtttcatactctcctgaaattgctgttagctttggtgcaggattgattggatcattggtgtacctccgcatgcttgggacaagtgtagattccctagctggtggaactggagaaactgtcaggagtgccgctgcacaaccaagattgcttattccagtggtacttgtgatgatgtataacagatggaatgagatactagttccagactatggcttcatgcacctggagttgataccaatgcttgttggattttttacctacaagattgctacgttcgctcaagcaattcaagattcgatacctccagttggaaatcgtgaagtttgaacagtgtcccagtgaataggaaataaaggttgttaccctaaaccctgagggaagattgaccagtggtcaacatgatagtaaggttggtttagaagaatctgatctggcgtctataccaagtagatgagatgctcattgaggatgccatctgaaaatctttagtggttaatgcaaatattctactatgacggaaggtggtgttgccacattcgttccatgttgttaacacgtagatcatcaatatacaaaatttacaacttggaaatttatcacaatgacaacatttagggcaaacaaattaagtggtatacagtacagaccacaactgaatgtaaataatgcagtatgtcagtatacttgtttgaataaaattgggccttacaaatgctaaaaccagtgaggaattcgtgatgatggcaagtgtttattatactgtc

SEQ ID NO: 1979 - DNA, 3643 bp, Panicum virgatum
atccgatccatcacccgtcccatccagtcgcctcctccccctcgtgatcccgacgacgacgacgacgacgacgacaacgaaacagctcagtttcgtgcttttctccagcaccgcagccccccaccccacgccccacctccggagtcacaaggctgggaggtaccagtagaaacgtgaagtgaaacggggggaggagtggaggagaaggcccggccagcagcgagcacgcggggcgcaccacaggcgcgcgccggcaccggccaccttcctggtcacccaacccatcatctataggaaggggggataggggagtagcagtaggcagtgtagcactgcggctcctaccactcccaccacgcctccaacccccgtcctataccataccaatccgccgcaggtctctatccagcccacttgcccctctcccccgccactgccgcgagctctcgcgtcgtctctccctttccctcaggcgtggcagatctgttccgtgatcccccaacttggatcttgatgatttggcgactatgaggcgtcgattcctccgggcgagctggtcataggggagtgtggtttcctggtcctctcaattcaacctctggagtttggatgttgaattgaatcaagtgatacccgaaacttctccttcatatggtcagccatcataaagatgccaacaaaaggacagtttagcagtgaaaggaatgtgaagaacatatcaggtcgtgatggacaaaagaagggaaattcactgcatgaccaaattgcatccctgccaaaggacagggttggggcggtcaatgggaatgtagatggaaaatttgaggatagaatccgagttgcgaagaatgataagttccgaaggcaacgcgaatctttgagtggggaaagggctgcatgcatgaagggctcaaaaccatggcctggtcgaaagacaaatactgttgatgaacttgtcaagcatatgtcaaatgttccttcatatttacagcataaagagactgctgaccatcgtcaagacaaagcactgaatgttggagttcttgagtggggccttcttgccaactggtctcagcaacaaaagcatgatcttactagaagccacggagcctctccatccagtactagcaggtctgtactattctcatctccatcacattcgtctgccagtcccagcagcagatcacttgagagtaatcagtctaccccagtgagtgacaatcaccattcatccatcagaggtcagcagagtaggctggcagataaacaccatgggactgccagatattcacctagcccaaattctgccgtattgagcttgttgccagcgcacagcaaacatccctgcccagagaccaccagtaattatgttggctcaggtctcagcaatgtttctttaccctctgactctctaggttcttcctccagaagttgcggaagacctgaaatggacgaagatgaagagagtaggaggattgaagacattgtgcatcactgttctcgtagactttttacagacagcgatagtattgggaagaatttgttcgcctcaaataacaataattccttgtgcaatgatcctgaacagagcagcgtcttgaatggtcaaagttttgaaccactaatatcttatgctgtgatggacactcctagaaatggcagtaggttacctgatgttttcttggaggatattgagccatcccatgaatttcctcaaattccatactcatgtccacttcccatcatagattcagcagctaaagagattcacaccacaagcactgaagcaagaaataattttgttggtacagctgcaaaagtaagtaagaacagtaaccgaaaccgatctgtgatgagtggcattgagaatcctccccaatgctctgcaaagtttagtgataggatgcctgatcgccatctaggtgctcggatgaatcgagtgagccgcagctccagcctgaaggagacacaatgtgctcgacagcccgatgtagggccctctgtcgatacgataggagacagatcatcatccaatggcaaaggtaggcgaagcccattgaggaggatgttagatccaatattaaagccaagacattctagtccagtacgaccttcatttgttccgaagtgtcatcttccagtcaataccactaagcagtctctggacatgggcggatcagtgccacagaatgtgcagaggtcagttgatatgatagtcaattcgaattatcctacagaagcatgtataaaccagcctcctcatgtgctgttgaacagtgcaagatacctccagcaagaaaaggattcaccaacgacaaggcaggcgcttctgcaactagcatggaagaatggcttgcctttattcatgatgtcgtatggggagtctgatatccttgcagccactgttagaaagaagggcatctccgagaaggatgacctggaaagcacatatgctgtattcactgttgaagaacctaagaaaaaaagtggaacgtggatcaaggcagggggtaagaacaagaaacatcacctgttatccagcatagttggagaattaaaggttgcacataaaaaatcaagatgccaccacacaaaaaatgttcatgtacacagggagtttgttttgattggttctgaatttctaccgtcatctgaagaatcaggtgatttgcacatcagcggagagcttgcagcttttatcagtgcactgcctcagcaagaagcggaaacttcaaatcagtcatcttcacagaatatgggacaaagtgatttggcgccgagtggctgcggttgccccccactgggaaacttccagcctagtacaaggaatgctaattccggtccagccaatgttattgccgttctacctgatggtttccatggcacatcaacatctgggcagccactgcctttgatcgagaggtggaaatcaggaggttcttgtgactgtggcggatgggatgaaggttgcatgctgagtgtcctcacgggtaccctgggaaatggtgctgttcaagctaaccaggccatggatggcagccagcgatttgagcttgtagctcagggtcgattgcgagaagataggaatgccttcagtatgacttccttcaaagagggtctatatacagtggaattcagatcatccattgctttacttcaagcttttgcgatgtgtatagtgatgcttcatgggaggtggtaccctaacaagatgcaagttgcttcgcaagcagtgcaagagcatgatctccttgccaatcatgagctcaagaccatggcagccagtcaaggtagagctccgaccagctatgtgccccatcggccacctctttctccagtaggccgagcctagcttatcgcgattaactgtatgttctttgtgtcctctcttcagttgtgtagtgcctatgggatcaatataccatggtcctctggtccatatacccaaagtgacaatctctgtgcaatcggccttagaagttagaagtagctacttgtacatgttgatgctgtatgactgctatgatgcggctgcaaggcccatctcagtgcttagctaccgtttatatgttctcttgtcagttgcttatatgctgaaaggatacacacctgctacctgttgatactagtttttgatgtgtct

SEQ ID NO: 1980 - DNA, 3344 bp, Panicum virgatum
taggcactaggcagtgtagcactgcggctcctacttcccaccacacgcctccaacccccgtccgataccataccaatccgccgcaggtctctttccagcccacttgcccttcctctccccgccaccgcggcgagctctcgtcgtctctccctttccctcaggagtggcagatctgttccgtgatccccaacttggatcttgatgatttggcgactatgaggcgccgattccttcgggcgagctgttcataggggagtgtggtttcctggtcctctcaattcaacctctggatgttgaattgaatcaagtgataactgtgttttgttcattcacaaagatacccgaaacttcttcatatggtcagccatcataaagatgccaacaaaaggacagtttagcagcgaaaggaatgtgaagaacatatcaggtcgtgatggacaaaagaagggaaattcactgcctgaccaaattgcacccctgccaaaggacagggttgcggcggtcaatgggaatggagatagaaaatttgtggatagaattcgagttgcgaagaatgacaagttccgtaggcaacgcgaatctttgagtggggaaaggtctgcatgtatgaagggctcaaaaccatggcctggtcgaaagacaactactgttgatgaacttgtcaagcacatgtcaaatgttccttcatatttacagcataaagagactgctgaccatcgtcaagacaaggcactgaatgttggagttcttgagtggggccttcttgccaactggtctcagcaacaaaagcatgatcttgctagaagccacggaacctctccatccaatactagcaggtctgtactattctcatctccatcacattcttctgccagccccagcagcagatcgcttgagagtaatcagtctaccccagtgaatgaccatcaccattcatccatcagaggtcagcagagtaggctggcagataaacaccatgggactgccagatattcacctagcccaaattctgccgtattgagcttgttgccagcacatggcaaacatccctgcccagagaccagcagtaattatgttggctcaggtctcagcaatgtttctttaccctctgattctctaggttcttcctccagaagttgcggaagacctgaaatggacgaagatgaagagagtaggaggattgaagacattgtgcatcactgttctcgtagactttttacagacagtgatagtattgggaagagtttgttcacctcaaataacaatgattccgatcctgaacagagcagtgtcttgaatggtcaaaattttgaaccacaaatacctgatgctgcgatggacacacctagaaatggcagtaggttacctgatgttttcttggaggatattgagccatcccatgaatttcctcgaattccacactcatgtccacttcccatcatagattcagcagctaaagagattcacaccacaagcactgaagctagaaataattttgttggtacagctgcaaaagtaagtaaaaacagtaaccaaaaccgatccgcgatgagtggcattgagaatcctccccaatgttctgcaaagtttagtgataggatgcctgatcgctatctaggtgctgggacgaatagagtgaaccgcagctccagcctgaaggagacaccatgtgatcgacagcctgatgtagggccctctggcgataagataggagacaggtcatcatccaacagcaaaggtaggcgaagcccattgaggaggatgttagatccaatattaaagccaagacattctagtccagtacgaccttcatttgttccgaagtgtcatcttccagtcaatacccctaagcagtctctggacatgggcggatcagtgccacagaatgtgcagcgaaggtcagttgatatggtagtcaattcgaattatcctactgaagcatgtataaaccagcctcctcatgtgctgttgaacagtgcaagatacctccagcaagaaaaggattcaccaacgacaaggcaggcgcttctgcagctagcatggaagaatggcttgcctttatttatgatgtcatatggtgagtctggtatccttgcagccactgttagaaagaagggcatctccgagaaggatgacctggaaagcacgtatgctgtattcactgttgaagaacctaagaaaaaaagtggaacgtggatcaaggcagggggtaagaacaagaaacatcacctattatccagcatagttggagaactaaaggtttcacatagaaaatcaagatgccaccacacaaaaaatgctcatgtacacagggagtttgtattggttggttctgaatatctaccatcatctgaagaatcaggtgattcacacatcagcggagagcttgcagcttttatcagcgcactgcctcagcaagaagcggaaacttcaaatcaatcatcttcacagaatatgggacaaagtgatttggcgccgagtggctgcggttgccccccactgggaaacttccagcctagtacaaggaatgctaattccggttcagccaatgttattgccgtactacctgatggtttccatggcacatcaacatctgggcagccactgcctttgatcgagaggtggaaatcaggtggtgcttgtgactgtggcggatgggatgaaggttgcacgctgagtgtcctcgcaggtatggccccaggaaacggtgccgttcaagctaaccaggcaatggatggcagtcagcgatttgagcttgtagctcagggtcgattgcgagaagataggaatgcattcagtatgacttccttcaaagagggtctatatacagtggaattcagatcatccattgctttacttcaagcttttgcgatgtgtatagtgatgcttcatgggaggtggtaccctaacaagatgcaagttgcttcacaagcagtgcaagagcgtgatctccttgccaatcatgagctcaagaccatggcagccattcaaagtagagctccgaccagctatgtgccccatcggccacctctttctccagtaggccgagcctagcttatcgcgattaaatgtatgttctttgtgtcatctctttagttgtgtagtagtgcctatgggatcaatataccatggtcctctggtccatatacccaaagtgacaatctctgtgcaatcggccttagaagttacctgtacatgttgatgttgtatgactgctatgatgtggctgcaaggcccatctcagtgtttagttaccgtttatatgttctcttgtcagttgcctctatgctgaaaggatacacacctgctgcctgttgatactagtttttgaagtgtctgttgca

SEQ ID NO: 1981 - DNA, 3856 bp, Sorghum bicolor
agccacccgcctgctctgcccgtccgcccccgcgcttttctttttaccgctgaggcagtgaagcacctcctccctctccccgttcccaccacttcaagatccgatccatcgtcctgtccgtcccatccaatcgccccctcctcctcgtgatcccgacgccgacgacgacaacgaaacagctcagtttcgtgcttttctccagtaccccgcagcccccccacaccacacctccgaatcacaagggtggcaccgtggtccgtggcagtagtacaagtagaaacgtcgagtgaaaccgggggaggggtcgagggaagaagcaggtcagcagcgagcacgcggggcgcaccacgagcgcgccgcgcgccggcaccggccacctacctggtcgcccaacctattgcctataggaggggagggggatagggagtagcagtagccagtaggcagtgtagcactccggctcctactaccaccgcacctccaacccccgtcctataccaatccgccgcaggtctctatctagtccgcttgccccctatctcacccgtcactgcagggagctctcgcttcgtctctccctttccctcaggagtggcagatctgttggtgtgatccccagcttggatcttgatgatttggtgacttgagtggcctattttcttcgaacaaactggtgttcaggaagtacggttttctcaatctctatttgaaccacagcatgcctaactgaatcaagtgataattgtgttttggccatacacagagatatacctgaaacttctgcttcatatgttcacccatcataaagatgccaacaaaagggcaggttagcagtgaaaggagtgtgaagatcatatcaggtcgtgatgggcaaaagaagggaaattcacagcatgaccaaattgtacacgtgccaaaggacatggtcacagcagtcaatggaaatgtggatgggaaatttgaagataaagttagagttgtgaagaatgataagttccgaagacagcgagagtcttggggtggggaaagggctgcatgcatgaagggctcaaaaccatggcctggtcgaaaggcaactactgttgatgaacttgtcaaacatatgtcaaatgttccttcatatttacagcgtaaagaaacttccgaccatcttcaagacaaggccctgaatgttggagttcttgagtggggtcttcttgctaactggtctcagcaacaaaagcttgagctcgctagaagccatggagcatctccatccaatactagccggtctgtactattctcatctccatcacattcttctgctagccctagcagcagatcccttgagagtaatcaatctaccccaatgagtgaccatcatcattcatccatcagagcccagcagagcaggctcgcagataaacaccatgggaaggccagatgttcgcctagcccgaattctgcggtattgagcttattgccaggtcatggcacacatccctgtccagagaacggtcgtaattatgttgacttgggtctcagcaatgtttctttagcctcagactctctaggttcttcctctagaagttgcggaagacatgaaatggttgaagatgaagagactagatggaagattgaagatgttgtccatcattgttctcgtaggctttttacagacagcgataacattgggaaacatttcttcacatcaaataacaatgattccatgtgtaatgatcctgaacagagcagtggcttgaatggtgaaaattttgagtcactaatatctgatgatttgatggacacagctagaagtggcagtaggtcacctgattgtttcttggaggatattgagccatcccgtgaatttcctcgaatcccatattcatgtccacttcccatcatagattcagcagctaaagagattggcaccactagcattgaggctggagataattttgttggtacagctgcaaaagtaaataagaattctaaccgaaaccaatctgccatgaatgtcactgagaatcatccccaatattctgcaaagtttagtgataggatgcctgatcgccacataggttctgggatgaatcgagtgagccgcagctctagcctcaaggagtcaccacatcgacaacccaatatagttcctcctgttgataagacaggagacaggtcatcacccaacagcaaaggtaggcgaagcccattgaggaggatgttagatccaatattaaagccaagacattctagtccagtgcgcccttcatttgttccgaagtgtcatcttccagtcaatactaccaagcagtctctggacttggggggatcagtgccacagaatgtgcagcgaaggtcagttgatttggttgtcaattcgaattatccgattgaagcaaatataaatcagcctcctcgtgtgctactgaacagtgcaagatacacccagaaagacaaggattcagcaacaacaaggcaagcacttctgcagctagcatggaagaatggcttgcctttattcatgctgtcttatggtgattcggatatcctggcagccactgttagaaggaagggcatctctgaaaaggatgatctggaaagcacatatgctgtattcactgttgaagaacctaagaaaaaaagtggagcttggatcaaggcagggggcaagaacaagaaacataaccttttatctagcatagttggggaaataaaggttgcatgtcgaaaatcaagatgccaccatacagcagatgttcatgtacacagggaatttgtgttagttggttccgaatttctaccatcatctgaagaatcaggtgattcacatgttagtggagagcttgcagcttttataactgcacttcctcagcaagaagcagaaacttcgaatcaatcatcttcacagaataccagacaaagaaattcagcaccaactggctgtggttgccccccactgggaaacttccagcctagtacgagaaatgctaattctgcttcagccaatgttattgcagtacttcctgatggcttccatggtacatcaacaactgggcagccattgcctttgattgagaggtggaagtcaggaggagcttgtgactgtggtggatgggatgaaggttgcacgctgagtatactcactgatgcggcccaagaaaatgatgccattcaggctaacctggcaaaggatggcagccagcgatttgagcttctagttcagggtcgatcgcgagaagataggcatgccttcagtatgacttccttcaaagaggggctttatacagtcgaattcagatcatccattgcgttacttcaagcttttgcaatgtgtatagtgatgctccatgggaggtaccctagcaggatgcaagttggttcgcaagcagcgcaggagcatgatctccttgctggtcatgagctcaaggccatggcagccagtcaaggaagagctccgaccagctatgtgccacaccggccacctctttctcctgtaggccgagcctagcttattgcgattaaatgtatgttctttctgtgtctgtcctctttcttcagttgtgtagtgccggtgggatcgatataccatggtcctcaggtccatatgcaatacgcatatccaaaatgacaatctctgtgcaagagtctttagaggtagctacctgtacatgttgtaatgtggatgttgtatgactgtactatgatgtggctgcaaggcccatctcactgcttagttaccctttatatgttctcctatcagttgcttctgtatatgctgaaaatctgaaatgcacctgcaatctgttgcaacccttgtttaaagtgtctgttgcattgcatcaacagcagcatttgtgcatctgctgaactt

SEQ ID NO: 1982 - DNA, 3801 bp, Zea mays
gcccccgcgcttttctttttaccgccgaggcagtgaggcccctcctccctctcgccgttcccaccacttcaagatccgatccatcgtccgtcccatccaatcgccccctctccctcgtgatcccgacgccgacgacgacaacgaaacagctcagtttcgtgtttttctcccgtaccccgcagccccccacacggccacgccccacctccgaatcacaagggtggcaccgtggcagtacaagtagaaacgtcgagtgaaactgaaaccgggggaggggtcgtgggaagaagcaaggccagcagcgagcacgcgggccgcaccacaagcgcgccgcgcgccggcaccggcaccggccacctacctggtcgcccaacctattgcctataggctataggagtaggcgggagggggacgatatggagtagcagtagccagtaggcagtgtagtactgcggcttctactaccactgcacctccaacccccgtccgatacctatccaccacaggtctctatccagtccacttgcccttcttctcatccgtcactgcagcgagctctcgcttcgtttccccctttccctcaggactggcagatctgttggtgtgatccccagcttggatcttgttgattcggtgatttgagtagccgattttcttcgagcaaactggtttttaggaagtgtggttttctcagtctctgtttgaaccacaacataccaaactgaatcaagtgataattgtgttctgaccatacgccaagttatacctgaaacttctgcttcatatgttcacccatcataaagatgccaacaaaagttcaggttagcagcgaaaggaatgtgaagatcatatcaggtcgagatgggcaaaagaagggaaattcacagcatgaccaaattgtacgcgtgccaaaggacatggtcacaccagtcaatggaaatgtagatggaaaatttgaagataaagttagagttgtgaagaatgataagttccgaagacaacgagagtcttggggtggggaaagggctgcatgcatgaagggctcaaaaccatggcctggtcgaaaggcaactactgttgatgaacttgtcaaacatatgtcaaatgttccttcatatttacagcgtaaagaaacttctgagcatcttcaagacaaggcgctgaatgttggagttcttgagtggggtcttcttgctaactggtctcagcaacaaaagcatgagctcgctagaagccatggagcatctccatccaatactagcaggtctgtactattctcatctccatcacattcttctgcaagccccagcagcagatctcttgagagcaatcaatctaccccaattagtgactatcatcattcatccatccgagcccagcagagtaggctcgcagataaacaccatgggaaggccagatgttcgcctagcccaaattctgcggtactgagcttattgccaggtcatggcacacatccctgtcaagagaatggttgtaattatgttgacttggatctcaacaatgtttctttagcctcagactctctaggttcttcctctcgaagttgcagtagacatgaaatagttgaagatgaagagactagatggaagattgaagatgttgtccatcattgttctcgtaggctttttacagacagtgataacattgggaaacatttcttcacatcaaataacaaagattccatgtgtaatgatcctgaacagagcagtggcttggattgtgaaaattttgagtcactaatatctgatgctgtgatggatacagctagaaatggcagtaggtcacctgattgtttcttggaggatattgagacatcccgtgaatttcctcgaatcccatattcatgtccacttcccatcatagattcagcagctaaagagattggcaccactagtactgaggctggagataattttattggtacagctgcaaaagtaagtaagaattctagcctaaaccaatctgccctgaatgccactgagaatcctccccgatattctgcaaagtttagtgataggatgcctgatcgccatcaaggttctgtgatgaatcgagtgagccgcagctctagcctcaaggagtcaccacatgctcgacaacccaatgtagttcctcctgttgataagacaggagatcggtcatcacccaacagcaaaggtaggcgaagcccattgaggaggatgttagatccaatattaaagccaagacattctagtccaatacgaccttcatttgttccaaaatgtcatcttccagtcaataccaccaagcaatctctggacttagggggatcagtgccacagaatatgcagcgaaggtcagttgatttggtagtcaattcgaattatcgaattgaagcaaatacaaatcagccacctcgtgtgctattgaacagtgcaagatacatccagaaagaaaaggattcaacaacaacaagacaagcatttctgcagctagcatggaagaatggcttgcctttattcatgctgtcttatggcgattctgatatcctggcagccactgttagaaggaagggcatctctgaaaaggatgatctggaaagcacatatgctgtattcactgttgaagaacctaagaaaaaaagtggagcttggatcaaggcagggggcaagaacaagaaacaccaccttttgtctagcatagttggggaaataaaggttgcacgtcgaaaatcaagatgtcaccatacagcagatgttcatgtatacagggaatttgtgttgcttggttccggatttctaccatcatctgaagaatcgggtgattcacatgttagtggagagtttgcggcttttattagtgcacttcctcagcaagaagcagaaacttcgaatcaatcatcttcacagaataccagacaaaaaaatttagcactaactggctgtggttgccccccactgggaaacttccagcctagttctgcttcagccaatgttattgcagtacttcctgatggcttccatggcaaatcaacgtctgggcagccgttgcctttgattgagaggtggaagtcaggaggagcttgtgactgtggcggatgggatgaaggttgcatgctgagtgtcctcactgatgcggccgaagaaaatgatgccgttcaggctaaccaggcaaaggatggcagccagcgatttgaacttctagctcagggtggatcacgagaagataggcatgccttcagtatgacttcattcaaagaggggctttatacagtggaattcagatcatccattgcattacttcaagcttttgcaatgtgtatagtgatgctacatgggaggtaccctgacaggctgcaagttggttcgcaagcagcgcaggagcatgacctccttgctggtcatgaggtcaaggccatggtagccagtcaaggaagagctccgaccagctatgtgccccaccgtccacctctttctcctgtgggccgagcctagcttatcgcgattaaatgtatgttctttctgtgtctgtgtcctctttctccttcagtcgcgtagtgctggtgggattgatataccatggtcctcaggcccatatgcaatacgcatattgaaagtgacaatctcagaacaatcaatcggctttagaggtagctacctgtacatgttgtgatgttgatgttgtatgactgtactatgatgcggctgcaaggcccatctcggtgattactcacccgttatatgttctcttatcagttgcttctgtatatgttgaaatatgtgattactgattagtcacccgttatgtgttctcttctca

SEQ ID NO: 1983 - DNA, 2794 bp, Saccharum officinarum
gaaaatttgaagataaagttagagttgtgaagaatgataagttccgaagacagcgagagtcttggggtggggaaagggctgcatgcatgaaaggctcaaaaccatggcctggtcgaaaggcaactactgttgatgaacttgtcaaacatatgtcaaatgttccttcatatttacagcgtaaagaaacttctgaccatcttcaagacaaggcgctcaatgttggagttcttgagtggggtcttcttgctaactggtctcagcaacaaaagcttgagctcgctagaagccatggagcatcgccatccaatactagcaggtctgtactattctcatctccatcacattcttctgcaagccccagcagcagatccattgagagtactcaatctaccccaatgagcgaccatcatcattcatccatcagagcccagcagagtaggctcgcagatacaccatgggaaggccagatgttcgcctagcccaaattctgcggtattgagcttattgccaggtcatggcacacatccctgtccagagaacggtcgtaattatgtggacttgggtctcaacaatgtttctttagccccagactctctagattcttcctctagaagttgcggaagacatgaaatggctgaagatgaagagactagatggaagattgaagatgttgtccatcattgttctcgtaggctttttacagacagcgataacattgggaaacatttcttcacatcaaataacaatgattccatgtgtaatgatcctgaacaaagcagtggcttgaatggtgaaaattttgagtcactaatatctgatgctttgatggacacagctagaagtggcagtaggtcacctgattgtttcttggaggatattgagccatcccttgaatttcctcgaatcccatattcatgtccacttcccatcatagattcagcagctaaagagattggcaccactagcactgaggctggagataattttgttggtacagctgcaaaagtaaataagaattctaaccgaaaccaatctgccatgaatgtcactgagaatcctccccgatattctgcaaagtttagtgataggatgcctgatcgccatataggttctgggatgaatcgagtgagccgcagctctagcctcaaggagtcaccacatgcccgacaacccaatgtagttcctcctgtcgataagacaggagacaggtcatcacccaacagcaaaggtaggcgaagcccattgaggaggatgttagatccaatattaaagccaagacattctagtccagtgcgcccttcatttgttccgaagtgtcatcttccggtcaataccaccaaacagtctctggacttggggggatcagtgccacagaatgtgcagcgaaggtcagttgatttggtaataaattcgaattatccgatcgaagcaaatataaatcagcctcctcgtgtgctattgaacagtgcaagatacatccagaaagacaaggattcagcaacaacaaggcaagcacttctgcagctagcatggaagaatggcttgcctttattcatgctgtcttatggtgattcggatatcctggcagccactgttagaaggaagggcatctctgaaaaggatgatctggaaagcacatatgctgtattcactgttgaagaacctaagaaaaaaagtggagcttggatcaaggcagggggcaagaacaagaaacataaccttttatctagcatagttggggaaataaaggttgcacgtcgaaaatcaagatgccaccatacagcagatgttcatgtacacagggaatttgtgttggttggttctgaatttctaccatcgtctgaagaatcaggtgattcacatgttagtggagagcttgcagcttttataactgcacttcctcagcaagaagcagaaacttcgaatcaatcatcttcacagaataccagacaaagaaattcagcaccaattggctgtggttgccccccactgggaaacttccagcctagtacaagaaatgctaattctgcttcagccaatgttattgcagtacttcctgatggcttccatggcacatcaacatctgggcagccattgcctttgattgagaggtggaagtcaggaggagcttgtgactgtggtggatgggatgaaggttgcatgctgagtgtcctcactgatgcggcccaagataatgatgccattcaggctaaccaggcaaaggatggcagccagcgatttgagcttttagttcagggtcgatcgcgagaagataggaatgccttcagtatgacttccttcaaagaggggctttatacagtggaattcagatcatccattgcattacttcaggcttttgcaatgtgtatagtgatgctccatgggaggtaccctagcaggatgcaagttggttcgcaagcagcgcaggagcatgatctccttgctggtcatgagctcaaggccatggcagccagtcaaggaagagctccgaccagctatgtgccccaccggccacctctttctcctgtaggccgagcctagcttatcgcgattaaatgtatgttctttctatatctgtgtcctctttcttcagttgcgtagtgccggtgggattgatataccatggtcctcaggtctatacgcaatatgcatatccaaagtgacaatctctgtgcaagagtctttagaggtagctacctgtacatgttgtgatgtggatgttgtattactgtactatgatgtggctgcaaggcccatctcagtgcttagttaccctttatatgttctcttatca

SEQ ID NO: 1984 - DNA, 3957 bp, Zea mays
acccgaacggatggcatcatggcaggatggggatgccgcctgggcatcgtgccattgcagccgctgctgacctcaccaccctggcgcacgcaaccctcgcgcacgtcaaactgctgcgacctgcgacaaaggagccacctccgggctccggcccctccccagcggcccagctacccgcctgctcgtccgcccccggcgccccgcgcttttctttccccgttcccaccacttcaagatccaatccatcgtccgtgaacgaaatagcccagtttcgtgcccctcgtgatcccgacgccgacaacgaaactgcccagtttcgtgcttttctccagtaccccgcgcacgcgcgcacacacacacatccgaatcacaaggattgcaccgtggcagtacaggtagaaacgtcgagtgaaaccgtgggaggggtcgagggaagaagcgggccagcagcgagcgagcagtcgagcacgcggggcgcaccacaaggccacaaagcgcgccgcgcggcggcacccgccacctacctggtcgcccaacctactgcctatacgaggggagggggatagggagtagcagtagccagtaggcagcgtagcactgcggctcctactaccaagtaccaaccacacctccaacccccgccgtataccaatccgccggaggtctctattcagtccacttgcctttttccctcaccggtcactgcatcgagctatcggttcgtctctccctttccctcaggagtggtagatctgccgaacattattgtgccaaaagctgttggtgggcaaacccctggtttttgggaagtgcggtttcctcaatgtctatttgaatcacagcatactgaactgaatcaagtgataattgtgttctggtcatacactaagatatacctgaaacttctgcttcatatgttcacacatcataaatattccaacaaaggtcagatgaacagcgaaaggaatgtgaagatcatatcaggtcgtgatgggcaaaagaagggaaattcacagtatggccaaattgtacacatgccaaaggacatggtcacaacagtcaatggaaacgtagatgcaaaatttgaagatgaagttagagttgtgaagaatgataggttccaaaggcaacgagagtcttggggtggggaatgcaagaagggctcaaaaccatggcctggtcgaaaggcagctactgttgatgaacttgttaaacatatgtcaaatgttccttcatatttacagcgtaaagaaacttctgaccatcttcaagacaaggcactgaatgttggagttcttgagtgggggcttcttgctaactggtctcagcaagaaaagcataagctcactagaagctatggaccatctccacccaatactagcaggtctgtactattcccatctccatcacattcttctccaagccccagcagcagatctcttgagagtaatcaatctaccccaatgagtggccatcatcattcatccatcagagcacagcagaataggctcacagataaacaccatgagagggccagatgtccacctagcccaaattctgcagtactgagcttattgtcaggtcatggcacacatccctgtccagagaacggtcataattatgttgggttgggtctcagcaatgtttctttagcctcagactctctaggttcttcctctagaagttgtggaagacatgaaatggttggagatgaagagactagacggaagactgaagacgttgtccatcattgttctcgtaggctttttgcagacagcgataacattgggaaacatttcttcgcatcaaataccaatgactccatgtgtaatgatcctgaacagagtattggcttgaatggggaaaattttgagtcactaacgtctgatgctgtaatggacacagctagaaatgacagtaagtcgtctgactatttactggaggatattgagccatcccttgaatttcctcgaatcccatattcatgtccacttcccatcatagattcagcagccaaagagattggcatcactagcactgaggctggagatgcaaaagtgagtaaaaattctaaccggaaccaatctgccatgaatgtcactgagaatcctccccaatactcagcaaagtttagtgataagatgccttattgtcatctaggttctgggatgaatcgagggagctgcagctctagcctcaaggagtcaccacatattcgacaacccaatatagttcctcctgtcgataagacaggagacaggtcatcacccaacagcaaaggtaggcgaagcccattgaggaggatgttagatccaatattaaagccaagacattctagtccagtacgtccttcatttgttcctaagtgtcaacttccagtcaataccaccaagcagtctctggacttggggaaatcagtgccacataatgttcagcgaaggtcggttgatttggtagtcaattcgaattatctgatcgaagaaaatagaaatcagcctcctccccgtgtgctattgaacagtgcaagatacatacaaaaaggaaatgattcagcaacaacaaggcaagcacttctgcagctagcatggaagaacggcttgcctttattcatactctcttatggtgattctgacatcctggcagccactgttagaaggaagggcatccctgaaaaggatggtctggaaagcacatatgctgtattcactgttgaagaaccgaagaaaaaaagtggagcttggatcaagacagggggcaagaacaaaaaacatcaccttttatctagcatagttggggaaataaaggttgcgcgtcgaaaatcaagatgccaccatacaaccgatgttcatgtacacagggaatttgtgttggttggttccaaatttctaccatcgtctgaagaatcaggtgattcaaatgttagtggagagcttgcagcttttatcagcacacttcctcagcaagaagcagaaacctcgaagcaatcatcttcacagaataccaggcaaagaaattcaatgccaattggctgtggttgccccccactgggaaatttccatcctagcacgagaagtgctaattctgcttcagccaatgttgttgcagtacttcctgatggcttccatggcacaataacatctggacagccattgcctttgattgagaggtggaggtcaggaggagcttgtgactgtggcggatgggatgaaggttgtatgctaagcgtcctcactgatgcggccgaagaaaatgatgccattcaggctaaccaggcaaaggatggcagccagagatttgagcttctagatcagggtcgatcacgagaagagaggcatgccttcagtatgacttccttcaaagaggggctttatacagtggaattcagatcatccattgcattacttcaggcttttgcaatgtgtatagtgatgctccatggaaggtacccaagaagaacgcaagttggctcgcaagcagagcaggagcatgatctccttgctggtcatgagctcaaggccatggcagccagtcaaggaagaaggcctccgaccagctatgtgccccaccggccacctctttctcctgtaggccgagcctagcttatcacgatttagtgtatgttctttctgtgtctgtcctctttcttcagctgcgtagtgccggtgggattgatataccatggtccaatggtccatatgtaatacgcatgtccaaagtgacaatctctgcgcaagtctttagagatagctccctgtacatgctgtgatgttgttgatggtgtatgactgtaccagtaccgtgatgtggctgcaaggtccatctcagtgcttagttacccttttatatgtccgcttatctgttgcttctgtatatgctgaaatgcgcctgcaatctgttgcaacccttgtttaaattgtgcgttgcatcgcagcagcatttgtgcagctgctgaagtta

SEQ ID NO: 1985 - DNA, 1836 bp, Panicum virgatum
ccccacctcgtgttggtgcggcggcgcccggaacaaaacccttcccttcccttctcccagatctcctcccactctccctcacactccaaaccctagcttcgcccagcccccaaccatggcgtcgatgatgcaaccgcagatcatcctgctcaaggagggcacggacacgtcgcaggggcgcgcgcaggttgtgagcaacatcaacgcgtgcacggcggtggcggacaccgtgcggaccacgctggggccccggggcatggacaagctcatccacgacgacaagggcggcgtcaccatctccaacgacggcgccaccatcatgcgcctcctcgacatcgtgcaccccgcggccaagatcctcgtcgacatcgccaagtcacaggactccgaggttggtgatgggacaactactgtggtgcttctagctgcagagttcttgaaggaagcaaaaccttatgttgaggatggagtgcacccccacagtctaatccgcagctataggactgcgggcaatatggcaattcaaagggttaaagaactggcagttagcattgaagggaaaagcctggaagagaagaaatcattgctagccaagtgtgctgccacaacattgtcatcaaaacttataggcggtgaaaaggaattctttgcttctatggttgtggatgctgtccttgccattggcaatgatgacaggcttaatcttatcgggattaaaaaggttcctggaggtaccatgagagattcattcctggtgaatggtgttgcattcaagaagacattttcatatgctggatttgagcaacaaccaaagaagttcctaaatccaaagattcttttgttgaacattgaactagaattaaaatctgagaaggaaaatgcagagatcagattatcagatcccctacaataccaatcaattgttgatgctgaatggaacattatttatgacaaactggataaatgtgtaaaaagcggggcaaagatagttctatcccggctagctattggtgatcttgcaacacagtattttgcagatcgagacattttctgtgccggtcgtgttacagaagaggatttgcaacgtgtggctgcagcaaccggtggaatggttcaaacttctgtaaataatgtcatcgatgaggtacttggttcttgtgaggtatttgaagaaaaacaagtaggtaatgaaagattcaacatatttagtggctgcccttccgggcagacagcaaccattgtcctccgtggtggcgcagaccagttcatcgaggaagctgaacgaagtctccatgacgccatcatgattgtgaggagagctcttaagaactctacagttgtaccgggtggtggtgctattgatatggaaataagcaaatatctcaggcagcatgcacggaccattgctgggaagtctcagttctttgttaattcgtttgctaaagcccttgaggttatcccacgacaactttgtgataatgctggatttgacgcaactgatgtgcttaataagctcaggcagaagcatgcatctggtgaaggtgctaattatggtgtagacataaacactggcggaattactgattcctttgctaactttgtgtgggaacctgctgttgtaaagatcaatgctataaatgccgcaactgaagcttcgtgccttattctaagcgtcgacgaaactgtgaaaaacccaaagtcggagagtgcacaaggtgaggctgcagctggtgcaatggctggtcgtggtggaggggcaatgcgaggccgtggtgggaggggcatgcgcaggcggtaaaccgagtcactccaaccctgtagcttcatgttttaatc

SEQ ID NO: 1986 - DNA, 1935 bp, Echinochloa colona
ctcagctcagatctcccctccctctgcccctccaaaccctagcacggtgtcaagcccccagccatggcgtcgatgatgcaaccgcagatcatcctgctcaaggagggcacggacacgtcgcaggggcgcgcgcaggtggtgagcaacatcaacgcgtgcacggcggtggcggacaccgtgcggaccacgctggggccccggggcatggacaagctcatccacgacgacaagggcggcgtcaccatctccaacgacggcgccaccattatgcgcctcctcgacatcgttcaccccgccgccaagatcctcgtcgacatcgccaagtcacaggactccgaggtcggtgatgggacaactactgttgtgcttctagctgcagaattcttgaaggaagcaaaaccttatgttgaggatggagtgcacccacatagtctaattcgcagctacaggactgcgggcagtatggcgattcaaagagttaaagaactggcagttagcatagaagggaaaagccttgaagagaagaaatcgttgctagccaagtgtgctgccacaaccctctcatcaaaactgattggcggtgaaaaagaattctttgcttctatggttgtggatgctgtccttgccattggcaatgacgacaggctgaatcttatcgggattaaaaaggttcctggtggtaccatgagagattcttttctggtgaatggtgttgcattcaagaagacattttcatatgctggatttgagcaacaaccaaagaagttcctaaatcctaagattcttttgttgaacattgaactagaactaaaatctgagaaagaaaatgcagagatcaggttatcagaccctctgcaataccaatcaattgttgatgctgaatggaacattatttatgacaaactggataaatgtgtaaaaagtggagcaaagatagttctgtctcggctggctattggtgatcttgcaacacagtattttgcagaccgagacattttctgtgctggtcgtgtcacagaagaggatttgcaacgagtggctgcagcaactggtggaactgttcaaacatctgtaaataatgttattgatgaggtgcttggttcttgtgaggtatttgaggaaaaacaagtaggaaatgaaagattcaacatatttagtggctgcccttctggtcagacagcaactattgtcctccgtggtggtaccgaccagtttattgaggaagctgaacgaagtctccatgatgccatcatgattgtgaggagagctcttaagaactctacggttgtgccggggggtggtgctatcgatatggaaataagcaagtacctcagacaacatgcgcggaccattgctgggaagtctcagttctttgtaaattcgtttgctaaagcccttgaggttattccacgacaactttgtgataatgctggatttgacgcaactgatgtgctcaataagctcaggcagaaacatgcatctggtgaaggtgctaattatggtgtagacataaacactggcggaattactgattcctttgctaactttgtgtgggaacctgctgttgtgaagatcaatgctataaatgccgcaacagaagcttcctgccttattcttagtgttgacgaaacagtgaaaacccaaaagtcggagagcgcacaaggtgatgctgcagctggtgcaatggctggccgtggtggaggtgcaatgcgaggtcgtggtgggaggggcatgcgcaggcggtaaattgaaccacgtcgatcctgtaactgttttgattgcctctgcaggctgttgtgtcacacagcacgtttaatgtgattttatgatgctgcgcgtgtaatatgagctttttggttcagaagcagtgctagccttttgttttaaaacagcagagatacgcgaggtatttgtcaacgtagctactgccggttg

SEQ ID NO: 1987 - DNA, 2023 bp, Sorghum bicolor
actcccgtctgctctcagatctcttccgctccctcctcacacttgaagccctagctccgcgcagcccccaaccatggcgtcgatgatgcaaccgcagatcatcctgctcaaggagggcacggacacgtcgcaggggcgcgcgcaggtggtgagcaacatcaacgcgtgcacggcggtgggcgacaccgtgcggaccacgctggggccccgggggatggacaagctcatccacgacgacaagggcggagtcaccatctccaacgacggcgcaaccatcatgcgcctcctcgacatcgtgcaccccgccgccaagatccttgtcgacatcgccaagtcacaggactccgaggttggtgatgggacaactactgtggtgcttctagctgcagaattcttaaaggaagcaaaaccttatattgaggatggggtgcacccccacagtctaattcgcagttatagaactgcaggcaatatggcaatccaaagggttaaagagctagcagttagcatagaaggaaaaagccttgaagagaagaaaacattgctagccaagtgtgctgctacaacactctcttcaaaacttataggcggtgaaaaagaattctttgcttctatggttgtggatgctgtccttgccattggcaatgatgacaggcttaatcttatcgggattaagaaggttcctggaggtaccatgagagattcttttctggtgaatggtgttgcgttcaagaagacattttcgtatgctggatttgagcaacaaccaaagaagttcctgaacccgaagattcttttgttaaacattgaactagaattgaaatctgagaaggaaaatgcagagatcaggttatctgaccctctgcaataccaatcaattgttgatgctgaatggaacattatttatgataaactggataaatgtgtgaaaagtggagcaaagatagttctgtctcggctagctattggtgatcttgcaacacagtatttcgcagatcgagacattttctgcgccggccgtgtcactgaagaagatttgcaacgtgttgctgcagcaactggtggaactgttcaaacttctgtaaataatgtcatcgatgaggtacttggttcctgtgaggtattcgaggaaaagcaagtaggtaatgaaaggttcaacatatttagtggctgcccttctggtcagacagcaactattgtgctccgtggtggtgcagagcagttcattgaggaagctgaacggagtctccatgatgccatcatgattgtgaggagagcacttaagaactcaacagttgtgccgggtggcggtgctattgatatggaaataagcaagtatctcaggcagcatgcacggacaattgctgggaagtctcagttctttgtaaattcgtttgctaaagccctcgaggtcattcctcgtcaactttgtgataatgctggatttgatgctactgacgttctcaataagctcaggcagaaacatgcatctggtgaaggtgctaattatggtgtagacatcaacactggcggaattgctgattcctttgctaactttgtgtgggaacctgctgttgtaaagatcaatgctataaatgctgcaactgaagcatcctgccttattcttagcgttgacgaaacagtgaaaaacccaaagtccgaaagcgcacaaggtgaggcagcagctggcgcaatggctggtcgtggtggtggggcaatgcgtggacgtggtggcaggggcatgcgcaggcgatgaactgagccacgttgatcctgtaacattatgttttgatcgcctttgttggtcagatttttttgcctgtttgcgcttgcgcggtgctgttgtgtcgtactgcacatgtaatgtgagtttatggacacgcacttattattgtgtgcttttggttgggaagcagtagcagcctttttgtttcagaggagatgcgctaggcgtttatcattgtagctttcctgttgtgatatagtagtagacctgagcctttggttacaatttgtttggccc

SEQ ID NO: 1988 - DNA, 2106 bp, Saccharum officinarum
cggacgccaggatctctccattaaaaaacctcggccgaaacctcaaaaccctactcccgtctcctctcagatctcctcccctccctcacacttgaagccctagctccgcccagcccccaaccatggcgtcgatgatgcaaccgcagatcatcctgctcaaggagggcacggacacgtcgcaggggcgcgcgcaggtggtgagcaacatcaacgcgtgcacggcggtgggcgacaccgtgcggaccacgctggggccccgggggatggacaagctcatccacgacgacaagggcggagtcaccatctccaacgacggcgccaccatcatgcgcctcctcgacatcgtgcaccccgccgccaagatccttgtcgacatcgccaagtcacaggactccgaggttggtgatgggacaactactgtggtgcttctagcttcagaattcttaaaggaagcaaaaccttatattgaggatggggtgcacccccacagtctaattcgcagttatagaactgcaggcaatatggcaatccaaagggttaaagagctggcagttagcattgaaggaaaaagccttgaagagaagaaaacattgctagccaagtgtgctgctacaacactctcttcaaaacttataggcggtgaaaaggaattctttgcttctatggttgtggatgctgtccttgccattggcaatgatgacaggcttaatcttatcgggattaagaaggttcctggaggtaccatgagagattcttttctggtgaatggtgttgcgttcaagaagacattttcgtatgctggatttgagcaacaaccaaagaagttcctgaaaccgaagattcttttgttaaacattgaactagaattgaaatctgagaaggaaaatgcagagatcaggttatctgaccctctgcaataccaatcaattgttgatgctgaatggaacattatttatgacaaactggataaatgtgtgaaaagtggagcgaagatagttctgtctcggctagctattggtgatcttgcaacacagtatttcgcagatcgagacattttctgcgccggtcgtgtcacagaagaagatttgcaacgtgttgctgccgcaactggtggaactgttcaaacttctgtaaataacgtcatcgatgaggtacttggttcctgtgaggtatttgaggaaaagcaagtaggcaatgaaaggttcaacatatttagtggctgcccttctggtcagacagcgactattgtgctccgtggtggtgcagaccagttcattgaggaagctgaacggagtctccatgatgccatcatgattgtgaggagagcacttaagaactcgacagttgtgccgggtggtggtgctattgatatggaaataagcaagtatctcaggcagcatgcgcggacaattgctgggaagtctcagttctttgtaaattcgtttgctaaagccctcgaggttattccacgtcaactttgtgataatgctggatttgacgctactgacgttctcaataagctcaggcagaaacacgcatctggcgaaggtgctaattatggtgtagacataaacactggcggaattgctgattcctttgcgaactttgtgtgggaacctgctgttgtaaagattaatgctataaatgctgcaaccgaagcttcctgccttattcttagtgttgacgaaacagtgaaaaacccaaagtcggagagcgcacaaggcgaggctgcagctggtgcaatggctggtcgtggtggaggggcaatgcgaggacgtggtggcaggggcatgcgcaggcgatgaactgagccacgttgatcctgtaacattatgttttgattgatcacctgtggatcagattctttatttgcctgtttgcgcggtgctgttgtgtcgtactgcacatgtaatgtgagtttatggacacgcacttattattgtgtgcttttggttgggaagcagtagcagcctttttgtttcaaaagaaatacaccaggcgtttatcattggaacattcctgttgggatataatagttggcccgaacctttggttacaatattgttgggccatattttaatttattggctttcattttcatgggag

SEQ ID NO: 1989 - DNA, 2048 bp, Zea mays
tgtccctcctgctcccagatctcttccactcggccactccctagcacatcaaaccctagctccgcccagcccccaaccatgtcggcgatgatgcaaccgcagatcatcctgctcaaggagggcacggacacgtcgcaggggcgcgctcaggtggtgagcaatatcaacgcgtgcacggcggtgggcgacaccgtgcggaccacgctggggcctcgggggatggacaagctcatccacgacgacaagggcggagtcaccatctccaacgacggcgccaccatcatgcgcctcctcgacatcgtgcaccccgccgccaagatccttgtcgacatcgccaagtcgcaggactccgaggtcggcgatgggacaactactgtggtgcttctagctgcagaattcttaaaggaagcaaaaccttatatcgaggacggggtgcacccccacagtctaattcgcagttatagaactgcaggcaatatggcaatccaaagggttaaagagctggcagttagcatagaaggaaaaagccttgaagagaagaaatcactgctagccaagtgcgctgctacaacactctcttcaaaacttataggtggtgaaaaagaattctttgcttctatggttgtggatgctgtccttgccattggcaatgatgacaggcttaatcttattgggattaaaaaggttcctggaggtaccatgagagactcttttttggtgaatggtgttgcgttcaagaagacgttttcatatgcaggatttgagcaacaaccaaagaagttccttaatccaaagattcttttgttaaacattgaactagaattgaaatctgagaaggaaaatgcagagatcagattgtctgaccctctgcaataccaatcaattgttgatgctgagtggaacattatttatgacaaactggataaatgtgtgaaaagtggagcaaagatagttctgtctcggctagctattggtgatcttggaacacagtattttgcagatcgagacattttctgtgctggccgtgtcactgaagaagatttgcaacgtgttgctgcagcaactggtggaactgttcaaacttctgtaaataatgtcatcaatgatgtactcggttcctgtgaggtattcgaggaaaagcaagtaggcaatgaaagattcaacatatttagtggctgcccttctggccagacagcgactattgttctccgtggtggtgcagaccagttcattgaggaagctgaacgaagtctccatgatgccatcatgattgtgaggagagcacttaagaactcgacagttgtgccgggtggtggtgctattgatatggaaataagcaagtatctcaggcagcatgcacgaacaattgctgggaagtctcagttctttgtaaattcatttgctaaagcccttgaggttattccacgccaactttgcgataatgctggatttgatgccactgacgttctcaataagctgaggcagaaacatgcatctggtgaaggtgctaattatggtgtagacataaacactggcggaattgctgattcctttgcaaactttgtttgggaacctgctgttgtaaagatcaatgctataaatgctgcaaccgaagcttcctgccttattcttagcgtcgacgagacagtgaaaaacccaaagtcggagagcgcacaaggtgaggctgctgccggtgcgatggctggtcgcggtcgaggtgcaatgcgaggacgtggtggcaggggcatgcgcaggcgataaactgggtcaagtagatcatggtgagatttttttgcatgtttgcgagtgcttttgtgccttactgcacatgtatggacgctgcacttactattgtgcgcttttggttgtgaagcagtcgtagactttttttttgtttcagaagagatgcaccaggcgtttatcagtgtaccgtccgctggatgtgttatagtagacctgagctttggattctaatttgtttgacatttatcttggtttattggcttgtcttttgaacaatgagaaaatcagtgttgtagtttgcgatc

SEQ ID NO: 1990 - DNA, 2116 bp, Brachypodium distachyon
aaaccgcaaaacccttttccctcctctgcccctctcccctctcgcgccgctcagatctccgcccttcactccaaaccctagctacgccgcctccgcgcagcctccagccatgtcggcgatgatgcaaccgcagatcatcctgctcaaggaggggacggacacgtcgcagggccgcgcgcaggtggtgagcaacatcagcgcgtgcacggcggtggcggacacggtgcggaccacgctgggcccccgcgggatggacaagctcatccacgacgacaagggcaccaccatctccaacgacggcgccaccatcatgcgcatcctcgacatcgtgcaccccgccgccaagatcctcgtcgacatcgccaagtcgcaggactccgaggttggtgatgggacaactactgtggtgcttctggctgcggaattcatgaaggaagcaaaaccttatgtggaggatggagtgcacccgcatagtctaatccgtagttataggactgctggcaatatggcaattcagagggttaaagaactggcagtcagcatagaaggaaaaagcctagaagagaagaaatcattgttagctaagtgtgctgctacaacactctcgtcaaaactgataggtggggagaaagacttctttgcttctatggttgtggatgctgtccttgccattggccatgacgacaggcttaaccttattggaattaagaaggttcctggaggtaccatgagagattccttccttgttagcggtgttgctttcaagaagacattttcatatgctggttttgagcaacaaccaaagaaatttttgaatccaaagattcttttgttgaacattgaactagaactgaagtctgagaaagaaaatgcggaaatcagactatctgaccctctgcaataccaatcaattgttgatgctgaatggaacattatttatgacaagctggacaagtgtgttaaaagtggggcaaaaatagtcctgtcccggctagctattggtgaccttgcaacacagtattttgcagatcgggacattttctgtgctggtcgtgtcacagaagaggatttacaacgcgtaagctcagcaacaggcggaactgttcaaacctccgtgaacaatgtcatcgacgaggttcttggtacctgtgaggtttttgaggaaaaacaagttggcaatgaaaggttcaacatatttagtggctgcccttctggtcagacagctactattgttcttcgtggtggtgcagaccagttcatagaggaagctgaaagaagtctccatgatgccatcatgattgtgaggagagctgtcaagaactcgacagttgtgcctggtggtggtgccattgatatggagataagcaagtatcttcgacaacatgcacgaacgatagctggaaagtctcaattttttgtaaattcatttgctaaagccctcgaggttattccgagacaactttgcgataatgctggatttgacgcgactgatgtgctcaataagctcaggcagaaacatgcatctggtgatggcgctaattatggtgttgacgtcaacactggtggaattgccgatgccttcgctaactttgtgtgggaacctgcagttgtgaagatcaatgctatcaatgccgcaactgaagctgcctgccttattctgagtgttgatgagacagtgaaaaacccaaagtcggagagtgcacaaggtgatgctgctgcaatgggcggccgcggtggaggggcaacacgaggacgtggcgggaggggaatgcgcaggcggtaaattctagctaagtccgccctgtaaccttatgctgccctggcgggatcagattttgagttccctctgtttgggttgatggcccggtagcccgcatccaggttttgcggaatttgtatgtcaaatgtcggagcttctagtgttgagaatgtgctagccttttgtttatgaacttggaggacatggtaggcttgtttatctacgtagctgttacctgttgtggttccatagcacgattaatgcttgctccttttccaccacgaggttctcgtggtcgatgtgatgtgctgacactgcgatggtggtggtgaataccatacctggttgttgcttggt

SEQ ID NO: 1991 - DNA, 2137 bp, Brachypodium distachyon
taaaccgcaaaacccttttccctcctctgcccctctcccctctcgcgccgctcagatctccgcccttcactccaaaccctagctacgccgcctccgcgcagcctccagccatgtcggcgatgatgcaaccgcagatcatcctgctcaaggaggggacggacacgtcgcagggccgcgcgcaggtggtgagcaacatcagcgcgtgcacggcggtggcggacacggtgcggaccacgctgggcccccgcgggatggacaagctcatccacgacgacaagggcaccaccatctccaacgacggcgccaccatcatgcgcatcctcgacatcgtgcaccccgccgccaagatcctcgtcgacatcgccaagtcgcaggactccgaggttggtgatgggacaactactgtggtgcttctggctgcggaattcatgaaggaagcaaaaccttatgtggaggatggagtgcacccgcatagtctaatccgtagttataggactgctggcaatatggcaattcagagggttaaagaactggcagtcagcatagaaggaaaaagcctagaagagaagaaatcattgttagctaagtgtgctgctacaacactctcgtcaaaactgataggtggggagaaagacttctttgcttctatggttgtggatgctgtccttgccattggccatgacgacaggcttaaccttattggaattaagaaggttcctggaggtaccatgagagattccttccttgttagcggtgttgctttcaagaagacattttcatatgctggttttgagcaacaaccaaagaaatttttgaatccaaagattcttttgttgaacattgaactagaactgaagtctgagaaagaaaatgcggaaatcagactatctgaccctctgcaataccaatcaattgttgatgctgaatggaacattatttatgacaagctggacaagtgtgttaaaagtggggcaaaaatagtcctgtcccggctagctattggtgaccttgcaacacagtattttgcagatcgggacattttctgtgctggtcgtgtcacagaagaggatttacaacgcgtaagctcagcaacaggcggaactgttcaaacctccgtgaacaatgtcatcgacgaggttcttggtacctgtgaggtttttgaggaaaaacaagttggcaatgaaaggttcaacatatttagtggctgcccttctggtcagacagctactattgttcttcgtggtggtgcagaccagttcatagaggaagctgaaagaagtctccatgatgccatcatgattgtgaggagagctgtcaagaactcgacagttgtgcctggtggtggtgccattgatatggagataagcaagtatcttcgacaacatgcacgaacgatagctggaaagtctcaattttttgtaaattcatttgctaaagccctcgaggttattccgagacaactttgcgataatgctggatttgacgcgactgatgtgctcaataagctcaggcagaaacatgcatctggtgatggcgctaattatggtgttgacgtcaacactggtggaattgccgatgccttcgctaactttgtgtgggaacctgcagttgtgaagatcaatgctatcaatgccgcaactgaagctgcctgccttattctgagtgttgatgagacagtgaaaaacccaaagtcggagagtgcacaaggtgatgctgctgcaatgggcggccgcggtggaggggcaacacgaggacgtggcgggaggggaatgcgcaggcggtaaattctagctaagtccgccctgtaaccttatgctgccctggcgggatcagattttgagttccctctgtttgggttgatggcccggtagcccgcatccaggttttgcggaatttgtatgtcaaatgtcggagcttctagtgttgagaatgtgctagccttttgtttatgaacttggaggacatggtaggcttgtttatctacgtagctgttacctgttgtggttccatagcacgattaatgcttgctccttttccaccacgaggttctcgtggtcgatgtgatgtgctgacactgcgatggtggtggtgaataccatacctggttgttgcttggtatgattcatgattaaatttg

SEQ ID NO: 1992 - DNA, 2115 bp, Oryza sativa
caaggtcattgggcacccggggggcctcctagaactctcgccttccccgcgccgccgccgccctctcaaaacgagcgatcgagaaaaaccctcgctgctctcctccccctccccctccccctccgccgccacctcagatctccatctccccgcccccaaatccccccgaaaccgcgagctcctcgccatggcgtccatgatgcaaccgcagatcatcctgctcaaggaggggacggacacgtcgcaggggcgcgcgcaggtggtgagcaacatcaacgcgtgcacggcggtggcggacacggtgcgcaccacgctggggccacgcggcatggacaagctcatccacgacgacaagggcggcaccaccatctccaacgacggcgccaccatcatgcgcctcctcgacatcatccaccccgccgccaagatcctcgtcgacatcgccaagtcccaggactccgaggttggtgatggaactaccacagtggtgcttcttgctgctgagttcctgaaagaagcaaaaccttacattgaggacggagtacatccgcatagtctaattcgcagttataggactgctggccatttggcaattgaaaaggtcaaagacttggccactagcattgaagggaaaagccttgaggaaaagaaggaattgctagccaagtgtgctgcaacgacactctcatcaaagttgataggtggcgagaaagaattttttgcatctatggttgtggatgctgttcttgccattagcaatgatgacagacttaaccttcttggaataaaaaaggttcctggaggcaccatgagagattccttccttgttaacggtgttgccttcaagaagacattttcctatgctggatttgagcaacagccaaagaagttcttgagtccaaagattcttttgctgaacatagaactagaattgaaatctgagaaagaaaatgcagaaatcagattgtctgaccctttacaataccaatcaatcgtcgatgctgaatggaatatcatttatgacaagttggataaatgtgtcaaaagtggggcaaagatagtcctttctcggttggcaattggtgatcttgcaacacagtattttgcagaccgggacattttctgtgctggccgtgttgcagaagaggatttacaacgtgttgcagcagcaacaggtggtaccgttcagacatcagtgaataatgtcattgatgaggtacttggtacttgcgaagttttcgaggaaaggcaagtgggcaatgaacggttcaatatatttagtggttgcccttctggtcaaacagcaaccatagtccttcgtggtggtgcagatcagttcatcgaggaagcagaaaggagcctccacgatgccatcatgattgttagaagagctcttaagaactcaacagttgtacctggtggtggtgctattgatatggaaataagcaagtacctcagacagcatgcacgtaccatagctgggaagtctcaattcttcgtaaactcatttgctaaagccctcgaggttattccaagacaactttgtgacaatgctggatttgatgcaactgatgtactcaataagctccgacagaaacatgcatctggtgaaggtgctaattttggtgtggacatcaacactggtggaattgctgattcctttgctaactttgtctgggaacctgctgttgtgaagatcaatgctataaatgctgcaactgaagctgcttgccttattctcagcgtggatgagacagttaaaaatcccaagtctgaaagtgcgcaaggtgatgcggctgctagcgcgatggctggccgtggcggaggagcgatgcggggccgtggtggaaggggcatgaggaggcggtaatcaatctacgccacgtttgtttagcttcgtcgctcgtgtggtttaaatttaggagtaggttatttgcagtctgctctttatcgaagtttttcgtgacgctacatgcatgccctgctcgatgtatttccaattgtgcttgtcagattcgtgaaaacatggcaaatatttttgtgatggttgcctactagcttttgtaacttcacatgttgactgtttcaatcaatgggtattcttcttgatcctca

SEQ ID NO: 1993 - DNA, 1873 bp, Lolium multiflorum
ccctccgccgcgccgcctccagccatgtcgtcgatgatgcaaccgcagatcatcctcctcaaggagggcacggacacctcgcagggccgcgggcagatgctcagcaacatcagcgcctgcacggccgtcgccgacaccgtgcgcaccacgctcggcccccgcgggatggacaagctcatccacgacgacaagggcaccaccatctccaacgacggcgccaccatcatgcgcctcctcgacatcatacaccccgccgccaaggtcctcgtcgacatcgcaaagtcgcaggactccgaggttggcgatgggacaactactgtggtgcttcttgcttcggaattcatgaaggaagcaaaaccttatgttgaggatggagtgcacccacatagtttaatccgcagttataggatggccggcaacatggcgatccaaagggtcaaggaactggcagtcagcatagaggggaaaagcctggaagagaagaaatcgttgttagccaagtgtgctgccacaacactctcgtctaaactgataggtggggagaaagaattctttgcttctatggtagtggatgctgtccttgccatcggacatgatgataggcttaaccttattggaattaagaaggttcctggaggtaccatgagagattccttccttgtcaatggtgttgccttcaagaagacattttcgtatgctggatttgagcagcaaccaaagaaattcctgaatccaaagattctgttgttgaacattgagctagaattgaagtctgagaaagaaaatgcagagatcagattgtcagaccctctacagtaccaatcaattgttgatgctgaatggaacattatttacgacaagttggacaagtgtgttcagagtggggcaaaaatagttctgtcgcggctagctattggtgatcttgcaacacagtattttgcagaccgagacattttctgcgctggtcgtgtcacagaagaggatttgcaacgcgtaagctctgcttcaggcggaactgttcagacctctgttaacaatgtcattgatgaggtccttggcacatgtgaggtttttgaggaaaaacaagtaggcaatgaaaggttcaacatatttagtggctgcccatctggtcagactgcaactattgttctacgtggtggtgctgaccagttcatagaggaagctgaacgaagtcttcatgatgccatcatgattgtgaggagagctgttaagaactcaacagttgtgcctggtggtggtgccattgatatggagataagcaagtatctccgacagcatgcacggacaatagctggaaagtctcagttctttgtgaattcatttgctaaagctctcgaggttattccaaggcaactttgtgataatgctggatttgacgcaactgatgtgctcaataagcttaggcagaagcatgcatctggtgatggtgctaattatggtgttgatatcaacactggtggaattgcggattctttcgctaattttgtgtgggaacctgctgttgttaagattaatgcgattaatgctgcgacagaagctgcctgccttattctgagtgttgacgaaacagtgaaaaacccaaagtcggagagcgcacaaggtgatgccgctgcgatgggtgggcgtggtggtggtggaatgcgaggacgaggtggtaggggcatgcgcaggcggtgattctagtcaagtgtgtcctgtaatgttgttctgccatgccgggtcaggttttgagttccctttgtatgggccatcggtcctcattacctgcatccaggttttgtggaatttgtatgtctagtgcgagaatttctagtgttgaaaatgtgctatgcttttttgggtgttttttttc

SEQ ID NO: 1994 - DNA, 1998 bp, Avena sativa
ctccccgtccccctcccatcctcctcaccgcgccgcctagacccctcactccaaaccctagctccgcctccgcgcagcctccagccatgtcggcgatgatgcaaccgcagatcatcctcctcaaggagggcacggacacgtcgcagggccgcgggcagatgctgagcaacatcagcgcctgcacggcggtggcggacacggtgcggaccacgctgggcccccggggaatggacaagctcatccacgacgacaagggcgtcaccaccatctccaacgacggcgccaccatcatgcgcctcctcgacatcatccaccccgccgccaaggtcctcgtcgacatcgccaagtcccaggactccgaggttggcgatgggacaactactgtggtgcttcttgcttcggaattcatgaaggaagcaaaaccttatgttgaggatggagtgcacccacatagtctaatccgtagttataggattgccggcaacatggcgattcaaagggttaaggaactggcagtcagcatagaggggaaaagcctggaagagaagaaatccttgttagccaagtgtgctgccactacactctcgtccaaacttataggtggggagaaagaattctttgctgatatggtagtggaggctgtccttgccatcggccatgatgacaggcttaaccttattggaattaagaaggttcctggaggtaccatgagagattccttccttgtcaatggtgttgctttcaagaagacgttttcgtatgctggatttgagcaacaaccaaagaaattcctgaatccaaagattcttttgttgaacattgagctagaattgaagtctgagaaagaaaatgcagagatcagattgtcagaccctctgcagtaccaatcaattgttgatgctgaatggaacattatttacgacaagttggacaagtgtgttcagagtggggcaaaaatagttctgtcgcggctagctattggtgatcttgcaacacagtattttgcggatagagacattttctgcgctggtcgtgtcacagaggaggatttgcaacgtgtaagctctgcttcaggcggaactgttcagacctctgttaacaatgtcattgatgaggtccttggaacatgtgaggtttttgaggaaaaacaagtaggcaacgaaaggttcaacatatttagtggctgcccatctggtcagacagcaactattgttcttcgtggtggtgctgaccagttcatagaggaagctgaaagaagtctccacgatgccatcatgattgtgaggagagctgttaagaattcaacagttgtgcctggtggtggtgccattgatatggagataagcaagtatctccgacagcatgcacggacaatagctggaaagtctcagttttttgtgaattcatttgctaaagctcttgaggttattccaaggcaactttgtgataatgctggatttgacgcaactgatgtcctcaacaagcttaggcagaagcatgcatctggtgatggtgctaattatggtgttgatatcaacactggtggaattgcggattccttcgctaattttgtgtgggaacctgcagttgttaagatcaatgcgattaatgccgcgaccgaagctgcctgccttattctgagtgttgatgaaaccgtgaaaaacccaaagtcggagagcgcacaaggtgacgctgctgcaatgggcgggcgtggtggaggtggaatgcgaggacgaggcgggaggggcatgcgcaggaggtaattctagtcaagtctgtcctctaatgttgtgccgccctggcaggtcaggttttgagttccctttgtatgggccattggtcctgacattacccgcatccaggttctgtggaatttctgtgtctaatgcgagaatttctagttgtgctaggctttttttgtttgagagcttgaaggacatgccaggtgttgtatctctatgtagcttttaccaggttgtggtattatagcacgattta

SEQ ID NO: 1995 - DNA, 2059 bp, Avena sativa
ccctctcccttccccgtccccctcccacttccatcctccaccgcgccgcccagactcctcactccaaaccctagccccgcctccgcgaagcctccagccatgtcggcgatgatgcaaccgcagatcatcctcctcaaggagggcacggacacgtcgcagggccgagggcagatgctgagcaacatcagcgcctgcacggcggtggcggacacggtgcggaccacgctgggcccccggggaatggacaagctcatccacgacgacaagggcgtcaccaccatctccaacgacggcgccaccatcatgcgcctcctcgacatcatccaccccgccgccaaggtcctcgtcgacatcgccaagtcccaggactccgaggttggcgatgggacaactactgtggtgcttcttgcctcggaattcatgaaggaagcaaaaccttatgttgaggatggagtgcacccacatagtctaatccgtagttataggattgccggcaacatggcgattcaaagggttaaggaactggcagtcagcatagaggggaaaagcctggaagagaagaaatccttgttagccaagtgtgctgccactacactctcgtccaaacttataggtggggagaaagaattctttgctgatatggtagtggaggctgtccttgccatcggccatgatgacaggcttaaccttattggaattaagaaggttcctggaggtaccatgagagattccttccttgtcaatggtgttgctttcaagaagacgttttcgtatgctggatttgagcaacaaccaaagaaattcctgaatccaaagattcttttgttgaacattgagctagaattgaagtctgagaaagaaaatgcagagatcagattgtcagaccctctgcagtaccaatcaattgttgatgctgaatggaacattatttacgacaagttggacaagtgtgttcagagtggggcaaaaatagttctgtcgcggctagctattggtgatcttgcaacacagtattttgcggacagagacattttctgcgctggtcgtgtcacagaggaggatttgcaacgtgtaagctctgcttcaggcggaactgttcagacctctgttaacaatgtcattgatgaggtccttggaacatgtgagatttttgaggaaaaacaagtaggcaacgaaaggttcaacatatttagtggctgcccatctggtcagacagcaactattgttcttcgtggtggtgctgaccagttcatagaggaagctgaaagaagtctccatgatgccatcatgattgtgaggagagctgttaagaattcaacagttgtgcctggtggtggtgccattgatatggagataagcaagtatctccgacagcatgcacggacaatagctggaaagtctcagttttttgtgaattcatttgctaaagctcttgaggttattccaaggcaactttgtgataatgctggatttgatgcaactgatgtcctcaacaagcttaggcagaagcatgcatctggtgatggtgctaattatggtgttgatatcaacactggtggaattgcggattccttcgctaattttgtgtgggaacctgcagttgttaagatcaatgcgattaatgccgcgaccgaagctgcctgccttattctgagtgttgatgaaacagtgaaaaacccaaagtcggagagcgcacaaggtgacgctgctgcaatgggcggacgtggtggaggtggaatgcgaggacgaggcgggaggggcatgcgcaggaggtaattctagtcaagtctgtcctctaatgttgtgccgccctggcaggtcaggttttgagttccctttgtatgggccattggtcctgtcattacccgcatccaggttctgtggaatttctgtgtctaatgcgagaatttctagttgtgctaggctttttttgtttgagagcttgaaggacatgccaggtgttgtatctctatgtagcttttaccaggttgtggtatgatagcacgatttacctatatttgctttttcttggcgattcgtctttttcaaacaaggcctc

SEQ ID NO: 1996 - DNA, 2217 bp, Setaria italica
atgctggcgtcccttagatctaaggatgaacggccgcgatgcaagcaaaccccatatgaccacacccgaactgacgagcctcctagaacgctcgccccgcgccgccggcgtccaccaccagacagagcagtcgaaaaaccctcgccgccgcgccgcctcgtcgtctccgccgcagatctcccaccagaaagccccaatctccccgcaaccccgaagctccccgccatgtcggcgatgctgcaaccgcaggtcatcctgctcaaggagggcacggacacgtcgcaggggaaggcgcagatggtgagcaacatcaacgcgtgcacggcggtggtggacacggtgcgcaccacgctgggaccccgcggcatggacaagctcatccacgacgacaagggcggcgtcaccatctccaacgacggcgccaccatcatgcgcctcctcgacatcgtccaccccgccgccaatatcctcgtcgacatcgccaggtcgcaggactccgaggttggtgatgggactactactgtggtgcttctagctggtgaatttttaaaggaggcaaagccttatattgaggacggtgtacaccctcacagtctaattcgcagttataggactgctggccatttggcgactgagaaagttaaagagctggcggttagcatagaagggaaaagccttgaagaaaagaaaatactgttagccaaatgcgctgcaacaacgctctcatcgaagttaataggcggcgagaaagagttctttgcttctatggttgttgatgctgtgcttgctattggaaatgatgacaggcttaacatgattggaataaaaaaggttcctggaggtactatgagagattctttccttgttaatggtgttgccttcaaaaagacgttttcatatgctgggtttgagcaacagccaaagaaattcttgaatccaaagattcttttgctcaacattgagcttgagctgaaatctgagaaagaaaatgcagagattagattgtcagaccctctgcaataccagtcaattgttgacgctgagtggaacattatttatgataaattggataaatgtgtaaaaagtggggcaaaaatagtgctttctcggttggcaattggtgatctcgcaacacaatatttcgcagatcgtgacattttctgtgctggccgtgttacggaagaggatttacagcgtgttgcagcagcaaccggtggattcgttcagacatctgtgaacaatgtcatcgacgaggttcttggttcctgtgaagtattcgaggaaaggcaagtgggaaatgaacggtttaacatattcagtggctgtccttctggtcaaacagcaaccatagtccttcggggtggtgcagatcagttcattgaggaagctgaaagaagtctccatgatgccatcatgattgttaggagagcgcttaagaattcaacagttgtgcctggtggtggtgcgattgatatggaagtaagcaagtatctcaggcagcatgcacggaccatagccgggaagtctcagttttttgttaattcattcgctaaagcacttgaggttattccgagacaactttgtgacaatgctggatttgatgcaactgatgtgctaaataagctcagacagaagcatgcatctggtgaaggtgctaactatggtgtggacatcaacactggtggaattgctgattcttttgctaactttgtgtgggaacctgcagtagtgaagatcaatgctataaatgctgcaactgaagctgcttgtcttattctcagcgtggatgagactgttaaaaaccccaagtctgaaagtgcacaaggtgatgctgctgctatgggtggtcggggccgtggtggagctgcaatgcgtggccgtggtggaaggggtatgaggcggcgataatcaatcgataccacatagtatctttgggtcacttgagtgggtcaaattttggagctgggcccttcctcttcctatatccatgctctccctgcgtggtgttgtttgtgagctctatgatttcctagatgtgctaattggaacagcaaatggattgcaaatattgctgttatgtaaacattacaggcagacaattgggagcttttggccccatcttgttcgtttcctgcgtagcactcggtagtgtcgtcttgtgaaccagatttatgtgctgagattgttcaatattatttgttcattgtgcgggtttca

SEQ ID NO: 1997 - DNA, 2100 bp, Setaria italica
ccaccaccagacagagcagtcgaaaaaccctcgccgccgcgccgcctcgtcgtctccgccgcagatctcccaccagaaagccccaatctccccgcaaccccgaagctccccgccatgtcggcgatgctgcaaccgcaggtcatcctgctcaaggagggcacggacacgtcgcaggggaaggcgcagatggtgagcaacatcaacgcgtgcacggcggtggtggacacggtgcgcaccacgctgggaccccgcggcatggacaagctcatccacgacgacaagggcggcgtcaccatctccaacgacggcgccaccatcatgcgcctcctcgacatcgtccaccccgccgccaatatcctcgtcgacatcgccaggtcgcaggactccgaggttggtgatgggactactactgtggtgcttctagctggtgaatttttaaaggaggcaaagccttatattgaggacggtgtacaccctcacagtctaattcgcagttataggactgctggccatttggcgactgagaaagttaaagagctggcggttagcatagaagggaaaagccttgaagaaaagaaaatactgttagccaaatgcgctgcaacaacgctctcatcgaagttaataggcggcgagaaagagttctttgcttctatggttgttgatgctgtgcttgctattggaaatgatgacaggcttaacatgattggaataaaaaaggttcctggaggtactatgagagattctttccttgttaatggtgttgccttcaaaaagacgttttcatatgctgggtttgagcaacagccaaagaaattcttgaatccaaagattcttttgctcaacattgagcttgagctgaaatctgagaaagaaaatgcagagattagattgtcagaccctctgcaataccagtcaattgttgacgctgagtggaacattatttatgataaattggataaatgtgtaaaaagtggggcaaaaatagtgctttctcggttggcaattggtgatctcgcaacacaatatttcgcagatcgtgacattttctgtgctggccgtgttacggaagaggatttacagcgtgttgcagcagcaaccggtggattcgttcagacatctgtgaacaatgtcatcgacgaggttcttggttcctgtgaagtattcgaggaaaggcaagtgggaaatgaacggtttaacatattcagtggctgtccttctggtcaaacagcaaccatagtccttcggggtggtgcagatcagttcattgaggaagctgaaagaagtctccatgatgccatcatgattgttaggagagcgcttaagaattcaacagttgtgcctggtggtggtgcgattgatatggaagtaagcaagtatctcaggcagcatgcacggaccatagccgggaagtctcagttttttgttaattcattcgctaaagcacttgaggttattccgagacaactttgtgacaatgctggatttgatgcaactgatgtgctaaataagctcagacagaagcatgcatctggtgaaggtgctaactatggtgtggacatcaacactggtggaattgctgattcttttgctaactttgtgtgggaacctgcagtagtgaagatcaatgctataaatgctgcaactgaagctgcttgtcttattctcagcgtggatgagactgttaaaaaccccaagtctgaaagtgcacaaggtgatgctgctgctatgggtggtcggggccgtggtggagctgcaatgcgtggccgtggtggaaggggtatgaggcggcgataatcaatcgataccacatagtatctttgggtcacttgagtgggtcaaattttggagctgggcccttcctcttcctatatccatgctctccctgcgtggtgttgtttgtgagctctatgatttcctagatgtgctaattggaacagcaaatggattgcaaatattgctgttatgtaaacattacaggcagacaattgggagcttttggccccatcttgttcgtttcctgcgtagcactcggtagtgtcgtcttgtgaaccagatttatgtgctgagattgttcaatattatttgttcattgtgcgg

SEQ ID NO: 1998 - DNA, 1954 bp, Leymus cinereus x Leymus triticoides
ctcgcctctctccaaaccctagctccgcctccgcgcagccactagccatgtcttcgatgatgcaaccgcagatcatcctgctcaaggaggggacggacacgtcgcagggccgcgcgcaggtggtcagcaacatcagcgcgtgcacggcggtggcggacacggtgcggaccacgctgggcccccgcgggatggacaagctcatccacgacgacaagggcaccaccatctccaacgacggcgccaccatcatgcgcctcctcgacatcgtgcaccccgccgccaagatcctcgtcgacatcgccaagtctcaggactccgaggttggtgatggcacaactacggtggtgcttcttgctgcagaattcatgaaggaagctaaaccttacgtggaggatggagtgcatcctcatagtctaatccgtagttataggagcgctggcaacatggcgattgaacgggttaaagaactggcagtcagcatagaaggaaaaagcctcgaagacaagaaatcattgttagccaagtgtgctgccacaacactctcgtcaaaattgataagtggagagaaagagttctttgcttctatggttgtggatgctgtccttgctatcggccatgacgacagacttaaccttattggaattaagaaggttcctggaggtaccatgagagattccttccttgtcaatggtgttgctttcaagaagacattttcctatgctggatttgagcaacaaccaaagaaattcctgaatccaaagattctcttgttgaacattgagctagagttgaagtctgagaaagaaaacgcagagatcagattatcagaccctctgcagtaccaatcaattgttgatgctgaatggaacattatttatgacaagctggacaagtgtgttcaaagtggtgcaaaaatagttctgtcgcggctagctatcggtgatcttgcaacacagtactttgcggatagagacattttctgtgctggtcgcgtcacagaagaggatttacaacgcctaagctcagctacaggcggaactgttcaaacctctgtcaacaatgtcattgatgaggtccttggcacatgtgagcttttcgaggaaaaacaagtaggcaatgaaaggttcaacatatttagtggctgcccttctggtcagacagcaactattgttcttcgtggtggtgctgaccagttcatagaggaagctgaaagaagtctccatgatgccatcatgatcgtgaggagagctgttaggaattcaacagttgtgcctggtggtggtgccattgatatggagataagcaagtatctccgcctgcatgcacggacaatagctggaaagtctcagttttttgtaaattcatttgctaaagcccttgaggttattcctaggcaactttgtgataatgctggatttgacgcaactgatgtgctcaataagctcagacagaaacatgcagctgatggtggtgctaattatggtgttgacatcaacactggtggaattgcggattccttcgctaactttgtgtgggaacctgcagtcgtgaagatcaatgcaattaatgctgccaccgaagctgcctgccttattctgagtgttgacgaaacagtgaaaaacccaaagtcggagagtgcgcaaggtgatgctgctgcgatgggcggccgtggtggaggggcaatgcgtggccgaggcggcaggggaatgcgcaggcggtaaattctagtcaactccgccctgtaaccttatgctgccctggcggggttagattttgagttccctctgttcgggctgttggtactggcattacccgcatccaggttttgcggaatttgtatgtctgatgtgagagcttttagtgttaagaatgtgctagccttttgtttgagaacatggaagacatggcaggcgtgtgtttatctagcggttaccggttgtggtattatagcaca

SEQ ID NO: 1999 - DNA, 2211 bp, Hordeum vulgare
cggaccttcgcaacctaaaccgcaaaacccttttccctcctccccctcccctctcggcctcttccttctcgcgccgcccagatctctcgcctcactccaaaccctagctccgcctccgcgcagccaccagccatgtcgtcgatgatgcaaccgcagatcatcctgctcaaggaggggacggacacgtcgcagggccgcgcgcaggtggtcagcaacatcagcgcgtgcacggccgtggccgacacggtgcggaccaccctgggcccccgcgggatggacaagctcatccacgacgacaagggcaccaccatctccaacgacggcgccaccatcatgcgcctcctcgacatcgtgcaccccgccgccaagatcctcgtcgacatcgcaaagtctcaggactcggaggttggtgatggcacaactacggtggttcttcttgctgcggaattcatgaaggaagctaaaccttatgtggaggatggagtgcatcctcatagtctaatccgtagttacaggagtgccggcaacatggcaattgaaagggttagagaactggcagtcagcatagaaggagaaagcctggaagagaagaaatcattgttagccaagtgtgctgccacgacactctcgtcaaaattgataagtggagagaaagagttctttgcttcgatggttgtggatgctgtccttgctatcggtcatgatgacagacttaaccttataggaattaagaaggttcctggaggtaccatgagagattccttccttgtcaacggtgttgctttcaagaagacattttcctatgctggatttgagcaacaaccaaagaaattcctgaatccaaagattcttttgttgaacattgagctagagttgaagtctgagaaagaaaatgcagagatcagattatcagaccccatgcagtaccaatcaattgttgatgctgaatggaacattatttatgacaagctggacaagtgcgttcaaagtggcgcaaaaatagttctgtcacggctagctatcggtgaccttgcaacacagtattttgcggatagagacattttctgtgctggtcgcgtcacagaagaggatttacaacgcctaagctcagctacaggcggaactgttcaaacctccgtcaacaatgtcattgatgaggtccttggcacatgtgaggttttcgaggaaaagcaagtaggcaatgaaaggttcaacatatttagtggctgcccttctggtcagacagcaactattgttcttcgtggtggtgctgaccagttcatagaggaagctgaaagaagcctccatgatgccatcatgattgtgaggagagctgttaggaattcaacagttgtgcctggtggtggtgccattgatatggagataagcaagtatctccgcctgcatgcacggaacatagctggaaagtctcagttttttgtaaattcatttgctaaagcccttgaggttattcctaggcaactttgtgataatgctggatttgacgcaaccgatgtgctcaataagctcagacagaagcatgcaactgatggtggtgctaattatggtgttgacatcaacactggtggaattgcggattccttcgctaactttgtgtgggaacctgcagtcgtgaagatcaatgcaattaatgctgcaactgaagctgcctgtcttattctgagtgttgatgaaacagtgaaaaacccaaagtcggagagcgcacaaggtgacgctgctgcgatgggcggccgtggtggagggggaatgcgtggccgaggcggccggggaatgcgcaggcggtaaattctagtcaactccgccctgtaaccttatgctgccctggcggggtcagattttgagttccctctgttcaggctgttggtcctggcatttgcccgcatccaggttttgcggaatttgtatgtctgatgtgagtttctagtgttaagaatgtgctagccttttctttgagaacatggaggacatggcaggcgtgtgtttatctagcggttactggttgtgtggtattatagcacgaattatgttcttgtttttgtgattcgtctttttccgattggttgatgtgatgtgctggctctaaatgtgctcgtgaggccttgattgcctggctggttgagcactatccagtcaattttcacaaaatactgatgttggtagtataaacttccagtcaattttcacaaaaac

SEQ ID NO: 2000 - DNA, 2218 bp, Triticum aestivum
gagggttgtgtgggctttcagacggacctcgcaacctaaaccgcaaaacccttttccctcctccccacttccctctcggcctctttcttctcgcgccgcccagatctctcgccccactccaaaccctagctccgcctccgcgcagccaccagccatgtcgtcgatgatgcaaccgcagatcatcctgctcaaggaggggacggacacgtcgcagggccgcgcgcaggtggtcagcaacatcagcgcgtgcacggcggtggccgacacggtgcggaccaccctggggccccgcgggatggacaagctcatccacgacgacaagggcaccaccatctccaacgacggcgccaccatcatgcgcctcctcgacatcgtgcaccccgccgccaagatcctcgtcgacatcgccaagtctcaggactccgaggttggtgatggcacaactacagtggtgcttcttgctgcagaattcatgaaggaagctaaaccttacgtggaggatggagtgcattgtcataatataatccgtagttataggagcgctggcaacatggcgattgaaagggttaaagagctggcagtcagcatagaaggaaaaagcctggaagaaaagaaatcattgttagcaaagtgtgctgccacaacactctcgtcaaaattgataagcggagagaaagagttctttgcttctatggttgtggatgctgtccttgctattggtcatgatgacagacttaaccttattggaattaagaaggttcctggaggtaccatgagagattccttccttgtcaatggcgttgctttcaagaagacattttcctatgctggatttgagcaacaaccaaagaaattcctgaatccaaagattcttttgttgaacattgagctagagttgaagtctgagaaagaaaacgcagagatcagattatcagaccctctgcagtaccaatcaattgttgatgctgaatggaacattatttatgacaagctggacaagtgtgttcaaagtggcgcaaaaatagttctgtcgcggctagctatcggtgatcttgcaacacagtatttcgcggatagagacattttctgtgctggtcgggtcacagaagaggatttacaacgcctgagctcagctacaggtggaactgttcaaacctctgtcaacaatgtcattgatgaggtccttggcacatgtgagatttttgaggaaaagcaagtaggcaatgaaaggttcaacatatttagtggctgcccttctggtcagacagcaactattgttcttcgtggtggtgctgaccagttcatagaggaagctgaaagaagtctccatgatgccatcatgattgtgaggagagctgttaggaattcaacagtcgtgcctggtggtggtgccattgatatggagataagcaagcatctccgcctgcatgcacggagcatagctggaaagtctcaggtttttgtaaattcatttgctaaagcccttgaggttattcctaggcaactttgtgataatgctggatttgacgcaactgatgtgctcaataagctcagacagaagcatgcagctgatggtggtgctaattatggtgttgacatcaacactggtggaattgcggattcctttgctaactttgtgtgggaacctgcagtcgtgaagatcaatgcaattaatgcagcgaccgaagctgcctgccttattctgagtgttgacgaaacagtgaaaaacccaaagtcggagagtgcgcaaggtgacgctgctgcgatgggtggccgtggtggagggggaatgcgtggtcgaggcggcaggggaatgcgcaggcggtaaattccagtcagctccgccctgtaaccttatgctgccctggcggggtcagattttgagttccctctgttcgggctgttggtcctggcattacccgcatccaggttttgcggaatttgtatgtctgatgtgagagtttctagtgttaagaatgtgctagccttttgtttgagaacatggaagacatggcaggcgtgtgtttatctagcggttaccggttgtggtattatagcacgaactatgttcttgttttggtgattcgtcttgcctattggtctatattatgttcgcgagatcttgattgcctcgctggttgagaactaactttgctaactttaactctctgatgttattggcgtgttgtttgaaatgctgatatcggtagtagtgaga

SEQ ID NO: 2001 - DNA, 1777 bp, Secale cereale
ggacctcgcaacctaaactgcaaaacccttttccctcctccccctcccctctcggcctcttccttctcgcgccgcccagatctctcgcctcactccaaaccctagctccgcctccgcgcagccaccagccatgtcgtcgatgatgcaaccgcagatcatcctgctcaaggaggggacggacacgtcccagggccgcgcgcaggtggtcagcaacatcagcgcctgcacggcggtggccgacacggtgcggaccaccctggggccccgcgggatggacaagctcatccacgacgacaagggcaccaccatctccaacgacggcgccaccatcatgcgcctcctcgacatcgtgcaccccgccgccaagatcctcgtcgacatcgccaagtctcaggactcggaggttggtgatggcacaactaccgtggtgcttcttgctgcagaattcatgaaggaagctaaaccttacgtagaggatggagtgcatcctcatagtctaatccgtagttataggagcgctggcaacatggcgattgcaagggttaaagaactggcagtcagcatagaaggaaaaagcctggaagagaagaaatcgttgttagccaagtgtgctgccacaacactctcatcaaaattgataagtggagagaaagaattctttgcctctatggtcgtggatgctgtccttgctatcggtcatgatgacagactcaaccttattggaattaagaaggttcccggaggtaccatgagagattccttccttgtcaatggtgttgctttcaagaagacattttcctatgctggatttgagcaacaaccaaagaaattcctgaatccaaagattcttttgttgaacattgagctagagttgaagtctgagaaagaaaacgcagagatcagattatcagaccctatgcagtaccaatcaattgttgatgctgaatggaacattatttatgacaagctggacaagtgtgttcaaagtggcgcaaaaatagttctttcacgactagctatcggtgatcttgcaacacagtattttgcggatagagacattttctgtgctggtcgcgtcacagaggaggatttacaacgcctaagctcagctacaggcgggactgttcaaacctctgtcaataatgtcattgatgaggtccttggcacatgtgaggtttttgaggaaaagcaagtaggcaatgaaaggttcaacatatttagtggctgcccttctggtcagacagcaactattgttcttcgtggtggagctgaccagttcatagaggaagctgaaagaagtctccatgatgccatcatgattgtgaggagagcagttaggaattcaacagttgtgcctggtggtggtgccattgatatggagataagcaagtatctccgcctacatgcacggactatagctggaaagtctcagttttttgtaaattcatttgctaaagcccttgaggttattcctaggcaactttgtgataatgctggatttgacgcaactgatgtgctcaataagctcagacagaagcatgcagctgatggtggtgctaattatggtgttgacatcaacactggtggaattgccgattccttcgctaactttgtgtgggaacctgcagtcgtgaagatcaatgcaattaatgctgccaccgaagctgcctgccttattctgagtgttgacgaaacagtgaaaaacccaaagtcggagagtgcgcaaggtgatgctgctgcgatgggcggccgaggtggaggggcaatgcgtggccga

SEQ ID NO: 2002 - DNA, 2272 bp, Elaeis guineensis
cgttgctcgaagcaaaccccagtatcgcactcccattgacgccgtctttctttcctcctctcttctgaagccctctcgctcgaaccttctaccgcccactcctctcttcccctccttcgctctcttccctctccctctctcgctccccgcttcctctgctccaatggcggcgatgctgcaaccccagatcatactgctaaaggaggggacggacacctcccaggggagggcgcaggtggtgagcaacatcaacgcctgtaccgcggtggccgacgccgtccgcaccacgctggggcctcgcggaatggacaagctcatccacgacgacaagggcaacaccaccatctctaatgacggcgccaccatcatgaagctccttgacatcatccaccctgccgccaagatcctcgtcgacatcgccaagtcccaggactccgaggttggtgatgggaccaccactgtagtgcttcttgctggtgagttcctaaaggaggcgaagcctttcattgaggatggagtccaccctcaaaatctcattcgaagttatcggactgcatcttatttggcaattgacaagattaaagagcttgctgttagcatagaggggaaaagccttgaagaaaagaaaaccttattggcaaaatgtgctgccacaacactctcttcaaaacttattggtggtgagaaggagttttttgcttccatggtcgttgatgctgtcatggctattggcaatgatgataggctaaatttaattgggattaaaaaggtgccagggggtaacatgagagattcatttcttgtcaatggtgttgctttcaagaagacattttcctatgctggttttgagcagcaaccaaagaagtttcttaatccaaagatccttttgttaaacattgagttagagttgaagtcagagaaagaaaatgcagaaatcagattatcagaccctatgcaatatcaatcaatcgttgatgctgaatggaatatcatctatgacaagttagataagtgtgttaaaagtggagcaaaaattgttctttcacgattggcaattggtgaccttgcaacacagtattttgcagatagggatattttctgtgctggtcgtgtaacagaagaggatctgcaacgtgttgctgcagcgaccggtggaactgtgcagacttctgtcaacaatattattgatgaggttcttggatcctgtgaagtatttgaggaaaaacaagtaggcaatgaacggtttaacattttcagtggctgcccctctggtcagacagcaaccattgttcttcgcggtggtgcagatcagttcatcgaggaagctgaaaggagcctgcatgatgccatcatgattgtgaggagggctttaaagaactccactgttgtggctggtggtggtgctatagatatggagataagccgatatttgagacaacatgcacggacaatagctgggaagtcacagttgtttattaactcatatgccaaagctcttgaggttattccacgacaactttgtgataatgctggatttgatgcaactgatgtattaaataagctcagacagaaacatgcttctggtgaaggtgtgaactatggtgtagatatcaacactggaggaattgcagattcctttgctaacttcgtgtgggaacctgcggttgttaagataaatgctataaatgctgcaacagaagctgcgtgtcttatactcagtgtggatgagacagttaaaaatccaaagtcggagagtgcacaaggtgaagctgctgccaatgcaatggctggtcggggccgtggtggagcagccttccgtggtcgtggtggaagaggcatgcgaagacgttgatctcctagtactaaatctgtatgaccattttaattggaacaatagttgtgtttcttgagagcttctatcagattttggtttccaagtcctcttgggtttttaattggtgggagttgaggcacgggctagaccttgctagaaagaaaatgttgtctcagctcatctattgttcaaatgcaggaccaacgggggtcttctcttaggttaacacagctctccggttgttttgtttaagtctgattctgtattttagattgcattagaaggtaaaagagaaaacagactacttggtgtattgatttgtgattcacccttggagacgtcttgttactagtttgcttaaatatgtacttgattggagtgagttatcgtaattttaccctaaaaaaaaaaaaaaactaagtagaactagcgaacgac

SEQ ID NO: 2003 - DNA, 2553 bp, Cocos nucifera
ataaatctgattcgaatccaaacattttgagttgatctaggtcataatttacctcaaccccaacttgattagctaatggattgagcttttgtcccaaatatcaaattagtttagatcaaggccaagcatgctccacgtccaactcgacccgtagcgccacgtacgagtgagggtaaaagataacagatttacccttcggggaatatatattcacgcagaataaacaggaaataattgaaccgcgcattccgtatcactattctcacacatcttaaagtaaagcttaagtgagtcgaagggaactcaagggagccgaacgggcgtccgttacttaaagcaaaccccagtaccgcactcctatagacgccgtctttccttcctgctctcttctgaagccctctcgctcgaaccttctaccgcccactcctctcttcccctccttcgctctcttctctctccctcgctagctccccgcttcctctgctccaatggcggcgatgctgcaaccccagatcatactgctgaaggaggggacggacacctcccaggggagggcgcaggtggtgagcaacatcaacgcctgtaccgcggtggccgacgccgtccgcaccacgctggggccccgcgggatggacaagctcatccatgacgacaagggcaacaccaccatctccaatgacggcgccaccatcatgaagctcctcgacatcgtccaccctgccgccaagatcctcgtcgacatcgccaagtcccaggactccgaggttggtgatggaaccaccactgtagtgcttcttgctggtgagttcttaagggaggcaaagcctttcattgaggatggagtccaccctcaaaatctcattcgaagttatcggactgcatcctatttggcaattgacaaaattaaagagcttgctgttagcatagaggggaaaagccttgaagaaaagaaaaccttattggcaaaatgtgctgccacaacgctctcttcaaaacttattggtggtgagaaggagttttttgcttccatggtcgttgatgctgtcatggctattggcaatgatgataggctaaatttaattgggattaaaaaggtgcctgggggtaacatgagagattcatttcttgtcaatggtgttgcttttaagaagacattttcctatgctggttttgagcagcaaccaaagaagtttcttaatccaaagatccttttgttaaacattgagttagagttgaagtcagagaaagaaaatgcagaaatcagattatcggaccctgtgcaatatcaatcaattgttgatgccgaatggaatatcatctatgacaagttagataagtgtgttaaaagtggagcaaaaattgttctttcacgattggcaattggtgaccttgcaacacagtattttgcagatagggatattttctgtgctggtcgtgtgacagaagaggatctgcgacgtgttgctgcagcaacgggtggaactgtgcagacttctgtcaacaatattatcgatgaggttcttggatcctgtgaagtgtttgaggaaagacaagtaggcaatgaacggtttaatattttcagtggctgcccttctggtcagacagcaaccattgttcttcgtggtggcgcagatcagttcattgaggaagctgaaaggagcctgcatgatgccataatgattgtcaggagggctttaaaaaactccactgtcgtggctggtggtggtgctatagatatggagataagccgatatttgagacaacatgcccggacaatagctgggaagtcgcagttgtttattaactcatatgccaaagctcttgaggttattccacgacaactttgtgataatgctggatttgatgcaactgatgtattaaataaactcagacagaaacatgcttctggtgaaggtgtgaactatggtgtagatatcaacactggaggaattgcagattcctttgctaacttcgtgtgggaacctgcggttgttaagataaatgctataaatgctgcaacagaagctgcatgtcttatactgagtgtggatgagaccgttaaaaatccaaagtcggagagtgcacaaggtgaagctgctgccaatgcaatggctggtcggggccgtggtggagcagccttccgtggtcgtggtggaagaggcatgcgaagacgttgatctcccagtactaaatctgtacgaccattttaataggaacaatagttgtgtttcttgagagcttctatcagattttggtttccaagtcctaatgggtttttaattggtgggagttgaggcacggtctagggaagaaaatgttgtctcagctcatctatttttcaaatgcaggaccaagatggatctttctttaagttaactcagctgtccggttgttttgtttaaaagtctgattctgtattttagattgcattataaggtaaaagagaaaacagactacttggtgtattgatttgtgattcacccttggcgacatcttgttactactttgcttaaatatgcacttgatcggagtgagttatcgtgtttctcaaaa

SEQ ID NO: 2004 - DNA, 2006 bp, Musa acuminata
ctaatacgaaccctcacccccgagcttatcacgatctgcttccccgctcttctcctcctcctcctttctctgctccgatggcggcgatgctgcaaccccagatcattcttctcaaggagggcacggacacctcgcaggggaaggcgcaggtggtgagcaacatcaatgcctgcacggccgtagccgacgccgtccgcacgacgctgggcccccggggaatggacaagctcatccacgacgaaaagggcagcaccaccatctccaatgacggcgccaccatcatgaagctgcttgacatcgttcatcctgccgccaagattcttgttgacattgctaagtcacaggactccgaggttggtgatggaaccaccactgtagtgcttcttgctggtgagttcttaaaggaggcaaaacctttcattgaagatggggtccaccctcagaatcttattcgaagttaccgaactgcatcctttttggccattaacaaaatcaaagaaattgctgtaagcatagaggggaaaagtcttgaagaaaagaaatccttgttggcaaaatgtgctgccacaacactctcatcaaagctaattggtggtgagaaggaattctttgcatccatggttgtggatgctgtccttgctattggcaatgatgataggcttaatttgattgggataaaaaaggtccctgggggtaacatgagagattcatttcttgttaatggtgttgcattcaagaagacattctcttatgctggttttgagcagcagccaaagaaatttttaaatccgaagatccttttgttgaatatcgaactagaattgaagtcggagaaagaaaatgcagaaatcagattatccgaccctttacaatatcaatcaattgttgatgccgaatggaatattatctatgacaaattagataagtgtgttaaaagtggagcaaaaattgtcctctcccgattggccattggtgaccttgcaactcagtattttgcagatagagatattttctgtgctggtcgtgtgacggaggaagatttacaacgtgtagctgctgcaactggtggaactgtccagacctctgtcaacaatgttattgatgaggttcttggatcctgtgaagtgtttgaggaaagacaagtaggcaacgaaaggtttaacatttttaatggatgtccttctggtcagacggcaaccattgttctccgaggtggtgcagatcagttcattgatgaagctgaaaggagccttcatgatgccattatgatagtgaggagagctttaaagaactccaccattgtgcctggtggtggtgctattgatatggagctaagccgatatttgagactgcatgcacgcacaatagctggaaagtcacagctatttatcaattcatatgccaaagctcttgaggtaattccacggcaactttgtgacaatgctggatttgattcaactgatgtacttaacaaactcagacagaagcatgcatctggcgaaggtgcaaattttggtgtggaaatcaatactggtggaattgctgattcttttgctaactttgtatgggagcctgcagttgtcaagatcaatgctataaatgctgcaactgaagctgcttgtctcatcttaagtgtggatgaaactgtgaaaaacccaaagtcggagagcgcacaaggtgaagctgctgcaaatgctatggctggtcgtggtggaccagctttccgaggtcggggtggaagaggcatgcggagacggtgaattcctgactaatatatgttatagcttgattgagattccaagtttcagggagctttttttcttttcctttttccttttctttcttgacttcacaatccacattaactctcagcatcattcatcagagtttcgggttgcttccccattgttgaccgaaaacctagtcttggttttgttgctgtgatgtggtgtcagtttatttcttggccatgttgcagtacagtttcttgatttaaggtttctaca

SEQ ID NO: 2005 - DNA, 2278 bp, Cocos nucifera
ccgtctttccttcctgctctcttctgaagccctctcgctcgaaccttctaccgcccactcctctcttcccctccttcgctctcttctctctccctcgctagctccccgcttcctctgctccaatggcggcgatgctgcaaccccagatcatactgctgaaggaggggacggacacctcccaggggagggcgcaggtggtgagcaacatcaacgcctgtaccgcggtggccgacgccgtccgcaccacgctggggccccgcgggatggacaagctcatccatgacgacaagggcaacaccaccatctccaatgacggcgccaccatcatgaagctcctcgacatcgtccaccctgccgccaagatcctcgtcgacatcgccaagtcccaggactccgaggttggtgatggaaccaccactgtagtgcttcttgctggtgagttcttaagggaggcaaagcctttcattgaggatggagtccaccctcaaaatctcattcgaagttatcggactgcatcctatttggcaattgacaaaattaaagagcttgctgttagcatagaggggaaaagccttgaagaaaagaaaaccttattggcaaaatgtgctgccacaacgctctcttcaaaacttattggtggtgagaaggagttttttgcttccatggtcgttgatgctgtcatggctattggcaatgatgataggctaaatttaattgggattaaaaaggtgcctgggggtaacatgagagattcatttcttgtcaatggtgttgcttttaagaagacattttcctatgctggttttgagcagcaaccaaagaagtttcttaatccaaagatccttttgttaaacattgagttagagttgaagtcagagaaagaaaatgcagaaatcagattatcggaccctgtgcaatatcaatcaattgttgatgccgaatggaatatcatctatgacaagttagataagtgtgttaaaagtggagcaaaaattgttctttcacgattggcaattggtgaccttgcaacacagtattttgcagatagggatattttctgtgctggtcgtgtgacagaagaggatctgcgacgtgttgctgcagcaacgggtggaactgtgcagacttctgtcaacaatattatcgatgaggttcttggatcctgtgaagtgtttgaggaaagacaagtaggcaatgaacggtttaatattttcagtggctgcccttctggtcagacagcaaccattgttcttcgtggtggcgcagatcagttcattgaggaagctgaaaggagcctgcatgatgccataatgattgtcaggagggctttaaaaaactccactgtcgtggctggtggtggtgctatagatatggagataagccgatatttgagacaacatgcccggacaatagctgggaagtcgcagttgtttattaactcatatgccaaagctcttgaggttattccacgacaactttgtgataatgctggatttgatgcaactgatgtattaaataaactcagacagaaacatgcttctggtgaaggtgcaaattatggtgtagatatcaacactggtggaatcgcagattcttttgctaactttgtatgggaacctgcagttgttaagattaatgctataaatgctgcgacagaagctgcttgtcttatcttgagtgtggacgagacagttaaaaatccaaagtcggagggtgcacaaggtgaagctgctgccaatgcgatggctggccggggtcatgcagcagccctccgtggttgtggtggaagaggcatgcggagacgttgatttcccggtaccagagctgtatgactttatttgggtaaaaagtttttggggtcagttgtgtttcttgaggtgctgctgttggtatttggatccgtgtcatcttcggcttgcaacttgtgggagttgaggcatgagccaggcctgcttgaaacaaatgtggtctgctaatcttttgtccaaaagaggactaatatggggctattctttagttaaggtagcagtctcaaatcattttgttcaaaagcccgtcattctgttagttggattgtattagaggggaaaatgctgccgcttggtttatcttatttttcatattttattattctgctgggaaactttctttttgatctgcaagatttcttattttttctgaaatatctaatcttcgtgttttctgtcgtcaccagaggaaggaaaggcgctagtttccctgggtcaaaaccatttagtttatgttagcaaataaaaac

SEQ ID NO: 2006 - DNA, 2738 bp, Ananas comosus
ccgctcaaaaccctcgtcccctcgccccctctccgttcactcctctccccgacctctacaatggcggcgatgctgcaaccgcagatcatactgttgaaggaggggacggacgcgtcgcaggggaaggcgcagctggtaagcaacatcaacgcgtgcacggcggtggcggacgcggtgcggacgacgctgggcccccgcggcatggacaagctcatccacgacgacaagggcaacaccaccatctccaacgacggcgccaccatcatgaagctcctcgatatcgtccaccccgccgccaagatcctcgtcgacatcgccaagtcccaggactccgaggttggtgatggaactactactgtagtgcttcttgctgctgaattcctgaaggaagcaaaacctttcattgaggatggtgtccattcacagaatctcattcgaagctacaggacagcttcatatttggcaatcgacaaaatcaaagaacttgctgtgagcatagaagggaaaagcctggaagaaaagaaaagtttgttggcaaaatgtgccgctaccacactctcttcaaagctgattggtggtgagaaagagttctttgcatcgatggttgtggatgctgtccttgctattggcaatgatgatagacttaatctaattgggattaaaaaggttcctgggggtaatatgagagattcatttctcgtcaatggtgttgcattcaagaaaacattttcttatgctggatttgaacaacaaccgaaaaagttcttgaatccaaaaattcttttgttgaacattgaactggaattgaagtcagagaaagaaaatgcagaaatcagattatcagacccactccagtatcagtcaattgttgatgctgaatggaatattatctatgacaagttagataagtgtgtgcaaagtggggcaaagatagttctttctcggttggcaattggtgaccttgcaacccagtactttgcagatagggatattttctgtgctgggcgtgtgacagaagaggatctacaacgtgttgctgctgcaactggtggaactgtgcagacttctgttaacaatattattgatgaggttcttggctcctgtgaagtttttgaggaaaaacaagtaggcaatgaaaggtttaatatattcagcggatgcccttctggccagacagcaactatagttcttcgtggtggtgcagatcagtttattgaggaagctgaaagaagtctgcacgatgccatcatgatagtgaggagagctttaaagaattcaactgttgtccctggtggtggtgctatagatatggagataagtcggtttctgaggctgcatgcgaggaccattgctgggaagtcccaactgtttataaattcgtacgccaaagccctcgaggtcattccacggcaactttgtgacaatgctggatatgatgcaacagatgtactgaacaagctcagacaaaaacatgcatctggtgaaggtgcaaactatggggtggacattaatactggtggaatagcagattcctttgctaactttgtatgggaacctgcagttgttaagatcaatgctataaatgctgcaactgaagcggcatgtcttatcctgagtgtggatgagacagttaagaacccaaagtctgagagtgcacaaggtgaagcagctgcaagtgcgatggctggtcgcggccgtggtggagcggcatttagaggccgtggcggaagaggcatgcgaagacgctgaaatccattcccccgaacaccgatctttgtattactttaaattatttttaggtcaccatgagttttgagagggttgctttttgcgagttttctcatgtttttgctttctactttcatttcttctgctttatgggacattcatctgatcagtggtttgggtatagtcttgtttgaagtagaaactgttgtagcactagtaggtttttctatctgccacagtacagcctgcgggctggcaagaaacactgaagactctaatttggttcggtgaggttgccgaggacttacactgggatcgctcatcattgctgtgcatcggcttaaaagtccgggaattagaagggccagtttatatgttctgtacgctgattttgttttttctgtggtattattctggctaaaaaaaggttcttcgtgcgctcttgaatgaaactttctttgtttttttattttaatgatttcagtcgggtgattttaatcattttaatttgggttagttgctattcgttccgtgtctggatgttatttttctagatttgattgtctctggatgttatttttctagcccaaatctttataaccaatgtgtttaaatttaatataaggctaatattagagatttggtgagcattcatttatacagtaggattgttgttgaatttcctggtgtagaaagatggcgcttgttagtgattgttagcggtatgaatgctgcgaccctcttaactgcgctgtctgaacttttttctaattgcagttttatttattttctccctccctgtttctggttcagttatgtttacatggattaagaattttgttaaaatttcgaccacggctgctaagataactcattttgttagctggtggatttaattaaaatttcaattcgttccataaccgtatttaagataagcaactttgagaatatcgaaggaaaaggaaaatagatagccttctaaaatggcttattaatcatggtttcctgta

SEQ ID NO: 2007 - DNA, 2055 bp, Musa acuminata
ccgtagctgccttcggtttccttctcccttcgcctctcctccgcctctcacttcgcctcctccttccgctcagatggcggcgatgatgcaaccccagatcatactgctgaaagaagggacggacacctcgcaagggaaggcgcaggtggtgagcaacatcaatgcttgcacagccgtggctgacgcggttcgcacgacgctgggcccccgaggaatggacaagctcatccacgacgataagggcaacaccaccatctccaatgacggcgccaccatcatgaagctgctcgacatcattcatcccgctgccaagattctcgttgacattgctaagtcacaggactccgaggttggtgatggaaccaccactgttgtgcttcttgctggtgagttcttaaaggaggcaaaacctttcattgaagatggagttcaccctcagaatcttattcgaagttaccgaactgcatcctcgttggccattaacaaaattaaagaacttgctgtaagcatagaggggaaaagccttgaagaaaagaaatctttattggcaaaatgtgcagctacaacactttcttcgaaactaataggtggtgagaaggagttctttgcttccatagttgtggatgctgtccttgctattggcaacgacgacaggcttaatatgatcgggataaaaaaggtccctgggggtaacatgagagattcatttcttgttaatggtgttgcttttaaaaagacattttcttatgctggtttcgagcaacagcccaagaaatttgtaaatccgaagatacttttattgaacattgagttggaactgaagtcagagaaagaaaatgcggaaatcaggctatcggatccattacagtaccaatcaattgttgatgctgaatggaatatcatctatgacaagctagataagtgtgtcaagagtggtgcaaaaattgtcctctctcgattggcaattggtgaccttgcaactcagtattttgctgatcgagatattttctgtgccggtcgtgtcacagaggaagatttacaacgagttgctgctgcaacaggtggaactgttcagacatctgtcaacaacatcatcgatgagattctcggatcctgtgaagtgttcgaggaaagacaagtaggcaatgaacggtttaacatttttaatggctgcccttctggtcagacagcaaccattgttctccgaggtggtgcagatcagtttattgatgaggcagaaaggagccttcatgatgctataatgattgttaggagagctttaaagaactctaccattgtgcctggtggtggcgctattgatatggagttaagccgatatttgagacagcatgcacgtacaatagcggggaagtcacagctatttatcaattcgtatgccaaagctcttgaggtcattccacggcaactttgtgacaacgctggatttgattcaactgatgtactgaacaaactaagacagaagcatgcgtctggggaaggttcaaactatggtgtggatataaatactggtggaattgctgattcttttgctaacttcgtatgggaacctgcagttgtgaaaatcaatgctataaatgctgcaacagaagcttcttgtcttatcttaagtgtggatgagactgtgaagaatcctaagtcggaaagtgcgcaaggtgaagctgctgcaagtgctatgatgggtcgtggtcagggtggaccagccttccgtggccgtggtggaagaggcatgcggcggcgttgattcccgttatcagtttttgtctccacttctacgcttaagctagattgagagtcggtgtatcaggagagctgcttcttttcgcttcaccaccccttttaacttatggacatgagaagtttggattgcagaacctgcttgaactaaatgttgtctcggttttgtcgctggcatggtttgtattatttgatatttggtagtggtttaagaatgtgatgtattctctgtaggtagaaatgcttgattggaaacttctagcccattggaaacacttaacaaaaaattgattctatgat

SEQ ID NO: 2008 - DNA, 2078 bp, Musa acuminata
atggaatgtcttgagctaacgggttcggtggttagcacagcgcaagcccgatccggcccccgtagctgccttcggtttccttctcccttcgcctctcctccgcctctcacttcgcctcctccttccgctcagatggcggcgatgatgcaaccccagatcatactgctgaaagaagggacggacacctcgcaagggaaggcgcaggtggtgagcaacatcaatgcttgcacagccgtggctgacgcggttcgcacgacgctgggcccccgaggaatggacaagctcatccacgacgataagggcaacaccaccatctccaatgacggcgccaccatcatgaagctgctcgacatcattcatcccgctgccaagattctcgttgacattgctaagtcacaggactccgaggttggtgatggaaccaccactgttgtgcttcttgctggtgagttcttaaaggaggcaaaacctttcattgaagatggagttcaccctcagaatcttattcgaagttaccgaactgcatcctcgttggccattaacaaaattaaagaacttgctgtaagcatagaggggaaaagccttgaagaaaagaaatctttattggcaaaatgtgcagctacaacactttcttcgaaactaataggtggtgagaaggagttctttgcttccatagttgtggatgctgtccttgctattggcaacgacgacaggcttaatatgatcgggataaaaaaggtccctgggggtaacatgagagattcatttcttgttaatggtgttgcttttaaaaagacattttcttatgctggtttcgagcaacagcccaagaaatttgtaaatccgaagatacttttattgaacattgagttggaactgaagtcagagaaagaaaatgcggaaatcaggctatcggatccattacagtaccaatcaattgttgatgctgaatggaatatcatctatgacaagctagataagtgtgttaagagtggtgcaaaaattgtcctctctcgattggcaattggtgaccttgcaactcagtattttgctgatcgagatattttctgtgccggtcgtgtcacagaggaagatttacaacgagttgctgctgcaacaggtggaactgttcagacatctgtcaacaacatcatcgatgagattctcggatcctgtgaagtgttcgaggaaagacaagtaggcaatgaacggtttaacatttttaatggctgcccttctggtcagacagcaaccattgttctccgaggtggtgcagatcagtttattgatgaggcagaaaggagccttcatgatgctataatgattgttaggagagctttaaagaactctaccattgtgcctggtggtggcgctattgatatggagttaagccgatatttgagacagcatgcacgtacaatagcggggaagtcacagctatttatcaattcgtatgccaaagctcttgaggtcattccacggcaactttgtgacaacgctggatttgattcaactgatgtactgaacaaactaagacagaagcatgcgtctggggaaggttcaaactatggtgtggatataaatactggtggaattgctgattcttttgctaacttcgtatgggaacctgcagttgtgaaaatcaatgctataaatgctgcaacagaagcttcttgtcttatcttaagtgtggatgagactgtgaagaatcctaagtcggaaagtgcgcaaggtgaagctgctgcaagtgctatgatgggtcgtggtcagggtggaccagccttccgtggccgtggtggaagaggcatgcggcggcgttgattcccgttatcagtttttgtctccacttctacgcttaagcttgattgagagtcggtgtatcaggagagctgcttcttttcgcttcaccaccccttttaacttatggacatgagaagtttggattgcagaacctgcttgaactaaatgttgtctcagttttgtcgctggcatggtttgtattatttgatatttggtagtggtttaagaatgtgatgtattctctgtaggtagaaatgcttgattggaaacttctagcc

SEQ ID NO: 2009 - DNA, 2207 bp, Cocos nucifera
ctcgatcgctcgaaaccttctctcgcctattcgccccgcttgctctctctcctctttttcttctcagctctccaaaaccctaataatcccaaagcctaaatctcttccttttcttcttcctccctctccatctcctcctgttcgccaatggcggcgatgctgcaacctcagatcatattgctgaaggaggggacggacacttcccaggggaaggcgcaggtggtgagcaacatcaacgcctgcacggcggtgacggacgccgtccggaccactatggggccccgcgggatggacaagctcatccacgacgacaagggccacaccaccatctccaacgatggcgccaccatcatgaagctcctcgacatcgtccaccctgctgcgaagatccttgtcgacatcgccaagtcccaggactcggaggttggtgatggaacaactactgtagtgcttcttgcaggcgagttcttaaaggaagcaaaacctttcattgaggatggagtccactctcagaatctcatccaaagttatcgggctgcatcctatctggcgattgacaaaatcaaagaacttgctgttagcatagaagggaaaagcctcgtagaaaagaaaactctattggcaaaatgtgctgctacaactctctcctccaagcttattggtggtgagaaggagttttttgcatccatggttgttgatgctgtcatggctattggcaatgatgataggctaaatttaattgggattaaaaaggtgcctgggggtaacatgagagattcatttcttgtcaatggtgttgcttttaagaagacattttcctatgctggttttgagcagcaaccaaagaagtttcttaatccaaagatccttttgttaaacattgagttagagttgaagtcagagaaagaaaatgcagaaatcagattatcggaccctgtgcaatatcaatcaattgttgatgccgaatggaatatcatctatgacaagttagataagtgtgttaaaagtggagcaaaaattgttctttcacgattggcaattggtgaccttgcaacacagtattttgcagatagggatattttctgtgctggtcgtgtgacagaagaggatctgcgacgtgttgctgcagcaacgggtggaactgtgcagacttctgtcaacaatattatcgatgaggttcttggatcctgtgaagtgtttgaggaaagacaagtaggcaatgaacggtttaatattttcagtggctgcccttctggtcagacagcaaccattgttcttcgtggtggcgcagatcagttcattgaggaagctgaaaggagcctgcatgatgccataatgattgtcaggagggctttaaaaaactccactgtcgtggctggtggtggtgctatagatatggagataagccgatatttgagacaacatgcccggacaatagctgggaagtcgcagttgtttattaactcatatgccaaagctcttgaggttattccacgacaactttgtgataatgctggatttgatgcaactgatgtattaaataaactcagacagaaacatgcttctggtgaaggtgtgaactatggtgtagatatcaacactggaggaattgcagattcctttgctaacttcgtgtgggaacctgcggttgttaagataaatgctataaatgctgcaacagaagctgcatgtcttatactgagtgtggatgagaccgttaaaaatccaaagtcggagagtgcacaaggtgaagctgctgccaatgcaatggctggtcggggccgtggtggagcagccttccgtggtcgtggtggaagaggcatgcgaagacgttgatctcccagtactaaatctgtacgaccattttaataggaacaatagttgtgtttcttgagagcttctatcagattttggtttccaagtcctaatgggtttttaattggtgggagttgaggcacggtctagggaagaaaatgttgtctcagctcatctatttttcaaatgcaggaccaagatggatctttctttaagttaactcagctgtccggttgttttgtttaaaagtctgattctgtattttagattgcattataaggtaaaagagaaaacagactacttggtgtattgatttgtgattcacccttggcgacatcttgttactactttgcttaaatatgcacttgatcggagtgagttatcgtgtttct

SEQ ID NO: 2010 - DNA, 2238 bp, Theobroma cacao
gaaccagaacactcttcctctcccactctgctcctttcttccacctaaaagaactagcaaaaccctagctacaatggcagccatgctgcaaccccaaatcattcttttgaaagaagggaccgatacgtcccaggggaaggctcagctcgtcagcaacataaacgcttgcactgccgtcgctgacgtggttagaacaaccctgggtcccaggggtatggacaaactcatccacgatgacaaagggaacgtcaccatttccaatgacggcgccaccatcatgaagcttctcgatatcgtccaccctgccgccaagatcctcgtcgatatcgccaagtctcaggactcagaggttggtgatggaactacaactgttgtactactagcaggggagtttttgaaagaggccaagccttttgtagaggatggagtccaccctcaaaatctcattcggagttatcgaactgcttgctatttggcaattgagaaggtcaaagaactagctgttagcatagaggggaaaagtctagaagagaagaaaagcttattagctaaatgtgctgcaacaacactctcttcaaaactcattggtggggaaaaggagttctttgcgtcaatggttgtggatgctgttattgctattggcaatgatgataggttaaatttaattggagttaagaaggttccaggtggtaccatgcgtgactcctttttggttaatggtgttgcctttaaaaagacattttcatatgcgggtttcgaacagcagccaaagaagtttctgaatcccaagatacttttgttaaacattgagttggaactgaaatctgagaaagaaaatgccgagataagactttcagatccatcacaatatcaatcaattgttgatgcagaatggaatatcatttatgacaagttggataaatgtgtgaagagtggtgcaaaagttgttctctcacggttggctattggtgatctggcgacacagtatttcgcagatagagatattttctgtgctggtcgtgtagctgaggaagatcttcaacgggttgctgctgcaactggtggaaccatacaaacatctgttaacaacataatcgatgaggttttagggacatgtgaggtttttgaggaaaggcaggttggaaatgagaggtttaatatattcagcggttgcccatcaggacggacagccactatagttcttcgtggtggagctgaccagttcattgaagaggcggagaggagtttacatgatgcaattatgattgttagaagagctttgaagaactctactgtagttgctggaggtggtgcaatagatatggagataagtcgatacttgaggcagcatgcacgaacaatagctgggaagtctcaactttttattaactcttatgcaaaagctcttgaggttatcccacggcagctgtgtgacaatgctggatttgatgcaactgatgtgctgaacaaattaaggcagaagcatgctcttccttctggtgagggtgcgccttacggggtggacatcaacactggtggaatagaagattcatttgcaaactttgtctgggagccatctgttgtaaagatcaatgccatcaatgctgcaactgaggctgcttgtcttattttaagtgtggatgagactgtaaagaatcccaagtcggagagtgcacagggagaagctgctgcaagtgccatggctggcagagggcatggaggtggtttccgtggccgtggacgaggaatgaggaggcgataagccttccaattttgtaacccaaattctgttaaggttgtctattcaaaatgacacagatttttagttaattaggttcttttaccggtattcagtttttggtatggtgcaaattgaactgccatttgaaggctaaactgtgaaggtgcctagtcagatgtgccttcgggacagcggaaaccttgcgttgattgattgattgactttttcgtgaaatgtggctgctcctttggattgctgtagaagttacaacttgttttttaaatctatttctcagaggaatttttgtgagggctgattccttctgtaggtatgatgatgaaatgcgtaggtttccaagcaaaggaagcggatgtggggggtgtcaggtgtggattaatttgtgttacatctacatatgaatattatctgaattgatcttcaatgtattgcaagatttcttcatttagtcgtgtattttcctaatggtattaatttta

SEQ ID NO: 2011 - DNA, 2198 bp, Elaeis guineensis
gcccggcctgctcccttctctctttcttcccagctctccaaaaccctaataatcccaaaacctcaatctcttccctttcttgttcatccctctccatctcctcctattctccaatggcggcgatgctgcaaccccagatcatactgctgaaggaggggacggacacttcccaggggaaggcgcaggtggtgagcaacatcaacgcctgcaccgcggtggcggacgccgtccggaccactctggggccccgtgggatggacaagctcatccacgacgacaagggcaacaccaccatctccaacgatggcgccaccatcatgaagcttctcgacatcgtccaccccgctgccaagatccttgtggacatcgccaagtcccaggactcggaggttggtgatggaacaactaccgtagtgcttcttgcaggcgagttcttgaaggaggcgaaacctttcattgaggatggagtccactctcagaatctcatcagaagttatcggattgcatcctatttggcgattgacaaaatcaaagaacttgctgttagcatagaagggaaaagcctcgaagaaaagaaaactctattggcaaaatgtgccgctacaactctctcctcgaagcttattggtggtgagaaggagttttttgcatccatggttgttgatgctgtcatggctattggcagtgatgataggctaaatttgattgggattaagaaggtccctgggggtaacatgagagattcatttcttgtcaatggtgttgctttcaagaagacattttcttatgctggttttgagcagcaaccaaaaaagtttctgaatccaaaaatccttttgttaaacattgagttagaattgaaatcggagaaagaaaatgcagaaatcagattgtcggaccctttacaatatcaatcaattgttgatgctgaatggaatatcatctacaacaagttagataagtgtgtacaaagtggagcaaaaatcgttctctcacgattggcaattggtgaccttgcaacacagtactttgcagatagggatattttctgtgctggtcgtgtaatggaagaggatctgcaacgtgttgctgcagcaacaggtggaactgtgcagacttctgtcaacaacattattgatgaggttcttggatcctgcaaagtgttcgaggaaagacaagtaggtaatgaacgatttaacatctttagtggttgcccttctggtcagacagcaaccatagttctccgtggtggtgcagatcagttcattgaggaagctgaaagaagcttgcatgatgccataatgattgtcagaagggctttaaagaactccactgttgtggctggtggtggtgctatagatatggagataagccgatatttgagacagcatgctcgggcaattgctggaaagtcacagttgtttattaattcatatgctaaagctcttgaggttattccacggcaactttgtgataatgctggatttgatgcaacggatatactgaacaaactcagacaaaaacatgcttctggtcaaggtgcaaattatggtgtagatatcaataccggtggaatcgcagattcttttgctaactttgtatgggaacctgcagttgttaagattaatgctatgaatgctgcaacagaagctgcctgtcttatcttgagtgtggacgagacagttaaaaatccaaagtcggagagtgcacaaggtgaagctgctgccaatgcaatggctggccggggtcgtggagcagccttccgtggtcgcggtggaagaggcatgcggagacgttgatttcctagtaccagagctgtatgactttaagtgaagttttggagtcagttgtgtttcttgaggtcctgcttttagtattcggatccgtgtcatcttcggcttgtaacttgtgggagttgaggcatgagccaggcctgcttgaaacaaacgtggtctgctaatcttttgtccaaacaggattaacatggggctattatttagttaacgtagcagtctcaaatcattttgttcaaaagcctgtcattctgttagttggattgtattaaaggggaaagctgccacttgatttatcttatttctcaaattttattattttgctaggagactttctttttggtgctgtaagatttcttattttttctgatatttctaatcttcatttctgaaaaaaaaaaaaaa

SEQ ID NO: 2012 - DNA, 2226 bp, Daucus carota
gcagtattacttaaaaaataaaagcagtgtagcggtcaagtgagtagcgcgaaaagaagactgttctgtgtttccaaaaccctagctccttcttcttcatcagtatacacaccacccaaccgcttttactctcatttctccatcacacaacatctctatctccattcaccatgtcaactatgatgcaacctcagattatattgcttaaagaagggacagatacatctcaagggaaggcccagttagtgagcaacattaatgcggttatggctgtggccgatgtggtgcgtaccactcttggaccaaggggtatggacaagttaatccatgacgataagggaaacaccactatttctaatgacggtgcaacgattatgaagcttcttgacattgtacaccctgcagctaagatccttgttgatattgccaaatcacaagactctgaggtgggtgatggaaccactactgtggttcttcttgcaggagagttcttaaaggaggcaaagcccttcattgaagacggcgtgcaccctcaaaacctcattcgcagctatcggactgcttcttatttggcaatcgagaagattaaagaattagcagttagcatagagggaaaaagtttagatgaaaagagaagtctactggctaagtgtgctgctacaaccctctcatcgaagctcataggaggagagaaagagttctttgcatcaatggttgttgattctgtccttgcaattgggaatgatgataggctaaatatgataggcataaagaaggttcccggaggtacaatgcgcgattcttttcttgtgaatggtgttgccttcaaaaagacattctcgtatgctggatttgaacagcaaccaaagaaatttgaaaatcctaagatactattgcttaacattgaactggagctgaaatcagaaaaagaaaatgctgagataaggctatcagacccgttgcagtatcagtcaattgttgatgccgaatggaatatcatttatgataaattggataaatgtgtgaagagtggagccaaaattgttttgtcccgtctggctattggtgatctaggaacacagtattttgcagaccgagatatcttttgcgctggccgtgttgctgaagaggatttgcaacgcgttgctgcggccacaggtggaactgtacagacatcagtcaacaatgtcattgatgaggttcttggatcgtgtgaaatttttgaggagaaacaagttggaaatgagcggtttaatatatttagtggatgcccttctggccagacagcaactattgttctccgtgggggagctgaccagttcatcgaggaagcagaacgcagcttacatgatgcaattatgatagtccggagggctatgaagaactctactgtagttgctggtggtggtgcaatagatatggaaataagtcgatacttgaggcagcatgcacgcacaatagctggaaagtcccagctatttataaactcgtatgcaaaagctctcgaggttattccacgtcaactttgtgacaatgctggatttgatgcaactgatgtgctgaacaaactaaggcagaaacatgcgctagcgtcaggtgagggtgcactatatggtgtagatatcaatactggtggaattgctgattcatatgcaaactttgtgtgggaaccagctgtcgtgaagatcaatgctataaatgcagctacagaggcagcttgtctcattttaagtgtggatgaaactgtaaagaacccaaagtctgagagtgcacagggtgaagctgctgcaggcgcaatgggcagagggcgtggcggtggtgctcttcgcggtcgtggaagagggatgcgcagacgataggttttttagatgtatatttaagtcattgctggttaatttactatttaaagtacccagctataattgcttgagagtccaaccatctgtattttttcttgtttatttatcattttgtatcctacgtagagattcaagtctatgttattgtgatttgtttttagttttgcccttgtagttataatgtattgatccttgtatgcctttggttcacattggaaagtttaccttatgtcctagatttttgtatccttgtaccgcagaacaaaaccacccgggttttataaactatgatcgtttttggttttgaaagtaagattgaattgcagagtagggcaggattactcaatgtcagcagtttatgcgggag

SEQ ID NO: 2013 - DNA, 1997 bp, Allium cepa
agaaactgtaataactcgctcgctacatttttccgtctctcgttcaagccctaaccaaaccctagatcttaagaaatttctagaaatcgaaaacaatgtcgtcaatgctacagcctcagataatccttctaaaagaaggcactgacacatcccagggtaaggcgcaagtgatcagcaatatcaacgcctgcaccggcgtcgccgactgcgtccgtacaaccctcggtccacgtggcatggacaagcttattcacgacgacaaggggaatacgacgatatcgaatgacggtgccacgatcatgaaactgcttgatattgttcatcctgctgctaagattttggttgatattgccaagtctcaggattctgaggttggagatggtacaactacagtagtactccttgctggagaattcttgaaagaggcaaaaccatttatcgaagatggagtccatcctcagaatctcattaggagctatcgtgctgcaagcaatttggccataaacaaagttaaagaacttgctgtaagcattgaagggaagagccttgaagaaaagaaatccttgttggcaaaatgtgctgctacaacactttcatcaaaattaattggcggggagaaggaattctttgctactatggttgtagatgctgtacttgctattggaaacgacgacagattaaatttaattgggattaaaaaagttcccggtggcaccatgagagattcattcctcgtcaatggcgttgcttttaaaaagactttctcatatgctggctttgaacaacagccaaagaaatttctcagtccaaagatacttctgttgaacgttgaactagaactgaagtcagaaaaagaaaatgctgagatcagattgtctgatccattgcaataccaatcaattgttgatgctgagtggaatatcatttatgataaactagataagtgtgttcagagtggagcgaaaattgttctctcaagattggctattggcgaccttgcaactcagtattttgcagatcgagatatcttttgtgctggtagagtagctgaagaagatttgaaacgtgttgctgctgctacaggtggaactgtccagacttctgttaacaatatcattgatgaggttatggggtgttgtgaagtttttgaagaacgacaagtagggaacgagaggttcaatatattcagtggctgcccatctggtcaaactgcaactattgtcctccgtggtggggcagatcagttcattgaagaagctgaaaggagtctgcatgatgctatcatgatagtaagaagggctgtaaagaactccactgttgtcgctggtggtggcgctattgatatggagattagtggatatctacgacagcatgcacgaacgatagctggaaagtctcaactttttataaattcatttgccaaggccctcgaggttattcctagacaactatgtgacaatgctggttttgatgcaaccgatgtcttgaataaactcagacagaagcatgcatctggtcaaggtgcgaactatggtgttgacatcaacactggtggaattacagattctttcgcgaattttgtatgggaaccttctgttgttaagataaatgctataaatgctgctgctgaagctgcttgtctcattttaagtgtggatgaaacagtgaaaaaccccaagtcggagagtgctcagggagaggctgcaggtgcaatgggtggacgtgggcgtggaggagctgcctttcgtggaggtcgtggtggcagaggcatgagaaggcgatgaacttttccattttttgaccgttgccaagtgttttgtgtggtgctttcagatgctatcttattttgtgttccaatgttcgcgttgtatttgttcggggaaagtggtttaggataagacatgataatttgtatgatgaaatcagtgtatgcagatctaatcccgtagctgttaaaagaaatatgattgttttttcaaccaagagcagttgatcgt

SEQ ID NO: 2014 - DNA, 1997 bp, Capsicum annuum
tttctacacaactctataaacctaataataacgagtaagtggaaaaaccctagcacaacttccacttggcttaattgttctactagctcactctcgaagaaataatcgttcaacgtcgccaccaaaaatggcggctatgatgcaacctcagatcatattgctgaaggaagggacagacacgtctcaaggaaaggcacaattagtaagcaacataaatgcatgtatggctgtggctgatgtggtgcgtaccacccttggacctaggggtatggacaagctgatccacgatgataaaggaaacacgactatttcgaatgatggtgccactataatgaagcttctagacataattcatcctgcagcaaaaatacttgttgacattgccaagtcccaagactctgaggttggtgatggaaccactacagttgttctgcttgcaggagaatttttaaaggaggccaagccgtttgttgaagagggtgtccaccctcaaaatcttattcgtagttatcgaaccgcttcaaatatggcaatcgagaaggtaaaagaattggctgttagcatagagggaaaaagtttggaagaaaagaaaagtcttcttgcgaagtgtgctgctactactctttcatcaaagctcattggaggggaaaaggaattctttgcatccatggttgtggatgccgttcttgcaatcggaaatgatgataggctgaacatgattggaattaagaaggtccctggaggtactatgcgggattccttccttgtagatggtgttgcctttaagaagacattttcctatgctggttttgaacagcaaccaaagaagtttgtaaaccccaagatacttttactgaacatagagttggagctaaaatcagaaaaggaaaacgcagagataaggctctcagatccagctcaatatcagtcaattgttgatgcagagtggaatatcatttatgacaagttggataaatgtgtaaagagtggtgccaaagttgttttgtctcgacttgctattggtgatctggccacacagtattttgcagaccgagatatattttgtgctggtcgtgtctctgaagaggatctgcaacgggtagcagctgccgctgggggaactgtacagacaactgtgaacaatgttattgatgaggttctcggctcttgtgagatttttgaggagaagcaagttggaaacgagagattcaatatattcagtggatgtccctcgggcaagaccgccactatagttcttcgtggtggagcagatcagttcattgaggaagctgagagaagcttgcatgatgctataatgattgttagaagggctgtgaaaaactctacggtcgttcctggaggtggtgctatagatatggaaataagccgtttcttgaggcaacatgctcgatcaattcaagggaaatctcagctctttataaactcttatgccaaagctcttgagattattccccgccagctatgtgacaatgctggttttgatgcaactgatgtgctgaacaagctcagacagaaacatgctcttgcttctggtgagggtgctccttatggagttgatataaatactggtggcattgccgattcatttgccaactttgtttgggagccagcagtcgtgaagataaatgccatcaatgcagccactgaagcagcatgcctcattctgagtgtggatgagacggtgaagaatcctaagtccgagagtgcacaaggagatgctgctgctggcgccatgggtggcatgggtggcagagggcgtggacgtgggcgtggaatgagacggcgatagatttcacaagtttgcagattttactatgattttcatttagagtttgatttttctctttgttggctcctcatgtagttctagtgctccccctcttgaccaaacttgttcagctttggatattgattagcatatagaaaccggaaaaatcaaaacagagttgtgttaaattcaggcaatatccagtgaa

SEQ ID NO: 2015 - DNA, 2066 bp, Gossypium hirsutum
ggggacaacataaacccgtagaataccgaagaaatacttgcgaacaaaaccagaacattctccctcactctcacgctttgctcatttcttcccctaaaaccagcaagcaaaaccctagcaacaatggcagccatgctgcaaccgcaaatcattcttttaaaagaagggaccgatacgtcccagggaaaggcgcagctagtgagcaacataaacgcttgcaccgccgtcgctgacgtggttagaacaaccttgggtcccaggggtatggacaagctcattcacgatgacaaggggaacgtcaccatttccaacgacggggctaccatcatgaagcttctcgatattgtccaccccgccgcaaagatcctcgtcgatatcgccaagtctcaggactccgaggttggtgatggaactacaactgttgtactactagcaggagagtttttaaaagaggccaagccttttgttgaggatggagtccaccctcaaaatctaattcggagctatcgaactgcttgctatttggctattgataagatcaaagaactagctgttagcatagagggcaaaagtctagaagagaagaaaagcttattagctaaatgtgctgcaacaactctctcttcaaaactcattggcggggaaaaggtgttctttgcatcaatggttgtggatgctgttatcgctattggcaatgatgataggttgaatatgattggaattaagaaggttccaggaggcaatatgcgggactcctttttggttaatggtgttgcctttaaaaagacattttcatatgcgggttttgagcagcaaccaaaaaagtttctaaatcccaagatacttctgttgaacattgagttggaactgaaatctgagaaggaaaatgctgagataagactttcggatccatcacaatatcaatcaattgttgatgcagaatggaatatcatttatgacaagttggataaatgtgtgaaaagtggtgcaaaagttgttctttcacggttggctattggggatctggcaacacagtattttgcagatagagatattttctgtgctggtcgtgtagctgaggaagaccttcagcgggttgctgctgcaactggtggaaccgtacagacatcagttaacaacataattgatgaggttctagggacatgtgaagtttttgaagaaaagcaagttggaaatgagaggtttaatatattcagcggttgcccatcaggacggacagccactatagttcttcgtggtggagctgatcagttcattgaagaagctgagaggagcttgcatgatgcaattatgattgttagaagagctctgaaaaactctacagtagttgctggaggtggtgcaatagatatggagataagtcgatacttgaggcagcatgcacgcacaatagctgggaagtcgcaactttttattaattcttatgcaaaagctcttgaggttatcccacggcaactgtgcgacaatgctggatttgatgctactgatgtgctgaacaaattaaggcagaaacatgcgcttccatctggcgagggtgcttcttacggagtggacatcaacactggtggaatagcagactcatttacaaactttgtctgggagccatcagttgtaaagagcaatgccatcaacgctgctaccgaggctgcttgtcttattctaagtgtggatgagactgtaaagaatcccaagtcggagagtgcacagggagaagctgctgctagtgccatggctggcagggggcgtggccgtggacgaggaatgaggaggcgttgagacttcacagtttttatgttcaacttgtcttattgttgtctaatgaaaatgaggatggaagattctaattaattaggttttgttcatcttgtatttgttcagtgtttttggccaaattgtttgaagatgtgtgctttttgattgtcattattatgcaactccatgatcataacctttcagcatcggtttcacacaagctttttgttttattaacttccaagtttgcaatatatgtttatatataaaggccagtcatttgccaaaaaaaa

SEQ ID NO: 2016 - DNA, 2138 bp, Gossypium raimondii
acaacataaacccgtagaataccgaagaaatacttgcgaacaaaaccagaacattctccctcactctcacgctttgctcatttcttcccctaaaaccagcaagcaaaaccctagcaacaatggcagccatgctgcaaccgcaaatcattcttttaaaagaagggaccgatacgtcccagggcaaggcgcagctagtgagcaacataaacgcttgcaccgccgtcgctgacgtggttagaacaaccttgggtcccaggggtatggacaagctcattcacgacgacaaggggaacgtcaccatttccaacgacggggctaccatcatgaagcttctcgatattgtccatcccgccgcaaagatcctcgtcgatatcgccaagtctcaggactccgaggttggtgatggaactacaactgttgtactactagcaggagagtttttaaaagaggctaagccttttgttgaggatggagtccaccctcaaaatctaattcggagctatcgaactgcttgctatttggctattgataagatcaaagaactagctgttagcatagagggcaaaagtctagaagagaagaaaagcttattagctaaatgtgctgcaacaactctctcttcaaaactcattggcggggaaaaggtgttctttgcatcaatggttgtggatgctgttatcgctattggcaatgatgataggttgaatatgattggaattaagaaggttccaggaggcaatatgcgggactcctttttggttaatggtgttgcctttaaaaagacattttcatatgcgggttttgagcagcaaccaaaaaagtttctaaatcccaagatacttctgttgaacattgagttggaactgaaatctgagaaggaaaatgctgagataagactttcggatccatcacaatatcaatcaattgttgatgcagaatggaatatcatttatgacaagttggataaatgtgtgaaaagtggtgcaaaagttgttctttcacggttggctattggggatctggcaacacagtattttgcagatagagatattttctgtgctggtcgtgtagctgaggaagaccttcagcgggttgctgctgcaactggtggaactgtacagacatcagttaacaacataattgatgaggttctagggacatgtgaagtttttgaagaaaagcaagttggaaatgagaggtttaatatattcagcggttgcccatcaggacggacagccactatagttcttcgtggtggagctgatcagttcattgaagaagctgagaggagcttgcatgatgcaattatgattgttagaagagctctgaaaaactctacagtagttgctggaggtggtgcaatagatatggagataagtcgatacttgaggcagcatgcacgcacaatagctgggaagtcgcaactttttattaattcttatgcaaaagctcttgaggttatcccacggcaactgtgcgacaatgctggatttgatgctactgatgtgctgaacaaattaaggcagaaacatgcgcttccatctggcgagggtgcttcttacggagtggacatcaacactggtggaatagcagactcatttacaaactttgtctgggagccatcagttgtaaagagcaatgccatcaacgctgctaccgaggctgcttgtcttattctaagtgtggatgagactgtaaagaatcccaagtcggagagtgcacagggagaagctgctgctagtgccatggctggcagggggcgtggccgtggacgaggaatgaggaggcgttgagacttcacagtttttatatccaacttgtcttattgttgtctaatcaaaatgaggatggaagattctaattaattaggttttgttcatcttgtatttgttcagtgtttttggccaaattgtttgaagatgtgtgctttttgattgtcattattatgcaactccatgatcataacctttcagcatcggtttcacacaagctttttgttttattaacttcgaagtttgcaatatatgtttatatataaaggccagtcatttgttatatacttaatagtgagtaaagatcctagaccttatctgaatgtcatcttcagtactgtaaatagaatgaaaatacttgtaata

SEQ ID NO: 2017 - DNA, 2499 bp, Populus trichocarpa
agacgaacatagagaaaaagtagacagaaaggaccagaaaagcgaaaacacccactcaaaaaaacaaaaccctagctctccctctcacttcactactctcgcgctctctctcaatctgcaacaatggcagccatgatgcaaccgcagatcatactactgaaagaaggaaccgacacgtcgcaaggcaaagcgcagttactaagcaacataaacgcgtgcacggcggtggcggatgtggtgaggacgacgttaggacctcgtggtatggataaattgatccatgacgataaaggaaatgtcaccatttctaatgacggcgctactattatgaaattgctcgatattattcatcctgccgccaagatccttgttgatatcgccaagtctcaggattctgaggttggtgatggtactactaccgtagttctacttgcaggggagtttttgaaagaggctaaaccttttgtagaggacggggtccacccacaaaatttaatacggagttatcgaactgcgtgcaatttggcaattgagaaggtcaaagaactagcttctagtatagaaggaaaaagtctagaagagaagaagagcttattggctaaatgtgctgctacaacattatcgtcaaaacttattggtggtgagaaggagttctttgcatcaatggttgtggatgctgtgattgcgatcgggaatgatgataggctaaatatgattggaataaagaaggtcccaggtggtaatatgcgagattcatttctggtgaatggtgttgcctttaaaaagacgttttcttatgcggggtttgaacaacaaccaaagaagtttgtaaatcctaagatactcttactcaacattgagttggagctaaaatctgagaaagaaaatgcagagataaggctgtcagatccatctcagtatcagtccattgttgatgcagaatggaatataatatatgataagttggataaatgtgcacagagtggggcaaaaattgttctttcacgccttgcaattggtgatcttgcaacacagtattttgctgatcgagatattttctgtgctggtcgtgtaagtgaagaagatctgcaaagagttgctgctgcaactggtggaactgtacaaacaactatcaacaacgtaattgatgaggttcttgggacttgtgagattttcgaggaaaagcaagttggaaatgagaggtttaatattttcaatggatgcccttctggaactacagccactattgttcttcgtggtggagcagatcagttcattgaagaggctgaacggagtctacatgatgcaatcatgatagttagaagagctatgaagaactcaaccgtagttgctggtggtggtgctatagatatggaaataagtcggtacttgaggcagcatgctcgcacaatagctgggaagtctcagctgtttatcaactcttatgcaaaagccctcgaggttatcccacgacaactatgtgataatgctgggttcgatgcaactgatgtgctgaacaaattaagacagaaacatgcacttccatctggtgagggtgcaccatatggagtggatatcaacaccggtggaattgcagattcttttgcaaactttgtttgggagccggcagttgtaaagatcaatgctatcaatgctgctactgaggcagcttgtctgatcttaagtgtggacgagacagtaaagaatcccaagtctgaaagcgctcagggagaagcagctgcaggtgctatgggtggacgtggaggaggtggtttccgtggtcgtggacgtgggatgcgaagacgatgagctcaccgaattgcaatttttgttctcttgattttagtttatgatggggttttcaatgtatttatcaatgggactgaaatgatcaatctgaacgtttggtattttgaatctgcgtggcttttctatttgaaagttgatcagttcactgattggtagcttctttctggattatggctgcagcttacttttgtttcttgccctccccatttgtctgcaggagagatattttgtatttttgtttcctttcttgctgaggaaatagtaaaaggcaatagaactcactctttgttgcatttttgtacttgtatttttattccatcttcttgtattttactgtattttaagtattatgatcaaaatctttgtatttttctgtacttatgatttaaatagtaatattcagaaaataaaaatctcataattcattacttcccgaagtattctaggcacggatagtttgacgtatcatatggaaataattttataatatctaagaaaatagatttttattctttatatatatataaaagatttgtcatgatattcagtgtagatagtatttctccataaaatacttgatgaaaatggcgaattaatcttgtcagtaaataaaaataaattcatagaataattcatgttatataattttgttcagttgcaaattatgaagttaaatataggaggttaaag

SEQ ID NO: 2018 - DNA, 1956 bp, Castanea mollissima
aacaatgtcagccatgatgcaaccgcagatcatacttctgaaagaggggaccgacacctcgcaaggaaaggcgcagctagtcagcaacataaatgcctgcaccgccgtcgccgacgtggtgcggaccaccctgggtcccaggggtatggataaactcatccacgacgacaagggcagcgtcaccatttccaacgacggcgccaccatcatgaagctcctcgacatcgtccaccccgccgccaagatcctcgtcgatatcgccaaatcccaagactccgaggttggtgatggaaccactacagtggttctgcttgcaggggagtttctgaaggaggccaagccttttatagaggacggggtccacccgcaaaatttgatacgcagttatcggattgcatccaatttggcacttgaaaaggtcaaagaactagcagttagcatagagggaaaaagtctagaagaaaagaaaagcttgctagctaaatgtgctgctactacactctcttcaaaactcattgggggagaaaaagaattctttgcctcaatggttgttgatgctgtaattgcaattgggcatgaagataggttgaatatgattggaataaagaaggttcctggtggaaacatgcgcgattcctttctggtaaatggtgttgcctttaaaaagacattttcatacgcgggttttgaacagcagccaaagaaatttttaaatcccaagatacttctcttaaacatcgagttggaactgaaatctgagaaagaaaatgctgagataagactttcagatccttcacaatatcagtcaatagtcgatgctgaatggaatatcatatatgacaagttggacaaatgcgtacagagtggggctaaagttgttctttcaaggctggctattggtgatctagccacacagtattttgcagatcgagatattttctgtgctggtcgtgtaacagaagaagatttgcgacgtgttgctgctgcaactggagggactgtacaaacatctgtcaacaatgttattgatgaggttcttgggacttgtgagctttttgaggaaaggcaagttggaaatgagaggttcaatatatttagtggatgtccgtctggcctaacagctaccatagttttgcgtggtggagctgatcagttcattgaggaagctgagcggagtttacatgatgcaatcatgattgttagaagggctatgaagaactccactgtagttgctggtggtggtgctatagatatggagataagtcgatatcttaggcagcatgctcgcacaatagccgggaaatctcagctttttatcaactcttatgctaaagctcttgaggttattccacggcaattgtgtgataatgctggatttgatgcaactgatgttctaaacaaattaagacagaaacatgccctacaatctggtgaaggcgcaaattacggggtggatatcaacactggtggaattaccgattcatttgctaactttgtctgggagccagcggttgtgaagatcaatgctataaatgcggctactgaagctgcctgccttattttaagtgtggatgagacagttaaaaacccaaagtctgaaagtgcacaaggagaagcagctgctagtgccatgggtggtagagggcgtggaggagcaggttttcgtggtcgcggacgtggcatgcgaaggcgataagctcttagaattataatttttggaagccttgtatgcattccaactggtaattttgctattttgacgtgtggaatttgagtgacttgtcttttctactgtcatacactttgccacaggtaaggctttgttatgaaagatgatgatgacctactggtagttaggagcagcacattgtacttaaaatcagaattccatatgcaagggcaacgtttaatttgtgtttctagaattataattggtggtagcaattttgattggag

SEQ ID NO: 2019 - DNA, 1886 bp, Panax ginseng
aaaaggaccgagtggaaaaccctagctccttcttcttcttcttcttcttcttcttcttcttcttctactactatttactatccctctcactaaaactacttcagactttctctctctagacctcgccattcacgatgtcagctatgatgcaacctcagattatattgctgaaagaaggtacagatacgtcccaagggaaggcgcaactggtcagcaacattaatgcttgtatggtggtggcagatgtagtacgtaccactctaggaccaaggggtatggacaagctgattcatgatgacaagggcaataccaccatttctaacgacggtgcaactattatgaagcttcttgacattgtccaccctgcagctaagatccttgtcgacattgctaagtcacaagattctgaggttggtgatggaaccactacagtagttctgcttgcgggagagttcttgaaggaggccaagcctttcgttgaggatggggtgcacccacaaaatctgattaggagttatcggactgcttcctatttggcaatagaaaagatcaaagaattagctgttagtatagaggggaaaagtttagaagaaaagagaagtttactagctaaatgtgctgctacaacactctcatcaaagcttataggcggagagaaggagttctttgcatcaatggttgttgattctgttgttgcaattgggaatgatgataggctaaacatgattggaataaaaaaggtacctggaggtacgatgcgggactctttcctcgtaaatggtgttgccttcaagaagacattttcgtatgccggttttgaacagcaaccaaagaagtttggaaatcccaagatactcttattgaacattgaactggaactaaaatcagaaaaagaaaatgcagagataaggctttcagatccattgcagtatcagtcgattgttgatgcagaatggaatatcatttatgataagttagacaaatgtgtgaagagtggagccaaaattgttctgtcgcggctagctatcggtgatttagcaacccagtattttgcagatcgagatatattttgtgctggtcgtgtttctgaagaggatctgcagcgggtggcagctgcgacaggtggaactgtacaaacatctgttaacaacgttattgacgaggttcttgggtcttgcgagctctttgaggagaggcaagttggaaatgagcggttcaatatatttagtggctgtccctcgggacagacggctactattgtcctccgtggtggagctgatcagttcattgaggaagcagaacgtagtttacatgatgcaattatgatagttaggagggccatgaagaattctactgtggttgctggcggtggtgcaatagatatggagataagcagatacttgaggcagcatgcacgcacaatagctggaaagtcccagctattcataaattcatacgcaaaagctcttgaggttatcccgcggcaactttgtgataatgctggatttgatgcaactgatgtgctgaacaaacttagacaaaaacatgcccttccgtccggtgagggtgcactttatggggtagatgtcaatactggtggaattgctgattccttcgcgaactttgtgtgggagccagcagttgtgaagatcaatgctataaatgctgctactgaggcagcttgccttatcttaagcgtggatgagacggtcaagaatccaaagtctgagagcgcacagggagaagctgctgcaagtgcaatgggcagagggcgtggtggcggtggtcgtggacgagggatgcgtaggcgataggctttcagtgtgtaaatttatgcacgagtcgagttgtttactaatcagagtttttagtcatgattgggtcgt

SEQ ID NO: 2020 - DNA, 2226 bp, Vitis vinifera
gaatcactagatccacaaccgtccacaaagccctcgatctttctcgtgcaaccaagaagcgtagccctagttttctctctttagcgtctcttgccagtttgctttctctttttccctctagtttcgctctatccttgttggtcactatggcagctatgctgcaacctcagatcattctactgaaggaagggacagacacatcgcaagggaaggctcagttggtgagcaacataagtgcgtgtacggtggtagcggatgtagtgagaacaaccctaggtccgaggggtatggacaagctcattcacgatgacaagggaaacaccaccatttccaatgatggtgctaccattatgaagcttcttgacattgttcatccggccgctaagatcctcgttgatattgccaagtcccaagactccgaggttggtgatggaactactaccgtggttctgcttgcaggcgagtttttaaaggaggcaaagccttttattgaggatggggtccacccccaaaatttaattcggagttatcggactgcatcttatttggcaatcgagaagatcaaagaacttgctgttagcatagaggggaaaagtctagaagaaaagaaaagcttattagctaaatgtgctgctacaacgctgtcttcaaagctcattggtggagaaaaggagttctttgcatctatggttgtagattctgtcattgcaattggaaatgatgataggctaaatatgattggaatcaagaaggttccaggcggtaccatgcgggactcttttcttgtaaatggtgttgcctttaaaaagacattttcatatgcggggtttgaacagcaaccaaagaaatttctaaatcccaagatactcctcctaaatattgaattggaactgaaatcagagaaggaaaatgcagagataagactttcagatcccctacaatatcagtcgatagttgatgcagagtggaatatcatttatgacaagttggataaatgtgtgcagagtggggctaaaattgttctttcacggctggctattggtgatctagccacacagtattttgcagatcgagatattttctgtgctggtcgtgtaaccgaagaggatctgcaacgagtggctgctgctactggtggaactgtacagacgactgttaacaacatcattgatgaggttcttggctcttgtgagctttttgaggaaagacaagttggaaatgagcgctttaatatatttagtggatgcccatcaggtcaaacggccactattgttcttcgtggtggagctgatcagttcattgaggaagctgagaggagtttacatgatgcaattatgattgttcgaagggctttgaagaactctactgttgttgctggtggtggtgccattgatatggagataagtcgatacttgaggcaacatgcacgcacgatagctgggaagtctcaactttttattaactcttatgcaaaggctcttgaggtcatcccacgtcaactctgtgataatgctgggtttgatgcaactgatgtgctgaacaaattaagacaaaaacatgcacttccatctggtgaaggtggactttttggagtggatattaacacgggtggcattgctgattcatttgctaactttgtctgggagccagcagtagtaaagatcaatgctatcaatgctgctaccgaggcagcttgccttgtcttaagtgttgatgagacagtaaaaaaccccaagtcagagagtgctcagggagaagctgctgcaagtgccatgggtggtagagggcgaggtggagctttccgtggtcgtggacgaggaatgcgaaggcgttgagggctagatttcatgttggaagcatgattcagttggcaactacaaatgtcaggggttggatctttatgatccctttttgacttacaattatggtgtggttcaagttgtatttagatttgaattcattccaactggtgaagccagcctgtattgactttggaaccccagtaactcacttttggacaatccaaagcttcacacttttgtttgggatgtgggccgagggccattttaggtgggtgaacgcttacatgttggtaggagtataatttgttttctcgttgattttattgtggggagaggagaatatgagaagcgtgatttccattttgctgttgcaatatggaattatattattttggtcatagctattttaatgcaaaactaatgg

SEQ ID NO: 2021 - DNA, 2227 bp, Quercus alba
aaagacagagagccctggaactgaagtgaaaagtaacaaaaccctagccttcatttccctcccatactctctctctctctctcactctcaaaaaccaaacctccacaatccacaacaatgtcagccatgatgcaaccgcagatcatacttctgaaagagggaacagacacctcgcaaggaaaggcgcaactagtcagcaacataaatgcgtgcaccgcagtcgccgacgtggtgcggaccacgctaggtcccaggggtatggataaactcatccacgacgacaagggcagcgtcaccatttccaacgacggcgccaccatcatgaagctcctcgacatcgtccaccccgccgccaagatcctcgtcgatatcgccaagtcccaagactccgaggttggtgatggaaccactacagtagttctgcttgcaggagagtttctgaaggaggccaagcctttcatagaggatggggtccacccgcaaaatttgatacgcagttatcggattgcatccaatttggcacttgaaaaggtcaaagaactagcagttagcatagagggaaaaagtctagaagaaaagaaaagcttgctagctaaatgtgctgctactacactctcttcaaaactcattgggggagaaaaagaattctttgcctcaatggttgttgatgctgtaattgcaattgggcatgaagataggttgaatatgattggaataaagaaggttcctggtggaaacatgcgtgattcctttctggtaaatggtgttgcctttaaaaagacattttcatatgcgggttttgaacagcagccaaagaaatttttaaatcccaagatacttctcttaaacatcgagttggaactgaaatctgagaaagaaaatgctgagataagactttcagatccttcacaatatcagtcaatagtcgatgctgaatggaatatcatatatgacaagttggacaaatgtgtacagagtggggctaaagttgttctttcaaggctggccattggtgatctaggcacacagtattttgcagatcgagatattttctgtgctggtcgtgtaacagaagaagatttgcatcgtgttgctgctgcaactggagggactgtacaaacatctgtcaacaatgttattgatgaggttcttgggacttgtgagctttttgaggaaaggcaagttggaaatgagaggttcaatatatttagtggatgtccgtctggcctaacagctaccatagttttgcgtggtggagctgatcagttcattgaggaagctgagcggagtttacatgatgcaatcatgattgttagaagggctatgaagaactccactgtagttgctggtggtggtgctatagatatggagataagtcgatatcttaggcagcatgctcgcacaatagccgggaaatctcagctttttatcaactcttatgctaaagctcttgaggttattccacggcaattgtgtgataatgctggatttgatgcaactgatgttctaaacaaattaagacagaaacatgccctacaatctggtgaaggcgcaaattacggagtggatatcaacactggtggaattgccgattcatttgctaactttgtctgggagccagcggttgtgaagatcaatgctataaatgcggctactgaggctgcctgtcttattttaagtgtggatgagacagttaaaaacccaaagtctgaaagtgcacaaggagaagcagctgctagtgccatgggtggtcgagggcgtggaggagcaggttttcgtggtcgcggacgtggcatgcgaaggcgataagcacttagaattataatttttggaagccttgtatgcattccaactggtaattttgctattttgacgtgtggaatttgagtgacttgtcttttctactgtcatacactttgccacaggtaaggctttgttatgaaggtgatgatgacctactggtagttaggagcagcatattgtacttaaatcagaattctatatgcaagggcaacgcttaatttgtttttctagaattataattggtggtagcaattttgattggagcttttttattgtttgtagtacatttcccattttgtatttattttaagtattctttttggaggattaaatttgtgttttgtggcttgtactgaacatgacgaatttgttcgtagttgaagttatttagttctcaaaaaaaaaaaaaagttaattaatcgcg

SEQ ID NO: 2022 - DNA, 2102 bp, Allium cepa
tagttaggggggacctagaaccaactagatcaattctgagcctgctactctcacttcagaaactgtaataactcgctcgctacatttttccgtctctcgttcaagccctaaccaaaccctagatcttaagaaatttctagaaatcgaaaacaatgtcgtcaatgctacagcctcagataatccttctaaaagaaggcactgacacatcccaggataaggcgcaagtgatcagcaatatcaacgcctgcaccggcgtcgccgactgcgtccgtacaaccctcggtccacgtggcatggacaagcttattcacgacgacaaggggaatacgacgatatcgaatgacggtgccacgatcatgaaactgcttgatattgttcatcctgctgctaagattttggttgatattgccaagtctcaggattctgaggttggagatggtacaactacagtagtactccttgccggagaattcttgaaagaggcaaaaccatttatcgaagatggagtccatcctcagaatctcattaggagctatcgtgctgcaagcaatttggccataaacaaagttaaagaacttgctgtaagcattgaagggaagagccttgaagaaaagaaatccttgttggcaaaatgtgctgctacaacactttcatcaaaattaattggcggggagaaggaattctttgctactatggttgtagatgctgtacttgctattggaaacgacgacagattaaatttaattgggattaaaaagttcccggtggcaccatgagagattctttccttgtcaatggtgttgcttttaagaagactttctcgtatgctggctttgaacagcagccaaagaaatttctcaatccgaagatacttctgttaaacgttgaactggaactgaagtcagaaaaagaaaatgctgagatcagattgtctgatccattgcaataccaatcaatagttgatactgagtggaatatcatttatgataaactagataagtgtgttcagagtggagcaaagattgttctttcaagattggcaattggcgaccttgcaactcagtatttcgcagaccgagatatcttttgtgctggtagagtagctgaagaagatttgaaacgtgtggctgctgctacaggtggaacagtgcagacttctgttaacaatgtcattgatgaggttatggggtgttgcgaagtttttgaagaacggcaagtagggaatgagaggttcaatatattcagtggctgcccatctggccaaactgcaactattgttctccgtggtggggcagatcagttcattgaagaagctgaaagaagtctgcatgatgctatcatgatagtaagaagggctgtaaagaactccactgttgttgctggtggtggtgctatcgatatggaggttagtggatatctacggcagcatgcacgaacaatagctggcaaatctcaactatttataaattcatttgccaaggcccttgaggttattcctaggcaactatgtgacaatgctggttttgatgcaaccgatgtcttgaataaactcagacagaagcatgcatctggtcaaggtgcgaactatggtgttgacatcaacactggtggaattacagattctttcgcgaattttgtatgggaaccttctgttgtcaagattaatgctataaatgctgccgctgaagctgcttgtcttattttaagtgtggacgaaacagtgaaaaaccccaagtcggagagtgctcagggagaggctgcaggtgcaatgggtggacgtgggcgtgggggagctgccttccgtggaggtcgtggtggccgaggaatgagaaggcgatgaactttgttttttgaccattgccaagttttgcatctgctcctttctgatggtatcttattttgtgtttcaatgttggctttgcatttgtttgtgggaaggggtgtaaggtaagatgataatttgtattgatgaaatctgtgtacgcagagatctaatcccgtagctgttaaaaagaaatatgattgttttttcaactaactgtagttggtagtgtatttaaaacgtttgtcggttatgattcacggttattttttggaaagca

SEQ ID NO: 2023 - DNA, 2372 bp, Petroselinum crispum
caggcacacagttgtgatttgtgaagtgagtagcgagcgcgagaagaagagtgttaacttttctaaaaccctagttccttctgctttcatctctctcatccctctcgtatatacacacacacatattcacacacttcgccatttcacgatgtctactatgatgcaaccacagattatattgttgaaagaagggacagatacgtctcaagggaaggcgcagttggtgagcaacattaatgcagttatggctgtggcagatgtggtgcgtactactcttggaccaaggggtatggacaagttgatccacgatgataaggggaacactactatttctaatgatggtgcaacgattatgaagcttcttgacattgtccaccccgcagctaagatccttgttgatattgccaagtcacaagactccgaggtgggtgatggaacgactacagtggttctgcttgcaggagagttcttaaaggaggcaaagcctttcattgaagatggtgtccacccacaaaacctcattcgcagttatcgaactgcatcctatttggcgatcgagaagattaaagaattagcagttagcatagaggggaaaagtttagatgaaaagagaagtctattagctaaatgtgctgctacaaccctctcatcgaagctcataggcggagagaaggagttctttgcatcaatggttgttgattctgtccttgcaattggaaatgatgataggctaaacatgattggaataaagaaggttcccggaggtacaatgcgcgattcttttctcgtgaatggtgttgcatttaaaaagacattctcatatgctggttttgaacagcaaccaaagaaatttgagaatcctaagatactattgcttaacattgaattggagctgaaatcagaaaaagagaatgctgagataaggttatcagacccattacagtatcagtcaattgttgatgcagaatggaatattatttacgataaattggataaatgtgtgaaaagtggagccaagattgttttgtcccgtctggctattggtgatctaggaacacagtattttgcagacagagatatcttttgtgctggccgtgttgccgaagaggatttgcagagggttgccgcagccactggtggaactgtacagacatcagtcaacaatgtcattaatgaggttcttggatcctgtgaaatttttgaggagaagcaagttggaaatgagcggtttaatatatttagtggatgcccttctggccagacagccactattgttctccgtgggggagctgaccagttcattgaggaagcagagcgcagcttacatgatgcaattatgatagtccggagggctatgaagaactctactgtagttgctggtgggggtgctatagatatggagataagccgatacttgaggcagcatgcacgcacaatagctggaaagtcccagctatttataaactcgtacgccaaagctctcgaggttatcccacgtcaactttgtgacaatgctggatttgatgcaaccgatgtgctgaacaagctgaggcagaaacatgcgctagcatcaggtgagggtgcactttatggggtagatatcaataccggtggaattgctgattcatacgcgaactttgtgtgggaaccagctgtcgtgaagatcaatgctataaatgcagctacagaggcagcttgtcttattctaagtgtggatgaaacggtaaagaacccaaagtctgagagtgcacagggtgaagctgcagcaagtgcaatgggcagagggcgtggcgggggtgctctccgtggtcgtggaagaggaatgcgcagacgataagatttttagatgtatatttacatcatttctggttggcttactactcgaagttcctaggcacgaatgcttgagagttcaaccatttgtatttttcttgttatttatccttttgtatcccaagtagagatttaagtcaatgttatattgttattgtgatttatctcctagtagtacacttttggttataatgctttaatccttgtatgccttcccaattttgactgttaaaagttaacattatgtcctagatttgcatcccatatattgcacgaattttatgagctatgaacatctttggttttcaagagtaaattgcatagtgtcaactgtcaacattactatttgcggtaagttttagtttgtaatgcactacaaagaattggttgaccaccaaataatgatggcgaaccattgtttaaatttcgcttcaagcaaccatacagtggggtgttttacaaggatagaaatagttcaacctcaaatatcaagaattttgtgcaacacgtgagtattcatacttttatttaagggttga

SEQ ID NO: 2024 - DNA, 2003 bp, Solanum tuberosum
gtagaagctcactttctcctcaagatcaaagtcggatcaaatcgcctccaacaatgtctgccatgatgcaacctcagatcatattgctgaaggaagggacagacacgtcccaagggaaggcacagttggtgagcaacataaatgcatgtatggctgtggctgatgtggtgcgtaccacccttggccctaggggtatggacaagttgatccacgatgataaaggaaacaccactatttcgaatgatggtgccactataatgaagcttctagacataattcatcctgcagcaaaaatacttgttgacattgccaagtcccaagactctgaggttggtgatggaaccactacagttgttctgcttgcaggagaatttttaaaggaagccaagccttttgtcgaagagggtgtccaccctcaaaatcttattcgtagttatcgaaccgcttctaatatggcaatcgagaaggtaaaagaattggctgttagcatagagggaaaaagtttggaagaaaagaaaagtctgcttgcgaagtgtgctgctacaactctgtcatcaaagctcattggaggggaaaaggaattctttgcatccatggttgtggatgctgttcttgcaatcggaactgatgataggctgaacatgattggaattaagaaggtccctggaggtactatgcgggattccttccttgtaaatggtgttgcctttaagaagacattttcctatgctggttttgaacagcagccaaagaagtttgtaaaccccaagatacttttactgaacatagagttggagctaaaatcagaaaaagaaaatgcagagataaggctctcagatccagcgcaatatcagtcaattgttgatgcagagtggaatatcatttatgacaagttggataaatgtgtaaagagtggtgccaaagttgttttgtctagactcgctattggtgatctggccacacagtattttgcagaccgagatatattttgtgctggtcgtgtctctgaagaggatctgcagcgggtagcggctgccgctggtggaacagtgcagacaactgtgaacaatgttattgatgaggttcttggctcttgtgagatttttgaggagaagcaagttggaaatgagagattcaatatatttagtggatgtccctcgggcaagaccgctactattgtccttcgtggtggagcagatcagttcattgaggaagctgagagaagcttgcatgatgctattatgattgttcgaagggctgtgaaaaactctacggttgttcctggaggtggtgcgatagatatggaaataagccgtttcttgaggcaccatgctcgaacaattcaagggaaatctcagctcttcataaactcttatgcaaaagctcttgagattatcccccgtcagctatgtgacaatgctggttttgatgcaactgatgtgctgaacaagctcagacaaaaacacgctcttccgtctggtgagggtgcaccttatggagtcgacattaatactggtggcatagctgattcatttgccaactttgtttgggagccagcagtcgtgaagataaatgccatcaatgcagccactgaagcagcatgcctcattctgagtgtagatgagacagtgaagaatcctaagtctgagagtgcacaaggagatgctgctgcaagtgccatgggtggtggtagagggcgtggacgtggacgtggaatgaggcggcgatagatttcacaagttcttttgcagattttgctatgatttttatgtagtgtttgctttttttgcattgtttgctcctcccttctgtagttctagttgtctccctcgatcaaaatgttcaaatttgggcatggattctcatatagcaaccgaaaacaatcaaaacagagttgtgttaagttcaggcaacatccagtgaactaaatcatttttgctgctgtcagttgtgcaatgtacgaagcctgccgttggatatataatattctgtgtattaaactt

SEQ ID NO: 2025 - DNA, 2115 bp, Solanum lycopersicum
gattatttttttttattagacagtaaaataaaagtacaatattgctaaacctaaggagcaaaggaaaaaccctagaatagaagctcacttttctcctcaagatcgaagtcggatcaaatcgcctccaacaatgtctgccatgatgcaacctcagatcatattgcttaaggaagggacagacacgtctcaggggaaggcacagttggtgagcaacataaatgcatgtatggctgtggctgatgtggtgcgtaccacccttggtcctaggggtatggacaagttgatccacgacgataaaggaaacaccactatttcaaatgatggtgccactataatgaagcttctagatataattcatcctgcagcaaaaatacttgttgacatcgccaagtctcaagactctgaggttggtgatggaaccactacagttgttctgcttgcaggagaatttttaaaggaagccaagccttttgtcgaagagggtgtccaccctcaaaatcttattcgtagttatcgaaccgcttctaatatggcaatcgagaaggtaaaagaattggctgttagcatagagggaaaaagtttggaagaaaagaaaagtctgcttgcaaagtgtgctgctacaactctgtcatcaaagctcattggaggggaaaaggaattctttgcatccatggttgtggatgctgttcttgcaatcggaactgatgacaggctgaacatgatcggaattaagaaggtccctggaggtactatgcgggattctttccttgtaaatggtgttgcctttaagaagacattttcctatgctggttttgaacagcagccgaagaagtttgtaaaccccaagatacttttactgaacatagagttggagctaaaatcagaaaaagaaaatgcagagataaggctctcagatccagcgcaatatcagtcaattgttgatgcagagtggaatatcatttatgacaagttggataaatgtgtaaagagtggtgccaaagttgttttgtctagactcgctattggtgatctggccacacagtattttgcagaccgagatatattctgtgctggtcgtgtctctgaagaggatctgcagcgggtagctgctgctgctggtggaacagtgcagacaactgtgaacaatgttattgatgaggttcttggctcttgtgagatttttgaggagaagcaagttggaaatgagagattcaatatatttagtggatgtccctctggcaagaccgccactattgtccttcgtggtggagcagatcagttcattgaggaagctgagagaagcttgcatgatgctattatgattgttagaagggctgtgaaaaactctacggttgttcctggaggtggtgcaatagatatggaaataagccgtttcttgaggcaccatgctcgaacaattcaagggaaatctcagctcttcataaactcttatgcaaaagctcttgagattatcccccgtcagctatgtgacaatgctggttttgatgcaactgatgtgctgaacaagctcagacaaaaacacgctcttccgtctggtgagggtgcaccttatggagttgacattaatactggtggcatagctgattcatttgccaactttgtttgggagccagcagtcgtgaagataaatgccatcaatgcagccactgaagcagcatgcctcattctgagtgtagatgagacagtgaagaatcctaagtctgagagtgcacaaggagatgctgctgcaagtgccatgggtggtggtagagggcgtggacgtggacgtggaatgagacggcgatagatttcacaagttcttttgcagattttgctatgatttttatgtagtgtttgctttttcccccatgtttgctcctcccttctgtagttctagttgtctccctcgatcaaaatgttcaaatttggacatcgattctcatatagcaaccgaaaaacaatcaaaacagagctgtgttaagttcaggcaacatccattaaactaaatcatttttgctgctgtcagttttgcaatgtacgaagcctgccgctggatatataatattctgtgtattaaacttcatcttgtgttgaaaagttcacaaatttacgaca

SEQ ID NO: 2026 - DNA, 1943 bp, Musa acuminata
tatttggatcttttggtgcgatggttgcagcaaccccagatcattcttctcaaggagggcacggacacctcgcaggggaaggcgcaggtggtgagcaacatcaatgcctgcacggccgtagccgacgccgtccgcacgacgctgggcccccggggaatggacaagctcatccacgacgaaaagggcagcaccaccatctccaatgacggcgccaccatcatgaagctgcttgacatcgttcatcctgccgccaagattcttgttgacattgctaagtcacaggactccgaggttggtgatggaaccaccactgtagtgcttcttgctggtgagttcttaaaggaggcaaaacctttcattgaagatggggtccaccctcagaatcttattcgaagttaccgaactgcatcctttttggccattaacaaaatcaaagaaattgctgtaagcatagaggggaaaagtcttgaagaaaagaaatccttgttggcaaaatgtgctgccacaacactctcatcaaagctaattggtggtgagaaggaattctttgcatccatggttgtggatgctgtccttgctattggcaatgatgataggcttaatttgattgggataaaaaaggtccctgggggtaacatgagagattcatttcttgttaatggtgttgctttcaagaagacattctcttatgctggttttgagcagcagccaaagaaatttttaaatccgaagatccttttgttgaatatcgaactagaattgaagtcggagaaagaaaatgcagaaatcagattatccgaccctttacaatatcaatcaattgttgatgccgaatggaacattatctatgacaaattagataagtgtgttaaaagtggagcaaaaattgtcctctcccgattggccattggtgaccttgcaactcagtattttgcagatagagatattttctgtgctggtcgtgtgacggaggaagatttactacgtgtagctgctgcaactggtggaactgtccagacctctgtcaacaatgttatagatgaggttcttggatcctgtgaagtgtttgaggaaagacaagtaggcaacgaaaggtttaacatttttaatggatgtccttctggtcagacggcaaccattgttctccgaggtggtgcagatcagttcattgatgaagctgaaaggagccttcatgatgccattatgatagtgaggagagctttaaagaactccaccattgtgcctggtggtggtgctattgatatggagctaagccgatatttgagactgcatgcacgcacaatagctggaaagtcacagctatttatcaattcatatgccaaagctcttgaggtaattccacggcaactttgtgacaatgctggatttgattcaactgatgtacttaacaaactcagacagaagcatgcatctggcgaaggtgcaaattttggtgtggaaatcaatactggtggaattgctgattcttttgctaactttgtatgggagcctgcagttgtcaagatcaatgctataaatgctgcaactgaagctgcttgtctcatcttaagtgtggatgaaactgtgaaaaacccaaagtcggagagcgcacaaggtgaagctgctgcaaatgctatggctggtcgtggtggaccagctttccgaggtcggggtggaagaggcatgcggagacggtgaattcctgactaatatatgttatagcttgtttgagattccaagtttcagggagctttttttcttttcctttttccttttctttcttgacttcacaatccacattaactctcagcatcattcatcagagtttcgggttgcttccccgttgttgaccgaaaacctagtcttggttttgttgctgtgatgtggtgtcagtttatttcttggccatgttgcagtacagtttcttgatttaaggtttctac

SEQ ID NO: 2027 - DNA, 1763 bp, Chelidonium majus
ctattctccccaaagcttcgatctaaagcttagagcaatgtcgtccatgatgcaaccccagatcatattgttgaaagaaggtacagatacatcacaagggaagccacagttgataagtaacatcaatgcttgtactgctgttgcagatgtggtgagaacaaccctaggtcccagagggatggacaaactcattcacgacgataagggtaacgttaccatctccaatgatggtgctactatcatgaagcttctcgatattgttcatcctgctgccaaaatcctcgtcgacatcgccaagtcccaagattccgaggttggtgatggaaccactactgtagtgcttcttgcaggagagtttctaaaagaggctaagcctttcatcgaggatggggttcaccctcggaatctcatacggagttatcgcactgcatccaatttggcgattgaaaaagtcaaagaacttgctgtgagcattgaaggtaaaagcttagaagaaaagaagaggttattggccaaatgtgcttccacgacactttcctcaaagcttattggtggagaaaaggagttttttgcaactatggttgttgatgctgttattgcaattggcattgatgatagacttaatttaattggtattaagaaggttcctgggggtaccatgagggattcttttcttgttaatggggttgcctttaagaagacattttcctatgctggttttgaacagcaaccaaaaaagtttttgaatccaaagatactcttgctgaacattgaactagaactgaagtcagagaaagagaatgcagagatcagactttctgatccgttacagtatcaatcaattgttgatgctgaatggaatatcatctatgacaagttggataaatgtgtccaaagtggcgctaaaatagtcctttcacggctggctattggtgatctagcaacacagtattttgcagacagagatattttctgtgctggtcgtgttgccgaagaggatttgcaaagggttgctgcagcaactgggggaacagttcagacatctgtcaacaacgttattgatgaggttcttgggtcctgtgagcttttcgaggaaaggcaagttggaaatgagcgcttcaatatattcagcggatgcccatcaggccagacagcaactattgttcttcgaggtggagctgatcagttcattgaggaagctgaacgaagtttacatgatgctattatgatagtcagaagggctttaaagaattccactgttgttgctggtggtggtgcaattgatatggagataagccggtacttgaggcaacatgctcggacaatagctgggaagtctcaactatttataaattcctatgcaaaggcacttgaggtcattccaaggcagctctgtgacaatgctggatttgatgccactgacgtattgaacaaactcaggcagaaacatgcacttccatctggtgagggagccctttatggggtggacatcaactctggtggcattgtggattcatatgctaactttgtatgggagcctgcagttgtgaagataaatgctattaatgctgcaactgaggcagcttgccttgttctaagcgttgatgagacagtaaaaaacccaaagtcggagagtgcacaaggagaagctgctgcgggtgccatgggccgagggcgtgggcgtggacgaggcatgcggcggtgatgacttgatttgcagtctagattttgaacgaggggaaagcagatcagtttcttggagc

SEQ ID NO: 2028 - DNA, 2223 bp, Populus trichocarpa
gagagagagggagatagaagctagaaacaaccagaaaattagaagggaaaaagaaaagttacactcaaaaaacacatacaaaaccctagctccccctccctccttccctccctcccttctctactccctctccctctctctatctctctgaatctgcaacaatggcagccatgatgcaaccgcagatcatactgctgaaagaaggaaccgacacgtcgcaagggaaagcgcagttagtaagcaacataaacgcgtgcacggcggtggcggatgtagtgaggacgacgttaggacctcgtggtatggataaattgatccacgacgataaaggaaatgtcaccatttctaatgacggcgccacgattatgaaattgctcgacattattcatcctgcctctaagatcctcgttgatatcgccaagtctcaggactctgaggttggcgatggaactactactgtagttctacttgcaggggagtttttgaaagaggctaaaccttttgtagaggaaggagtccacccacaaaacttaatacgtagttatagaactgcatgcaatttggcaattgagaaggtcaaagaactagctgttagcatagagggtaaaagtctagaggaaaagaaaagtttattggctaaatgtgctgctacaacactatcatcaaaacttattggtggtgagaaggagttctttgcatcaatggtcgtggatgctgtgattgcaattgggaatgatgacaggctaaatatgattggaataaagaaggttccaggtggtactatgcgagattcatttctggttaatggtgttgcctttaaaaagacgttttcttatgcggggtttgaacaacaaccaaagaagtttgtgaatcccaagatgctcttactcaacattgagttggagctgaaatctgagaaagaaaatgctgagataaggctgtcagatccatctcagtaccagtccattgttgatgcggaatggaatatcatttatgacaagttggataaatgtgtgcaaagtggggcaaaagtggttctttcacgccttgcaatcggtgatctggcaacacagtattttgctgatcgagatatattctgtgctggtcgtgtaagtgaagaagatctgcaaagagtttctgcggcatctggtggaactgtacagacaactgtcaacaacataattgatgaggttcttgggacttgtgagatttttgaggaaaagcaagttggaaatgagaggtttaatattttcagcggatgcccttctggaaggacagccaccattgttcttcgtggtggagctgaccagttcattgaggaggctgaacggagtttacatgacgcaatcatgatagtcagaagagctatgaagaactcaactgttgttgctggtggtggtgctatagatatggaaataagtcggtacttgaggcagcatgctcgcactatagctgggaagtctcaactgtttatcaactcttatgcaaaagcccttgaggttatcccacgacaactatgtgataatgccgggtttgatgcaactgatgtgctgaacaaactaaggcagaaacatgcacttccatctggtgagggtgcaccgtatggagtggatatcaacaccggtggaattgcagattcattttcaaactttgtttgggagccttcagttgtgaagatcaatgctataaatgctgctacggaggctgcttgtcttattttaagtgtggatgagacagtaaagaatcccaagtctgaaagcgctcagggagaagctgctgcaggtgctatgggtggacgtgggggaggtggtttccgtggccgtggacgggggatgcgaagacgatgagctcaccaaatagcaattttcttggaagtgtaggtggattagtcaaacttttgtctacttgatttcagtttattatgggtttcaagttgatgttcaatcttgatgtctgggattttgaacccgagtggctttttctggattatggcagcagattatttttcctgcatgccctacccccttgtctgtaggagatctttgttgaaatttttgtttcctttatttcagaagaaatggtagaaggcaatatcactcactctttttttacccttttttatttaacgcaatttcttgcgctcccctttacttacatttgtaacctcattgattgtgtgaagattcctcatcctacttcatgtctcatattttttttataata

SEQ ID NO: 2029 - DNA, 2142 bp, Solanum phureja
aatgccaagaagcacaaaaggttcttgattattccctttttatattattagatacagtaaagtaaaaagtgtataatattgctaaacctaaggagcaaaggaaaaaccctagaagctcactttctcctcaagatcaaagtcggatcaaatcgcctccaacaatgtctgccatgatgcaacctcagatcatattgctgaaggaagggacagacacgtcccaagggaaggcacagttggtgagcaacataaatgcatgtatggctgtggctgatgtggtgcgtaccacccttggccctaggggtatggacaagttgatccacgacgataaaggaaacaccactatttcgaatgatggtgctactataatgaagcttctagacataattcatcctgcagcaaaaatacttgttgacattgccaagtcccaagactctgaggttggtgatggaaccactacagttgttctgcttgcaggagaatttttaaaggaagccaagccttttgtcgaagagggtgtccaccctcaaaatcttattcgtagttatcgaaccgcttctaacatggctatcgagaaggtaaaagaattggctgttagcatagagggaaaaagtttggaagagaagaaaagtctgcttgcaaagtgtgctgctacaactctgtcatcaaagctcattggaggggaaaaggaattctttgcatccatggttgtggatgccgttcttgcaattggaactgatgataggctgaacatgatcggaattaagaaggtccctggaggtactatgcgggattccttccttgtaaatggtgttgcctttaagaagacattttcctatgctggttttgaacagcagccaaagaagtttgtaaacccccagatacttttactgaacatagagttggagctaaaatcagaaaaagaaaatgcagagataaggctctcagatccagcgcaatatcagtcaattgttgatgcagagtggaatatcatttatgacaagttggataaatgtgtaaagagtggtgccaaagttgttttgtctagactcgctattggtgatctggccacacagtattttgcagaccgagatatattttgtgctggtcgtgtctctgaagaggatctgcagcgggtagcggctgccgctggtggaacagtgcagacaactgtgaacaatgttattgatgaggttcttggctcttgtgagatttttgaggagaagcaagttggaaatgagagattcaatatatttagtggatgtccctcgggcaagaccgccactattgtccttcgtggtggagcagatcagttcatcgaggaagctgagagaagcttgcatgatgctattatgattgttagaagggctgtgaaaaactctacggttgttcctggaggtggtgcgatagatatggaaataagccgtttcttgaggcaccatgctcgaacaattcaagggaaatctcagctcttcataaactcttatgcaaaagctcttgagattatcccccgtcagctatgtgacaatgctggttttgatgcaactgatgtgctgaacaagctcagacaaaaacacgctcttccgtctggtgagggtgcaccttatggagtcgacattaatactggtggcattgctgattcatttgccaactttgtttgggagccagcagttgtgaagataaatgccatcaatgcagccactgaagcagcatgcctcattctgagtgtagatgagacagtgaagaatcccaagtctgagagtgcacaaggagatgctgctgcaagtgccatgggtggtggtagagggcgtggacgtggacgtggaatgaggcggcgatagatttcacaagttcttttgcagattttgctatgatttttatgtagtgtttgctttttttgcattgtttgctcctcccttatgtagttctagttgtctccctcgatcaaaatgttcaaatttgggcatggattctcatatagcaaccgaaaacaatcaaaacagagttgtgttaagttcaggcaacatccagtgaactatatcatttttgatactgtcagttttgcaatgtacgaagcctgccgttggatatataatattctgtgtattaaacttcatcttgtgttgaaaagttcacaaatttacg

SEQ ID NO: 2030 - DNA, 2272 bp, Cocos nucifera
ctccggcattctcgatcgctcgaaaccttctctcgcctattcgccccgcttgctctctctcctctttttcttctcagctctccaaaaccctaataatcccaaagcctaaatctcttccttttcttcttcctccctctccatctcctcctgttcgccaatggcggcgatgctgcaacctcagatcatattgctgaaggaggggacggacacttcccaggggaaggcgcaggtggtgagcaacatcaacgcctgcacggcggtgacggacgccgtccggaccactatggggccccgcgggatggacaagctcatccacgacgacaagggccacaccaccatctccaacgatggcgccaccatcatgaagctcctcgacatcgtccaccctgctgcgaagatccttgtcgacatcgccaagtcccaggactcggaggttggtgatggaacaactactgtagtgcttcttgcaggcgagttcttaaaggaagcaaaacctttcattgaggatggagtccactctcagaatctcatccaaagttatcgggctgcatcctatctggcgattgacaaaatcaaagaacttgctgttagcatagaagggaaaagcctcgtagaaaagaaaactctattggcaaaatgtgctgctacaactctctcctccaagcttattggtggtgagaaggagttttttgcatccatggttgttgatgctgtcatggctattggcaatgatgataggctaaatttaattgggattaagaaggtccctgggggtaacatgagagattcatttcttgtcaatggtgttgctttcaagaagacattttcttatgctggttttgagcagcaaccaaaaaagtttctgaatccaaaaatccttttgttaaacattgagttagaattgaaatcagagaaagaaaatgcagaaatcagattatcagaccctatacaatatcaatcaattgttgatgctgaatggaatatcatctacaacaagttagataagtgtgtacaaagtggagcaaaaatcattctctcacgattggcaattggtgaccttgcaacacagtactttgcagatagggatattttctgtgctggtcgtgtaacagaagaggatttgcaacgtgttgcagcagcaactggtggaactgtgcagacttctgtcaacaacattattgatgaggttcttggatcctgtgaagtgtttgtggaaagacaagtaggtaatgagcgatttaacatctttagtggttgcccttttggtcagacagcaaccatagttctccgtggtggtgcagaccagttcattgaggaagctgaaagaagcctgcatgatgccataatgattgtcagaagggctttaaagaactccactgttgtggctggtggtggtgctatagatatggagatgagccgatgtttgagacagcatgctcgggcaattgctggaaagtcgcagttgtttattaattcatatgctaaagctcttgaggttattccacggcaactttgtgacaatgctggatttgatgcaacagatgtactgaacaaactcagacagaaacatgcttctggtgaaggtgcaaattatggtgtagatatcaacactggtggaatcgcagattcttttgctaactttgtatgggaacctgcagttgttaagattaatgctataaatgctgcgacagaagctgcttgtcttatcttgagtgtggacgagacagttaaaaatccaaagtcggagggtgcacaaggtgaagctgctgccaatgcgatggctggccggggtcatgcagcagccctccgtggttgtggtggaagaggcatgcggagacgttgatttcccggtaccagagctgtatgactttatttgggtaaaaagtttttggggtcagttgtgtttcttgaggtgctgctgttggtatttggatccgtgtcatcttcggcttgcaacttgtgggagttgaggcatgagccaggcctgcttgaaacaaatgtggtctgctaatcttttgtccaaaagaggactaatatggggctattctttagttaaggtagcagtctcaaatcattttgttcaaaagcccgtcattctgttagttggattgtattagaggggaaaatgctgccgcttggtttatcttatttttcatattttattattctgctgggaaactttctttttgatctgcaagatttcttattttttctgaaatatctaatcttcgtgttttctgtcgtcaccagaggaaggaaaggcgagtttccc

SEQ ID NO: 2031 - DNA, 2505 bp, Lupinus angustifolius
acatagtacaagaagaaaaacatcactcaccactttcacagtgaaaaacagaaagagagaaactgcttcgtttcacttcactcttattttcaaacctaaaccctagttccctttctctctctctctctcaacaatgtcatcgatgatgcaaccacagatcatactattgaaggaaggtactgatacttctcaagggaaggctcaattggttagcaatatcaacgcctgcactgctgtcgccgatgtcgttcgaaccacgcttggacctcgcggcatggacaagctcatccatgatgataaaggctccgtcactatctccaatgacggcgccaccatcatgaagctacttgatatcgtccatcctgctgccaaaatccttgttgatattgctaaatctcaggattctgaggttggagatggaaccactactgtggtgttgcttgcagccgagtttttgagagaggcgaagcctttcattgaagatggcgttcactctcaaaatttgataaaaagctatagggctgcatccaccttggcaattgagaagattaaggatcttgctaccagcattgaaggaaaaagtctagaagaaaagaaaagcttgctcgccaagtgtgctgccaccacactttcttcaaaactcattggcggagagaaagagttcttcgcgtcaatggtcgtggatgctgtgattgcaattgggtatgatgacaggttgaacatgattggaattaaaaaggttcctggtggtaccatgcgggactcatttctagtaaatggtgttgcctttaaaaagacattttcatatgctgggtttgagcaacagcccaagaagtttctcaatccaaaaatactattactaaacattgagttggagctaaaatctgagaaagaaaatgctgaaataagattatcagatccatctcaatatcagtcaattgttgatgcagaatggaatattatttatgacaagttggataaatgtgtcaacagtggtgccaaagttgttctttcacgactggctattggagatctagctactcagtattttgcagacagagacattttctgtgctggtcgtgtaaccgaagaagatttaaaaagggttgctgctgcaacaggtggaactgtacaaacatctgtcaataatgttattgatgaggtccttggaacttgtgaggtttttgaggaaaagcaagttggaaatgagagatttaatttattcagtggatgtccatctggccaaacagccaccatagttcttcgtggtggagctgatcagttcatcgaggaagctgagcgaagtttgcatgatgcaatcatgattgttagaagggctttgaagaattcaactgttgttgccggtggaggtgctatagatatggagataagccgttatctaaggcagcatgcacgtacaatagcgggaaagtctcagctttttattaactcttatgcaaaagcgcttgaggttattcctcggcaattatgtgataatgctggatttgatgccactgatgtgctgaacaaactaaggcagaaacatgcacttccttctggtgaaggggcaccatatggggtggacatagctactggtggaattgctgactcgtttgctaactttgtttgggagcctgcagttgtgaagatcaatgctataaatgctgctacagaagcagcttgccttatcctaagcgtggatgagacagttaaaaatcccaagtctgaaagtgcacaaggagatgctgctgccagtgccatgggcggcagaggccgaggcggtttccgtggccgtggtcgaggaatgcgaagatgatgaaatttcattacgatggattagcatttgttcagtgcagtggtgtatttatgaatacatgcaaggccaatcaatgcatgcattattctgctagtcggtgttgctagaagcatgccatattttggatatacagaagatggtgttatgaaattgtaatggtgaggattctgggaacatcggaaggatttgataatattaactttgaagcatgtatttctgacctttgggttttttatactacgcttgaggggtttaaactattgggttttacttattttggtggctataatgtgtgaatttttgcatttccctgttttacttctcaaactgtaaaaacaggcatgggatttctgtttcgccttcccataaattttgtatcactttttgaccatttcgtatttgacgagtatgtgattattttgcttaaaacaatatgttggtactagagaaagagaagtcatgtgtgaagggtacttcagagaacatgggattgaagggaggtagttaccatttaaggttaagccacacaaccaatctttaattcaccatttaccatttttttacttggtattgcctttatctaatctgtcatatcatgttgacagttattgtgcctgtcaatccgctttcctatcgtttgtgtaacatatagtttgtatgttataaatgataaatatagtattttgtgt

SEQ ID NO: 2032 - DNA, 2008 bp, Amsonia hubrichtii
agttaaaaccctagaaacttctcctgtttcctcgctctctcactcacccacacgcatacacactagctcgttcgttgcagtcactgacaatggcgactatgatgcaaccgcaaatcatattgctgaaggaagggacagacacatcccaagggaagccacagttggtaagcaatataaatgcttgtacggctgtagctgacgtggtccggactactcttgggccaaggggtatggacaagttgatccatgatgaaaagggcaatacaacgatatctaatgatggtgctaccataatgaagcttcttgacattattcatccagcagctaagattcttgttgatatagccaaatcccaagattctgaggttggtgatggaacaactacagtagttttgcttgcagcagaatttctgaaggaggcaaagccttttattgaggatggagtccatcctcagaatcttatacggagttaccgggcagctagccatttggcaattgagaaggtcaaggaattagctgttagcattgaaggaaaaagtttagaagaaaagaagagcttactggctaaatgtgcagctactactctttcctcaaagctcatcggtggtgagaaggatttttttgcaccaatggttgtcgatgctgtccttgctattgggaatgatgataggctaaatatgattggaattaagaaggttcctggaggtacgatgagggattctttccttgtgaatggtgttgctttcaagaagacattctcatatgcaggttttgaacagcagccaaagaagtttgttaatcccaagatacttttgctaaacatagaattggaattgaaatcagagaaagagaatgcagagataaggctgacagatccatcgcagtatcaatcaattgttgatgcagagtggaatatcatttatgacaagttggataaatgtgtcaacagtggtgccaaaattgttctgtcacggcttgctattggtgatctggcaacacagtattttgcagaccgagatatattttgtgctggtcgtgtcactgaggaggatctgaatcgtgttgctgcagctactggtgggacaatacagaccactgtgaacaacgttattgatgaggtgcttggtacatgcgaatattttgaggagaagcaagttggaaatgagcggtttaatatattcagtgggtgcccattaggtcaaacggccactatggttcttcgaggtggagcagatcagttcattgaagaagctgaaagaagtctccatgacgcaattatgattgttagaagggctttgaagaactctactgttgttcctggtggcggagctatagatatggagataagtagatacttgaggcagcatgcccgcacgatagctgggaagtctcaactctttataaactcttatgctaaagcccttgaggtaatcccacgtcagttgtgtgacaatgctggttttgatgctactgatgtcttgaacaaattgagacaaaaacatgccctgccttcaggcgaaggtgcaccttatggggtggatataaatactggtggaatttctgattcatttgctaactttgtttgggagccagcagtagtgaagataaatgccataaatgcagctactgaagcagcttgtcttatcttaagtgtggatgaaacggtgaaaaaccccaagtccgagagtgcacaaggagaggctgctgcaaatgccatgggtggtagagggcgtggaggaccagctttccggggtcgtgggaggggaatgaggaggcgataggcgatcatccaaaaagactggctagtttatctaagttttgattgtaatcttgattgttctgtatcttctctaatagtttttagttctctctttttctagcttcgagctatggcaaaatttctaaatcgtatgttttatggacaaacttatttgttttagctgatttgtaactttacgaaactccgattttggttggttgcaagtttctccagattgctggttgtgct

SEQ ID NO: 2033 - DNA, 2179 bp, Lupinus angustifolius
gaacttcaaacataaaccctaattccctttctctctcgcaacaatggcatccatgatgcaaccacagatcatactgttgaaggaaggtactgacacttctcaaggtaaggctcaacttgttagcaacatcaacgcttgttccgctgtcgccgatgttgtccgaaccaccctcgggccccgtggaatggataaactcatccacgacgataaaggatctgttaccatctccaatgacggcgccaccattatgaaactccttgatattgttcaccctgccgctaagatccttgttgatattgcgaagtcgcaggactcggaggttggagatggaaccactactgttgtgttgcttgcagctgagtttttgaaagaggctaagccttttgttgaagacggtgttcattctcagaatttgataaaaagctatagggctgcatccaccttggcaattgaaaaggttaaggagctagctactagcatagaaggaaaaagtctggatgaaaagaaaagcttgctctcaaagtgtgctgctacgactctttcttcgaagctcattggtggagaaaaggagttctttgcttcaatggttgtcgatgctgtaattgcaattgggtatgaggacaggttgaacatgattggaataaaaaaggttcctggtggtactatgcgggactcatttctagtaaatggtgttgccttcaaaaagacattttcatatgctgggtttgagcaacagcccaagaagtttcttaatccaaaaatactattactaaacattgagttggagctaaaatctgagaaagaaaatgctgaaatacgattatcagatccatctcaatatcagtcaattgttgatgcagaatggaatattatttatgacaagctggataaatgtgtcaacagtggtgccaaagttgttctttcacggctggctattggagatctagctacacagtattttgcagatcgagacattttctgtgctggtcgtgtaacagaagaagatttaaaaagggttgctgccgccacaggtggaactgtacaaacatccatcaataacgttattgatgaggtccttggaacttgtgaggtttttgaggaaaagcaagttggaaacgagagattcaatttattcagtggatgcccatctggcctaacagccaccatagttcttcgtggtggagctgatcagttcattgaggaggctgagcgaagtttgcatgatgcaatcatgattgtgagaagagctttgaagaattcaactgtggttgctggtggtggtgctatagatatggagataagtcggtatctaaggcagcacgcacgtacaatagcgggaaagtctcagctttttatcaactcctatgcaaaagctcttgaggttatacctcggcaattatgcgacaatgctggttttgatgctactgatgtgctgaacaaactaaggcagaaacatgcacttccttctggtgaaggggcagcatatggagttgacatagctactggtgggattgctgactcgttcgctaactttgtttgggagcctgcagttgtgaagatcaatgctataaatgctgctacagaagcagcttgtcttatcctaagtgtggatgaaacggttaaaaatcccaagtctgagagtgcacaaggagatgctgctgcaagtgccatgggtggcagaggccgcggaggtggcttccgtggtcgtggacggggaatgcgaagatgatgagaaattcattgcgatgggcagcatttttgttcactgcattgggtggatgttttatacatgtaaggttactgcatgtattactctgctagttagtgttgttagaagcatgccatattttggatctgcaaacgatgaagatatgaaattgtaggtgattccgggtacgtagctaggatttgatgatagcaattttcaagcatgtatttctgacgtttgggcttttttatattagtttgtagggtttaaattattggctattatttattttgattggtgtaggtgacttgagctacttagtgtgaaattttgcatttccctgtttaactgttttacttctctactgtaaaacaagcatgggatttttgtttcgtatcttccgataagttttgcatcactattttttaccactttgtattgtttcttttaatgcagagtttttttctttag

SEQ ID NO: 2034 - DNA, 2080 bp, Vaccinium corymbosum
caggagccaaacagtgaaagttcgaacctaacccgccgcaccgccgttcacgatctactcgccgccgttccttctttgccggaatccgacatccccgtattctctctataagccactcactatgacagctatgatgcaacctcagatcatattgctgaaggaagggacagacacgtcccaagggaaggcacaactagtgagcaacataaacgcgtgcatggctgtggcagatgttgtgcgcaccacgctcgggccaaggggtatggacaagctgatccatgatgagaaaggcaataccaccatttcgaatgacggtgccaccatcatgaaacttcttgacattgttcacccagctgctaagatccttgttgatattgccaagtcacaggattctgaggttggtgatggaactactactgtggttctgcttgcaggggaatttctgaaggaggccaagccttttattgaggacggggtccaccctcaaaatctaatccggagttttcgcactgcagcgtatttggcaattgagatggtcaaagaactagcccaaagcatagaaggaaaaagtctagaagaaaagaaaagtttacttgccaagtgtgctgctacgaccttatcttcaaagcttattggtggagaaaaggagttctttgcttctatggttgtggatgctgtccttgcaattggcactgatgacaggctaaatatgattggaatcaagaaggttccaggaggtaacatgcgggactccttccttgtaaacggggttgccttcaaaaagacattctcatacgctggttttgaacagcaaccaaagaagtttgtcatgcccaaaattctcctattgaacattgaattggagctaaaatcagaaaaagaaaatgctgagataagactttcagatccttcacagtatcagtcaattgttgatgcagaatggaatattatttacgataagttggataaatgtgtgaaaagtggggctaaaattgtgctttcacgtctggctattggtgatctaggcacacagtattttgcagatcgagatatattttgtgcgggtcgagtcgctgaagaggatctgcagcgagttgcagctgcaacaggtggaacagtacagacatctgttaataacatcatcgatgaggttcttggatcttgtgagctctttgaggagagacaagttggaaatgagcggtttaacatatttagtgggtgcccatctggtcagacagccactatagttctccgcggtggggccgatcagttcattgaggaagctgagcgtagtttacatgatgcaatcatgattgttagaagagctttgaagaattctactgttgtggctggtggcggtgccatagatatggagataagccggtatttgaggcagcatgcacggacaatagctggaaagtctcagctttttattaactcttacgctaaagctctagaggttatcccacgacaactctgtgacaatgctggttttgattgcgactgatgtgctgaacaaactgagacagaaacatgcactacattctggtgaggggaaactgtacggggtggatattaacactggtggaattgctgataattatgctaattttgtttgggagccagcagtagtcaagatcaatgccataaatgcggctactgaagcagcctgccttgtcttaagcgtggatgagacagtgaaaaacccaaagtcagaaagtgctcagggagatgctgctgcgggtgcaatgggtggtagaggtcgtggtggagctgctttccgtggtcgtggtggacgaggaatgcggaggcgatagggttcccacatcctaaatccttggctgtttgatcaaagttttggtggctttcagaatgtaatttccccccggcctttaccggacttgagcacagactttaagatgtattttcttgtgattcttctcgtagtgctgaatgttcagaactttgactaagcttggcaacatttttgcggtgatctgtagtttctttgtgctatgaattggtatgtttgggcatttattttgtattttgaattagtgcgctccctttcttgcgcgcg

SEQ ID NO: 2035 - DNA, 1991 bp, Amorphophallus konjac
actactcgaaaattctagacaccccaaaccctagcgttcgtatcccgttccctctcacccctctcactctccctcgctccctccacccagcgatggcggctatgctgcaaccacagatcatattgctgaaggaagggacggacacgtcgcaggggaaggcgcaagttgtgagcaacatcaacgcctgcacggcggtggcggacgtggtgcggacaacgctggggccccgcgggatggacaagctgatccacgacgacaagggcaacaccaccatctccaacgacggcgccaccattatgaagctcctggacatcgtccaccctgccgctaagatccttgtcgatatcgccaagtcccaggactccgaggttggtgatggaactactacagttgtgcttcttgctggtgagtttctaaaggaggcaaagcctttcattgaggacggagttcatcctcaaaatctcatacgcagttaccggacagcatgcaatttggcaattagtaaaatcaaagaacttgctatgagcatagagggaaaaagccttgaagaaaaaagaagctgctagccaagtgtgcttctacaacactttcttcgaagcttattggaggtgaaaaggagttctttgcatccatggttgttgatgctgtcattgcagttgcgaatgatgacagactaaatttgattgggattaaaaaggttcctgggggaaatatgcgagattcttttctggtaaatggtgttgcattcaaaaagacattttcttatgctggatttgagcagcaaccaaagaaatttcacaaccccaagattcttttgttgaatattgaattggagttaaagtcggagaaagaaaatgcagaaatcagattatcagatcctgcagaatatcagtcaattgtcgacgctgaatggaatatcatctacgacaaactcgacaaatgtgtccaaagtggagccaaaattgtactgtcacggttggcaattggtgaccttgcgacacagtatttcgctgatcgggatatcttctgtgctgggcgtgtaacagaggaagatttacagcgtgttgccgcagctactggtggtgctctgcagacgtctgtcaataacattgtggatgaggttcttggatcgtgtgaactttttgaagaaaagcaagtagggaatgaaagatttaacatatttagcggttgcccctctggtcatacggccaccattgttctccgtggtggagcagatcagttcattgaagaagctgagcgtagtctgcatgatgctattatgatagtgagaagagcactgaagaactccactgttgtatctggtggtggtgcaatagatatggagataagcagatacctcagacagcatgcacggacaatagctgggaagtctcaactatttataaattcctatgctaaagcacttgagataataccacggcagctatgtgacaatgccggttttgatgcaactgatgtgttgaacaagctccgacagaaacatgcaaccggtgaaggtgcaaactatggtgtggatatcaatactggtggaattgcagattcctttgccaactttgtatgggagccttctgttgtgaagattaatgctattaatgctgcaactgaggcggcttgtctcattctcagtgtggatgaaacagtgaaaaatccaaagtctgagagcgcccaaggtgaggctgcagccagtgcaatggctggtaggggacgtggtggtggacctgcattccggggccgcggggaaggggcatgaggcggcgatgatcatccaggtattgaaatctggtataccaggaatctcccccacacactcacttgactgccccccccctcctctctctctctctctctcatgactggtgtcgggggacacaaaagcctgacgatggctgcaatccaagacatcatctccgatggctggaacttctagaacaactagacgttagagtgaagtgattagtacctttttttat

SEQ ID NO: 2036 - DNA, 2108 bp, Daucus carota
taaaaccctagttacacacagtaccatacaaacctacattcttctctttgctctctcttttaatttttctcgtctctttctctctctgtatctacaaatctcgctactcacaatgtctactatgatgcaacctcagattatcttgctgaaagaagggacggatacgtcgcaagggaaggctcagttagtgagcaacataaatgcgtgtggggctgttgctgatgtggttcggactactcttggacctaggggtatggacaagctgattcacgatgataagggaaataccactatttctaatgatggtgccacgattatgaagcttcttgatatagtccatcctgcagctaagatccttgtggatattgccaagtcacaagattctgaggttggtgacggaacaactacagtggttctgcttgcaggggaattcttaaaggaggcaaagccttttattgaagatggtgtgcacccacaaaacctcatccggagctataggactgcttcctatttggcaatcgagaagatcaaagaattagctgttagcatagagggaaaaagcttagacgaaaagagaagtctattagctaaatgtgctgctacaactctctcgtcgaagcttataggcggagagaaagagttctttgcatctatggttgttgattctgtcctagctattggaaatgatgataggctaaacatgatcggaataaagaaggttcctgggggtacaatgcgcgactctttccttgtaaatggtgttgccttcaagaagacattttcatatgccggttttgaacagcaaccgaagaaatttgaaaatcccgagatactactacttaacattgaattagagctgaaatcagaaaaagaaaatgcagagataaggctatcagatccattgcagtatcagtcgattgttgatgcagaatggaatatcatttatgataaattggataaatgtgtgaagagtggagccaaaattgttctttctcgtctggctattggtgatctaggaactcagtattttgcagatcgagatattttttgtgctggccgtgtcgctgaagaggatttgcaaagggttgcagcagctacaggtggaactgttcagacatcagtcaacaatgtcattgatgaggttcttggaacttgtgagatttttgaggagaaacaagttggaaatgagcgcttcaatatatttagtgggtgcccctcaggccagacagccactatagttctccgcgggggagctgatcaattcatcgaggaagcagagcgcagcttacatgatgcaattatgatagttcggagggctatgaagaactctactgtagttgctggtgggggtgctattgatatggagataagcagatacttgaggcaacattcacgcacaatagctggaaagtcccaactatttataaactcctatgcaaaagctcttgaggttatcccacggcagctttgtgacaatgcgggatttgatgcaactgatgtgctgaacaatctaagacagaaacatgcgctaacatcaggtgagggtgcactttatggtgtagatatcaacaccggtgggattgctgattcgtacgcaaattttgtgtgggaaccagcagttgtaaagatcaatgctattaatgcagctacagaggcggcttgtcttatcttgagtgtggatgagacggtaaagaacccgaagtctgagagtgcacagggcgaagctgctgcaggtgcaatgggcagagggcgtggaggtggtcgtggtagaggaatgcgtaggcgataggctatatagaaattaggtgtatttttacgcaattaatgggtggttcacttattggggtttttaggcatgatcaaccgtcttcatttttctcttcattcgtcctttgtaactaaactatagatttaaggttgtatttcttatattgtgattttgcccctagtggtgcagttttggtttaaaatgctctaatatttgtatggcctgtgccgattttgactaaaagagtgaaacttcacattatgccgatcttttgtattcttgaaagttggaggaagtgatatgagtgatcttggatagtttaacagtaaaagttaagctc

SEQ ID NO: 2037 - DNA, 2072 bp, Gossypium hirsutum
aagggatataagcatatagtctaaaaggttaaacaaccaaattcggccttccgaaagagttaaacccctaaaaacacttccttcttccatctctcttctcccttaaacaacaagcttaaccctagcaacaatggcatccatgctgcaaccccaaatcattcttttgaaagaagggacggacacatcacaggggaaggcgcagctcgtcagcaacataaacgcttgcaccgcagtggctgatgtggttagaacgaccctgggtcccaggggcatggacaagctcatccacgatgacaaaggaaatgtcaccatttccaacgatggcgccaccatcatgaagctcctcgatattgtccatcctgccgccaagatccttgttgatatcgccaagtctcaggactcagaggttggtgacggtactacaactgttgtactgctagcaggagaatttttaaaagaggccaagccttttgtagaggatggagtccaccctcaaaatcttattcgcagttatcgaactgcttgcaatttggcaattgtgaagatcaaagaactagctgttagtatagaggggaaaagtctagaagagaagaaaagcttattagctaaatgtgctgctacaacactttcttcaaaactcattggtggagaaaaggagttctttgcatcaatggttgtggatgctgttattgctattggcagtgaagataggttgaatatgattggaattaagaaggttcctggtggtaacatgagggattcctttttggttaatggtgttgcctttaaaaagacattttcatatgctggttttgagcagcagccaaagaagttcatgaatcccagaatacttctgttaaacatcgagttggaactgaaatctgagaaagaaaatgctgagataagactttcagatccatcacaatatcaatcaatagttgatgcagaatggaatatcatttatgacaagttggataaatgtgtgaagagtggtgcaaaagttgttctttcacggttggctatcggtgatttggcgacacagtattttgcagatagagatattttctgtgctggtcgtgtagctgaggaagatcttaatcgggttgctgctgcaactggtggaactatacaaacatctgttaacaacataattgatgaggttctaggaacatgtgaggtttttgaggaaaagcaggttggaaatgaaagatttaatatattcagtggttgcccatcaggacggacagctactatagttctacgtggtggagcagatcagttcattgaagaagctgagaggagcttacatgatgcaattatgattgttagaagagccttgaagaactctactgtagttgctggaggtggtgctatagatatggagataagtcgatacttgaggcagcatgcacgcacaatagctgggaaatctcaactttttattaactcttatgcaaaagcacttgaggttattccacggcagctttgtgacaatgctggatttgatgcaactgatgtgttgaacaaattaaggcacaagcatgcacttccatctggtgagggtgcaccttacggagtggagatcaacactggcggaatagcagattcatttgcaaactttgtgtgggagccatcagttgtaaagatcaatgcaatcaatgctgcaactgaggctgcatgtcttattctaagtgtcgatgagactgttaagaatcctaagtcggagagtgcacagggagaagctgctgcaagtgccatgggtggcagaggtcgtggaggtggtttccctggccgtggacgaggaatgaggaggcgttgagatagctgtttcatttttttgttatcgaattttggttgtgttatttccttttatgccgtagatgaactaccgttttaagggccaaaatgtgaaggtgcctatttagatgtggcatccgaatgaccaaaatctgggattgaatgttggattttttgtgaactgtggctggtgctttcgtttgctgtagaaaattacacttgttccttaaatttatttttcaaaggaatttttgtgagtgaagaaaaaaaaaaaa

SEQ ID NO: 2038 - DNA, 2044 bp, Gossypium raimondii
aaaaggttaaacacccaaattcggccttccgaaagagttaaacccctaaaaacacttccttcttccatctctcttctcccttaaacaacaagcttaaccctagcaacaatggcatccatgctgcaaccccaaatcattcttttgaaagaagggacggacacatcacaggggaaggcgcagctcgtcagcaacataaacgcttgcaccgcagtggctgatgtggttagaacgaccctgggtcccaggggcatggacaagctcatccacgatgacaaaggaaatgtcaccatttccaacgatggcgccaccatcatgaagctcctcgatattgtccatcctgccgccaagatccttgttgatatcgccaagtctcaggactccgaggttggtgatggtactacaactgttgtactgctagcaggagaatttttaaaagaggccaagccttttgtagaggatggagtccaccctcaaaatcttattcgcagttatcgaactgcttgcaatttggcaattgagaagatcaaagaactagctgttagtatagaggggaaaagtctagaagagaagaaaagcttattagctaaatgtgctgctacaacactttcttcaaaactcattggtggagaaaaggagttctttgcatcaatggttgtggatgctgttattgctattggcagtgaagataggttgaatatgattgggattaagaaggttcctggtggtaacatgagggattcctttttggttaatggtgttgcctttaaaaagacattttcatatgctggttttgagcagcagccaaagaagtttatgaatcccagaatacttctgttaaacatcgagttggaactgaaatctgagaaagaaaatgctgagataagactttcagatccatcacaatatcaatcaatagttgatgcagaatggaatatcatttatgacaagttggataaatgtgtgaagagtggtgcaaaagttgttctttcacggttggctattggtgatttggcgacacagtattttgcagatagagatattttctgtgctggtcgtgtagctgaggaagatcttaatcgggttgctgctgcaactggtggaaccatacaaacatctgttaacaatataattgatgaggttctaggaacatgtgaggtttttgaggaaaagcaggttggaaatgaaagatttaatatattcagcggttgcccatcaggacggacagctactatagttctacgtggtggagcagatcagttcattgaagaagctgagaggagcttacatgatgcaattatgattgttagaagagctttgaagaactctactgtagttgctggaggtggtgctatagatatggagataagtcgatacttgaggcagcatgcacgcacaatagctgggaaatctcaactttttattaactcttatgcaaaagcacttgaggttattccacggcagctttgtgacaatgctggatttgatgcaactgatgtgttgaacaaattaaggcacaagcatgcacttccatctggtgagggtgcaccttacggggtggacatcaactctggtggaatagcagattcatttgcaaactttgtgtgggagccatcagttgtaaagatcaatgcaatcaatgctgcaactgaggctgcatgtcttattctaagtgtcgatgagactgttaagaatcccaagtcggagagtgcacagggagaagctgctgcaagtgccatgggtggcagaggtcgcggaggtggtttccctggccgtggacgaggaatgaggaggcgttgagatagctgtttcatttttttgttatcaaattttatttccttgtacgtcgtagatgaactaccattttaagggccaaaatgtgaaggtgcctatttagatgtggcatccgaatgaccaaaatctgggattgaatgttggattttttgtgaactgtggctggtgctttcgtttgctgtagaaaattacacttgttccttaaatttatttttcaaaggaatttttgtttgtgagtgaaggaaaatgaaaa

SEQ ID NO: 2039 - DNA, 2189 bp, Petroselinum crispum
caggcacacagttgtgatttgtgaagtgagtagcgcgagaagaagagtgttaacttttctaaaaccctagttccttctgctttcatctctctcatccctctcgtatatacacacacacatattcacacacttcgccatttcacgatgtctactatgatgcaaccacagattatattgttgaaagaagggacagatacgtctcaagggaaggcgcagttggtgagcaacattaatgcagttatggctgtggcagatgtggtgcgtactactcttggaccaaggggtatggacaagttgatccacgatgataaggggaacactactatttctaatgatggtgcaacgattatgaagcttcttgacattgtccaccccgcagctaagatccttgttgatattgccaagtcacaagactccgaggtgggtgatggaacgactacagtggttctgcttgcaggagagttcttaaaggaggcaaagcctttcattgaagatggtgtccacccacaaaacctcattcgcagttatcgaactgcatcctatttggcgatcgagaagattaaagaattagcagttagcatagaggggaaaagtttagatgaaaagagaagtctattagctaaatgtgctgctacaaccctctcatcgaagctcataggcggagagaaggagttctttgcatcaatggttgttgattctgtccttgcaattggaaatgatgataggctaaacatgattggaataaagaaggttcccggaggtacaatgcgcgactctttcttagtaaacggtgttgccttcaagaagacattttcatatgctggttttgaacagcaaccaaagaaatttgaaaatcccaagatactattacttaacatcgaattggagctaaagtcagaaaaagaaaatgctgaaataaggctatcagatccattgcagtatcagtcaattgttgatgcagaatggaatatcatttatgataaattggataaatgtgtgaagagtggagccaaaattgttctttcacgtctggctattggtgatctaggaacacagtattttgcagatcgagatatcttttgtgctggacgtgttgctgaagaggatttgcagcgagttgcagcagccacaggtggaactgttcagacatcagtcaacaatgtcattgatgaggttctgggaacttgtgagatttttgaagaaaaacaagttggaaatgagcgttttaatatatttagtggatgcccttcaggccagacagcaactatagttctccgtgggggagctgatcagttcatcgaggaagcagagcgcagcttacatgatgcaataatgatagttcggagggctatgaagaactctactgtagttgctggtgggggtgctatagatatggagattagcagatacttgaggcagcattcacgcacaatagctggaaagtcccaactattcattaattcctatgcaaaagctcttgaggttatcccacgacaactttgtgacaatgctggatttgatgcaactgacgtgctgaataatctaagacagaaacatgctctagcatcaggtgagggtgcactttatggggtagatatcaataccggtgggattgctgattcatacgcacattttgtttgggaaccagcagttgtaaagataaatgccatcaatgcagccacagaggcagcttgtctcatcttaagtgtggatgagacggtgaagaacccaaagtccgagagtgcacagggagaagctgctgcaagtgcaatgggtagagggcgtgggggcggtggtcgtggtagaggaatgcgtaggcgataggctattaagggactagttgtatttttacgcagttaatgggtggtttaccaatcggagtttttaggcatgatcaaccatccttacttttctttttactcatcctttgtaactaaactatatatttaaggctgtatttttccccccccccccccccccccccccccccccccccccccccccccccccccccccccccccccccccccctttttcccattgtgatttggcctttagtggtgcctttttgtatccaatgccctaaattttgtatggcttgtgccagttttgactactaagagttcacattacgtctttgtatctttatattcttaaagttggatgaacttatacgagtgagcttgttg

SEQ ID NO: 2040 - DNA, 1945 bp, Arabidopsis thaliana
tctctctctctctctgctccatttctctcactttcttcacatctctgaagctcttcgtcacgcatctacaatggcatcgatgatgcaaccgcagatcatactgctgaaggaagggacggacacatctcagggcaaagcgcaactagtaagcaacatcaacgcttgcactgctgttggagatgtagttcgaaccacgctcgggccacgagggatggacaaactcattcacgacgataaaggatccgtcaccatttctaacgatggtgctaccatcatgaagctcctcgacattgttcatcctgctgctaagatcctcgtcgatatcgccaaatcccaagactccgaggtgggtgatgggacaactacagtggttcttcttgcagcagagtttttgaaggaagcgaagccatttattgaggatggtgttcacgctcagaatctaattaggagttaccgcactgcaagcactttggcaattgccaaggttaaagaactcgctgttagcattgaggggaagagtgtagaggaaaagaaaggtttattggctaaatgtgctgctacgactctctcatctaagcttatcggtggagaaaaggagttttttgctacaatggttgttgatgctgttatggccattgggaatgacgacaggctaaatctgattgggatcaagaaggttcctggtggcaatatgcgagactctttcctcgttgatggtgtagctttcaaaaaaacattctcgtatgctggttttgagcaacagccaaagaaatttcttaaccccaaaattctcttgcttaacatcgaattggagttgaaatctgagaaggaaaacgctgaaattaggctgtcagatccatcacagtaccagtcaatagttgatgcagaatggaatatcatttatgacaaactagacaaatgtgttgagagtggagcaaaagttgttctttctcgattggctattggtgatctagctactcagtattttgccgatcgtgatattttctgtgctggtcgtgttgctgaggaagatcttaaccgtgtggctgctgcagctggaggaacagttcagacaagtgttaacaacataatagatgaggttcttggaacttgtgagatttttgaggaaaaacaagttggtggggagagatttaatatattcagtggttgcccttcaggacgaacagcaactattgttctccgtggtggagctgatcagttcatcgaagaagctgagcggagtttacatgatgcgattatgattgtgagaagagctgtgaagaactcaactgttgttcctggaggtggagctatagatatggagataagcaagtacctgaggcagcattcaagaacaattgctgggaagtcacagcttttcatcaactcttatgcgaaggctctagaggttattccacgacagttatgtgataatgctggatttgatgcaactgacgtcttgaataaacttagacaaaaacacgccatgcaaagcggtgaaggagcttcgtatggagtggacattaacactggtggcatagcagattcttttgctaacttcgtttgggaaccagcagttgtgaagatcaacgcaataaatgctgcgactgaagcggcttgcctcattcttagtgtcgacgaaaccgtgaagaaccctaaatctgagagcgcacagggagacgccgcaggtgcaatggggagaggacgcggtggaggtcgtggccgtggaatgcgaaggcgataagctccgtctctaatgccaaacttgtgggattcttcttcttcttctctaatttcgattttgttgaatttttgttttgaagttaaaaaacctattattgggtttgtgtttgttcaattagaatactggttgggtatgtatgtctatacaatctgtgaaacataagttttagtgttgttttggttaaggagtttatatttgctt

SEQ ID NO: 2041 - DNA, 2089 bp, Cucumis sativus
gaagttagaaagcttaacgcacaaagtgcttcttctccaactctccacaaaaccctagagaccaacagcacaaacgaacacttccactttcctcacttcccttctactcccatctcaacatcttcaacaatggcagccatgctgcaaccacagatcatactccttaaagagggaacggatacttcccaaggcaaggcgcagttggtaagcaacatcaatgcctgcacagctgtggccgatgtggtgcgtactaccttgggacctagaggtatggacaaactcatccatgacgataagggtaatgtcaccatttctaatgatggcgctactattatgaagcttcttgatattgttcatcctgctgctaagatccttgtggatatcgctaagtcgcaggactccgaggttggtgatgggacaacaactgttgttcttctcgctgctgagtttttgaaggaggccaagccttttattgaggatggagttcactctcaaaatttaatacggagctatcggactgcaagctatttggcaattgagaaagtaaaagagttggcaatcagtatagaggggaagagcttggaggaaaagaaaagcttgttggctaaatgtgctgcaacaacactttcatctaagctcattggcggagagaaggatttctttgcatcaatggttgttgattctgttattgctattggcaatgaagataggctaaatatgattggcataaagaaggtacctggagggaccatgcgcgactccttcttggtaaatggtgttgccttcaagaaaacattttcttatgcaggtttcgaacagcagcccaagaagttttcaaatccaaaaattctcttgctaaatattgaattggaattgaaatcggagaaagaaaatgcagagatacggctctctgatccgtcacagtatcagtccattgttgatgcagaatggaatattatttacgaaaaattagacaagtgtgtggagagtggagccaaagtggttctttcacgtttggctattggtgatcttggcacacagtattttgctgaccgagatattttctgtgctggccgtgtggccgaggaagatctacaaagggttgctgctgcaactggtggaactatacagacatctgttaataacgttattgatgaggttcttgggacatgtgaggtttttgaggaaaagcaagttggtaatgaaagatataatatattcagtggatgcccatcaggtagaacagctaccattgtccttagaggtggagccgatcagtttattgaagaagcagagcgtagcttgcacgatgcaatcatgattgtaagaagagcactgaaaaattctactgttgttgctggtggtggagcaatagatatggagatcagccgatatttgaggcaacatgcacgcacaatagctggaaagtctcaactttttatcaattcatatgccaaagctcttgaggttatccccagacaactgtgtgacaatgctgggtttgatgctactgatgtgctcaacaagttgcgacaaaagcatgctcatccttcaggtgagggtgcaccgtatggggtggacatcaacaccggtggagttgctgattcatttgcaaactttgtatgggaacctgctgttgtgaagataaatgctattaatgctgctacagaggcagcttgtctcatactaagtgttgacgaaactgtgaagaatcccaagtctgagagtgcacagggggaagctgcagccagtgccatgggcggaagacgtggcggggctgcattccgtggacgtggacgtggaatgcgaagacgataggcaatttcattgtgacgagaagcacagtttggttagttcaatatattttttttacatttttgcctgcgtgtgcttttcattcaaattgtagtagaatcagattttaatcttatttggccaatagacaaaaccttgagttatacatccgttgcgaattgatttggtcatatagaactttacggatggagagtgattttgatggtgcatctgatttgcccccctttttttgttctttctggaccctacatattcattttgtagttttgaatta

SEQ ID NO: 2042 - DNA, 2127 bp, Arachis hypogaea
gcaacagaacgaaccaaccagaaacttcaccctcctactctcgtttaacttccaacttaaaccctagttctctctctctctctcgcaaccatggcagctatgctgcaaccgcagatcatactgctgaaggaaggtacggacacgtctcaggggaaggctcagctagtcagcaacatcaacgcctgcaccgccgtcgccgacgtcgtcaggtccaccctcggcccacgcggcatggacaagctcattcacgacgacaagggatccgtcaccatctccaacgacggcgccaccatcatgaagcttcttgacatcgtccaccctgccgccaagatcctcgtcgatatcgccaagtcacaggactccgaggttggtgatggaaccaccactgtggttttgcttgctgctgagtttttgaaggaggccaagcccttcatcgaagacggtgttcactctcagaatttgattaggagctataggactgcatgcacattggcgattgagaagattaaagagctggcggttagcatagagggtaaaagtttggaagagaagaaaagcttgcttgcaaagtgtgcttctaccacgctctcttcaaaacttattggtggagagaaagaattctttgcatcgatggttgtggatgctgttattgcaattggaaatgatgacagattgaacatgattggtatcaagaaggttcccggtggtaacatgcgggactcatttctagtaaatggtgttgccttcaaaaagacattttcatatgccgggtttgagcaacagccaaagaagtttctcaatccaaagatactactgctaaacgttgaattggagctaaaatcagagaaagaaaatgctgaaatcagattatctgatccatcacaatatcaatcaattgttgacgccgaatggaatattatttatgacaaattggataaatgtgtcaacagtggtgcaaaagtagttctttcacgattggcaattggtgatcttgctacacagtatttcgcagatcgagacattttctgtgctggtcgtgtagcagaagaagatttaaaaagggtcgctgctgcaactggtggaactgtacaaacatctgtcaataacatcattgatgaggtacttggaacttgtgacgtttttgaggagaagcaggttggaaatgaaaggttcaacatattcagtggatgtccatctggacaaacagcaaccatagttcttcgtggaggagctgatcagttcatagaggaagcagagcgaagtttgcatgatgcaatcatgattgttcggagggctttgaaaaactcaactgtagttgctggcggaggtgctatagatatggagataagtcgataccttaggcaacatgcacggacaatagcaggaaagtctcagcttttcattaactcatatgcaaaagctctagaggttatacccagacaattatgtgacaatgctgggtttgatgcgactgatgtgctgaacaaactaagacagaaacatgcacttccatctggtgagggagcaccatatggagtggatataagcactggtggaattgctaactcatttactaactttgtctgggagcctgcaattgtcaagattaatgctataaatgctgctacagaagccgcatgcttaatactaagtgtggatgaaacagttaaaaaccccaagtctgagagtgcacaaggagatgctgccgcaagtgctatgggtggtagaggtcgtggaggtgccttccgcggccgtggccgtggacgaggaatgcgaagatgatgagaaatgtggcataatgggttggcttttatcttagttcatttgtatgtttgtctaatacatggaaggccagtgcatatttatatctgctagttgatactgctagaagcatgccttatttttggatctacaaatgatgatataaaattgtaatgcggtatatgggatcatcatcagagtgggatttgatggtaacaattttcaagaattttgtcgttacgacatttactcattttatacgctggaggattgggatggtagttaattttgcatcttattgttcttcccttgtaaaaaaaaaaaaaaaaaaaaaagtatacactgtctctgagactcgacgacgac

SEQ ID NO: 2043 - DNA, 1961 bp, Phalaenopsis aphrodite
gcaaccacatattatacttctgaaagaggggacggacacggcgcaggggaaagcgcaggtggtttcgaatatcaacgcgtgtacagcagtggctgatgcagtgcggtcgactttgggccccaggggcatggacaagctcatccatgacgacaagggtaataccaccatctcaaacgatggtgctaccatcatgaagttgctcgatattattcatcctgccgccaagatcctcgtcgacatcgccaagtcccaggactccgaggtaggcgatggaaccactacggtagtgctcctagcaggagagttcttaaaggagggaaaaccgttcatcgaggatggtgttcattctcaaaatctgatacgaagttataggactgcatctcatttggcaattaacaaaatcaaggaacttgctgtgagtattgaggggaaaagcctggaggagaagaaaaatttattggcgaaatgtgctgaaaccacactttcttcaaaacttattggtggcgaaaaggagttttttgcgtcaatggttgtggatgctgtcgttgcaattggcaatgatgatagattgaacttgattggtattaaaaaggttcctgggggtaacatgagagattcattccttgtgaatggtgtagccttcaagaagacattttcttatgctggttttgagcagcagcccaagaaatttgtaaatccaaagattcttttgttgaatattgaacttgaacttaaatccgagaaggaaaatgctgaaatcagactatctgatccagcacagtatcagtcaattgttgatgcagagtggaatatcatctatgataaattggataaatgtgttcagagtggagcaaaaattattctttctaggttggcaattggtgaccttgcaacacagtattttgcagatcgtgatattttttgtgccggtcgtgtaaccgaggaggacctgcagcgcgttgctgctgcaactggtgggactgtccagacttctgtaaacaatgtcattgatgaggttcttggatcttgcgagctctttgaggagaagcaagttggaaatgagcgctttaacatatttagtggctgcccttctggccagacggccacaatagttctgcgtggtggtgctgaccagttcattgatgaagctgaacggagcttacatgatgcaatcatgattgtgagaagagctgtaaagaattccactgtcgtggctggtggcggcgcaatagatatggaacttagccgctatctgagacaacatgcgaggacaattgctggcaagtcacagttgtttataaattcatatgccaaggcccttgaggttattcctcgtcaactttgtgacaacgctggatttgatgccactgacgtgctgaacaagctaaggcagaagcatgcatcaggtgaaggtgcaaactatggtgtagacataaatacgggtggaattgccgattcttttgcaaactttgtatgggaaccttcagtagtgaagatcaatgctataaacgctgctacggaagctgcctgtcttatcctaagtgtggacgagacggtgaaaaaccccaagtcggagagtgcccaaggcgaggctgcagcaagtgcgatggccggtcgtgggcgtcccgctttcggtggacgcggaggaagaggcatgagaagaaggtgatcaaaacactattcatttcattaagcctcaactttagtgcttcttcttcagtcatattttcctactactcttatagtttcacctttggggtgcttattttaagcttcttattggccttttcaaagatatgttgagtatgaagcaattgactaacttatgttacattatgttgcacagattttgatgagctttttgttatattatttcctagttatcttatgctttgctcatttggttgttttgttaaagcaaatgaaatggtccataaatatcaaaatatagttgatatatg

SEQ ID NO: 2044 - DNA, 2027 bp, Triphysaria pusilla
aattttacttttgtctttcgaacccatttttattttctgaaccctagaacatactgcttcactctcccccgctcagcaaagaacactcagaaactcacatcaaacctaacaatgtcatccatgttgcaaccacaaatcatactgctcaaggagggcactgatacatctcaaggaaaaccacagttaataagcaacatgaatgcgtgcatggctgttgctgatgttgtgcgaactacccttggtccaagaggcatggacaagttgatccatgatgacaagggcaacaccaccatctccaatgatggagctaccataatgaagctcctcgacattgttcatcctgctgccaagatccttgttgatattgcgaagtcccaagattccgaggttggagatggaactactacagtagttcttcttgcaggagagtttctgaaggaagcaaagccttttgttgaagatggagtccatccgcaaaacctgatacggagttatagaacagcttcttctttggcaattgagaaaattaaagaattagctactagcatagaagggaaaagcttggaagaaaaaaagagtttactggcgaaatgtgctgctacaacgctatcttcaaagctcattggcggtgaaaaggagttttttgcaacaatggtggtggatgctgtccttgctattggaaatgaggataggttgaacatgattggaatcaagaaggttcctggaggtaccatgagggactcttttcttgtgaacggtgttgccttcaaaaagacattctcatatgctggttttgagcagcaaccaaaaaagtttgtaaatcctaagttacttttgctaaacatagaattggagttaaaatcagagaaagaaaatgcagagatcaggttgtcagatccattacagtaccagtcaattgtagatgcagaatggaatatcatctatgacaaattggataaatgtgtaaagagtggagccaaggttgttttgtcacggcttgctattggtgatctggcaactcagtatttcgcagatcgtgatatcttttgcgctggtcgtgttactgaagaggatttacagcgagttgctgcggctacaggtggaactgttcagacaactgtgaacaatgtcattgatgaggtccttggatcttgtgacctatttgaagagaagcaagttggaaacgagcggtttaatatatttagtggatgtccatctggtaggactgccactatcgttcttcgtggtggcgcagatcagttcattgaggaggcagaacgaagtttacacgatgctattatgattgttagaagggctgtgaaaaactcaaccgtggttgctggtggcggtgcgattgatatggagataagtcggtacctgagacagcatgcacgtacgattgccggaaagtcccagctgtttataaactcttatgccaaagcccttgaggtaatcccacgacaactgtgtgataacgctggttttgacgcaactgatgtgttgaacaaactgagacaaaaacacgcccttccatctggggaaggcgcaccttatggtgtagacattaacactggtggaattgctgattcatttgctaactttgtttgggagcccgctgttgtgaagattaatgcgataaatgcggctacagaagcagcttgcctcgtcttaagtgtggacgaaactgtgaagaaccctaagtctgagagtgcacaaggagaggctgctatgggcagaggtggtggtggtatgcgtggccgcggtggccgaggaatgaggaggcgataaaagccttttgaaagttgtgtttcactttcaaaacatctttttgttgttactctttgatttttgtttttgtttgtgtttccatttattttgtttttattgtaatctctgccttttttagcaccccgcagaagaatagtacttagtaaccttatttcgtgatttttatttgtagtgcattggagactgttgattagttttgagtttattcatctgagaaattctcacttatattttacccc

SEQ ID NO: 2045 - DNA, 2118 bp, Triphysaria pusilla
acaaattaaaagcaccggaaaccccctcaaagatttataaaaccctagaacattctgcttcactctcacttcaatcagcagagaacactaagcaaatcacatcaaatctaacaatgtcagccatgctgcaaccacaaatcatactgctcaaggaggggactgatacatctcaaggaaaaccgcagctgataagtaacatgaatgcctgcatggctgttgctgatgttgtgcgaactaccctcggcccaagaggcatggacaagttgattcatgatgacaagggtaacaccaccatctccaatgacggggccaccataatgaagcttcttgacattgttcatcctgctgccaagatccttgttgatattgcgaagtcccaagattctgaggttggagatggaactactacagtggttctgcttgcaggagagtttctgaaggaagcaaagcctttcgttgaagatggagtccatccacagaacctgatacggagttatagaacagcttcttctttggcaattgagaaaattaaagaattagctactagcatagaggggaaaagtttggaagaaaaaaagagtttactggccaaatgtgctgctacaacgctatcttcaaagctcattggtggtgaaaaggagttttttgcaacaatggtggtggatgctgtccttgccattggaaatgaggataggctgaacatgattggaatcaagaaggttcctggaggtaccatgagggactcttttcttgtgaacggtgttgcctttaaaaagacattctcctatgctggttttgagcagcaaccaaaaaagtttgtaaatcctaagttacttttgctaaacatagaactggagttaaagtcagagaaagaaaatgcagagatcaggttgtcagatccattacagtatcagtcaattgtagacgcagaatggaatatcatttatgacaaattggataaatgcgtaaagagtggagccaaggttgtcttgtcacggcttgccattggtgatctggcaactcagtacttcgcagatcgtgatatcttttgtgctggccgtgttactgaagaggatttacaaagagttgctgcggctacaggtggaactgttcagacaactgtgaacaatgtcattgatgaggtccttggatcttgtgacctatttgaagagaagcaagttggaaacgagcggtttaatatatttagtggatgcccatctggcaagactgctactattgttcttcgtggtggtgcagatcagttcattgaggaagcagaacgaagtttacacgatgctattatgattgttagaagggctgtgaagaactcaactgtggtagctggtggcggtgccattgatatggagataagtcggtacctgagacagcatgcacgcacaattgccgggaagtctcagctctttataaactcttatgcgaaagcccttgaggtaatcccacgacaactgtgtgataacgctggtttcgacgcaactgatgtgttgaacaaactgagacaaaaacatgcacttccatctggggagggtgcaccttatggtgtagacatcaacactggtggaattgctgattcatttgccaactttgtttgggagccggccgttgtgaagatcaatgcgataaatgcggctacagaagcagcttgccttgtattaagcgtggatgaaactgtgaagaaccccaagtctgagagtgcacaaggagaagctgctatgggcagaggtcgtggtggaggtggccgtggtggccgaggaatgaggaggcgataaaagcctttcgaaagttgtatttggctttctcgttcttggttaaattttcttattactcgttcaatctgtgattttgtttgtgtttcagtttgttttgttttcttgtattctctgccctttttagcacactgcaaaaagataggaattagtaaaccctatctcatgatttttatttgtagtgccaggtcgatattggtgttttgttttgagtttaacgtcaggcttgaactaaatttcatccgctagcctcttgttatgagaaatttcatccacatttcaccccgagtcttttttactatgaatattttctgtgcatatatgtttatctggt

SEQ ID NO: 2046 - DNA, 1823 bp, Tripterygium wilfordii
tctctcgaccgcataatggctgcgatgatgcaaccgcagatcatactgttgaaggagggaacggacacttcacaggggaaggcacagttggtgagcaacataaatgcttgcacagcggtggccgacgtggtgaggacgacgttgggtcctagagggatggacaagctgatccatgacgataaaggtaacgttaccatctccaatgatggcgccaccatcatgaagcttctcgacattgtccaccctgctgccaagatccttgttgacatcgccaaatcccaggactctgaggttggtgatggaacaactactgttgtgctactggcagcggagtttttgaaggaggccaaaccttttatagaggatggagtccactctcaaaatttgatacggagttacaggacagctggaaatttggcaatctcgaaggtaagagaactagctgttagcatagaggggaaaagtttagaagagaagaagagcttactggctaaatgtgctgcaacaacactctcatcaaaactcattggtggagagaaggatttctttgcttcaatggtagtggatgctgtcattgctattgggaatgaagatagactgaatatgattggaatcaagaaggttccaggtggtaatatgagagactctttcttggtcaatggtgttgccttcaaaaagaccttttcttatgcgggtttcgagcagcaaccgaagaagtttttaaaccccaagatacttttgctcaacatagaattggagcttaaatctgagaaagaaaatgctgaaataaggctgtcagatccatctcagtatcagtcaattgtagatgcagaatggaatatcatctacgataaattggataaatgtgtgcagagtggagcaaaagttgttctttcacgtctagctattggtgatctagctacgcagtattttgcagatagagatatcttctgtgctggtcgtgtggcagaagaagatctgcaacgggttggtgctgcggccggtggcacggtgcaaactactgtcaataatgtaattgatgaggttcttggaacctgtgagcttttcgaggaaagacaagttggaaatgagaggttcaatatatttagtggatgtccatctggaaggacagctacaatagttcttcgtggtggagctgatcagttcattgaagaagctgagcggagcttacatgatgcaatcatgattgttagaagagctatgaagaactcaactgtggttgctggtggtggtgctatagatatggaaataagtcgatacttgaggcagtacgctcgcgatatagctgggaagtctcagctatttattaactcttatgcaaaagctctcgagataatcccacgacaactttgtgacaatgctggatttgatgctactgatgtgctgaacaaattgagacaaaaacatgcgcatccatctggtgatggtgcaccttatggagtggatattaacactggtggaattgcagattcttttgctaactttgtctgggagcctgcagttgtaaagataaatgctttaaatgcagctacagaggctgcttgcctcgttttaagtgtggacgagactgtaaagaaccccaagtctgaaagtgctcaaggagaagctgctgcaagtgccatgggtggtagaggacggggaggagctttccgtggtcgtggacgcggcatgcgtaggcgatgagctcaccagatatcgaatttttgaaacagttatttgctttgtcaagctaagattaaatggaagattttgtttagttgaaattctgaaatgctgaagtcaagggttatcgcttttttttt

SEQ ID NO: 2047 - DNA, 2183 bp, Citrullus lanatus
gaaaaaaagcaaaaaaaagaaatcttcggaagttagaaagcttgacgcacaagtgcttcttctccaactctccacaaaaccctagagacctcacaaacactttaacaccttcttcacttccgttctactcccgcctccacatctccaacaatggcagccatgctgcaacctcagatcatactgctgaaagagggaacggatacttcccaaggcaaggcgcagttggtgagcaacatcaatgcctgcacagcagtggccgatgtggtgcgtaccaccttgggacctagaggtatggacaagctcatccatgacgataagggtaatgtcaccatttctaatgatggcgctaccattatgaagctcctcgatatcgttcatcctgctgctaagatcctcgtcgacatcgctaagtcgcaggactccgaggttggtgatgggacaacaactgttgttcttctcgctgctgagtttttgagggaggccaagccttttatagaggacggagtccactctcaaaatttaatacggagctataggactgcaagccatttggcaattgagaaagtaaaagagttggcgatcagtatagaggggaagagcttggaggaaaagaaaagcttgttggctaaatgtgctgcaacaacactttcatctaagctcattggtggagagaaggatttctttgcatcaatggttgttgatgctgttattgcaattggcaatgaagataggctaaatatgattggtataaagaaggttcctggagggaccatgcgtgactccttcctggtaaatggtgttgccttcaagaagacattttcctatgcaggtttcgaacagcagcctaagaagttttcaaatccgaaaattctcttgctaaatattgaattggaactgaaatcagaaaaagaaaatgcagagatacggctctctgatccatcgcagtatcagtccattgttgatgcagaatggaatattatttatgaaaaattagacaaatgtgtagagagtggagccaaggttgttctttcacgtttggctattggtgatcttggcacacagtattttgcagaccgagatattttctgtgccggccgtgtggctgaggaagatcttcaaagggttgctgctgcaactggtggaactgtacagacatctgttaacaatgttatcgatgatgttcttgggacatgtgaggtttttgaggaaaagcaagttggtaatgaaagatataatatattcagtggctgtccatcaggtagaacagccaccatagtccttcgaggcggagctgatcagtttattgaagaagcagagcgtagcttgcacgatgcaatcatgattgtaagaagagcactgaagaattctactgttgttgctggtggtggagcaatagatatggagatcagtcgatatttgaggcaacatgcacgcacaatagctggcaagtctcaactttttatcaactcatatgccaaagctcttgaggttatccccagacaactgtgtgacaatgctgggtttgatgctaccgatgtgctcaacaaattgcgacaaaagcatgctcatccttcaggtgagggtgcaccgtatggagtggatatcaacaccggtggagttgctgattcatttgcaaactttgtatgggaacctgctgttgtgaagataaatgctattaatgctgctacagaggcagcttgtctcatactaagtgttgacgaaactgtgaagaatcccaagtccgagagtgcacagggggaagctgctgccagtgccatgggcggaagacgtggtggggctgcattccgtggccgtggacgtggaatgcgaagacgataacagcttcattcatcttgcttgcgagaagcacggtttggttagttcaatttacatttttgcctgcgtgtgcttttcaaaatgtactacaatcagattttaatcttattagggccaatagacaagaccttgagttatatatccgttgggaatttggtcatatagaacttccggatgaagagtgattttgatggtgcatctgattgcccttttttctttcccttttttcttttcctatttgtggaccctacatattcattttgtagttttgaattatttgtagagaatttttcttcaattttttttttccttttttcccctggaattatagtttaattttgttaaga

SEQ ID NO: 2048 - DNA, 1827 bp, Cyclamen graecum
ctctctctctcgatctcgatcatcacctgtaatggcggcgatgatgcaaccacagatcatattgcttaaggaaggaacagacacgtctcaagggaaggcacagttaattagcaatataaatgcgtgcacggctgtggctgatgtcgtgcgcaccactctgggcccaagaggtatggacaagttaattcatgacgataaaggcaaaaccacaatctctaacgatggagccaccatcatgaagcttcttgacattattcacccagcagcaaagatccttgttgacatcgctaagtcccaagactccgaggttggtgatggcaccactactgttgttcttttcgcgggggagtttctgaaggaggccaaaccttttatcgaggatggtgttcactctcaaaatttgatccgaagttaccgcacagcgtgccatttggcaattgagaagatcaaagaactagctgttagcatagaagggaaaagtttggaagagaagaaaactttgttagctaagtgcgctgccacaacactctcatcaaagctcattggtggagaaaaggatttctttgcgtctatggtagtggatgctgtcattgcgattgggaacgatgatcggcttaatatgattggaatcaagaaggttccaggaggtaccatgcgggattcttttcttgtaaacggtgttgccttcaagaagacattctcatatgctgggtttgaacagcaacccaaaaaatttgagaaaccacaaattctcttattaaacgtggagctggaactgaaatcagagaaagagaatgcagagataagactttcagatccatcacagtatcagtcaattgttgatgctgagtggaatatcatttatgataagttggataaatgtgtgaaaagtggggccaaaatcgtcctttcacgccttcccattggtgatctggctacacagtattttgcagatcgtgatattttttgtgctggtcgagtgacagaagaggatttacatcgagttgcagccgcaactggtggaactgtgcagacctctgttaataacatcattgatgaggttcttggatcttgtgagcttttcgaggagaaacaagttgggaatgagcggtttaatatatttagtggatgcccatccggtcagacagccacaattgttcttcgaggtggagctgatcagttcattgaggaagctgagcggagtttgcatgatgcaatcatgattgttagaagagctttgaagaattcaacagttgttgctggtggtggtgcaatagatatggagataagccgctacttgaggcagcatgctcggactatagctggaaagtcccaactttttatcaactcctgtgctaaagctctagaggttattccacgacaactttgtgataatgctggctttgatgcgacggatgtgctaaacaagttgagacagaagcatgcccttcaatctggggagggtgcactatatggtgttgatatcaacactggtggaatcactgattcatttgccaacttcgtatgggagcctgcggttgttaagctcaacgccataaatgctgccactgaagcagcttgcctcatattaagcgtggacgaaacagtcaagaacccaaagtctgagagcgcacaaggagatgctgctgctaatgccatgggtggcagaggccgtggtggagccgctttccgtggtggacggggacggggaatgaggaggcgataggaagttttcggtatctttttatttcttgtttattgaagtcgtattttttgttgtgattgctatctgctacccactaatgaagtttattagatgactagggc

SEQ ID NO: 2049 - DNA, 2363 bp, Petroselinum crispum
cacatcgccactcacaatgtctactatgatggtaaattcttctctctcatctcactccaattcatatattcaaatgtatatacatgtttgtattatatagatcatagacttacagcactttagactgtcatttgaaatgaaattattaacacatcacagttagtgcgattataattgttggattcaactaatatttactcacattttcgaaactcttaaactggttagaattcgataaattgagctaattgtaaacattaggtttgtttgtttgtcgcgaataatggtgttcttatagatcttattgattatgactgtttaaaaaatgtatgcggaaacagcaacctcagattatattgttgaaagaagggacggatacgtcgcaagggaaggctcaattagtgagcaacattaatgcttgtatggctgtggctgatgtggtgagaaccactcttggaccgaggggtatggacaagttgattcacgatgataagggcaatactactatttctaatgacggtgctacgattatgaagcttcttgatattgtccacccggctgccaagatccttgttgatattgctaagtcgcaggactctgaggtgggtgatggaaccactacagtggttttgcttgcaggggagttcttaaaggaggcaaagcccttcattgaagatggtgtgcacccacaaaacctcatccggagttatcggactgcttcctatttggcgatcgagaagatcaaagaattagctgttagcatagagggaaaaagtttagaagaaaagagaagtctattagctaaatgtgctgctacgaccctttcctcaaagcttataggtggagaaaaagagttctttgcatcaatggttgttgattctgtcctagcaattggtaatgatgataggctaaacatgattggaataaagaaggttcccggaggtacaatgcgcgactctttcttagtaaacggtgttgccttcaagaagacattttcatatgctggttttgaacagcaaccaaagaaatttgaaaatcccaagatactattacttaacatcgaattggagctaaagtcagaaaaagaaaatgctgaaataaggctatcagatccattgcagtatcagtcaattgttgatgcagaatggaatatcatttatgataaattggataaatgtgtgaagagtggagccaaaattgttctttcacgtctggctattggtgatctaggaacacagtattttgcagatcgagatatcttttgtgctggacgtgttgctgaagaggatttgcagcgagttgcagcagccacaggtggaactgttcagacatcagtcaacaatgtcattgatgaggttctgggaacttgtgagatttttgaagaaaaacaagttggaaatgagcgttttaatatatttagtggatgcccttcaggccagacagcaactatagttctccgtgggggagctgatcagttcatcgaggaagcagagcgcagcttacatgatgcaataatgatagttcggagggctatgaagaactctactgtagttgctggtgggggtgctatagatatggagattagcagatacttgaggcagcattcacgcacaatagctggaaagtcccaactattcattaattcctatgcaaaagctcttgaggttatcccacgacaactttgtgacaatgctggatttgatgcaactgacgtgctgaataatctaagacagaaacatgctctagcatcaggtgagggtgcactttatggggtagatatcaataccggtgggattgctgattcatacgcacattttgtttgggaaccagcagttgtaaagataaatgccatcaatgcagccacagaggcagcttgtctcatcttaagtgtggatgagacggtgaagaacccaaagtccgagagtgcacagggagaagctgctgcaagtgcaatgggtagagggcgtgggggcggtggtcgtggtagaggaatgcgtaggcgataggctattaagggactagttgtatttttacgcagttaatgggtggtttaccaatcggagtttttaggcatgatcaaccatccttacttttctttttactcatcctttgtaactaaactatatatttaaggctgtatttttcccccccccccccccccccccccccccccccccccccccccccccccccccccccccccccccctttttattgtgatttggcctttagtggtgcctttttgtatccaatgccctaaattttgtatggcttgtgccagttttgactactaagagttcacattacgtctttgtatctttatattcttaaagttggatgaacttatacgagtgagcttgttg

SEQ ID NO: 2050 - DNA, 1928 bp, Ambrosia trifida
aacactcactaccgaaacactaaaaccctaatttcaccctcctgcatcacctccaccgttctccgccgcaccaaatccgctaacaatggcatcaatgatgcaaccacagatcatactactaaaagaaggtacagacacatcacaagggaagccacagctaataagcaacatcaatgcgtgtatggcggttgctgacgtcgtccgtacaaccctaggtcctcgaggtatggataaattaatccatgatgacaaaggtaacaccactatttccaacgacggagctactattatgaagcttctcgatattgttcatcctgctgctaagatccttgttgatattgctaaatcacaggattctgaggttggcgatggaaccactaccgtcgttctccttgctggtgagttcttgagagaggccaaaccattcattgaagatggtgttcatcctcaaaatctgatacgaagttatcgagccgcttccaatatggcaattgagaagattaaagaattagctgtaagcatagagggaaaaagtttagacgagaaaagaagcttattagctaaatgtgctgctacaacgctctcatcgaagctaataggtggagagaaagacttttttgcaaaaatggttgttgatgccgtcattgcaattggaaatgatgatagactgaacatgattggaataaaaaaggttcctggtggtacaatgagggattcctttcttgtgaacggtgttgcctttaaaaagaccttttcttatgctgggtttgagcagcaacccaagaagttccaaaatccaaagatattactgttgaacattgagctggaactaaaatcagaaaaagaaaatgctgagataagactttcagatccgttgcaatatcagtctatagttgatgcagaatggaatatcatatatgataagttggataaatgcgtgaagagtggtgccaaaattgttttgtcgcgtctggctattggtgatctggcaacgcagtattttgcagaccgtgatattttttgtgctggccgcgttgctgaagatgacctacaccgtgttgcagctgcaaccggaggtactgtccagacatcggtgaacaacgttatagatgaggttcttgggtcttgtgatgtttttgaggaaaagcaagttggaaatgaacggttcaacatatttagtggatgtccttcaggccagacagccacgattgttcttcgaggtggagcagatcagtttattgaggaagctgagcgcagcttacacgatgcgattatgatcgtgaggagggctatgaagaattccacagtggttgctggtggcggtgcaatagatatggagataagccgttacctgtggcaacatgcgcgcaatatagctgggaagtcacagctttttataaacgcctttgctaaagcacttgaggttattccacgtcaactttgtgataatgctggattcgacgcaactgatgtactaaacaaactgaggcaaaaacacgcacttccttctggtgagggcgctctttacggagtagatatcaacacgggtggaatttgtgattcatttgccaattttgtgtgggagcctgcgttggtgaagataaatgctataaatgctgcaacagaggcagcatgccttgtcttaagtgttgatgaaaccgtgaagaacccgaagtcagagagcgcacaaggagaggcggctgctggtatgggtagaggccgtggcggtggcatgcgtggaagaggtatgcgcaggcgttaagcatcttcattttggtatttaaacgttcaacctactactactgctttgttgggtttttttcttctgtacggaacttgttgcgccgaggtttatttcaacacatttgtaggtagttgaagggattaaaagttgattaattgtaaaaataattttaggttaaacttag

SEQ ID NO: 2051 - DNA, 1949 bp, Manihot esculenta
actgaaactccagtctttactctctgagctctctttggttctcatctaaaccttcctcacttcaaatcttcagcaatggcagccatgctgcagccgcagatcatactcttgaaggaagggacggatacgtcgcaagggaaggctcagctggttagcaacattaatgcttgcactgcggtggccgatgtagtcaggacgactctgggacccagggggatggacaagctcatccacgatgacaaaggcagtgttaccatttccaatgatggagctaccataatgaagttgcttgatattgtccatccggctgctaagatccttgccgatatcgctaagtctcaggactctgaggttggtgatggaaccactacagtagtattgcttgcagctgagtttttgaaggaggccaaaccttttgtggaggatggagtccacccacaaaatttaatacggagttataggactgcatgctatttggcaattgagaagatcaaagaactagctgtaagcatagaaggaaaaagcctagaagaaaagaaaagtttacttgctaaatgtgctgccacaactctttcttcaaagcttatcggtggggagaaagagttctttgctcagatggttgtggatgctgtcattgcaattggaaatgatgataggctaaatatgattggaataaagaaggtacctggtggcaacatgcgagattcctttctagtgaatggtgttgcctttaaaaagacattttcatatgccgggtttgaacagcaaccaaagaagtttttaaatccaaagatacttctactcaacattgaattggaattgaaatctgagaaagaaaatgcagagataaggctgtcagacccgtcacagtatcagtcaattgttgatgcagaatggaatattatttatgaaaagttggataaatgtgtacaaagtggggccaaagtggttctttcacgtctggctattggagatttggcaacacagtattttgcagatcgagatattttctgtgctggtcgtgtagctgaagaagatttgcaaagggttgcagctgcaactggtggaactgtgcagacaactgtgaacaacataatcgaggaggttcttggagcttgtgatatttttgaggaaaagcaagttggaaatgagaggtttaacatattcagtggatgcccttctggaaggacagccactatagttcttcgtggtggagcagatcagttcattgaggaagctgagcggagtttacacgatgcaatcatgattgttagaagagctttgaaaaactcaaccgttgttgctggtggtggtgccattgatatggaattaagcagatatttgaggcagcatgctcgcacaatagctgggaagtctcagttatttatcaactcttatgcaaaagcccttgaggttatcccgcgacaactatgtgataatgcggggtttgatgcaactgatgtgctgaacaaattaagacagaagcatgcacttccatctggtgagggtgcacctttcggagtggatatcaacactggtggaatagctgattcatttgctaattttgtttgggaaccagccgttgtaaagattaacgcaataaatgctgctactgaggctgcctgtcttgtattaagtgtggatgagacagtaaagaaccctaagtctgaaagtgcacagggggaagctgctgcaagtgctatgggcggtagagggcggggagctgccttccgtggccgtggacgaggtatgcgaagacgatgagctaactggatgtgatttgcaggaggtgttgtacttgttaacgagcatctttcaaattttctccccttgatatcagtcggtttcaatgtatgatcatttgaattagatttgttctatctgcctattcaacttatggacgtagtggccttgcgactcattgtctaaaattttgttgatttggtatt

SEQ ID NO: 2052 - DNA, 2114 bp, Eucalyptus grandis
aaaaaccctagtcccccttctccctccttctccctccctccctctctctctctctctctcttctcctctgcaagctccgatccgcgacaatggcagccatgctgcaaccgcagatcatcctgctgaaggaaggcacggacacgtcgcaggggaaggggcagctggtgagcaacatcaacgcctgcacggtggtggccgacgtcgtccgcaccaccctcggcccccgcggcatggacaagctgatccacgacgacaagggcgccgtcaccatctccaacgacggcgccaccatcatgaagctcctcgacatcgtccaccccgccgccaagatcctcgtcgacatcgccaagtcccaggactccgaggttggtgatggaacgactacagtggttctacttgcgggagaatttttgaaagaggctaaaccttttattgaagacggggtccatcctcagaatttgattcgtagctatcggacagcatgctctcttgcaattgagaaggtcaaagaactagccattagcatagaagggaaaagcttggaggagaagaagagcttgttggctaaatgtgctgctacaacactttcttcgaaactcattggtggagagaaggagttttttgctttaatggtcgttgatgctgttattgcaattggaactgatgacagactgaatatgattggaatcaagaaggtgccgggtggtagcatgagagattcattccttgttgacggtgttgcttttaagaagacattttcctatgcaggtttcgaacagcagccaaagaagtttctgaaacccaaaatacttttgttgaacattgaactggaactgaaatctgaaaaggaaaatgctgagatcagactttcagatccctcacaatatcaatcgatagttgatgctgaatggaatattatatatgacaaactggataaatgtgttcaaagtggagcaaaagtcgttctgtcacggttagccattggcgatttagctacacagtatttcgcagaccgagatattttttgtgctggtcgtgtgactgaggaagatctactaagggttgctgctgcaactggtggaactgtacagacatctgttaacaatgtgatcgatgaggttcttggtacttgcgaaatttttgaggaaaagcaagttgggaatgaaaggtttaacatattcagtgggtgcccatcaggtctgacagcaactattgttcttcgtggtggagcggatcagttcattgaagaggctgagaggagtctacacgatgcaatcatgattgttagaagagctctgaagaactccactgttgttgctggtggcggcgctatagatatggagataagtcgatatttgaggcagcatgcacgcacaattgcagggaaatcgcagctttttattaattcatatgccaaggcacttgaggtcattcctcgtcaactctgtgacaatgctggctttgatgcaactgacgtgttgaacaaattgaggcagaagcatgctctcccatctggagaaggtgcaccttatggagtggatattaacaccggtggaattgctgattcttttgccaactttgtttgggagccatctgttgtgaaggttaatgcaataaatgcggctactgaggctgcttgccttgtattaagtgtggatgagacagtaaagaaccctaagtctgagagtgcccaaggagatgctgctgctatgggtggcagagggcgtggaggagctgctttccgtggtgggcgtggacgtggaatgagaaggcgatgagctgctcagaaccatggaaacgattctgtagcggtttggttctctttatcatcgtgccagtgttcatcgtccagtcctttccggggtcgtgattcgaaacctgtgtgaccctgcttgaatcttacagagtgagatggctttggatgggatggtcaatttattaatcaaatttttgtataaggacggtgatcctcttcctctaatgattgctggttggcaattgaagatatttgatgtgggataaaaagatctatttgtgatatgaaattttggctgcgcaaccttttagttccctgatgctatggaccgtgccgacgtaattatgcactatccgct

SEQ ID NO: 2053 - DNA, 1825 bp, Flaveria ramosissima
tctctaaacttctaaagttacttaaagaaccaaaacacccactcggtgtaaaaccctagcttcaccatctgctaccattctccgccgcaccaaatacgctcacgatggcatccatgatgcaacctcagatcattctgctcaaagaaggcacagacacctcgcaggggaaaccgcagcttataagcaacatcaatgcgtgtatggcggtggctgatgtcgtccgtacaaccctaggtcccaggggtatggataaattgatccatgatgacaagggtaacaccactatttctaacgatggagccactatcatgaagcttcttgacattgttcatcccgctgctaagatccttgttgacattgctaagtcgcaggattcggaggttggtgatggaaccactaccgtagttctccttgctggtgagttcttgagagaggccaagccgttcattgaagacggtgttcatcctcaaaatctaatacgaagttatcggtccgcttccaatatggctattgagaagattaaagagctagctgtaagcatagaggggaaaagtttagacgaaaaaagaagcttattagctaaatgtgctgctacaacactctcatcgaagctaataggaggagagaaggacttttttgcaacaatggtcgtggatgctgtcattgcaattggaaatgatgatagactgaacatgattggaataaaaaaggttcctggtggtacaatgagggattcctttcttgtgaatggtgttgcttttaaaaagactttttcatatgctgggtttgagcagcaacctaagaaatttcaaaatccaaagatattactattgaacattgagcttgaactaaaatcagaaaaagaaaatgccgagataagactttcagatccgttgcaatatcagtccatagttgacgcagaatggaatatcatatatgataagttggataaatgtgtaaagagtggtgccaaaattgttttgtcgcgtctggctattggtgatctggcaacacagtattttgcggaccgggatatattttgtgctggtcgagttgctgaagatgatctgcatcgtgttgcagctgcaactgggggtatggtacagacatcggtcaacaatgttatagatgaggttcttgggtcttgtgaggtttttgaggaaaagcaagttggaaatgaacggttcaacatatttagtggatgtccttcaggccagacagccaccattgttcttcgaggaggagctgatcagtttattgaggaagctgagcggagtttacatgatgcaatcatgattgtgaggagggccatgaagaattccacagtggttgctggtggcggtgcaatagatatggagataagccggtacctgtggcaacatgcacgcaatatagctggaaagtcccaactatttataaatgcctttgctaaagcacttgaggttattccgcggcaactttgtgataatgctggatttgatgcaactgatgtactcaacaaactgaggcaaaaacacgcacttccttctggtgaaggtgctctttacggagtagatatcaacacaggtggaatttctgattcatttgccaactttgtgtgggagccagcagtggtaaagatgaacgctataaatgctgcaacagaggcagcatgccttgtcttaagtgttgatgaaacagtgaagaacccaaagtcggagagtgcacaaggagaagctgctgctggcatgggaagaggacgcggtgggggtgctatgcgcggaagaggtatgcgtagacgttgaacgtggtataatatcatttaagtttgaatctttactgtgag

SEQ ID NO: 2054 - DNA, 2312 bp, Panax ginseng
ggggcttctgtttttttcattaaaaataactaaaataaaaccggagcgagaaatcccgtgagaaaggtagttcagtaaaaccctagctccgtctacaactacttgttctctcccacttctgctactactactggtttctcctcatttccccctatttctctttatacgcctcgccattaacgatgacagctatgatgcaacctcagattatattgctgaaagaagggacagatacttcccaagggaaggcccagttgatcagcaacatcaatgcgtgtatggcagtagcagatgtggtgcgcaccactcttggaccgaggggtatggataagttgatccatgatgacaagggaaataccaccatttctaatgatggtgccactattatgaagcttcttgacattgtccaccctgcagctaagatccttgtggacattgccaaatcacaagactctgaggttggtgatggaaccaccaccgtagttctacttgcgggggagttcttgaaggaggctaagcctttcattgaggatggggtgcacccacaaaatctgatacggagttatcggaatgcttcctatttggcaatcgagaagatcaaagaattagctgttggtatagaggggaaaagtttagaagaaaagaaaagtctactagctaactgtgctgccacaacattatcttcaaagctcataggcggagagaaggaattctttgcatcgatggttgttgattctgtccttgcaattgggagtgatgatagactaaatatgattggaataaagaaggttcctggaggtacgatgcgggactctttccttgtaaatggtgttgccttcaaaaagacattttcatatgccggttttgaacaacaaccaaagaagtttgaaaatcccaaaatactcttactaaacattgaactggaactaaaatcagaaaaagaaaatgcggagataaggctttcagacccattgcagtatcagtcgattgttgacgctgaatggaatatcatttatgataagttggataaatgtgtgaagagtggagccaaaattgttctctcacggctggctattggtgatttagcaacacagtattttgcagatcgggatatattttgtgctggtcgggtttctgaagaggatttgcatcgagttgcagctgcaactggtggaactgtacagacatctgtcaacaatgttatcgatgaggttcttgggtcttgtgagatttttgaggaaaggcaagttggaaatgagcggtttaatatatttggtggatgccccctgggccagacggccactatcgttctccgcgggggagctgatcagttcattgaggaagcagaacggagtttacatgatgcaattatgattgttaggagggctgtaaaaaactctactgtagttgctggtggtggtgctatagatatggatataagtcgatacttgaggcagcatgcacgcacaattgctggaaagtcccagctatttataaactcatatgcaaaagctcttgaggttatcccccggcagctgtgtgacaatgctggatttgatgcaactgatgtgctgaacaaactaagacagaagcatgctcttccatcaggtgagggtgcactttttggggtcgatatcaacactggtggaattgctgattcatacgccaactttgtgtgggagccagcagttgttaagatcaatgctataaatgcagctactgaagcagcttgccttatcttaagcgtggacgagacggtaaagaacccaaagtctgagagcgcacagggagaagctgcttcaagtgcaatgggtagagggcgtggtggtggtggtctccgtggtcgtggaagagggatgcgtaggcgataagactttccaggtgtaaatttacacaagaatcaagtggttttactaatcaaattttgaagtcatgattggcttgcgtgttcaactatctttcttttctcctcctcttttttctttctccctggcccttataacttgaatatagagttcaaaggtgtaattctatggtggttcttttcctagatgtacaccttttaccctttgcttgcttctgacttttgaaccttgtgtggtactagtcaattttgggtatcaggaacttacacatctattcttgtatgtattgaattggcagtactactcccactggggtgtgctaatgtatcagcattagatctacttttatgcaaaggctctgctctctctctctctactaaaaaaaaaaaaaaaaaaaaaaaaaaaaaaaaaaaaaaaaaaaaaaaaaaaaaaaaaaaaaaaaaaaaa

SEQ ID NO: 2055 - DNA, 2067 bp, Aquilegia formosa
ctctctttaaatcttaaaccctaattcactacttttttccctccaatctcagatctgcaacaacttttaactttacttcaatggcgtctatgatgcaaccacaaatcatattattgaaagaaggaacagatacatcacaaggaaaagcacaattaattagtaatatcaatgcttgtacagcacttgcagatgtagttcgtactacacttggtccaagaggtatggataagttgattcatgatgataagggtaatactactatttctaatgatggagctactattatgaaacttcttgatgttgttcatcctgctgctaagattcttgttgatatcgccaagtctcaagattctgaggttggtgatggtaccactacagtggtactctttgctggagaatttttgaaggaagctaaaccttttatggaggatggggttcacccacagaatcttatacgcagttatcgtattgcttgccaattggcgattgaaaaaattaaggaacttgctgtgagcatagaaggaaagagtatggaagaaaagaagagtttgctgcagaaatgtgctgctactacactttcgtcaaaacttattagtggagaaaaggaattttttgcatctatggttgtggaggcggttattgctattggcaatgatgatagactcaatatgattggaataaaaaaggttccaggtggtaacatgcgggattcgtttcttgttagtggtgttgccttcaagaaaacattttcctatgctggatttgagcagcagcctaagaagttcttaaatgcaaagatacttttgcttaatattgagctagaactgaagtcagaaaaagaaaatgcagagataagactttctgatccattgcagtatcaatcaattgttgatgccgaatggaatatcatttacgacaaattggataaatgtgttcaaagtggggctaaaattgtcctttcacgactggcaataggtgatttggcaacacagtattttgccgatcgagatatcttctgtgctggtcgtgtaactgaagaggacttgcaacgggttgctgccgctactgggggaactgtacagacatctgtcaacaacgtcatcgatgaggtccttggaacctgtgagctttttgaggaacgccaagttggaaacgagcgtttcaatatatttagtgggtgtccatcaggtcagacagcaactattgttcttcgtggtggtgctgatcagttcattgaggaggcagagcggagtctacacgatgctattatgatagtcagacgggctctaaaaaactcaactgttgttgctggtggtggtgctattgatatggaaattagtaggtatttgagacagcacgcacggacaatagctgggaagtctcagctttttataaattcttatgcgaaagcatttgaggttatcccaaggcagctgtgtgacaatgctggatttgatgcaactgatgtattgaacaaactcagacagaaacatgcacttccatctggtgagggtgccctttttggggtggatatcaacactggtggaatcatagatacatttgccaactttgtatgggaacctgcagttgtgaagataaatgccattaatgcggccacagaagcagcttgccttattctaagtgtggatgaaacagtgaaaaacccaaagtctgaaagtgcacaaggagatgctgctgctggtgccatgggtcgagggcgtggtatgggaggtttccgtggtcgtggacgaggaatgaggagacgttgagctcttagcttttggaattttaaagaaagattggtaaattgtgggcaagattttgacagcaagtgtgttttgtttcttggaaagttcgcttttcggctttcacctttattctactacagtttgagtgagtgtagcaatagatccttccagtttgtaagcaatagaggcaccatctgagctagaaagtataaaaatgcggatggtccaaggcacattacaactaactattgtttgacttgttctagaatgcaccttaattcctcatttactaaagtagtagtgttgtgattgaatggct

SEQ ID NO: 2056 - DNA, 1960 bp, Arabidopsis lyrata
ccctctctctctctctttctgctcatttctcgcactttcttcacatctccgaagctcttctttacgcatctacaatggcgtcgtcgatgatgcaaccgcagatcatactgctaaaggaagggacggacacatctcagggtaaagcgcaactagtaagcaacatcaacgcttgcacggctgttggagatgtggttcgaaccacgctcgggccacgagggatggacaaactcattcacgacgataaaggatctgtaaccatttccaacgatggtgctaccatcatgaagctcctcgatattgttcatcctgctgctaagatcctcgtcgatatcgccaaatcccaagactctgaggtgggtgatgggacaactacagtggttcttcttgcagcagagtttttgaaggaagctaagccatttattgaggatggtgttcactctcagaatcttattaggagttaccgcactgcaagcactttggcaattgcgaaggttaaagaactcgctgttagcattgaggggaagagtgtagaggaaaagaaaggtttgttggctaaatgtgctgctactactctttcatctaagcttatcggtggagaaaaggagttttttgctacaatggttgttgatgctgttatggcgattgggaatgacgacagactaaatctgattgggatcaagaaggttcctggtggcaatatgcgggactctttcctcgttgatggtgtagctttcaaaaagacattctcgtatgcaggttttgagcaacagccaaaaaaatttcttaaccccaaaattctcttgcttaacatcgaattggagttgaaatctgagaaggaaaacgctgaaattaggctgtcagatccatcgcagtaccagtcaatagttgatgcagaatggaatattatttatgacaagctagacaaatgtgttgagagtggagcaaaagttgttctttctagattggctatcggagatctagctactcagtattttgcggatcgtgatattttctgtgctggtcgtgtggcagaggaagatcttaaccgtgtggctgctgcagctggcggaacagttcagacaagtgttaacaacataatagatgaggttcttggaacttgtgagatttttgaggaaaaacaagttggtggggagaggtttaatatattcagtggttgcccttcaggacgtacagcaactattgttctccgtggtggagctgatcagttcatcgaagaagctgagcggagtttacatgatgcgattatgattgtgagaagagctgtgaagaactcaactgttgttcctggaggtggagctatagatatggagataagcaagtacctgaggcagcattcaagaacaattgctgggaagtcacagcttttcatcaactcttatgcgaaggctctggaggttattccacgacagttatgtgacaatgctggatttgatgcaactgacgtcttgaataaacttagacaaaaacacgccatgcaaagcggtgaaggagcttcgtatggagtggacattaacactggtggcatatcagattcttttgctaacttcgtttgggaaccagcagttgtgaagatcaacgcaataaatgctgcgactgaagcggcttgcctcattcttagtgtggacgaaactgtgaagaaccctaaatctgagagcgcacagggagacgctgcaggtgcaatggggagagggcgcggtggaggtcgtggccgtggaatgcgaaggcgataggctctgtctcttatgctaaacttgtgggattcttctctaaatttcgattttgttgaatttttgttttgaagttaaaaaagctatcattgggtttgtgttgttcaattagaatactggttggttatgtatgtctatacaatctgtgaaacagaagttttagcgtggttttagttaaggaatttacatttgcttagacaaatcttgacaag

SEQ ID NO: 2057 - DNA, 1974 bp, Tabernaemontana elegans
cacccacacgcataaacacgagctcgttctttgcactcactaacaatggcgactatgatgcaaccacaaatcatactgctgaaggaaggaacggacacgtcccaagggaagccacagttggtaagcaatataaatgcttgtatggctgtagctgacatggtgcggtccactcttggcccaaggggaatggacaagttgatccatgatgaaaagggcaacacaacaatctccaatgatggtgctaccataatgaaacttcttgacattgttcacccagcagctaagattcttgttgatatagccaaatcccaagactctgaggttggtgatggaacaactacagtagttttacttgcagcagagtttctgaaggaggcaaagcctttcattgaggatggcgtccatcctcagagtctaatacggagtttccggacagctagctatttggcaattgagaaggtcaaggaattagctgttagcattgaagggaaaagcttagaagaaaagaagagcttactggctaaatgcgcagctaccactctctcctcgaagctcattggtggcgagaaggatttttttgcacccatggttgtggatgcagtccttggtattgggaatgatgataggctaaatatgattggaattaagaaggttccaggaggtacaatgagagattctttccttgtcagtggtgttgctttcaagaagacattctcatatgcaggttttgagcagcagccaaagaagtttgtaaatcccgagatacttttgctaaacatagagttggaactgaaatcagagaaagagaatgcagagataaggctgtcagatccatcacagtatcagtcaattgttgatgcagagtggaatatcatttatgacaagttggataaatgtgtcaagagtggggccaaaattgttctttcacggcttgctattggtgatctagcaacacagtattttgcagatcgagatatattttgtgctggtcgtgtcactgaagaggatctgcatcgtgttgctgcagcaactggtggaactatacagaccactgtgaacaatgttattgatgaggtgcttggtaaatgcgagtattttgaggagagacaagttggaaatgagcggtttaatatattcagtgggtgcccatcaggtcggacggccaccattgttcttcgtggcggagcagatcagttcattgaagaagctgaacgaagtctccatgatgcaattatgattgttagaagggctttgaaaaactctactgttgttcctggtggtggagctatagatatggagatcagtagatacttgaggcagcatgcccgcacaatagctgggaagtctcaactctttataaactcttatgctaaagcccttgaggtaatcccacgccagctgtgtgacaatgctggttttgatgctactgatgtcttgaataaattgagacaaaaacacgcactgccgtcaggtgaaggtgcaccttatggagtggacattaatactggcggaattgctgattcatttgctaattttgtttgggagccagcagtagtaaagataaatgccataaatgcagctaccgaagcagcttctcttatcttaagcgtggatgagactgtgaaaaatcccaagtctgagagtgcacaaggggaagctgctgcaagtaccatgggtggcagaggacgtggaggaccagctttccgtggccgtgggaggggaatgaggaggcgataggctatccaaaaacctacgtggctagttcatcgaagttttgattgtaatctcgattgttctgtatctttctcttatagtgtttagttttatcttcagtagcttcaagccatggtgaaatctctaacttgtatgttttttgaactaggttattcgttttagctgatttgttacttttacgagactaattttgtttggtttccaaatcctcttcaaatcgctggttgtgataatatatgg

SEQ ID NO: 2058 - DNA, 2310 bp, Aristolochia fimbriata
cacttatatatatatataaacatatttatgtgaaattcatcataacgcgttaccgaaggttgggtccgcacatccaaccatttatgttgcgagtacacatgtggggttgcgtgtaccgagagtctcttgacgttcatcgtgtgcgaaaaacctagacgtttcaatttctccgaattcgggttttacctcttcttcgctaacactctccctccgactccctgctataaacctcttataaacctctgtcgccttctccacccactgaatccctaactcctcttcacttcttagtctctgatctttcctttcgcgaaatggcggccatgatgcaaccccagattattttgttgaaggaaggcacggacacttcacaagggaagcctcaactgatcagcaacatcaatgcttgcatggtggtggcggatgcggttcgatcgactctggggcccagagggatggacaagttgattcacgatgacaagggcaataccactatttccaacgatggtgccaccatcatgaagctgcttgacatcgtccatcccgctgctaagatcctcgtcgacattgctaaatctcaggactctgaggttggtgatggaaccacaacggttgtgcttctcgctggagagtttctaaaagaggctaagcccttcattgaggatggcgtccatgcccaaaatttaatccgcagctacaggaccgctgcctatctggcaattaataaaatcaaagaacttgctgtgagtattgaaggaaaaagtgtagaagagaagaaaagcttattggccaaatgtgcagctactacattatcatcaaagcttattggtggagaaaaggagttttttgcaaccatggttgtggatgctgtaatggcaattgggaatgatgacagattgaacttaataggcataaaaaggttccaggtggtaccatgcgtgattcattttttgttaacggcgttgctttcaagaagactttctcttatgctggttttgagcagcaaccaaagaagtttgtcaacccaaaaattcttcttctgaacattgaacttgagcttaaatccgagaaggaaaatgcagaaattaggttatcagatccgctgcagtatcaatctattgtagatgcagagtggaatatcatctatgacaagttggataaatgtgttaaaagtggggcaaaaattgttctctcacgtttggcaattggtgatttggcaacacagtattttgcagatcgagatattttctgtgctggtcgtgtggcagaagaggatttgagtagagtaactgcagcaactggtggtactgtgcaaacatctgtcaataacatacttgatgaggttcttggctcttgcgaagtttttgaggagaagcaagtaggaaatgaccgcttcaatatatttagtggatgtccttccagccagacagcaacaattgttcttcgtggcggtgctgatcagtttattgaggaagcagaacgaagcctacatgatgcgatcatgattgtcaggagagcattgaagaactctaccgtagttgcaggaggtggcgctattgatatggagataagtaggtatctcaggcagcacgccagaaccatcgctggcaagtcccagctgtttataaattcatatgccaaagcactagagattattccccgacaattgtgtgataatgctgggtttgatgcaactgacgttcttaacaaactcagacaaaaacatgcacttccatctggtgaaggtgctcgttttggtgtggatataaatactggtggcatttcagattcttttgctaactttgtgtgggaacctgcagttgtgaagattaatgctataaatgcggcaactgaagcagcatgtcttattcttagtgtggatgagactgtaaaaaacccgaagtccgagagtgcccaaggtgaggctgcagcaagcgcaatgggtcgaggtcgcggtggcgctttccgtggtcgtggtcgaggcatgaggaggcgatgatcttcttttgggtcttggaagctgtaccatgttgatctttgatggtatcagggaccatagatggttccataatgtggagcctctctgttttgtctgtgtgggtttccttctttgagttatcattcttgtacaccaccctcctcgagttgcaggctggcaatatcttggttgggaacaatcacgtggaaatttgtactggtcatgtagtttggaaccgcgcttattgagatagtaaggagtgctattacctgtatcttagccttttgccagcaaatggattttgtagtgctgttattctatgtgaaattttg

SEQ ID NO: 2059 - DNA, 1823 bp, Brassica oleracea
tctctctctctctctcgtttctccgtagctcaatcacgcatctacaatggcgtcgatgatgcaaccgcaaatcattctgctgaaggaaggcacagacacttctcaggggaaagcgcagctgctcagcaacatcaacgccgtcacggcggtcggcgacgtggttcgaaccacgctcgggccgcgagggatggacaagctcatccacgacgataagggatccgtcaccatttccaacgacggcgctaccatcatgaagctcctcgacatcgttcatcccgccgctaagatcctcgtcgatatcgccaaatctcaagattcagaggtaggtgatgggacgactacagttgtgcttcttgcagctgagtttttgaaggaggctaagccgtttgttgaggatggtgttcactctcagaatctgattaggagttatcgcactgcgagcactttggcgattgagaaggtgaaagaactcgctgttagcattgaggggaagagtgtggaggagaagaaaggtctgttggctaagtgtgctgctactactctttcgtcgaagcttattggtggagagaaggagttttttgctacaatggttgttgatgctgttatggctattggggatgacgacaggcttaatttgattgggatcaaaaaggttcctggtggtaacatgagagactctttcctagttgacggtgtggctttcaaaaagacattctcatatgcgggttttgaacaacagccaaagaagtttcttaatccgaaaatccttcttcttaacatcgagctggagttgaaatctgagaaggaaaacgctgagattaggctatcggatccatcacagtaccagtcaatagtcgatgcagaatggaatatcatttatgacaagctagacaaatgtgtcgaaagtggagcaaaagttgttctttctcgattggctattggtgatctagctactcagtattttgcagatcgtgatattttctgcgctggccgtgtagcagaagaagatcttaatcgcgtggctgctgccgctggtggaacagtccagacaagtgttaacaatataatacccgaggttctcggaacttgtgagatatttgaggaaaaacaagttggtggggagaggtttaacatattcagtggttgcccttcaggacgtacagcaactattgtccttcgtggtggagctgatcagttcatcgaagaagctgagcggagtttacatgatgctattatgattgtgaggagagctgtgaagaactcaactgttgttcctggaggtggagctatagatatggagataagcaagtacctgaggcagcattcacgaactattgccgggaagtctcagcttttcattaactcgtatgcaaaggccctggaggttattccacgacaattatgtgacaatgctggatttgatgcaactgatgtgctgaataaattaagacaaaaacacgccatgcaaagcggtgaaggagcttcatatggagtggacattaacactggtggaatagctgattcatttgctaacttcgtctgggaaccagcagttgtgaagattaatgctataaacgctgcgactgaagcagcttgccttatccttagtgtggacgaaactgtgaagaaccctaaatctgagagcgcacagggagatgcagcaggtgctatgggaagaggacgcggtggaggtcgtggccgtggtatgaggagacgataagttttctctatcttatggcaaaacttgggggtcttcttctctgaattttaattttgttgaattttgatcttgaaatcaaaaagctagtatggtgtttgtgttt

SEQ ID NO: 2060 - DNA, 1923 bp, Chrysanthemum coronarium
ccctaacaccaccatcgtctcctccaccattctccgccgccgacaacaacaaacaatggcatccatgatgcaacctcagatcatactattgaaagaaggaacagacacatcacaagggaaacctcaattaataagtaacataaatgcttgtatggctgttgctgatgttgtccgtacaaccttgggcccacgtggtatggataaactgatccatgatgatagaggtgttactactatttccaatgatggtgctactattatgaagcttcttgatattgttcaccctgctgctaagatccttgtcgatatcgctaaatcgcaggattccgaggttggtgatggaactacttctgtggttcttcttgctggtgagtttttgagagaggctaaaccgtttattgaagatggtgttcatcctcaaaatttgatacgaagttacagaaccgctgcatctatggcaattgagaaggttgaaaaattggctgtaagcattgaggggaaaagtttagatgaaaagaaaaacttattagctaaatgtgctgctacgacgctttcatcaaagctaatcggaggagagaaagacttttttgcaaagatggtcgtggatgctgtcattgccattggaaatgatgatagattgaacatgattgggataaagaaggttcctggtggtacaatgagggattcgtttcttgtgaatggtgttgcgtttaagaagactttttcatatgctgggtttgagcagcaaccaaagaagtttttgaatccaaagatcttgttgttgaacattgaactggaattaaagtcagaaaaagaaaatgccgagataagactttcagatccattgcaatatcagtctattgttgacgcagaatggaacatcatatatgataagttggataaatgtgtaaagagtggtgctaaaattgttctgtcgcgtctggctattggtgatctggcaacacagtattttgcagaccgagatatattttgtgctggtcgagttgctgaagatgatctgaatcgtgttacagctgcaactggtggtactgtgcagacatcggtcaacaatgttattgatgaggttcttgggtcttgtgaggtgtttgaggaaaagcaagttggaaatgaacggttcaacatattcagtggatgtccttctggccagacagccactattgttcttcgaggtggagctgatcagtttattgaggaagctgagcgaagtttacatgatgcaatcatgattgtgaggagggccatgaagaattccacggtggtcgctggtggtggtgcaatagatatggagataagccgattcctacggcaacatgcacgtaatatagctgggaagtcccagttatttataaatgcctttgctaaagcacttgaggttattccacgacaactttgtgataatgctggattcgatgcaactgatgtacttaacaaacttaggcaaaaacatgcacttgagtctggtgagggtgctctttatggagtagatatcaacaccggtggtatatgtgattcctttgctaactttgtgtgggagccagcagtcgttaagatcaacgctataaacgctgcagccgaagcagcatgccttatcttaagtgttgatgaaacagtgaagaacccaaagtcggagagtgcacaaggagatgctgctgctatgggcagaggacgtggcggcggcggcatgcgtggtggacgtggaagagggatgcgtagacgttagacatttctcgttttggtttatcataaaaacttgagcctaggcatgagcatgggaaatgtattctcttatgtgagaggaagtaattttggtttttaagtgaagtttttattttcctacttgtttgctggttgttttggttgctgtattgattttgtatgggacttgtattttgtagctgtggg

SEQ ID NO: 2061 - DNA, 2047 bp, Chrysanthemum coronarium
acaccccctttaatctaacttcttcttccttcattagcaaaccctacttcactccacttcttcttcttgttccatttcaaaaccctacatccaaacaccacccttaacctcctccatccacaatggcatccatgatgcaacctcagataatattattgaaagaaggaacagacacatcacaagggaaaccacaattaataagtaacataaatgcttgtatggctgttgctgatgttgtccgtacaaccttgggcccacgaggtatggataaactgatccatgatgatagaggtgttactactatttccaatgatggtgctactattatgaagcttcttgatattgttcaccctgctgctaagatccttgtcgatatcgccaagtcgcaggattccgaggttggtgatggaaccaccagtgtagttcttcttgctggcgagttcttaagagaggccaagccattcattgaagatggcgtgcatcctcaaaatctgatacgcagttatagaactgctgcgtttatggcgattgagaagattaaagaattggctgtaagtatagagggaaaaagtttggatgaaaagagaagcttgttagctaaatgtgctgctacaacactctcatcgaagctgataggaggagagaaagatttctttgcaacaatggtcgtcgatgctgtcgttgcaattgggaatgaggatagactgaacatgattggaataaaaaaggttcctggtggtacaatgcgggactcttttctggtaaatggtgttgcgtttaaaaagaccttctcatatgctgggtttgagcagcaaccaaagaagtttttgaatccgaagatattactgttgaacattgaattagaactaaaatcagaaaaagaaaatgctgagataagactttcagacccgttgcaatatcagtccatagttgatgccgaatggaatatcatatatgataagttggataaatgtgtacagagtggtgccaaaattgtcttgtcgcgtctggctattggtgatctggcaacacagtattttgcagacagagatatattttgtgctggtcgagttgctgaagatgatctgcatcgtgttgcagctgcaactggcggtactgtacagacatcagtcaacaatgttattgatgaggttcttgggtcttgtgaggtgtttgaggaaaagcaagttggaaatgaacggttcaacatattcagtggatgtccttctggccagacagccactattgttcttcgaggtggagctgatcagtttattgaggaagctgagcgaagtttacatgatgcaatcatgattgtgaggagggccatgaagaattccacggtggtcgctggtggtggtgcaatagatatggagataagccgattcctacggcaacatgcacgtaatatagctgggaagtcccagttatttataaatgcctttgctaaagcacttgaggttattccacgacaactttgtgacaatgccggattcgatgcaactgatgtacttaacaaattgaggcaaaagcatgcacttcctgctggtgagggtgctctctatggagtagatattaacacaggtggaatttgtgattcttttgccaactttgtgtgggagccggcagtggtaaagatcaatgctataaacgctgcagctgaggcagcatgcctaatcttaagcgtggatgaaacagtgaagaacccaaagtccgaaagtgcacaaggagacgctgcagctggtataggtagaggtggcggtggcatgcgtggtggacgtggaagagggatgcgtagacgttaaatgtttcttgttttgtgacatatcatttaaacttaaacctaggcacgagcatgggatatgtaacatgtttgttccagagtagttttgtctattctgtgaagacttccttccaagttccaacttgttcgctgattttttgtagctgtattaaatttgtatggaacttgatactttttagcttgggattctgtaggatcttttaaaaccgatcatcgtttaagtaatttcctttttgtcgtctc

SEQ ID NO: 2062 - DNA, 2035 bp, Cirsium arvense
atttgaatactctgaaaatccctaatcgaactcttgttctctgccctactgtagtgtagtgcccctctccgtctctcatcattttcactcgaatcgagtctttctcgcactctggctctccgcctctgccggctgcccatctcgttgccgtcgattctcggctatccgcccccggttctctcgatttcagatttgcaatctgatttagtttcatctttcgactaatagttgtgtaacgaagtgccaaaaacaccagtgggaaggaagcaaggacatcaagttctaaaccctagcgccaaccttaattcctgtattcacttccgcaaatctcctccttccaatggcatctatgatgcaacctcagatcatattgcttaaagaaggtacagacacttcccaagggaaaccgcagttgataagcaacatcaatgcgtgtatggcggtggctgatgtggtccgtacaaccctaggtccaagaggtatggacaagttgatccatgatgataagggtaacaccactatttcaaacgatggtgccaccatcatgaagcttcttgacgtcgttcaccctgccgctaagatccttgttgatatcgcaaagtcgcaggattcagaggttggtgatggaaccactacagtagttctccttgcaggtgagttcttgaaggaggccaagccattcattgaagacggtgtccatccacaaaatctgatacgaagttatcgaaccgcttcttttatggcaattgaaaagattaaagaattagctgtaagcatagagggtaaaagtccagaggagaaaagaagcttattagctaaatgtgctgctaccacactctcttcaaagctaataggaggagagaaggagttttttgcatcaatggtcgtggatgctgtctttgcaattggaaatgatgataggttgaacatgataggaattaaaaaggtgcctggtggtacaatgcgggactcctttcttgtgaatggtgttgctttcaaaaagacattttcatatgctgggtttgaacagcaacccaagaagtttttaaatcctaagatcctcctattgaacattgaactggaactaaaatcagaaaaagaaaatgccgagataagactttcagatccgttgcaatatcaatccatagttgatgcagaatggaatatcatatatgataagttagacaaatgtgtgcagagtggtgccaaaattgttttgtcgcaccttgctattggtgatctggcaacacagtattttgcagatcgggatatattttgtgctggtagggttgccgaagatgatctgcatcgtgttgcagctgcaactggtggcaccgttcagacatcagtcaacaatgttatagatgagattcttgggtattgtgaggtttttgaggaaaagcaagttggaggtgaacggttcaacatatttagtggatgtccttcaggccagacagccactattgttcttcgaggtggagctgatcagtttattgaggaagccgagcggagtttacatgatgcaatcatgatagtgaggagggccacgaagaattccacagtggttgctggtggtggtgcaattgatatggagttaagccggtacctgtggcaacatgcacgaaatatagctggaaagtcccagctatttataaattcctatgctaaagcacttgaggttattccacgacaactttgtgataatgctgggtttgacgcaactgatgtacttaataaactgaggcagaaacatgcacttcccgctggtgaaggtgccctttatggagtggatattaacacaggtggaatttctgattcttttgctaactttgtgtgggagccagcagttgtgaagatcaatgctataaacgctgcaactgaggcagcatgtcttattctgagtgttgatgagacagtgaagaaccctaagtcggagagtgcccaaggagatgctgcaggtggtatgggtagaggtcgtggtggcggcggcatgcgtggtggacgtggaagagggatgcgtagacgttgaatatta

SEQ ID NO: 2063 - DNA, 2179 bp, Euonymus alatus
gacaagtcattttgctggttgatttgctctcacaggagcaaaaccctaactccctttcggctgtaacttgactgtctgctctacttcatttttgtattctcgacatctctcgaccgcacaatgtctgcgatgatgcaaccgcagatcatactgttgaaggagggaacggacacttcacagggaaaggcacagttggtgagcaacataaatgcttgcactgcggtggccgacgtggtgaggacgacgctgggtcccagaggtatggacaagctgatccatgacgataaaggtagcgttaccatctccaatgatggcgccaccatcatgaagctcctcgacattgtccaccctgctgccaagatcctcgttgacatcgctaaatcccaggactctgaggttggtgatggaacaactactgttgtactactggcagcagagtttttgaaggaggccaaaccttttatagaggatggagtccactctcaaaatttgatacggagttacaggacagctggaaatttggcaatctcgaaggtaagagaactagctgttagcatagagggtaaaagtctagaagaaaagaagagcttactggctaaatgtgctgcaacaacactctcatcaaaactcattggtggagagaaggatttctttgcttcaatggtagtggatgctgtcattgctattggggatgaagataggctgaatatgattggaatcaagaaggttccaggtggtaatatgagagactctttcttggtaaatggcgttgccttcaaaaagactttttcttatgcgggtttcgagcagcaaccaaagaagtttgtaaatcccaagatactcttgctcaacatagaattggagcttaaatctgagaaagaaaatgctgaaataaggctgtcagatccatctcagtatcagtcaattgtagatgcagaatggaatatcatctatgataaattggataaatgtgtgcagagtggagcaaaagttgttctttcacgtctagctattggtgatttagctacacagtattttgcagatagagatatattctgtgctggtcgtgtagcagaagaagatctgcagcgggttgctgctgcagctggtggaatggtgcaaactactgtcaataatgtaattgatgaggttcttggaacctgtgagcttttcgaggaaagacaagttggaaatgagagattcaatatatttagtggatgtccatcaggaaggacagctaccatagttcttcgtggtggagctgatcagttcattgaggaagctgagcggagcttacatgatgcaatcatgattgttagaagagctatgaagaactcaactgtgattgctggtggtggcgctatagatatggaaataagtcgatacttgaggcagcacgctcgcaatatagctgggaagtctcagctatttattaactcttatgcaaaagctctcgagataatcccacgacaactttgtgacaatgctggatttgatgctactgatgtgctgaacaaattgagacaaaaacatgcacttccatctggtgatggtgcaccttatggagtggatattaacactggtggaattgcagattcttttgctaactttgtctgggagcctgcagttgtaaagataaacgctctcaatgctgccacagaggctgcttgcctgattttaagtgtggacgagactgtaaagaaccccaagtctgaaagtgctcaaggagaagctgctgcaagtgccatgggtggtagagggcgcggaggagctttcggtggtcgtggacgcggcatgcgtaggcgatgagcttaccagatgttgaaattttggaacagttacttgctttgtcaacttaagattcaaaggaagatctggtttggttgagattctgaaaatgatttaaagggtttgcgctttttatttatttagtggtgtgttttattaacttgtattatttccttgtgaagttccattgtcaacatgcttgcttcatatccttgtatttaaatgacatcgcatgtggaaaaaactcgtcgaatgatggcagcttctcgactgaaatgtagctgctggtgctgtttttggatttgttagcccagtggtattaacattttttgtacttgagtatgctcgttagcaaataactggaggagtggagccactgcttttctgtact

SEQ ID NO: 2064 - DNA, 1955 bp, Helianthus annuus
cctccaccgttctccgccgtaccaaatccgctcacgatgacatctatgatgcaaccacagatcatactgctaaaagaaggtacggacacttcgcaagggaaaccacagctagtaagcaacatcaatgcgtgtatggcggttgctgacgtcgtccgtacaaccctaggtcctcgaggtatggataaattgatccatgatgacaaaggtaacactactatttctaacgatggagctacgatcatgaagcttctggatattgttcatcctgctgctaagttgcttgttgatattgcaaaatcacaggattcggaggttggcgatgggaccactactgtagttctccttgccggtgagttcttgagagaggccaaaccattcattgaagacggtgttcatcctcaaaatctgatacgaagttatcgagccgcttcgaatatggcaattgagaaggttaaagagttagctgtaagcatagagggaaaaagtttagacgagaaacgaagcttattagctaaatgtgctgctacaacgctctcatcaaagctaataggcggagagaaagacttctttgcaaaaatggtcgtggatgctgtcattgcaatcggaaatgatgatagattgaacatgattggaattaaaaaggttcctggtggtacgatgcgggattcttttctcgtgaacggtgttgcgtttaaaaagaccttttcgtatgctgggttcgagcagcaacccaagaagtttcataacccgaagatattactgttgaacatagagctggaactaaagtcagaaaaagaaaatgctgagataagactttcagatccgttgcaatatcagtcgatagttgatgcagaatggaatatcatatacgataagctggataagtgcgtaaagagtggtgccaaaattgttttgtcgcgtctagctattggtgatctggcaacacagtatttcgcagaccgtgatattttttgtgctggtagagttgctgaagatgacctgcaccgtgttgcagctgcaaccgggggtactgtacagacatcagtcaacaacgttatagatgaggttcttgggacttgtgacgtttttgaggaaaaacaagttggaaatgaacggttcaacatatttagtggatgtccttcaggccagacagccacgattgttcttcgaggtggagccgatcagtttattgaggaagctgagcgcagtttacatgatgcaattatgattgtgaggagggctatgaagaattccacagtggttgctggtggcggtgcaatagatatggagataagccggtacctgtggcaacacgcgcgcaatatagctgggaagtcgcagcttttcataaacgcctttgctaaagcacttgaggttattccacgtcagctttgtgataatgctggattcgatgcaactgatgtactaaacaaactgaggcaaaaacacgcgcttccttctggtgaaggctctctttacggagtggatattaacacaggtggaatttgtgattcatttgcgaattttgtgtgggagcctgcgttggtgaagataaatgctataaatgctgcaacagaggcagcatgccttgtcttaagtgtcgatgaaacagtgaagaacccaaagtcggagagtgcacaaggagatgctgctggtatgggtagaggccgtggtggtggcatgcgtggaagagggatgcgcaggcgttaaacatttttttggtatttaaaagtttttcaacctactactactgctttgctggttcatttcaaacaaatctgtagttagttgaaggaattcaaagttattttttgtagaaataattttggttaaatttagcatttgtgtcacgcatcagaaattttgttgggctttgaaaaagatttattagctgctcgtttgtctatatgactctactccggtggcatattgctaacacttatctcatagtctag

SEQ ID NO: 2065 - DNA, 2252 bp, Vaccinium corymbosum
gaattcagaggattagcttgagatgctatttgcagaagtcgtcgttattttgaggattttcggtccaatataaaagatctgggatttggtttctctagctaaaagaattgtcaaccattcaggagccaaacagtgaaaagttcgaaaccctaacccgctgcaccgccgttcacgatctactcgccgccgttccttctttgccggaatccgacatcccccgtattctctctataagccactcacaatgacagctatgatgcaacctcagatcatattgctgaaggaagggacagacacgtcccaagggaaggcacaactagtgagcaacataaacgcgtgcatggctgtggcagatgttgtgcgcaccacgctagggccaaggggtatggacaagctgatccatgacgagaaaggcaataccaccatttcgaatgacggtgccaccatcatgaaacttcttgacattgttcacccagctgctaagatccttgttgatattgccaagtcacaggagttctggaggttggtgatggaactactactgtggttctgcttgcaggggaatttctgaaggaggccaagccttttatgaggacgggtccacctcaaaatctaatccggagttttcgcactgcagcgtaatttggcaattgagatggtcaaagaactagcccaaagcatagaaggaaaaagtctagaagaaaagaaaagtttacttgccaagtgtgctgctacgaccttatcttcaaagcttattggtggagaaaaggagttctttgcttctatggttgtggatgctgtccttgcaattggcactgaagacaggctaaatatgattggaatcaagaaggttccaggaggtaacatgcggactccttccttgtaaacggcgttgccttcaaaaagacattctcatacgctggttttgaacagcaaccaaagaagtttgtcatgcccaaaattctcctattgaacattgaattggagctaaaatcagaaaaagaaaatgccgagataagactttcagatccttcacagtatcagtcaattgttgatgcagaatggaatattatttacgataagttggataaatgtgtgaaaagtggggccaaaattgtgctttcacgtctggctattggtgatctaggcacacagtattttgcagatcgagatatattttgtgcgggtcgagtcgctgaagaggatctgcagcgagttgcagctgcaacaggtggaacagttcagacatctgttaataacgtcatcgatgaggttcttggatcttgtgagctctttgaggagagacaagttggaaatgagcggtttaacatatttagtgggtgcccatctggtcagacagccactatagttctccgcggtggggccgatcagttcattgaggaagctgagcggagtttacatgatgcaatcatgattgttagaagagctttgaagaattctactgttgtggctggtggcggtgccatagatatggagataagccggtatttgaggcagcatgcacggacaatagctggaaagtctcagctttttattaactcttacgctaaagctctagaggttatcccacgacaactctgtgacaatgctggttttgatgcgactgatgtgctgaacaaactgagacagaaacatgcactacaatctggtgaggggaaaccgtacggggtggatattaacactggtggaattgctgataattatgctaattttgtttgggagccagcagtagtcaagatcaatgccataaatgcggctactgaagcagcctgccttgtcttaagcgtggatgagacagtgaaaaacccaaagtcagaaagtgctcagggagatgctgctgcgggtgcaatgggtggtagaggtcgtggtggagctgctttccgtggtcgtggtggacgaggaatgcggaggcgatagggttcccacatcctaaatccttggctgtttgatcaaagttttggtggctttcagaatgtaatttcaatccttggctgtttgatcaaagttttggtggctttcagaatgtaatttccccccggcctttaccggacttgagcacagactttaagatgtattttcttgtgattcttctcgtagtgctgaatgttcagaactttgactaagcttggcaacatttttcgcggtgatctgtagtttctttgtgctatgaattggtatgtttgggcatttattttgtattctgaattagtgcgctctctttcttgcgcgcg

SEQ ID NO: 2066 - DNA, 1832 bp, Brassica oleracea
ccatcccctcccatttctccgtaagctctttcacgcatctacgatggcgtcaatgatgcaaccgcaaatcatactgctcaaggaaggcactgacacttcccaggggaaagcgcagctactgagcaacatcaacgccgtcactgccgtcggcgatgtggttcgaaccacgctcggtccacgagggatggacaagctcatccacgacgataagggatccgtcaccatctccaacgacggcgctaccatcatgaagctcctcgacattgtccatcccgccgctaagatcctcgtcgatatcgccaaatcgcaagattccgaggttggtgatggaacaactacggttgttcttcttgctgctgagtttttgaaggaggctaagccgtttgttgaagatggtgttcactcccagaatctgattaggagttaccgcactgcaagcactttggcaattgagaaggttaaagaactcgctgttagtattgaggggaaaagtgtagaggagaagaaaggtttgttggctaaatgtgctgctaccactctttcctctaagcttattggtggagagaaggagttctttgctacaatggttgttgatgctgttatggccattggggatgacgacaggctcaatttgatcggaatcaaaaaggttcctggtggtaacatgcgagactctttcctagttgatggtgtggctttcaaaaagacattctcatatgcgggttttgaacaacagccaaagaagtttcttaatcccaaaatcctcttgcttaacatcgaattggagttgaaatctgagaaggaaaacgctgagattagactgtcagatccgtcacagtaccagtcaatagttgatgcagaatggaatatcatttatgacaagctagacaaatgtgtcgaaagtggagctaaagttgttctttctcgattggctattggtgatctagctactcagtattttgccgatcgtgatattttctgcgctggccgtgtagcagaagaagatcttaaccgcgtggctgctgcggctggaggaacagttcagacaagtgttaacaatataatacccgaggttctcggaacttgtgagatatttgaggaaaaacaagttggtggggagaggtttaacatattcagtggttgtccttcaggacgtacagctactattgtcctccgtggtggagctgatcagtttatcgaagaagctgagcgtagtttacatgatgcgattatgatagtgagaagagccgtgaagaactcaactgttgttcctggaggtggagcgatagatatggaggtaagcaagtacctgaggcagcattcaagaacaattgctgggaaatcacagcttttcatcaactcgtatgcaaaggccttggaggttattccacggcaattgtgtgacaatgctggatttgatgcaacggatgttctgaataagttaagacaaaaacacgccatgcaaagcggtgaaggagcttcttatggagtggacattaacactggtggaatcgctgattcatatgctaactttgtctgggaaccagcagttgtaaagattaatgctataaacgctgcgactgaagcagcttgccttattctcagcgtggacgaaactgtgaagaaccctaaatctgagagcgcacagggagacgctgccgcaggtgctatgggaagaggacgcggtggaggtcgtggccgtggtatgaggaggcgataagttttgttatttttttagtcttatgacaaaacttgcaagcttcttctctgaattttacttttgttgaattttgtcttgaaatcaaaaggagctagtgtcgtgtttgtgttta

SEQ ID NO: 2067 - DNA, 2221 bp, Cichorium intybus
attccatctgagtaaacaaaagtgactctatttcgatttgtgccctaaccttttcagccatcgtccccatcctctcttcatctcgcctcttctcaccttgaacccgtctctttcttctcttccgttcacgttcgtctcctccgtgcacgtctgaccggccctaaacaacagtgggaaggaagcaagtgaacaagtccaaaccctagcgccaccattaccataagctcctgtattacctccacccttcaaatctactcgcaatggcatctatgatgcaacctcagatcatactgcttaaagaaggcacagacacttcgcaagggaaaccgcagttgataagcaacattaatgcgtgtatggcggtggctgatgtcgttcgtacaaccctaggtccaagaggtatggataagttgatccatgatgataagggtaacaccactatttctaacgacggcgccaccatcatgaagcttcttgacatcgttcaccccgccgctaagatccttgtcgatatcgctaagtcacaggattcagaggttggtgatggaacgactacggtagttcttcttgctggtgaattcttgaaggaggcaaaaccattcattgaagatggtgttcatcctcaaaatctcataagaagttatcgaagcgcttcctttatggcaattgagaagatcaaggagttagctgtaagcatagagggaaaaagtttagatgaaaaaagaagcttattagctaaatgtgctgctacaacactctcttcaaagctaattggaggagagaaggacttctttgcaaaaatggtggtggatgctgttattgcaattggaaatgatgataggttgaacatgattggaataaaaaaggtgccaggtggtacaatgagggattcatttcttgtgaatggtgttgcatttaaaaagacattttcatatgctggattcgaacaacaacccaaaaagtttctgaatccaaagatactcttgttgaacattgaacttgaactcaaatcagaaaaagaaaatgctgaaataagactttcagatcctttacaataccagtccatagttgatgcagaatggaatatcatttatgataaattggataaatgtgtcaaaagtggtgccaaaattgttctctcacgtcttgctattggtgacctggcaactcagtattttgcggacagagacatattttgtgctggtagagttgctgaagatgatctgcatcgtgttgcagctgcaactggagctacagtacaaacttcagtcaacaatgttattgaggaggttcttggatcctgtgaagtttttgaagaaaagcaagttggaagtgaaagattcaacatatttagtggatgcccttcaggccaaacagccactattgttctccgtggtggagccgatcagtttattgaggaagcagaaaggagtttacacgatgcaatcatgatagtcaggcgggccatgaaaaattccacggtggttgctggtggtggtgcaatcgatatggaaataagccggtacctatggcaacatgcacgcaatatagccggaaagtctcaattatttataaatgcctacgctaaagcacttgaggttattccacgccaactttgtgataatgctggattcgatgcaactgatgtactcaacaaactgagacagaaacatgcacttgctgctggtgagggtgctctttatggagtggatataaacacaggtggaatttctgattcttttgccaactttgtgtgggagcctgcagtcgtaaagattaatgctataaatgctgcaactgaagcagcctgtcttatcttaagtgttgatgagactgtaaagaatccaaagtcggagagtgcacaaggggaagctgccgccggaatgggtagaggacgcggtggcggacgtggcagagggatgcgaagacgttagtatttcttaggatacaaaacttgagccgaggagggtatgatggtaattttggcttttgatcgaaaacgtttccaatttgctgtgttttgtaggattatgttcaagtttgattatggttttcagagtttttttttttttttgtaagttgatccatgagctttgatttagaccgggacattgaaattatatgtgagtttattattattatttttaaaatggtattgttggaaactaatagcatcctacttttaatcctttccattattacatcatttcaaagtgtgaag

SEQ ID NO: 2068 - DNA, 1982 bp, Brassica rapa
aagacccaaaataaaccctaaatctctctctctctctctctctctctctctctctcgtttctccgtagctcaatcacgcatctacaatggcgtcgatgatgcaaccgcaaatcattctgctgaaggaaggcacagacacttctcaggggaaagcgcagctgctcagcaacatcaactccgttacggcggtcggcgacgtggttcgaaccacgctcgggccgcgtgggatggacaagctcatccacgacgataagggatccgtcaccatttccaacgacggcgccaccatcctgaagctcctcgacatcgttcaccccgccgctaagatcctcgtcgacatcgccaaatctcaagactcagaggtaggtgatgggacgactacagttgtgcttcttgcagctgagtttttgaaggaggctaagccgtttgttgaggatggtgttcactctcagaatctcattaggagttatcgcactgcgagcactttggcgattgagaaggtgaaagaactcgctgttagcattgaggggaagagtgtggaggagaagaaaggtctgttggctaagtgtgctgctactactctttcgtcgaagcttattggtggagagaaggagttttttgctactatggttgttgatgctgttatggctattggggatgacgacaggcttaatttgattgggatcaaaaaggttcctggtggtaacatgagagactctttcctagttgacggtgtggctttcaaaaagacattctcatatgcgggttttgaacaacagccaaagaagtttcttaatccgaaaatccttcttcttaacatcgagctggagttgaaatctgagaaggaaaacgctgagattaggctatcggatccatcacagtaccagtcaatagtcgatgcagaatggaatatcatttatgacaagctagacaaatgtgtcgaaagtggagcaaaagttgttctttctcgattggctattggtgatctagctactcagtattttgcagatcgtgatattttctgcgctggccgtgtagcagaagaagatcttaaccgcgtggctgccgccgctggaggaacagttcagacgagtgttaacaatataatacccgaggttctcggaacttgtgagatatttgaggaaaaacaagttggtggggagagatttaacatattcagtggttgcccttcaggacgtacagcaactattgtccttcgtggtggagctgatcagttcatcgaagaagctgagcggagtttacatgatgctattatgattgtgaggagagctgtgaagaactcaactgttgttcctggaggtggagctatagatatggagataagcaagtacctgaggcagcattcacgaactattgccgggaagtctcagcttttcattaactcgtatgcaaaggccctggaggttattccacgacaattatgtgacaatgctggatttgatgcaactgatgtgctgaataaattaagacaaaaacacgccatgcaaagcggtgaaggagcttcatatggagtggacattaacactggtggaatagctgattcatttgctaacttcgtctgggaaccagcagttgtgaagattaatgctataaacgctgcgactgaagcagcttgccttatccttagtgtggacgaaactgtgaagaaccctaaatctgagagcgcacagggagatgctgccgctggtgctatgggaagaggacgcggtggaggtcgtggccgtggtatgaggagacgataagttttctctatcttatggcaaaacttgggggtcttcttctctgaactttaattttgttgaattttgatcttgaaatcaaaaagctagtatggtgtttgtgtttatttgacgtatgttcatacaattattgacactggaaactatatttgcttaattagaccaagacaaggatgaatcattgtattaaattcagttagtgatgtatctctctacctatta

SEQ ID NO: 2069 - DNA, 1943 bp, Brassica napus
atcactcactcctacacaccattccctcccatttctccgtaagctctttcacgcatctacgatggcgtccatgatgcaaccgcaaatcatactgctgaaggaaggcacagacacttcccagggtaaagcgcagctactgagcaacatcaatgccgtcacggcggtcggcgatgtggttcgaaccacgctcggtccacgagggatggacaagctcatccacgacgataagggatccgtcaccatctccaacgacggcgctaccatcatgaagctcctcgacattgtccatcccgccgctaagatcctcgtcgatatcgccaaatcgcaagattccgaggttggtgatggaacaactacggttgttcttcttgctgctgagtttttgaaggaggctaagccgtttgttgaagatggtgttcactcccagaatctgattaggagttaccgcactgcaagcactttggcaattgagaaggttaaagaactcgctgttagtattgaggggaaaagtgtagaggagaagaaaggtttgttggctaaatgtgctgctaccactctttcgtctaagcttattggtggagagaaggagttttttgctacaatggttgttgatgctgttatggccattggggatgacgacaggcttaatttgattgggatcaaaaaggttacctggtggtaacatgagagactctttcctagttgacggtgtggctttcaaaaagacattctcatatgcgggttttgaacaacagccaaagaagtttcttaatccgaaaatccttcttcttaacatcgagctggagttgaaatctgagaaggaaaacgctgagattaggctatcggatccatcacagtaccagtcaatagtggatgcagaatggaatatcatttatgacaagctagacaaatgtgtcgaaagtggagcaaaagttgttctttctcgattggctattggtgatctagctactcagtattttgcagatcgtgatattttctgcgctggccgtgtagcagaagaagatcttaatcgcgtggctgctgccgctggtggaacagtccagacaagtgttaacaatataatacccgaggttctcggaacttgtgagatatttgaggaaaaacaagttggtggggagaggttcaacatattcagtggttgcccttcaggacgtacagcaactattgtccttcgtggtggagctgatcagttcatcgaagaagctgagcggagtttacatgatgctattatgattgtgaggagagctgtgaagaactcaactgttgttcctggaggtggagctatagatatggagataagcaagtacctgaggcagcattcacgaactattgccgggaagtctcagcttttcattaactcgtatgcaaaggccctggaggttattccacgacaattatgtgacaatgctggatttgatgcaactgatgtgctgaataaattaagacaaaaacacgccatgcaaagcggtgaaggagcttcgtatggagtggacattaacactggtggaatagctgattcatttgctaacttcgtctgggaaccagcagttgtgaagattaatgctataaacgctgcgactgaagcagcttgccttatccttagtgtggacgaaactgtgaagaaccctaaatctgagagcgcacagggagatgctgccgcaggtgctatgggaagaggacgcggtggaggtcgtggccgtggtatgaggagacgataagttttctctatcttatggcaaaacttgggggtcttcttctctgaactttaattttgttgaattttgatcttgaaatcaaaaagctagtatggtgtttgtgtttatttgacgtatgttcatacaattattgacactggaaactatatttgcttaattagaccaagacaaggatgaatcattgtattaaattcagttagtgatgta

SEQ ID NO: 2070 - DNA, 2312 bp, Citrus sinensis
catcaagctggtgcagcgacggtcatgcttcgtaggctttaaacgacatgagtatataaaccctaagacaatccctccaataaattaaacccaaagtcacagcaatcactagaaacaactagtcactgcgcagtacacacttgggatctcgtcagtgttattgaacttgagtaaggggtaaaaaaaaaaaaatcaaaccctagcgttctctcataaacttcatttcgatttcaatctcaacaatggcagccatgatgcagccgcagatcattttattgaaagaaggaaccgacacgtcgcaaggaaaggctcagttggtgagcaacataaacgcgtgcacggcggtggctgatgtggtgaggtcgacgctgggccccagagggatggacaagttgatacacgacgacaagggcaccgttaccatctctaacgacggcgccaccatcatgaagcttctcgacatcgtccatcccgccgccaagattctcgttgacatcgccaagtctcaggactctgaagtcggcgacggtaccaccactgtggttctgcttgcggccgagttcttgagggaggccaagccttttattgaggatggagttcaccctcagaatttgattaggagttttcgcaacgccagctataaggcgattcagaaggtcaaggaattggctaaaagcatagagggtcaaagtttagaagagaagaaaagactattgtcaaaatgtgctgccactacgctttcttctaaacttattggtggtgaaaaagagttttttgcttcaatggtcgtagatgctgttggtgcaattggcgatggtgataggttgaatatgattggaatcaagaaggttccaggtggtaccatgcgggattcctttctagtaaatggtgttgcttttaagaagacattttcgtatgcaggctttgaacagcaaccaaagaagtttttaaacccaaagatactcttattgaacattgagttggaactgaaatctgagaaagaaaatgctgagataagactttcagatccatcacagtatcaatcaattgttgatgcagaatggaatatcatttatgacaagttggataaatgtgtacagagtggggccaaagttgttctttcacggcttgctattggtgatctagccacgcagtattttgcagaccgagatattttctgcgctggtcgtgtggctgaagaagatctgctacgtgttgctgctgcaactggtggaactgtgcagacatctgttaacaatgttgttgatgaggttcttggtacttgtgaacattttgaggaaaggcaagttggaaatgagaggtttaatatctttagtggatgcccatcagggaggacagctactatagtacttcgtggtggagctgaccagttcattgaagaagccgagaggagtttacatgatgcaattatgattgttagaagagctacgaagaattccactgtagttgctggtggtggtgctatagatatggagataagtaaatacttgaggcaggaatcccgcgcaatagccgggaagtctcagttttttatcaactcttatgcaaaagctctcgaggttatcccacgccagttgtgtgacaatgctggatttgatgctactgatgtgctgaataaattaagacagaaacatgcgcttccaactggtgagggtgccccttatggagtggatatcaacactggtggaattgcagattcatttgctaactttgtctgggagccagcagttgtcaagatcaatgctataaatgctgctactgaggcagcatgccttatcttgagtgtggatgagacagtaaagaaccctaagtctgaaagtgcacaaggtgaagctgccgcaagtgccatgggcggcagagggcgtggtcgtgggaggggcatgcgcaggcgatgagcttacgatatttcaagtcttgaatgtcttttttgatggtgaattgggggtgctgattcgattagattttcctcatcttttgtagtctctctatgttgtgtttccaagtgtaattgaaaatttaacagactggtggttaccctcagccagttatgccatttgcgtttgttgttgtttggtgaagccaacgagccaacgagactatagttttgtcccattgtggaattatggccgtggttttaattatgttaaatgggttttcttctactcttttgacctttggtttcttcttgcccttgctgccaaaaaaatggaaccctcttttgtttttagaaccttgatggcatatctgacactgactatttattttattcaatcgatattttgttagaatta

SEQ ID NO: 2071 - DNA, 2030 bp, Eutrema halophilum
agacctaactaaaactaaaccctaactctctctctctctcttcactcccatttctcccttttctccgtagctctttcacgcatctacaatggcgtcgatgatgcaaccgcaaatcatactgctcaaggaaggtacggacacttctcagggcaaagcgcagctagtgagcaacatcaacgcttgcacggcggttggcgatgtggttcggactacgctcgggccacgagggatggacaagctcatccacgacgataagggatccgtcaccatttccaacgacggtgctaccatcatgaagcttctcgacattgtccatcctgccgctaagatcctcgtcgatatcgccaaatcacaagattccgaggtcggcgatgggacaaccactgttgttcttcttgcagcagagtttttgaaggaggccaagccatttatcgaggatggtgttcactcccagaatttgattagaagttaccgcaccgcaagcactttggcaattgagaaggtcaaagaactcgctgttagcattgaggggaagagtgttgaggaaaagaaaggtttgttggctaaatgtgctgctaccaccctttcctctaagcttattggtggagaaaaggagtttttttctacaatggttgttgatgctgttatggcgattgggaatgacgacaggctaaatctgattgggatcaaaaaggttcctggtggtaatatgcgagactctttcctagttgatggtgtagctttcaaaaagacattctcgtacgcgggtttcgaacaacagccaaagaagtttgttaatccgaaaattctcctgcttaacatcgaattggagttgaaatctgagaaggaaaacgctgagattagactgtcagatccatcgcagtaccagtcaatagttgatgcagaatggaatatcatttatgacaagctagacaagtgtgtcgaaagtggagctaaagttgttctttctcgcttggctattggtgatctagcgactcagtattttgcagatcgtgatattttctgcgctggccgtgtagcagaggaagatcttaatcgcgtggctgctgcagctggaggaacagttcagacaagtgttaacaatataataaccgaggttctcggaacttgtgaaatattcgaggaaaaacaagttggtggagagaggtttaacatcttcagtggctgcccttcaggacgtacagcaactattgtcctccgtggtggagctgatcagtttattgaagaagctgagcggagtttacatgatgcgattatgatcgtgagaagggctgtgaagaactcaactgttgttcctggaggtggagctatagatatggagattagcaagtacctgaggcagcattcacgaacaattgctgggaagtctcagcttttcatcaactcgtacgcaaaggccctggaggttattccacgacaattatgcgacaatgctggattcgatgcaactgatgtcctgaacaaattaagacaaaaacacgccatgcaaagcggtgaaggagcttcttatggagtggacattaacactggtggaatagcagattcatacgctaacttcgtctgggaaccagcagttgtgaagattaatgctataaacgctgcgactgaagcagcctgccttattcttagtgtggacgaaaccgtgaagaaccctaaatctgagagcgcacaaggagaagctgccgcaggtgctatggggagaggacgcggtggaggtcgtggccgtggtatgcgaaggcgataagtttttttctcttaatggcaaacatgtgggtttcttcttcttgtctaaactttagttttgttgaattttgatcttgaaatcaaaaagctagtgttgggtttgtgtttgttgaattagaataccgtttgggcgtccatacaatttgtggaagtgaaatttcagtgtggtttttggtacacttaaagaaattttatttgcttaatcaggatcatgacgaggatgaatcactgtaacaaaattcaattggtgatgtatctgtaactat

SEQ ID NO: 2072 - DNA, 2050 bp, Brassica oleracea
ctccaatctctctcccatttctccgtagctcctcaacgcatctacaatggcgtcgatgatgcaaccgcaaatcatactgctgaaggaaggcacagacacttctcaggggaaagctcagcttctgagcaacatcaacgccgtcacggcggttggcgacgtggttcgaaccacgctcggtcctcgagggatggacaagctcatccacgacgataagggatccgtcaccatttccaacgacggcgctactattatgaagctcctcgacatcgtacatcccgccgctaagatcctcgtcgatatcgccaagtctcaagactcagaggttggtgatgggacgacgacggttgttcttcttgctgctgagtttttgaaggaagctaagccgtttgtggaggatggtgttcactctcagaatctgattaggagttatcgcactgcaagcactttggcaattgagaaggtgaaagaactcgctgttagcattgaagggaagagtgtggaggagaagaaaggtttgttggctaaatgtgctgctaccactctttcctctaagcttattggtggagaaaaggagtttttcgctactatggttgttgatgctgttatggccattggggatgacgacaggctcaatttgattgggatcaaaaaggttcctggtggtaacatgcgggactctttcctagttgatggtgtggccttcaaaaagactttctcgtatgcgggttttgaacagcagccgaagaagtttgataaccccaaaatcctactgcttaacattgaactggagttgaaatctgagaaggaaaacgctgagattaggctgtcagatccatcgcagtaccagtcaatagttgatgcagagtggaatatcatttatgacaagctagacaaatgtgtcgaaagtggagctaaagttgttctttcccgattggctattggtgatctagctacccagtattttgcggatcgtgatattttctgcgctggccgtgtagcagaagaagatcttaatcgcgtggctgctgcggccggaggaacaattcagacaagtgttaacaacataatacccgaggttctcggaacttgtgagatttttgaggaaaaacaagttggtggggagaggtttaacatattctgtggttgcccttcaggacgtacagcaactattgtcctccgtggtggcgctgatcagttcatcgaagaagctgagcggagtttgcatgatgctattatgattgtgagaagagctgtgaaaaactcaactgttgtgcctggaggtggagctattgatatggagataagcaagtacctaaggcagcattcacgaacaattgctgggaagtcacaacttttcatcaactcgtatgcaaaggccctggaggttattccacgacagctatgtgacaatgctggatttgatgcaactgatgtcctaaataaattaagacagaaacacgccatgcaaagcggtgaaggagcttcttacggagtagacatcaacactggtggaatagcggactcatttgctaacttcgtgtgggaaccagcagttgtgaagattaatgctataaacgctgcaactgaggcagcgtgccttatcctaagtgtggatgaaaccgtgaagaaccctaaatctgagagcgcacagggagatgctgccgctggtgctatgggaagaggacgcggtggaggtcgtggccgtggtatgcgcaggcgatgagcttttttaagttttcttttttttttttttttttttttatgtttgagaatgtgtatataatgtgttgataattgtataacaaaaatgcagtctgagagcgcacagggagatgctgccgctggtgctatgggaagaggacgcggtggaggtcgtggccgtggtatgcgcaggcgatgagcttttttttttctctaatgtcaaacttgcagattttttctctgaattttagtcttgctgaattttggtgatcttgaaatcaaaaagctagtgtgtgtttgttgacttatgtccatacaatttgttaaaatgaaatttcagtgtggtttt

SEQ ID NO: 2073 - DNA, 1938 bp, Cichorium intybus
tgggaaggaagcaagtgaacaagtccaaaccctagcgccaccattaccataagctcctgtattacctccacccttcaaatctactcgcaatggcatctatgatgcaacctcagatcatactgcttaaagaaggcacagacacttcgcaagggaaaccgcagttgataagcaacattaatgcgtgtatggcggtggctgatgtcgttcgtacaaccctaggtccaagaggtatggataagttgatccatgatgataagggtaacaccactatttctaacgacggcgccaccatcatgaagcttcttgacatcgttcaccccgccgctaagatccttgtcgatatcgctaagtcacaggattcagaggttggtgatggaacgactacggtagttcttcttgctggtgaatttttgaaggaggcaaaaccattcattgaagatggtgttcatcctcaaaatctcataagaagttatcgaagcgcttcctttatggcaattgagaagatcaaggagttagctgtaagcatagagggaaaaagtttagatgaaaaaagaagcttattagctaaatgtgctgctacaacactctcttcaaagctaattggaggagagaaggacttctttgcaaaaatggtggtggatgctgttattgcaattggaaatgatgataggttgaatatgattggaataaaaaaggtgccaggtggtacaatgagggattcatttcttgtgaatggtgttgcatttaaaaagacattttcatatgctggattcgaacaacaacccaaaaagtttctgaatccaaagatactcttgttgaacattgaacttgaactcaaatcagaaaaagaaaatgctgaaataagactttcagatcctttacaataccagtccatagttgatgcagaatggaatatcatttatgataaattggataaatgtgtcaaaagtggtgccaaaattgttctctcacgtcttgctattggtgacctggcaactcagtattttgcagacagagacatattttgtgctggtagagttgctgaagatgatctgcatcgtgttgcagctgcaactggagctacagtacaaacttcagtcaacaatgttatcgaggaggttcttggatgttgtgagatttttgaagaaaaacaagttggaagtgaaagattcaacatatttagtggatgcccttcaggccaaacagccactattgttctccgtggtggagccgatcagtttattgaggaagcagaaaggagtttacacgatgcaatcatgatagtcaggcgggccatgaaaaattccacggtggttgctggtggtggtgcaatcgatatggaaataagccggtacctgtggcaacatgcacgcaatatagccggaaagtctcaactatttataaatgccttcgctaaagcacttgaggttattccacgccaactttgtgataatgctggattcgatgcaactgatgtactcaacaaactgagacagaaacatgcacttgctgctggtgagggtgctctttatggagtggatataaacacaggtggaatttctgattcttttgccaactttgtgtgggagcctgcagtggtaaagattaatgctataaatgctgcaactgaggcagcctgtcttatcttaagtgttgacgagactgtaaagaatccaaagtcggagagtgcacaaggggaagctgccgccggaatgggtagaggacgcggtggcggacgtggcagagggatgcgaagacgttaaattttagtatttgttaggatacaaaacttgaggcaagggtatgatggtaattttgggttttgatcgaaaatgtttccgatttgttttgtatggacggaacttgtgttttgtaggattatggttttgagagttgtttttgggagaaattatgtgagtttattattattatttgtta

SEQ ID NO: 2074 - DNA, 1654 bp, Echinochloa colona
caccaccagacagagcagtcgaaaaaccctcgccgccgcgccgcctcgtcgtctccgcgccgcagatctcccacccggaagccccaatctccccgtaaccccaaagctccccgccatgtcggcgatgctgcaaccgcaggtcatcctgctcaaggagggcacggacacgtcgcaggggaaggcgcagatggtgagcaacatcaacgcgtgcacggcggtggtggacacggtgcgcaccacgctggggccccgcggcatggacaagctcatccacgacgacaagggcggcgtcaccatctccaacgacggggccaccatcatgcgcctcctcgacatcgtccaccccgccgccaagatcctcgtcgacatcgccaagtcacaggactccgaggtcggtgatgggacaactactgttgtgcttctagctgcagaattcttgaaggaagcaaaaccttatgttgaggatggagtgcacccacatagtctaattcgcagctacaggactgcaggcaatatggcgattcaaagggttaaagaacttgcagttagcatagaagggaaaagccttgaagagaagaaatcgttgctagccaagtgtgctgccacaaccctctcatcaaaactgattggcggtgaaaaagaattctttgcttctatggttgtggatgctgtccttgccattggcaatgacgacaggctgaatcttatcgggattaaaaaggttcctggtggtaccatgagagattcttttctggtgaatggtgttgcattcaagaagacattttcatatgctggatttgagcaacaaccaaagaagttcctaaatcctaagattcttttgttgaacattgaactagaattaaaatccgagaaagaaaatgcagagatcaggttgtcagaccccctgcaataccaatcaattgttgatgctgaatggaacattatttatgacaaactggataaatgtgtaaaaagtggagcaaagatagttctgtctcggctggctattggtgatcttgcaacacagtattttgcagaccgagacattttctgtgctggtcgtgtcacagaagaggatttgcaacgagtggctgcagcaactggtggaactgttcaaacatctgtaaataatgttattgatgaggtgcttggttcttgtgaggtatttgaggaaaaacaagtaggaaatgaaagattcaacatatttagtggctgcccttctggtcagacagcaactattgtcctccgtggtggtaccgaccagttcattgaggaagctgaacgaagtctccatgatgccatcatgattgtgaggagagctcttaagaactctacggttgtgccggggggtggtgctatcgatatggaaataagcaagtatctcagacaacatgcgcggaccattgctgggaagtctcagttctttgtaaattcgtttgctaaagcccttgaggttattccacgacaactttgtgataatgctggatttgacgcaactgatgtgctcaataagctcaggcagaaacatgcatctggtgaaggtgctaattatggtgtagacataaacactggcggaattactgattcctttgctaactttgtgtgggaacctgctgttgtgaagatcaatgctataaatgccgcaacagaagct

SEQ ID NO: 2075 - DNA, 2194 bp, Phaseolus vulgaris
agagagagagtaggagccagaaactgctgcttcttcgacccacttcgaacttcaaaacttaaaccctagttctctctctttcttctgcgtcttcaaccatgtcagcgatgcttcaacctcagatcattctgctcaaggaaggcacggacacttcgcaagggaagccacagctggtgagtaacatcaatgcctgcaccgccgtcgccgacgtcgtccgcaccaccctcggacctcgcggcatggacaagctcatccacgatgacaagggagctgtcaccatctccaacgatggcgccaccatcatgaagctccttgacatcgtccaccctgccgcaaaaatccttgtcgacatcgctaagtctcaggactccgaggttggcgatggaaccaccactgttgtgttgcttgcagctgagtttttgagggaggccaagcctttcattgaagatggtgttcactctcaaaatttgatacggagctatagggctgcaagtaccttggcaattgaaaagattcaagagctagcggttagcattgaggggaaaagtctggaggaaaagaaaagtttgcttgcaaagtgtgcttctaccacactttcttcaaagcttattggtggagagaaggaattctttgcatccatggttgtggatgctgtacttgcaattgggtacgaggacaggttgaacatgattggaataaagaaggttcctggtggtaccatgcgggactcatttctggtaaatggtgttgccttcaaaaagacgttttcatatgctgggtttgagcaacaacccaagaagtttctcaatccaaaaattctattattaaacgttgagttggagctaaagtctgagaaagaaaatgctgaaataaggttgtcagatccttcgcaatatcagtcaatagttgatgcagagtggaatattatttatgacaagttagataaatgtgtcagcagtggtgccaaagttgttctttcacgattggccattggtgatctagcgacccagtattttgcagatcgagatattttctgtgctggtcgtgttgcagaagaagatctaaaaagggttgctgctgcaactggtggaaccgtacaaacatctgttaataacattattgaggaggtccttggaacttgtgaggtttttgaggaaaagcaggttggaaacgagaggttcaatattttcaatggatgtccatctggcctaacagccacaatagttcttcgtggtggagctgatcagttcatagaggaagcagagcgaagtttgcatgatgcaatcatgattgtgaggagggctttgaagaattccactgtggttgctgggggaggtgctatagatatggagataagccggttcctgaggcagcatgcacggactatagctggaaagtctcagcttttcattaactcctatgcaaaagctcttgaggttatacctagacaactatgcgacaatgctggttttgatgcaactgatgtgttgaataaactaaggcagaaacatgcacttccttctggtgagggggcaccatatggggtggacatagccactggtggaattgctgactcttttgctaactttgtctgggagcctgcaattgtgaagatcaatgctataaatgctgcaacagaggctgcttgccttatcttaagtgtggatgaaacaattaaaaaccccaagtctgagagtgcacaaggagacgccgctgcaagtgccatgggcagaggtcgtggaggcggattccgtggacgtggacgagggatgcgaagatgattaggaatgcattctattatattacggattgagtgtctggtgcattctgtctaatttatgtgaggccaatgcatgcttgtttctactataagcatgccgatttttgaaccttataagccatcaaatgaaaatgtaatggagattccggtaacatcatctgatcaaactagggttttcaagcagcaatgttagtggtagtctttctgatgatcattttacactttggggaagggtatgattgcatggcagatgatgggacttgagcttcgtgtgaaattttgcatcttgttctacaattttcaactatttattattttgtatgcgtataaaacacatgatttaagtttttctcttacggatatgaaagtcaccagtgaagtgagaatgtggcgtacttcaaaaacttatctttg

SEQ ID NO: 2076 - DNA, 1860 bp, Brassica napus
tttctccgtagctcctcaacgcatctacaatggcgtcgatgatgcaaccgcaaatcatactgctgaaggaaggcacagacacttctcaggggaaagctcagcttctcagcaacatcaacgccgtcacggcggttggcgacgtgcttcgaaccacgctcggtcctcgagggatggacaagctcatccacgacgataagggatccgtcaccatttccaacgacggcgctactatcatgaagctcctcgatatcgtacatcccgccgctaagatcctcgtcgatatcgccaagtctcaagactcagaggttggtgatgggacgacgacggtggtgcttcttgctgctgagtttttgaaggaagctaagccgtttgttgaggatggtgttcactctcagaatttgattaggagttatcgcactgcaagcactttggcaattgagaaggtgaaagaactcgctgttagcattgaggggaagagtgtggaggagaagaaaggtttgctggctaaatgtgctgcgaccacgctttcctctaagcttattggtggagaaaaggagtttttcgctactatggttgttgatgctgttatggccattggggatgacgacaggctcaatttgattgggatcaaaaaggttcctggtggtaacatgcgagactcgttcctagttgatggtgtggctttcaaaaagacattctcgtatgcgggttttgagcaacagccaaagaagtttgataatcccaaaatccttctgcttaacattgaactggagttgaaatctgagaaggaaaacgctgagattaggctgtcagatccatcgcagtaccagtcaatagttgatgcagagtggaatatcatttatgacaagctagacaaatgtgtcgaaagtggagctaaagttgttctttcccgattggctattggtgatctagctacccagtattttgcggatcgtgatattttctgcgctggccgtgtagcagaagaagatcttaatcgcgtggctgctgcggccggaggaacaattcagacaagtgttaacaacataatacccgaggttctcggaacttgtgagatttttgaggaaaaacaagttggtggggagaggtttaacatattcagtggttgcccttcaggacgtacagcaactattgtcctccgtggtggcgctgatcagttcatcgaagaagctgagcggagtttgcatgatgctattatgattgtgagaagagctgtgaaaaactcaactgttgtgcctggaggtggagctattgatatggagataagcaaatacctgaggcagcattcacgaacaattgctgggaagtcacagcttttcatcaactcgtatgcaaaggccctggaggttattccacgacagctatgtgacaatgctggatttgatgcaactgatgtcctaaataaattaagacagaaacacgccatgcaaagcggtgaaggagcttcttacggagtagacatcaacactggtggaatagcggactcatttgctaacttcgtgtgggaacctgcagttgtgaagattaatgctataaacgctgcaactgaggcagcgtgccttatcctaagtgtggatgaaaccgtgaagaaccctaaatctgagagcgcacagggagatgctgccgctggagctatgggaagaggacgcggtggaggtcgtggccgtggtatgcgcaggcgttaagtttttttctctctaatgtcaaacttgcagatttttttctctgaattttagttttgcttgaattttggtgatcttgaaatcaaaaagctagtgtcggggtgtgtgtttgttgacgtatgtccatacaatttgttaaaatgaaatttcagtgtgg

SEQ ID NO: 2077 - DNA, 1773 bp, Centaurea maculosa
ctccactcttctccgccgcaaatctcctcttccaatggcgtccatgatgcaacctcagatcatactgcttaaagaaggtacagacacttcgcaagggaagccgcagctgataagcaacatcaatgcgtgtatggcggtcgctgatgtcgtccgtacaaccctaggtccgagaggtatggataagttgatccacgatgataagggcaacacgactatttctaacgatggagcgactatcatgaagcttctagacgtcgttcatcccgccgctaagatccttgttgatatagcaaagtcacaggattcagaggttggtgatggaaccactacagttgttctccttgctggcgagttcttgaaggaggccaagccatttattgaagatggtgtccatcctcaaaatctgatacgaagttatcgaaccgcttcttttatggcaattgagaagattaaagaattagctgtaagcatagagggtaaaagctcagacgagaaaagaagcttattagctaaatgtgcagctacaacactgtcttcaaagctaataggaggagagaaggagttttttgcaacaatggtcgtggatgctgtctttgcgatcggaaatgaagataggttgaacatgataggaataaaaaaggttccaggcggtacaatgcgagactcctttcttgtgaatggtgttgcttttaaaaagactttttcatatgccgggtttgaacagcaacctaagaagtttttgaatcccaagatacttctgttgaacattgaattggaactaaaatcagaaaaagagaatgctgagataagactttcagatcctttgcaatatcagtccattgttgatgcagaatggaatatcatttacgataagttagacaaatgtgtgcagagtggtgccaaaattgttttgtcacgccttgctattggtgatctggcaacacagtattttgcagatcgggatatattttgtgctggtagggttgccgaagatgatctgcatcgcgtagcagctgcaactggcggtactgtccagacatcagtcaacaatgtgatagacgagattcttggatcttgtgaggtttttgaagaaaagcaagttggaggtgaacgtttcaacatatttagcggatgtccttcaggtcagacagccactattgttctccgaggtggagctgatcagtttattgaggaagcagagcggagtctacatgatgcaatcatgatagtaaggagagccacaaagaattccacagtggttgccggtggtggtgcaatcgatatggagttaagccggtacctgtggcaacatgcacgaaatatagctggaaagtcccagctatttataaattcctatgctaaggcccttgaggttattccacgacaactttgtgataatgctggatttgatgcaactgatgtacttaataaactgaggcagaaacatgcacttccaggaggcgaaggtgccctttatggagtggatattaacacaggtggaatttctgattcctttgctaactttgtgtgggagccagcagttgtcaagatcaatgctataaacgctgcaactgaggcagcatgccttattttaagtgtcgatgagacagtgaagaacccaaagtcggagagtgcacaaggagaagctgcaggcggtatgggtagaggacgcggtggtggcggcatgcgtggcggacgtggaagagggatgcgaagacgttgattatcattaagtcatttattaggatacaaacaaactttgggaaattttgt

SEQ ID NO: 2078 - DNA, 1751 bp, Cirsium arvense
ctccactcttctccgccgcaaatctcctcttccaatggcgtccatgatgcaacctcagatcatactgcttaaagaaggtacagacacttcgcaagggaagccgcagctgataagcaacatcaatgcgtgtatggcggtcgctgatgtcgtccgtacaaccctaggtccgagaggtatggataagttgatccatgacgataagggcaacacaaccatctctaacgatggagctacaatcatgaagcttctagacgtcgttcatcccgccgctaagatccttgttgatatagccaagtcacaggattcagaggttggtgatggaaccactacagttgttctccttgctggcgagttcttgaaggaggccaagccattcattgaagatggtgtacatcctcaaaatctgatacgaagttatcgaactgcttcttttatggcaattgagaagatcaaagaattagctgtaagcatagagggtaaaagctcagacgagaaaagaagcttattagctaaatgtgcagctacaacactgtcttcaaagctaataggaggagagaaggagttttttgcaacgatggtcgtggatgctgtctttgcgatcggaaatgaagataggttgaacatgataggaataaaaaaggttcctggcggtacaatgagagactcctttcttgtgaatggtgttgcttttaaaaagactttttcgtatgccgggtttgaacagcaacccaagaagtttttgaatcccaagatactcctgttgaacattgaactggaactaaagtcagaaaaagaaaatagctgagataagactttcagatccattgcaatatcagtccattgttgatgcagaatggaatatcatatatgataagttagacaaatgtgtgcagagtggtgccaaaattgttttgtcacgccttgctattggtgatctggcaacacagtattttgcagatcgggatatattttgtgctggtagggttgccgaagatgatctgcatcgtgtagcagctgcaactggtggtactgtccagacatcagtcaacaatgttatagatgagattcttgggtcttgtgaggtttttgaggaaaagcaagttggaggtgaacgtttcaacatatttagcggatgtccttcaggccagacagccactattgttctccgaggtggagctgatcagtttattgaggaagcagagcggagtttacatgatgcaatcatgattgtaagaagggccacgaagaattccacagtggttgccggtggtggtgctatcgatatggagttgagccgatacctgtggcaacatgcacgaaatatagctggaaagtcccagctatttataaattcctatgctaaggcccttgaggttattccacgacaactttgtgataatgctggatttgatgcaactgatgtacttaataaactgaggcagaaacatgcacttcccggaggtgagggtgccctttatggagtggatattaacacaggtggaatttctgattcctttgccaactttgtgtgggagccagcagttgtcaagatcaatgctataaacgctgcaactgaggcagcatgccttattttaagtgtcgatgagacagtgaagaacccgaagtcggagagtgcacaaggagaagctgcaggcggtatgggtagaggacgtggtggtggcggcatgcgtggcggacgtggaagagggatgcgaagacgttgattatcattaagtcttttattaggatac

SEQ ID NO: 2079 - DNA, 2096 bp, Nicotiana benthamiana
tctttagcgaacgaactagaaaaagtataaaccctaacgagtagggaaaaaccctagaaagttccacttgtacccaggcttctgcttcttcggccatttgctaactcaccaagtagcctactttctcgctcaattgatctctctcgccatcaacaatggcgtctatgatgcaacctcagatcatattgctgaaggaagggactgatacgtcccaagggaaggcacagttggtgagcaacataaatgcttgtatggctgtggctgatgtggtgcgtaccacccttggtcctaggggtatggacaagctgatccacgacgagaaggggaacacgactatttcgaatgatggtgccactataatgaagctgctagacataatacatcctgctgcaaaaatacttgttgacattgccaagtcccaagactctgaggttggtgatggaaccactacagtagttctgcttgcaggagaatttttgaaggaagccaagccttttattgaagagggtgtccaccctcaaaatcttattcgcagttatcgagccgcttctaatatggcaatagagaagataaaagaattggctgttagcattgagggaaaaagtttggaagaaaagaaaagtctacttgcgaagtgtgctgctacgactctgtcgtcgaagcttattggaggggaaaaggaattctttgcacccatggttgtggattctgttcttgcaattggaaatgatgataggctgaacatgattggaattaagaaggtgcctggaggtaacatacgggattctttccttgtaaatggtgttgcctttaagaagacattctcctatgctggttttgaacagcagccaaagaagtttgtggaccccaagatacttttactgaacatagaattagagctaaaatcagaaaaggaaaatgcagagataaggctttcagatccagcgcaatatcaatcaattgttgatgcagagtggaatatcatttatgacaagttggataaatgtgtaaagagtggggccaaagttgtgttgtctcgacttgctattggggatctggccacacagtattttgctgatcgggatatattttgtgctggtcgtgtggctgaagaggatctgcaccgggtagcagctgccactgggggaacaatacagacaactgtgaacaatgtcattgatgagattcttggctcttgtgagctttttgaggagaagcaagttggaaatgagagattcaatatattcagtggatgtccctcaggcaaaaccgccactattgtccttcgtgggggagcagatcagttcatagaggaatccgagagaagcttgcatgatgctattatgattgttagaagggctttgaaaaactctacagtcgttcccggaggtggtgctatagatatggaaataagccgtttcttgaggcaccatgctcgaacgattcaagggaaatctcagctcttcataaactcttatgcaaaagctcttgagattattccccgtcagctatgtgataatgctggttttgatgcaactgatgtgctgaataagctcagacaaaaacacgctcttccatctggtgagggtgcgccttatggagtcgacatcagtactggtggcattgccgatgcatttgccaactttgtttgggagccagcagtcgtgaagattaatgccattaatgcagccacagaagcagcatgcctcattttgagtgtggatgagacagtgaagaatcctaagtcggagagtgctcaaggagatgctgctgcaagcgctatgggtggtagagggcgtggaggtggtcgtggtcgtggaatgaggcggcgatagatttcacaagttctttgcagattttgctatgattttcgtttagacttttttgcattgttcactcctgctgagatggaatcgaaagaatgcaaggaaaagaaatgcgggaagcaagggggttgaccccttgatagtatgtgatgtgattcccaaaattggtctctaaattctggctgatgagtttatttttatttgtgaaactaatttcccggatttgcaactgtcatatttccatcggctgctaatgtaatgtatttctag

SEQ ID NO: 2080 - DNA, 2132 bp, Panicum virgatum
gtaggtggcacccaagggaaccctaacccccagtccattcacgccgctgctccccattaagctacggttcactgatcctgatgtccgtcttctcgttcccgtttctttcccgcagcaaccgcagatcatcctgctcaaggagggcacggacacgtcgcaggggggcgcgcaggtggtgagcaacatcaacgcgtgcacggcggtggcggacatcgtgcggaccacgctggggccccggggcatggacaagctcatccacgacgacaagggcagcgtcaccatctccaacgacggcgccaccatcatgcgcctcctcgacatcgtgcaccccgcgtccaagatcctcgtcgacatcgccaagtcacaggactccgaggttggtgatgggacaactactgtggtgcttctagctgcagagttcttgaaggaagcaaaaccttatgttgaggatggagtgcacccccacagtctaatccgcagctacagggctgcgggtaatatggcaattcaaagggttaaagaactggcagttagcattgaagggaaaagcctggaagagaagaaatcattgctagccaagtgtgctgccacaacattgtcatcaaaacttataggtggtgaaaaggaattctttgcttctatggttgtggatgctgtccttgccattggcaatgatgacaggcttaatcttattgggattaaaaaggttcctggaggtaccatgagagattctttcctggtgaatggtgttgcattcaagaagacattttcatatgctggatttgagcaacaaccaaagaagttcctaaatccgaagattcttttgttgaacattgaactagaattaaaatctgagaaggaaaatgcagagatcagattatcagatcccctacaataccaatcaattgttgatgctgaatggaacattatctatgacaaactggataactgtgtaaaaagcggggcaaagatagttctatctcggctagctattggtgatcttgcaacacagtattttgcagatcgagatattttctgtgccggtcgtgttacagaagaggatttgcaacgtgtggctgcagcaactggtgaaatggttcaaacttctgtaaataatgtcatcgatgaggtacttggttcttgtgaggtctttgaggaaaaacaagtaggtaatgaaagattcaacatatttagtggctgcccttctggacagacagcaaccattgtcctccgtggtggcgcagaccagttcatcgaggaagctgaacgaagtctccatgacgccatcatgattgtgaggagagctcttaagaactctacagttgtgccgggtggtggtgctattgatatggaaataagcaaatatctcagacagcatgcacggaccattgctgggaagtctcagttctttgttaattcgtttgctaaagcccttgaggttatcccaaaacaactttgtgataatgctggatttgacgcaactgatgtgcttaataagctcaggcagaagcatgcatctggtgaatgtgctaattatggtgtagacataaacactggcggaattactgattcttttgctaactttgtgtgggaacctgctgttgtaaagatcaatgctataaatgccgcaactgaagcttcgtgccttattctaagtgttgacgaaactgtgaaaaacccaaagtcggagagtgcacaaggtgaggctgcagctggtgcgatggctggtcgtggtggaggagcaatgcgaggccgtggtgggaggggcatgcgcaggcggtaaaccgagtcactccaaccttgtagcttcatgttttaatcacctgtgggtcagatcttgtgccatactgcacatgtaatgtgtgtttatggacactgcatgtgtaatgaatttttgttttagaagcagtgctagcccttttgtttcagaacaggagagatacgccaagcatttatctgttaactgctgccgtgttgtgatatagctggtgggagccgtggatcatggtttgtttgctcccaatttttttgatgcaagaatgtagcctcttgttaatcttgccatgcgctaaagtgtgaaacatactccctccgtccttaaatataaggcattccaagatttttggagagtc

SEQ ID NO: 2081 - DNA, 2001 bp, Vinca minor
aaagtaccagaaccctctcacttacagaggagttaaaaccctagaaacttctcctccttcaccatcgcactctcactcatcaacgcatccgagctcgttcttcagtaacaatggcgagtatgatgcaaccacaaatcatattgctgaaggaagggaccgacacgtcccaagggaagccacaattattaagcaatataaatgcttgtacggccgtagctgatgtggtgaggtccactcttggccctaggggtatggacaagttgatccatgatgagaagggaaacacaacgatttccaacgatggtgctaccataatgaaacttcttgacattattcacccagcagctaaaattcttgttgatatagccaaatcccaagactctgaggttggtgatggaacaactacagtagttttacttgcagcagagtttctgaaggaagccaagccttttattgaggatggagttcattctcagaatttgatacggagctaccggacggctagctatttggcaattgagaaggtcaagcaattagctgttagcattgaaggaaaaagcttagaagaaaagaagggcttactggctaaatgcgcagctactactctctcctcgaagctcattggtggcgagaaagattttttcgcacccatggttgtcgatgctgtcctctctattgggaatggtgataggctaaatatgattggaatcaagaaggttccagggggtacaatgagggattcgttccttgttaatggcgttgccttcaaaaagacattctcatatgcaggttttgaacagcagccaaagaagtttttgaaccccaagatacttctgctaaacattgaattggagctgaaatcagagaaagagaatgcagaaattaggctgtcagatccatcacagtatcagtcaattgttgatgcagagtggaatatcatttatgacaagttggataaatgtgtcaagagtggtgccaaaattgttctctcgcggcttgctattggtgacctaggaactcagtattttgcagatcgagatatattctgtgctggtcgtgtcactgaagaggatttgcatcgtgttgctgctgcaactggtggtactgtgcagaccaccgtgaacaatattattgatgaggtactcggtacatgtgagtgctttgaggagaggcaagttggaaatgagcggtttaatatattcagtgggtgcccatcaggtcaaacggccactattgttcttcgaggcggagcagatcagttcattgaagaagccgaacgaagtctccatgacgcgattatgattgtcaggaggactctaaaaaactctactgttgttcctggtggtggagctatagatatggagattagtagatacttgaggcagcatgcccgaacaatagctgggaagtctcaactctttataaactcttacgctaaagccctcgaggtaattcctcgtcaactatgtgacaatgccggttttgatgctactgatgtcttgaacaaattgagacaaaaacatgcactgccctcaggtgaaggtgcaccatatggggtggatattaataccggaggaatagctgattcatttgctaattttgtctgggagccagcagttgtgaagataaatgccataaatgcagctaccgaggcagcttgtcttgtcttaagcgtggatgaaacagtcaagaacccgaagtctgagagcgctcaaggggaagctgccgcaagtgccatgggtggtagagggcgcggaggatcagctttccggggtcgtggaagggggatgaggaggtgataggctatccaaatatgggcttggctagttgatcgaagttttgattgtattcttgattgcgctgtattttctcttgtcgtttttttggttttggttttggttgtctttagtagcttcaaactatgctgaaatttctatatgtatgcctttggatatggatatttgtttttactttaattgtaacttcaggaaactcgtgttg

SEQ ID NO: 2082 - DNA, 1980 bp, Chrysanthemum coronarium
ggagtgctttcagcttgcgggaaagatctaaagtttaaaaccctaacaccaccatcgtctcctccaccattctccgccgccgacatcaacaatggcatccatgatgcaacctcagatcatactattgaaagaaggaacagacacatcacaagggaaaccacagttaataagtaacataaatgcttgtatggctgttgctgatgttgtccgtacaacgttgggcccacgaggtatggataaactgatccatgatgatagaggtgttactactatttccaatgatggtgctactattatgaagcttcttgatattgttcaccctgctgctaagatccttgtcgatatcgccaagtcgcaggattccgaggttggtgatggaactacttctgtggttcttcttgctggtgagtttttgagagaggctaaaccgtttattgaagatggtgttcatcctcaaaatttgatacgaagttacagaaccgctgcatctatggcaattgagaaggttgaaaaattggctgtaagcattgaggggaaaagtttagatgaaaagaaaaacttattagctaaatgtgctgctacgacgctttcatcaaagctaatcggaggagagaaagacttttttgcaaagatggtcgtggatgctgtcattgccattggaaatgatgatagattgaacatgattgggataaagaaggttcctggtggtacaatgagggattcgtttcttgtgaatggtgttgcgtttaagaagactttttcatatgctgggtttgagcagcaacccaagaagtttttgaatccaaagatcttgttgttgaacattgaactggaattaaagtcagaaaaagaaaatgccgagataagactttcagatccattgcaatatcagtctattgttgacgcagaatggaacatcatatatgataagttggataaatgtgtaaagagtggtgctaaaattgttctgtcgcgtctggctattggtgatctggcaacacagtattttgcagacagagatatattttgtgctggtcgagttgctgaagatgatctgaatcgtgttacagctgcaactggtggtactgtgcagacatcggtcaacaatgttatagatgaggttcttgggacttgtgaggtttttgaagaaaaacaagttggaaatgaacgattcaatatatttagcggatgtccttcaggtctgacagccactattgttctccgaggtggagctgatcagtttattgaggaagctgagcggagtctacatgatgcaatcatgattgttagaagggccatgaagaattccacagtggttgctggtggtggtgcaatagacatggagataagccgccacttgtggcagcatgcacgaaagatagctggaaagtctcagctattcataaatgccttcgccaaagcccttgaggttattccacgacaactttgtgataatgctggattcgatgcaactgatgtacttaacaaacttaggcaaaaacatgcacttgagtctggtgagggtgctctttatggagtagatatcaacaccggtggtatatgtgattcctttgctaactttgtgtgggagccagcagtcgttaagatcaacgctataaacgctgcagccgaagcagcatgccttatcttaagtgttgatgaaacagtgaagaacccaaagtcagagagtgcacaaggagatgctgctgctatgggcagaggacgtggcggcggcggcatgcgtggtggacgtggaagagggatgcgtagacgttagacatttctcgttttggtttatcataaaaacttgagcctaggcatgagcatgggaaatgtattctcttatgtgagaggaagtaattttggtttttaagtgaagtttttattttcctacttgtttgctggttgttttggttgctgtattgattttgtatgggacttgtattttgtagctgtgggtttagtaagatcatttagtct

SEQ ID NO: 2083 - DNA, 1970 bp, Cichorium intybus
ccattaccataagctcctgtattacctccacccttcaaatctactcgcaatggcatctatgatgcaacctcagatcatactgcttaaagaaggcacagacacttcgcaagggaaaccgcagttgataagcaacattaatgcgtgtatggcggtggctgatgtcgttcgtacaaccctaggtccaagaggtatggataagttgatccatgatgataagggtaacaccactatatctaacgacggcgccaccatcatgaagcttcttgacatcgttcaccccgccgctaagatccttgtcgatatcgctaagtcacaggattcagaggttggtgatggaaccaccacagtagttcttcttgctggtgaattcttgaaggaggcaaaaccatttattgaagatggtgttcatcctcaaaatctgataagaagttatcgaaccgcttcctttatggcaattgagaagatcaaggagttagctgtaagcatagagggaaaaagtttagatgagaaaagaaggttattagctaaatgtgctgctacaacactctcttcaaagctaattggaggagagaaggacttctttgcaaaaatggtggtggattctgtcattgcaattggaaatgatgataggttgaatatgattggaataaaaaaggtgccaggtggtacaatgagggattcatttcttgtgaatggtgttgcatttaaaaagactttttcatatgctggattcgaacaacaacccaaaaagtttctgaatccaaagatacttttgttgaacattgaacttgaactcaaatcagaaaaagaaaatgctgaaataagactttcagatcctttacaataccagtccatagttgatgcagaatggaatatcatttatgataaattggataaatgtgtcaaaagtggtgccaaaattgttctctcacgtcttgctattggtgacctggcaactcagtattttgcagacagagacatattttgtgctggtagagttgctgaagatgatctgcatcgtgttgcagctgcaactggagctacagtacaaacttcagtcaacaatgttattgaggaggttcttggatcctgtgaagtttttgaagaaaagcaagttggaagtgaaagattcaacatatttagtggatgcccttcaggccaaacagccactattgttctccgtggtggagccgatcagtttattgaggaagcagaaaggagtttacacgatgcaatcatgatagtcaggcgggccatgaaaaattccacggtggttgctggtggtggtgcaatcgatatggaaataagccggtacctatggcaacatgcacgcaatatagccggaaagtctcaattatttataaatgcctacgctaaagcacttgaggttattccacgtcaactttgtgataatgctggattcgatgcaactgatgtactcaacaaactgagacagaaacatgcacttgctgctggtgagggtgctctttatggagtggatataaacacaggtggaatttctgattcttttgccaactttgtgtgggagcctgcagtcgtaaagattaatgctataaatgctgcaactgaggctgcctgtcttatcttaagtgttgatgagactgtaaagaatccaaagtcggagagtgcacaaggggaagctgccgccggaatgggtagaggacgcggtggcggacgtggcagagggatgcgaagacgttagtatttcttaggatacaaaacttgagccgaggagggtatgatggtaattttgggttttgatcgaaaacgtttccaatttggtttgttttgtaggattatgttcaagtttgattatggttttgagattttttttttgtaagttgatccatgagctttgatttagaccgggacattgaaattatatgtgagtttattattattatttttaaaatggtattgttggaaactaatagcagtattgagaattt

SEQ ID NO: 2084 - DNA, 3112 bp, Brassica rapa
ctaaatctctctctctctctctctctctccttctctcccatttctccgtagctcctcaacgcatctacaatggcgtcgatgatgcaaccgcagatcatactgctgaaagaaggcacagacacttctcaggggaaagctcagcttctcagcaacatcaacgccgtcacggcggttggcgacgtggttcgaaccacgctcggtcctcgagggatggacaagctcatccacgacgataagggatccgtcaccatttccaacgacggcgctaccatcatgaagctcctcgacatcgtacatcccgccgctaagatcctcgtcgatatcgccaagtctcaagactcagaggttggtgatgggacgacgacggttgttcttcttgctgctgagtttttgaaggaagctaagccgtttgttgaggatggtgttcactctcagaatctgattaggagttatcgcactgcaagcactttggcaattgagaaggtgaaagaactcgctgttagcattgaagggaagagtgtggaggagaagaaaggtttgttggctaaatgcgctgctaccactctttcctctaagcttattggtggagagaaggagtttttcgctactatggttgttgatgctgttatggccattggggatgacgacaggctcaatttgattgggatcaaaaaggttcctggtggtaacatgcgagactctttcctagttgatggtgtggctttcaaaaagacattctcgtatgcgggttttgagcaacagccaaagaagtttgataatcccaaaatccttctgcttaacattgaactggagttgaaatctgagaaggaaaacgctgagattaggctgtcagatccatcgcagtaccagtcaatagttgatgcagagtggaatatcatttatgacaagctagacaaatgtgtcgaaagtggagctaaagttgttctttcccgattggctattggtgatctagctacccagtattttgcggatcgtgatattttctgcgctggccgtgtagcagaacaagatcttaatcgcgtggctgctgcggccggaggaacagttcaaacaagtgttaacaatataatacccgaggttcttggaacttgtgagatatttgaggaaaaacaagttggtggggagagatttaacatattccgtggttgcccttcaggacgtacagcatctattgtcctccgtggtggtgctgatcagttcatcgaagaagctgagcggagtttgcatgatgctattatgattgtgagaagagctgtgaagaactcaactgttgtgcctggaggtggagctatagatatggagataagcaagtacctgaggcagcattcacgaacaattgctgggaagtcacaacttttcatcaactcgtatgcaaaggccctggaggttattccacgacagctatgtgacaatgctggatttgatgcaactgatgttctaaataaattaagacagaaacacgccatgcaaagcggtgaaggagcttcttacggagtagacatcaacactggtggaatagcggactcatttgctaacttcgtgtgggaaccagcagttgtgaagattaatgctataaacgctgcaactgaggcagcgtgccttatcctaagtgtggatgaaaccgtgaagaaccctaaatctgagagcgcacagggagatgctgccgctggtgctatgggaagaggacgcggtggaggtcgtggtatgcgcaggcgatgagcttttttttttctctaatgtcaaacttgcagattttttctctgaattttagtcttgctgaattttggtgatcttgaaatcaaaaagctagtgtgtgtttgttgacttatgtccatacaatttgttaaaatgaaatttcagtgtggtttttttgttacacttgagaagctaattagatcaagaatcactgcataaaattcatttggtgatgttatctcttgctacatacatcatcttggagagcaatttacttgattggagtacataacgcaaaagtgctaaacaccaactcgtgagtaatactcggtgagtagatctttgggtgaagagcttaaaagcttagaaattagagctacatcaatgcatggaaacttcttccactcatcaatatgatttctaagtatctctttcgctttctccttcaagcttaagctacagtctatacttaggacagcgcaaagcttctttactgtacttacgctagccatctcttccaccacttcgctttccggcgaatatttggacactgagcttagtatagagatagctctatcgtctgctgcagccgaaaccctcaacaaccgttttgtcacaatcgctatccctcctctatgagcgagaaactcagctctaccatttgcacaacaacataaacgagacaagattcccagcacaagttcagtggttctcttctcgccagttgagcttatttcaagttcaatgagtttggaaaccgctccgagatccacaaggatggttctgttcctgctccaagaagaggtctctagaagaatcatcagcgcagcgatcacagcttgtttaataaccacgctatgatctagtttcgatggtgccttgtttctcactctagagtttgatggttgtaccgtagcgcacacgctagggtttacgcgattggaacgacttacaacgtccttgagaaaccctatgatgcctttgaatatctcagcactcaatctctcgacgatatgagaggatgtgttttcagttaggttcctcaagaggacaatagtataagccttgttcatgaaatctttttggtttaagaccatagtcaacgattccaagatccgttcattttcgatcaagattgttcttgcttcatttaacggaacaccgatcaagtgaagaagacgtagagactcatctagcttccctttgatatgatgttgcccctcctcctcttcttcttcacgagcatacttgactatgaacaagatcaaagacttatgtacacctccttcacacatcagtctcctgtttctctctccctccatagctaacacttcaagcttctttaacgtgtcttcttttcctaaggctgttcaattcaaaccgaaccaaacgttaa

SEQ ID NO: 2085 - DNA, 1868 bp, Brassica napus
acgcatctacgatggcgtcgatgatgcaaccgcaaatcatactgctcaaggaaggcacagacacttcccaggggaaagcgcagctactgagcaacatcaacgccgtcactgccgtcggcgatgtgcttcgaaccactctgggtccacgagggatggacaagctcatccacgacgataagggatccgtcaccatctccaacgacggcgctaccatcatgaagctcctcgacattgtccatcccgccgctaagatcctcgtagatatcgccaaatcgcaagattccgaggttggtgatgggacaactacggttgttcttcttgctgctgagtttttgaaggaggctaagccgtttgttgaggacggtgttcactcccagaatctgattaggagttatcgcactgcaagcactttggcaattgagaaagttaaagaacttgctgttagcatcgagggtaaaagtgttgaggagaagaaaggtatgttggctaaatgtgctgctaccactctttcctctaagcttattggtggagaaaaagagttctttgctactatggttgttgatgctgttatggccattggggatgacgacaggctaaatttgatcggaatcaaaaaggttcctggtggtaacatgcgagactctttcctagttgatggtgtggctttcaaaaagacattctcatatgcgggttttgaacaacagccaaagaagtttcttaatcccaaaatcctcttgcttaacatcgaattggagttgaaatctgagaaggaaaacgctgagattagactgtcagatccgtcacagtaccagtcaatagttgatgcagaatggaatatcatttatgacaagctagacaaatgtgtcgaaagtggagctaaagttgttctttctcgattggctattggtgatctagccactcagtattttgccgatcgtgatattttctgcgctggccgtgtagcagaagaagatcttaaccgcgtggctgctgcggctggaggaacagttcagacaagtgttaacaatataatacccgaggttctcggaacttgtgagatatttgaggaaaaacaagttggtggggagagatttaacatattcagtggttgtccttcaggacgtacagctactattgtcctccgtggtggagctgatcagtttatcgaagaagctgagcgtagtttacatgatgcgattatgatagtgagaagagccgtgaagaactcaactgttgttcctggaggtggagcgatagatatggaggtaagcaagtacctgaggcagcattcaagaacaattgctgggaaatcacagcttttcatcaactcgtatgcaaaggccttggaggttattccacggcaattgtgtgacaatgctggatttgatgcaacggatgtcctaaataagttaagacaaaaacacgccatgcaaagcggtgaaggagcttcttatggagtggacattaacactggtggaattgctgattcttatgctaactttgtctgggaaccagcagttgtaaagattaatgctataaacgctgcgactgaagcagcttgccttattctcagcgtggacgaaactgtgaagaatcctaaatctgagagcgcacagggagacgctgccgcaggtgctatgggaagaggacgtggaggtggaggtcgtggccgtggtatgaggaggcgataagttttgttatttttttagtcttatggcaaaacttgcaagcttcttctctgaattttagttttgttgaattttgtcttgaaatcaaaaggagctagtgtctcgtgtttgtgtttatttgacttatgtccatacaatttttgaaattgaaatttcagtgtgggtttttgttcgaactga

SEQ ID NO: 2086 - DNA, 2311 bp, Citrus clementina
catcaagctggtgcagcgacggtcatgcttcgtaggctttaaacgacatgagtatataaaccctaagacaatccctccaataaattaaacccaaagtcacagcaatcactagaaacaactagtcactgcgcagtacacacttgggatctcgtcagtgttattgaacttgagtaagggggaaaaaaaaaaaatcaaaccctagcgttctctcataaacttcatttcgatttcaatctcaacaatggcagccatgatgcagccgcagatcattttattgaaagaaggaaccgacacgtcgcaaggaaaggctcagttggtgagcaacataaacgcgtgcacggcggtggctgatgtggtgaggtcgacgctgggccccagagggatggacaagttgatacacgacgacaagggcaccgttaccatctctaacgacggcgccaccatcatgaagcttctcgacatcgtccatcccgccgccaagattctcgttgacatcgccaagtctcaggactctgaagtcggcgacggtaccaccactgtggttctgcttgcggccgagttcttgagggaggccaagccttttattgaggatggagttcaccctcagaatttgattaggagttttcgcaacgccagctataaggcgattcagaagatcaaggaattggctaaaagcatagagggtcaaagtttagaagagaagaaaagactattgtcaaaatgtgctgccactacactttcttctaaacttattggtggtgaaaaagagttttttgcttcaatggttgtagatgctgttggtgcaattggcgatggtgataggttgaatatgattggaatcaagaaggttccaggtggtaccatgcgggattcctttctagtaaatggtgttgcttttaagaagacattttcgtatgcaggctttgaacagcaaccaaagaagtttttaaacccaaagatactcttattgaacattgagttggaactgaaatctgagaaagaaaatgctgagataagactttcagatccatcacagtatcaatcaattgttgatgcagaatggaatatcatttatgaaaagttggataaatgtgtgcagagtggggccaaagttgttctttcacggcttgctattggtgatctagccacgcagtattttgcagaccgagatattttctgcgctggtcgtgtggctgaagaagatctgctacgtgttgctgctgcaactggtggaactgtgcagacatctgttaacaatgttgttgatgaggttcttggtacttgtgaacattttgaggaaaggcaagttggaaatgagaggtttaatatctttagtggatgcccatcagggaggacagctactatagtacttcgtggtggagctgaccagttcattgaagaagccgagaggagtttacatgatgcaattatgattgttagaagagctacgaagaattccactgtagttgctggtggtggtgctatagatatggagataagtaaatacttgaggcaggaatcccgcgcaatagccgggaagtctcagttttttatcaactcttatgcaaaagctctcgaggttatcccacgccagttgtgtgacaatgctggatttgatgctactgatgtgctgaataaattaagacagaaacatgcgcttccaactggtgagggtgccccttatggagtggatatcaacactggtggaattgcagattcatttgctaactttgtctgggagccagcagttgtcaagatcaatgctataaatgctgctactgaggcagcatgccttatcttgagtgtggatgagacagtaaagaaccctaagtctgaaagtgcacaaggtgaagctgccgcaagtgccatgggcggcagagggcgtggtcgtgggaggggcatgcgcaggcgatgagcttacgatatttcaagtcttgaatgtcttttttgatggtgaattgggggtgctgattcgattagattttcctcatcttttgtagtctctctatgttgtgtttccaagtgtaattgaaaatttaacagactggtggttaccctcagccagttatgccatttgcgtttgttgttgtttggtgaaggcaacgagccaacgagactatagttttgtcccattgtggaattatggccgtggtttttattatgttaaatgggttttcttctactcttttgacctttggtttcttcttgcccttgctgccaaaaaaatggaaccctcttttgtttttagaaccttgatggcatatctgacactgactatttattttattcaatcgatattttgttagaatta

SEQ ID NO: 2087 - DNA, 2109 bp, Medicago truncatula
ctcattctcacactgcaaaaaagaaggagccagaaactgctactcgaaaaaactcttcaaatcttaaaccctaataactctctctctctctctctctcttcctctttcaatcatcgtcttcaaccatgtcttctatgctgcaaccacagatcatactactgaaagaaggtacagacacatctcaagggaagccacaactcgtaagcaacatcaatgcttgcactgccgtcgccgacgtcgttcgaaccaccctaggccctcgcggtatggacaaactcatccacgatgataaaggctcagtcaccatttctaacgacggcgcaactatcatgaagcttcttgatatcgttcatcccgccgctaagatcttagttgatattgccaagtctcaggactctgaggttggtgatggaaccaccactgtggtattgcttgcagctgagtttttaagagaagcaaagcctttcattgaagatggtgtccactctcaaaatttaatacgaagttataggactgcaggctccttggcgattgagaaggttaaagagctagctgttagcattgagggaaaaagtttggaagagaagaaaagtttactcggaaagtgtgctgctacaacactttcttcaaaacttataggtggagaaaaggagttctttgcatctatggttgtggacgctgtaattgccattgggactgatgataggttaaacatgatcggaataaagaaggttcctggtggtaacatgcgcgactcatttcttgtcaatggtgttgccttcaagaagacattttcatatgctggatttgagcagcagcccaagaagtttctcgatccaaaaatactattacttaatgttgagttggagctaaaatctgagaaagaaaatgccgaaataagattatcagatccatcgcagtatcaatctattgttgatgcagaatggaatattatttatgacaaattggataaatgtgtccaaagtggtgccaaagttgttctctcacgcctggctattggtgatctggctacacagtattttgccgatagagacattttctgtgctggtcgtgtagcagaagaagatcttaaaagagttgctgctgcaactgggggaactgtgcaaacatctgtcaacaacattattgatgaggttcttggaacttgtgagatttttgaggaaaagcaagtaggaaacgagagattcaacatcttcaatggatgtccatctggccaaacagccaccatagttctccgtggtggagccgatcagttcatagaggaagcagagcgaagtttgcatgatgcaatcatgattgttagaagggctatgaagaattcaactgtagttgctggtggaggtgctatagatatggaaataagccggtacctaaggcagcatgcacgcacaatagctggaaagtctcaacttttcatcaactcctatgcaaaagctctagaggttattccccggcaattatgtgacaatgctggatttgatgcaactgatgtgctgaacaaactaagacagaaacacgcgcttccttctggtgagggtgctccatttggggtcgacatagccactggtggaattgctgattcatttgccaactttgtctgggagccagcagttgtaaagatcaatgctataaatgctgctacggaggcagcttgcctggtcttaagtgtggatgaaacggttaaaaatcctaagtccgagagtgcacaaggagaggctgctgcaagtgccatgggaggcagaggtcgcggaggtggtttccgtggccgtggacgaggaatgcgtagatgattagaaatgtgttctaatgggttagtttgtttcgtgtgttgaatgtctgtaatatgtgcaatgccactggatgtatgtttctggtattgttgctagaagcataccatatttatctacagatgatgatatgttatgaaatggtagtaatattggggattctaggagcatcatctgatcaaactaggatttgatggtagcgattttgaggcatggtcttttttgtatttgttaattttatatgttggagggttgaatttattagatggctgttgttggggatttctattgtgtgaaattt

SEQ ID NO: 2088 - DNA, 2288 bp, Cajanus cajan
tcgtttcggtgcgagagtgaaggagccagaaactgctgcttctcgacccactacactctcttcgaagctcaaaacttaaaccctagttctccctctctttctctgttgcgtcttcaaccatgtcagcgatgctgcaacctcagatcattctgctcaaggaaggcacagacacttcgcaggggaagccgcagcttgtgagcaacatcaatgcctgcaccgccgtcgccgacgtcgtccgcaccaccctcggccctcgcggcatggacaagctcatccacgacgacaagggaaccgtcaccatctccaacgacggcgccaccatcatgaagctcctcgacatcgtccatcccgccgccaaaatcctcgtcgacatcgccaagtctcaggactccgaggttggcgatggaaccaccactgtggtattgcttgcagcggagtttttaagggaggccaagcctttcattgaagacggtgttcactctcaaaatttaattcggagctataggaccgcaagctccttggcaattgagaagattaaagagcttgctgttagcatagaggggaaaagtcttgaagagaagaaaagcttgcttgcaaagtgtgctgctaccacactttcttcgaagctcattggtggagagaaagaattctttgcatccatggttgtggatgctgtaattgcaattgggactgaggacaggttgaacatgattggaataaagaaggttcctggtggtaccatgcgagactcatttctagtaaatggtgttgccttcaaaaagacattttcatatgctgggtttgagcagcaacccaagaagtttctcagtccaaaaatactattactaaatgttgagttggagctaaaatctgagaaagaaaatgctgagataagattgtcagatccagcgcaatatcaatcaattgttgatgcagaatggaatattatttatgacaagttggataaatgtgtcaacagcggtgccaaagtagttctttcacgattggctattggcgatctagctacacagtattttgcagatcgagacattttctgtgctggtcgtgtagctgaagaagatctaaaaagggttgctgctgcaactggtggaactgtacaaacatctgtcaataacataattgatgagatccttggaacttgcgagatttttgaggaaaggcaggttggaaatgagaggttcaatatatttaatggatgtccatctggccaaacagctaccatagttcttcgtggtggagctgatcagttcatagaggaagcagagcgaagtttgcatgatgcaatcatgattgttaggagggctttgaagaattcaactgtggtagctgggggtggtgccatagatatggagataagccggtacctgaggcagcatgcccgtacaatagccggaaaatcccagcttttcattaactcctatgcaaaagctcttgaggttataccaagacaattatgtgacaatgctggatttgatgcaactgatgtgctgaataaactaaggcagaaacatgcacttccttctggtgagggggcaccatatggggtggacatagccactggtggaattgctgactcttttgctaactttgtctgggagcctgcaattgtgaagatcaatgccataaatgctgcaactgaggctgcttgcctcatcttaagtgtggatgaaacaattaaaaatcctaagtctgagagtgcacaaggagaggctgctgcaagtgccatgggcagaggacgtggaggtgcattccgtggtcgtggaagaggaatgcgaagatgatgagaaattcattctatttattacgggttgagtgtggtgcattgtctgtctaattcgtgtgaggccaatgcatgcttctttctgctactgctacttgatgttgctagaagcatgccgatttttgaacctacaaatcatgaaatgaaaatgtaatggagattctgggaacatcatctgatcaaaactaggatttgaagatagcagttttcgagcatcgtctttctgagcatcattttatacgatggaggggttaaaaactatcgcatggctgttggtgggactttagctatttagtgtgaaaattttcatcatcttgttcaactattttattattatttagtattcgtttaagcatgcgatttcagttttcttttacgactataaaagtcatcagtgggcaagtgcaagtaatattgcatactaattgcagaaacagttaagcagatcaaactactcaattttattagaaaatgaaactgtgtaggg

SEQ ID NO: 2089 - DNA, 2193 bp, Glycine max
ctcatttccacacttgacactctgctagagcctagaagccagaaaactgctgtttctcgacccacacttttgaacttgaaaacttaaaccctagttctctctcttgtctttcttctgcatcttcaaccatgtcagcgatgctgcaacctcagatcattctgttgaaggaaggcacggacacttcgcaagggaagccgcaggtggtgagcaacatcaatgcctgcaccgccgtcgccgacgtcgtccgcaccaccctcggccctcgcggcatggacaagctaatccacgacgacaagggaaccgtcaccatctccaacgacggcgccaccatcatgaagctcctcgacatcgttcaccccgccgccagaatcctcgtcgacatcgccaagtctcaggactccgaggttggcgatggaaccaccactgtggtgttgcttgcagcggagtttttaagggaggctaagcctttcattgaagatggtgttcactcacaaaacttgatacgaagctataggacggcctgctccttggctattgagaagattaaagatctagctgttagcatagaggggaaaagtctggaagaaaagaaaaacttgcttgcaaagtgtgcttctaccactctttcttcgaagcttataggtggagaaaaagaattctttgcacccatggttgtggatgctgtaatttcaattgggaatgaagacaggttgaacatgattggaataaagaaggttcctggtggtaccatgcgggactcatttctagtaaatggtgttgccttcaaaaagactttttcatatgctgggtttgaacaacagcccaagaagtttctcaatcctaaaatactattactaaatgtcgagttggagctaaaatctgagaaagaaaatgctgaaataaggttatcagatcctgcgcaatatcaatcaatagttgatgcagaatggaacattatttatgataagttggataaatgtgtcatcagtggtgccaaagttgttctttcacgattggctatcggtgatctagctacacagtattttgcagaccgagatattttctgtgctggtcgtgtagctgaagaagatctaaaaagggttgctgctgcgactggtggaaccgtacaaacatctgtgaataacgtgattgatgaggtccttggaacttgtgaagtttttgaggaaaggcaggttggaaatgagaggttcaatattttcagtggatgttcatctggccaaacagccaccatagttcttcgtggtggagctgatcagttcatagaggaagcagagcgaagtttgcatgatgcaatcatgattgttaggagggctttgaagaattcaacagtggttgctgggggaggtgcaatagatatggagataagccggtatctgaggcagcatgcacgtacaatagctggaaagtctcagcttttcattaactcctatgcaaaagctcttgaggttatacctagacaattatgtgacaatgccggatttgatgcaactgatgttctgaataaactaaggcagaaacatgcgctcccttctggtgaggggggaccatatggggtggacatagccactggtggaattgctgactcgtttgctaactttgtctgggagcctgcaattgtgaagatcaatgctataaatgctgcaacagaggctgcttgccttatcttaagtgtggatgaaacaattaaaaatcccaagtctgagagtgcacaaggagatgctgctgcaagtgccatgggcagaggtcgtggaggtgcattccgtggtcgaggacgaggaatgcgaagatgatgagaagtgcattctatgggttgagtgtctgttcattgtctgtctaattcgtgaggccaatgcatgcttgtttctgctacttgatgttgctagaagcatgccgatttttgaacttacaaatcatgaaatgaaaatgtaatggagactctgggaacatcatcttatcaacctaagatttgcagatagcaattttcaagcattgtctttctgacgatcattttatacatttggaggggttaaaactatcgcatggctgtggaggacttgagcttcgtgtgaaattttgcatcttgttctacaatttttaactatatatttattgcttagtttgcgtatagtaagcatttctacaattttcaactatttatttattgcaaagtta

SEQ ID NO: 2090 - DNA, 2085 bp, Ricinus communis
gaaaaaacactcttgacaaaaccctagcatcctctttcctctctcactcaactccgttctctgctctctgttctctctctccgtcaatctcactaataaaatctttccttcattttctccaaatcttaatcaatggcagccatgctgcaaccccagatcatactgctaaaagaagggacagacacgtcacaaggcaaagcacagctagtaagcaacattaacgcttgcacagccgtggccgatgttgttagaacgacactgggtcctagaggtatggacaagcttattcatgacgataaaggaaatgttaccatttcaaatgacggtgctaccattatgaagttgcttgatattgttcatcccgctgctaagatccttgttgacattgctaaatctcaggactctgaggttggtgatgggaccactacagtagttctacttgcggcagaatttttgaaggaggcgaaaccttttatagaagatggggtccactcacaaaatttaatacggagttataggactgcatgcaatttggcacttgagaagatcagagaactagcttttagcatagaaggaaaaagtattgaagaaaagaaaagcttactcgctaaatgtgcttccacaacgctttcgtcaaagcttattggtggtgagaaggagttctttgcacagatggttgtggatgctgtcattgcaattgggaatgaagataggctaaatatgattggaataaagaaggtacctggtgggaatatgcgagattccttcctggtaaatggtgttgcctttaagaagacgttttcatatgctggatttgaacaacaaccaaagaagtttgtaaatcccaagttacttttactcaacattgaattagaattgaaatctgagaaagaaaatgcagagataaggctgtcagacccatcagaatatcaatcaattgttgatgcagaatggaatatcatctatgacaagttggataaatgtgtacagagtggggccaaagttgttctttcacgtttggctattggggatctagcaacgcagtattttgcggatcgagacatattctgtgctggccgtgtagctgaagaagatttgcaaagggttgctgctgcaactggtggaactgtgcaaacaactgtcaacaatataattgatgaggttctcggaacttgcgagatttttgaggaaaaacaagttggaaatgagaggtttaatatattcagtggatgcccttctgggaaaacagccactatagttcttcgtggtggagctgatcagttcattgaggaagctgaacgaagtttacatgatgctattatgatagtcagaagagctatgaaaaactcaactgtcgttgctggtggtggtgcaatagatatggaaataagtagatttttgaggcagcatgctcgcacaatagctggaaagtcccagctgtttattaactcatatgcaaaagcccttgaggttatcccacgacaactatgtgataatgctgggtttgatgcaactgatgttctgaacaaattaaggcagaagcatgcacttccgtctggtgagggtgcgccttttggagtggatatcaacactggtggaattgcagattcatttgctaactttgtttgggaaccagcagttgttaagatcaatgcaataaatgctgctactgaggctgcttgtcttatattgagcgtggatgagacagtgaagaaccccaagtctgaaagtgctcagggggaagctgctgctggtgccatgggtggtagagggcgtggaggggctgctttccgtggccgtggacgcgggatgcgaagacgataagcttagaagtgttatagttgagaagcaatttgcaacttttcaacttgtctctttgatttagttgatttcacattgtattattggaattacatctgtgttatctgcctatgcgacttataaacgccaagtggccttgcaaatgacgctgaaaactttgtgctcattgtttgcttttaggagtgcagcagctgctgcttatttttgctgggtgtagaatgtaggtaggggtatgccatgttttgtaattcacaatcaatttgg

SEQ ID NO: 2091 - DNA, 2507 bp, Ricinus communis
tgtaagattttatttttacttttgtaagttaaagaccaacatttttcttaaattcttttattactatttgtttaaactagaaagaaccagaaaaaacactcttgacaaaaccctagcatcctctttcctctctcactcaactccgttctctgctctctgttctctctctccgtcaatctcactaataaaatctttccttcattttctccaaatcttaatcaatggcagccatgctgcaaccccagatcatactgctaaaagaagggacagacacgtcacaaggcaaagcacagctagtaagcaacattaacgcttgcacagccgtggccgatgttgttagaacgacactgggtcctagaggtatggacaagcttattcatgacgataaaggaaatgttaccatttcaaatgacggtgctaccattatgaagttgcttgatattgttcatcccgctgctaagatccttgttgacattgctaaatctcaggactctgaggttggtgatgggaccactacagtagttctacttgcggcagaatttttgaaggaggcgaaaccttttatagaagatggggtccactcacaaaatttaatacggagttataggactgcatgcaatttggcacttgagaagatcagagaactagcttttagcatagaaggaaaaagtattgaagaaaagaaaagcttactcgctaaatgtgcttccacaacgctttcgtcaaagcttattggtggtgagaaggagttctttgcacagatggttgtggatgctgtcattgcaattgggaatgaagataggctaaatatgattggaataaagaaggtacctggtgggaatatgcgagattccttcctggtaaatggtgttgcctttaagaagacgttttcatatgctggatttgaacaacaaccaaagaagtttgtaaatcccaagttacttttactcaacattgaattagaattgaaatctgagaaagaaaatgcagagataaggctgtcagacccatcagaatatcaatcaattgttgatgcagaatggaatatcatctatgacaagttggataaatgtgtacagagtggggccaaagttgttctttcacgtttggctattggggatctagcaacgcagtattttgcggatcgagacatattctgtgctggccgtgtagctgaagaagatttgcaaagggttgctgctgcaactggtggaactgtgcaaacaactgtcaacaatataattgatgaggttcttggaacttgcgagatttttgaggaaaaacaagttggaaatgagaggtttaatatattcagtggatgcccttctgggaaaacagccactatagttcttcgtggtggagctgatcagttcattgaggaagctgaacgaagtttacatgatgctattatgatagtcagaagagctatgaaaaactcaactgtcgttgctggtggtggtgcaatagatatggaaataagtagatttttgaggcagcatgctcgcacaatagctggaaagtcccagctgtttattaactcatatgcaaaagcccttgaggttatcccacgacaactatgtgataatgctgggtttgatgcaactgatgttctgaacaaattaaggcagaagcatgcacttccgtctggtgagggtgcgccttttggagtggatatcaacactggtggaattgcagattcatttgctaactttgtttgggaaccagcagttgttaagatcaatgcaataaatgctgctactgaggctgcttgtcttatattgagcgtggatgagacagtgaagaaccccaagtctgaaagtgctcagggggaagctgctgctggtgccatgggtggtagagggcgtggaggggctgctttccgtggccgtggacgcgggatgcgaagacgataagcttagaagtgttatagttgagaagcaatttgcaacttttcaacttgtctctttgatttagttgatttcacattgtattattggaattacatctgtgttatctgcctatgcgacttataaacgccaagtggccttgcaaatgacgctgaaaactttgtgctcattgtttgcttttaggagtgcagcagctgctgcttatttttgctgggtgtagaatgtaggtaggggtatgccatgttttgtaattcacaatcaatttgggggcagaaatgtttcaaggaaatcgaattttgtagtctcttggttgggatgatgcaattgctacttttctgcaatcaaactctttaccagatcagcatttctagaacatgcccttcatcctctcatttctcgggagagagccatcggatatttgaagagatgaagagagagaaatagaatcttggtaaaaagaagattggacctggtatgctaatctacaatctatcttgaagatgcatatttcaatttaagaaaattgaaaaagaaatcgaaataaattgaaaaagaaattgatgtgtttaagttagtatttgtaagtgtacaaattgtttt

SEQ ID NO: 2092 - DNA, 2137 bp, Glycine max
agctctaaagaaatctcacgttcactgcgagagtgtgggagccagaaaactgctgcttctcgacccacttttgaagttcaaaacttaaaccctagttctctctctctttctttctcctgcatcttcaaccatgtcagcgatgctgcaacctcagatcattctgctcaaggaaggcacggacacttcgcaagggaagccacagctggtgagcaacatcaatgcctgcaccgccgtcgccgacgtcgtccgcaccaccctcggccctcgcggcatggacaagctcatccacgacgacaagggaaccgtcaccatctccaacgacggcgccaccatcatgaagctcctcgacatcgtccaccccgctgcaaaaatcctcgccgacatcgccaagtctcaggactccgaggttggcgatggaaccaccactgtggtgttgcttgcagctgagtttttaagggaggccaagccattcattgaagacggtgttcactctcaaaacttgatacggagctataggacggcctgctccttggctattgagaagattaaagatctagctgttagcatagaggggaaaagtctggaagaaaagaaaagcttgcttgcaaagtgtgcttctaccactctttcttcgaagcttattggtggagagaaagaattttttgcacccatggttgtggatgctgtaatttcaattggaaatgaagacaggttgaacatgattggaataaagaaggttcctggtggtaccatgcgggactcatttctagtaaatggtgttgccttcaaaaagacattttcatatgctgggtttgagcaacaacccaagaagtttctcaatccaaaaatactattactaaatgttgagttggagctaaaatctgagaaagaaaatgctgaaataaggttatcagatcctgcgcaatatcagtcaatagttgatgcagaatggaatattatttatgacaagttggataaatgtgtcagcagtggtgccaaagttgttctttcacgactggctattggtgatctagctacacagtattttgcagatcgagatattttctgtgctggtcgtgtagctgaagaagatctgaaaagggttgctgctgcgactggtggaaccgtacaaacatctgtgaataacattattgatgaggtccttggaacttgtgaaatttttgaggaaaggcaggttggaaatgagaggttcaatattttcaatggatgtccatctggccaaacagccaccatagttcttcgtggtggagctgatcagttcatagaggaagcagagcgaagtttgcatgatgcaatcatgattgttaggagggctttgaagaattcaacagtggttgctgggggaggtgcaatagatatggagataagccggtacctgaggcagcatgcacgtacaatagctggaaagtctcagcttttcattaactcctatgcaaaagctcttgaggttatacctagacaattatgtgacaatgccggatttgatgcaactgatgtgctgaataagctaaggcagaaacatgcgcttccttctggtgagggggcaccatatggggtggacatagcaactggtggaattgctgactcatttgctaactttgtctgggagcctgcagttgtgaagatcaatgctataaatgctgcaacagaggctgcctgccttatcttaagtgtggatgaaacaattaaaaatcccaagtctgagagtgcacaaggagatgctgctgcaagtgccatgggcagaggtcgtggaggtggattccgtggtcgtggacgaggaatgcgaagatgatgatgagaagtgtattctacgggttgagtgtctgttcattgtctgtctaattcgtgaggccaatgcatgcttgtgtcttctacttggtgttgctggaagcatgccgatttttggacctacaaatcatgaaatgaaaatgtaatggagattctgggaacatcatctgatcaacctaggatagcaattttcaagcattgtctttctgacgatcgtttcgacttgagcttcgtgtgaaattttgaatcttgttctacaattttcaactatttatttattacttggtatgcgtatagtataaacatgtgatttcaggttttttttttc

SEQ ID NO: 2093 - DNA, 2049 bp, Echinacea purpurea
cggccgggggacaaactaaatcacatgaaaaaatctttacaagtatacaagtctgcatcttaacagtgcaaagaagccactacacacaacctaaaccctagctccaccattaccgccaccgttctccgccgcaccaaatccgtttgcaatggcgtccatgatgcaacctcagatcatactgctcaaagaaggtaccgacacttcgcaagggaaaccgcagctaataagcaacatcaacgcctgtatggcggtcgctgatgtcgtccgtacaaccctaggccccagaggcatggataaattgatccatgatgataaggggaatactactatttctaatgatggagctactatcatgaagcttcttgatgttattcatcccgctgctaagatcttggttgatattgctaagtcacaagattcagaggttggtgatggaacgactactgtagttcttcttgctggagagttcttgagagaggctaagccattcattgaagatggagttcaccctcaaaatctgatacgaagttaccgaactgctgccaatatggcaattcagaagattaaagaattagctgtaagcatagagggaaaaagtttagatgaaaaaagaagcttattagctaaatgtgctgctacaacactctcatcgaagctgattggaggggaaaaggattttttgcaaaaatggttgtggatgctgtcattgctattggaagtgatgatagattgaacatgattggaataaaaaaggttcctggtggtacaatgagggattcctttcttgtgaatggtgttgcctttaaaaagaccttttcttatgctgggtttgagcagcaacccaaaaagtttctaaatccaaagatattactattgaacattgaactggaactaaaatcagaaaaagaaaatgctgagataagactttcagatccactgcaatatcagtccatagttgatgcagaatggaatatcatatacgataagttggataaatgtgtaaagagtggtgcaaaaattgttttgtcacgtctagctattggtgatctggcaacacagtattttgcagaccgagatatattctgtgcaggtagagttgctgaagatgatctaaatcgtgttgcagctgctaccggggctactgtacagacatcagtcaacaatgttatagatgaggttcttgggtgttgtgaggtttttgaggaaaaacaagttggaaatgaacggttcaacatatttagtggatgtccttccgggcagacagctaccattgtccttcgaggtggagctgatcaatttattgaagaagctgagcggagtttacatgatgcaatcatgattgtgaggagggcaatgaagaattccacagtggttgctggtggcggtgcaattgatatggagataagccggtacctgtggcagcatgcacgcaatatagctggaaagtctcagctatttataaattcttttgctaaagctcttgaggttattccacgacaactttgtgataatgctggatttgatgcaactgatgtactcaacaaactgaggcaaaaacacgctcttcctgctggtgagggtgctctttatggagtagacatcaacacaggtggaatttgtgactccttcgccaactttgtgtgggagccagcagtggtaaaggtgaatgctataaatgctgcaacagaggcagcctgtcttatcttaagtgttgatgaaacagtgaagaacccaaagtcggagagtgcacaaggagaggctgctggtggcatgggtagagggcgtggcgctggacgtggaagagggatgcgcagacgttaagtgttttatatcttgttttggtttgaacctgagcatgggaattgtgaagtaatttaattttggttttagagtgacgaagacaacttttgtttggtggttgtgggacttgctttttgtagcaataggatcatttcaaatgtatggattatggtatcgttgagtatactgtcattagtagtatcaagaatgtgagttccttttcaatgacaaaatcttgttttggtaatc

SEQ ID NO: 2094 - DNA, 2453 bp, Chrysanthemum coronarium
tccttgtttttgacaaaacttttgacggaggatttaccccggttatttgttcgtcccaataagattgtcttagactttcaaaaagggaaagctgttggtccagtccgaaatgatttcaagacaggagaagtacaagaaggaaataaagattttgttggcgaactatcagtcactcttgttgatgctaggaagctcccttacgccttctttggaaaaccagatccctatgttgtactaaggctaggagatcaggtaatacgtagcaaaaagaacagtcagacaactgttattggggctcccggtgaaccaatttggaaccaggacttttacatgctagttacgaaccctagaaaacagaaattgtcaattcaagtgaaggatttttttggatttccagatgcaactgtaggctcaggagaggttgatcttggatctttaaaagacacagtaccaacagacaaaattgtggcacttagacgtggctggggactattcagaaaaggatatgcgggagagatctaaagtttaaaaccctaacaccaccatcgtctcctccaccattctccgccgccgacaacaacaacaatgacatccatgatgcaacctcagatcatactattgaaagaaggaacagacacatcacaagggaaaccacagttaataagtaacataaatgcttgtatggctgttgctgatgttgtccgtacaacgttgggcccacgaggtatggataaactgatccatgatgatagaggtgttaccactatttccaatgatggtgctactattatgaagcttcttgatattgttcaccctgctgctaagatccttgtcgatatcgccaagtcgcaggattccgaggttggtgatggaaccaccagtgtagttcttcttgctggcgagttcttaagagaggccaagccattcattgaagacggcgtgcatcctcaaaatctgatacgcagttatagaactgctgcttttatggcgattgagaagattaaagaattggctgtaagtatagagggaaaaagtttggatgaaaagagaagcttgttagctaaatgtgctgctacaacactctcatcgaagctgataggaggagagaaagatttctttgcaacaatggtcgtcgatgctgtcgttgcaattgggaatgaggatagactgaacatgattggaataaaaaaggttcctggtggtacaatgcgggactcttttctggtaaatggtgttgcgtttaaaaagaccttctcatatgctgggtttgagcagcaacccaagaagtttttgaatccaaagatcttgttgttgaacattgaactggaattaaagtcagaaaaagaaaatgccgagataagactttcagatccattgcaatatcagtctattgttgacgcagaatggaacatcatatatgataagctggataaatgtgtaaagagtggtgctaaaattgttctgtcgcgtctggctattggtgatctggcaacacagtattttgcagacagagatatattttgtgctggtcgagttgctgaagatgatctgaatcgtgttacagctgcaactggtggtactgtacagacatcagtcaacaatgttattgatgaggttcttgggtcttgtgaggtgtttgaggaaaagcaagttggaaatgaacgattcaatatatttagcggatgtccttcaggtctgacagccactattgttctccgaggtggagctgatcagtttattgaggaagctgagcggagtctacatgatgcaatcatgattgttagaagggccatgaagaattccacagtggttgctggtggtggtgcaatagacatggagataagccggcacttatggctgcatgcacgaaagatagctggaaagtctcagctattcataaatgccttcgccaaagcccttgaggttattccacgacaactttgtgataatgctggattcgatgcaactgatgtacttaacaaacttaggcaaaaacatgcacttgagtctggtgagggtgctctttatggagtagatatcaacaccggtggtatatgtgattcctttgctaactttgtgtgggagccagcagtcgttaagatcaacgctataaacgctgcagccgaagcagcatgccttatcttaagtgttgatgaaacagtgaagaacccaaagtcagagagtgcacaaggagatgctgctgctatgggcagaggacgtggcggcggcggcatgcgtggtggacgtggaagagggatgcgtagacgttagacatttctcgttttggtttatcataaaaacttgagcctaggcatgagcatgggaaatgtattctcttatgtgagaggaagtaattttggtttttaagtgaagtttttattttcctacttgtttgctggttgttttggttgctgtattgattttgtatgggacttgtattttgtagctgtggg

SEQ ID NO: 2095 - DNA, 2023 bp, Cichorium intybus
ctgtgaggatctgaagtcacgacgaatcaaaaccttttagttcttccaaatcacgtataggtcgccttctgtgctcccattcataccacaataaggcatcatcttcaagcgccgcaactgctgcttctaacttggcatcttcaatcagttgaatcacactcccgctcccattaccataagctcctgtattacctccacccttcaaatctactcgcaatggcatctatgatgcaacctcagatcatactgcttaaagaaggcacagacacttcgcaagggaaaccgcagttgataagcaacattaatgcgtgtatggcggtggctgatgtcgttcgtacaaccctaggtccaagaggtatggataagttgatccatgatgataagggtaacaccactatttctaacgacggcgccaccatcatgaagcttcttgacatcgttcaccccgccgctaagatccttgtcgatatcgctaagtcacaggattcagaggttggtgatggaaccaccacagtagttcttcttgctggtgaattcttgaaggaggcaaaaccatttattgaagatggtgttcatcctcaaaatctgataagaagttaccgaactgcttcctttatggcaattgagaaggtcaaagaattagctgtaagcatagagggaaaaagtttagatgaaaaaagaagcttattagctaaatgtgctgcaacaacactctcttcaaagttaattggaggagagaaggacttttttgcaaaaatggtggtggatgctgtcattgcaattggaaatgatgataggttgaatatgattggaataaaaaaggtacccggtgggacaatgagggattcatttcttgtgaatggtgttgcatttaaaaagactttttcatatgctggattcgaacaacaacccaaaaagtttctaaatccaaagatacttttattaaacattgaacttgaactcaaatcagaaaaagaaaacgctgaaataagactttcagaccctttacaataccagtccatagttgatgccgaatggaatatcatttatgataaattggataaatgtgtcaaaagtggtgccaaaattgttctctcacgtcttgctattggtgacctggcaactcagtattttgcagacagagacatattttgtgctggtagagttgctgaagatgatctgcatcgtgttgcagctgcaactggagctacagtacaaacttcagtcaacaatgttatcgaggaggttcttggatgttgtgagatttttgaagaaaaacaagttggaagtgaaagattcaacatatttagtggatgcccttcaggccaaacagccactattgttctccgtggtggagccgatcagtttattgaggaagcagaaaggagtttacacgatgcaatcatgttagtcgggcgggccatgaaaaattccacggtggttgctggtggtggtgcaatcgatatggaaataagccggtacctgtggcaacatgcacgcaatatagccggaaagtctcaactatttataaatgcctacgctaaagcacttgaggttattccacgccaactttgtgataatgctggattcgatgcaactgatgtactcaacaaactgagacagaaacatgcacttgctgctggtgagggtgctctttatggagtggatataaacacaggtggaatttctgattcttttgccaactttgtgtgggagcctgcagtcgtaaagattaatgctataaatgctgcaactgaagcagcctgtcttatcttaagtgttgatgagactgtaaagaatccaaagtcggagagtgcacaaggagaagctgccgccggaatgggtagaggacgcggtggtggacgtggcagagggatgcgaagacgttaaatttcatagtatttgttaggatacaaaacttgagccgagggtattatggtaattttgggttttgatcgaaaacgtttccaatttggtttgtatggatggaacttgtgttttgttttgattatggttttgagag

SEQ ID NO: 2096 - DNA, 2225 bp, Chenopodium quinoa
acaaaaccaaaaaacctgcgttttctcccatacactcgcactctccttactctctgcaaaacctagttccctcattttctctctcctccccaacaatggcggcgatgatgcagccccagatcatactcctcaaagaaggcactgacacttcgcaaggcaaagcgcagctaattagcaacatcaacgcttgcactggtatcgccgatgttgttcgcactactctaggtcctcgtggtatggacaaactcatccatgacgataaaggtaataccaccatttctaatgatggtgctactattatgaagcttcttgatattattcatcctgctgctaagatccttgtcgatatcgcccgttctcaagattctgaggttggcgatggtactacaacagttgtattactagctggtgaatttttgaaggaggcaaagccttttgttgaagatggagtccatccacagaatttgattcgaagttatcgaattgcttcccaattggctattgagaaggttaaagatttggctgttagtattgaaggaaagagtttagaagaaaagaaaggcttattagcgaagtgtgcagcaacaacacttagctcaaagcttattggcggagaaaaagatttctttgcaaacatggttgttgatgcggttcttgctgttggagttgatgacaggttgagcatgattggaattaaaaaggtacctggaggcaatatgcgagattcatttcttgtcaacggtgtagcatttaagaagacgttttcttatgctggttttgaacaacagcctaagaagtttgtttcacctaagatacttctgttgaacattgagttggaactgaaatctgagaaagaaaatgcagagataaggctttcagatccatcccaatatcagtcaattgttgatgcggaatggaatatcatttatgacaaattagacaaatgtgtgcagactggtgctaaaattgttctttcacggttggcaattggagacctagcaacacagtattttgcggatagagatatattctgtgctggccgtgttgctgaggaagatctacaacgtgttgctgctgcaactggtggaactgtccaaacatcagtcaacaatataattgatgaggttcttggaacatgtgagatatttgaggagaagcaagttggaaatgagaggttcaatattttcagtggatgtccttctggtcatacagccaccattgttcttcgtggtggagctgatcagttcattgaagaagctgagcgcagcctgcacgatgctattatgatagttagaagagctgttaagaactctacagtggttgctggtggtggggccatagatatggaaataagccgacacctaaggcagcatgccaggactatagcaggaaaatctcagcttttcataaactcttatgccaaagctttggaggtaattccaagacaactttgtgacaatgctggatttgatgcgacagatgtgctgaacaaattgagacagaagcatgcacttccctctggggagggtgctaattatggggtggacatcaacactggaggcatagctgattcctttgccaattttgtttgggagccagcagttgttaaaattaatgcaattaatgcggctacagaggcagcatgtctcgtcttgagtgttgatgagacagtgaagaatcccaagtcagagagtgctcaaggtgatgctgctgctatgggaggtagaggacgaggtgcaggtggattcggcggtcgtggacgaggaatgagaaggcgatgagcttaatcctggggattgcaatcacgtaggagttagctgaagttttgatgtgatgccatcctgtccgtaccatgtgaagtcatttgaggaagggcaatgttcaagcatatccagttgagaggaagacaattgcatatatgctaaaccaattgtgctctagactgttgggtttgttcgaatcaaaattgtgcttccctgtgtgtgttgtgcttatttgtggcgcaattaaattctagtagtactgcttgattgaatataatgttgaggggattagggaaggtttgaaaattttgtttgtgtagggatcagccagtttgttgttatctgaacgctctgttttttatgggcaatgctttatgtattcgcaacatactttttatacatttattttaggcacctttgccaagccaatgtcctcaaatatgaataattattatgggataa

SEQ ID NO: 2097 - DNA, 2063 bp, Mimulus guttatus
taatattccttctctctcctcttctctctctagaaaggacactcttcactcataaactcaaatccaacaatgtcagccatgatgcaaccacaaatcatactactcaaggaagggaccgacgcatcccaaggaaaaccgcaattaataagcaacataaatgcgtgcatggctgtggctgatgttgtgcggactactctcggtccacgaggcatggacaagttgatccacaatgaaaaggggaacacaaccatatccaacgatggtgctaccataatgaagcttctcgacattattcatcctgctgccaagattcttgttgatattgcaaagtcccaagattctgaggttggcgatggaaccactacagtcgttttgctcgcaggagaattcctgaaggaagcaaaaccttttgttgacgatggagttcaccctcaaaaccttatacgaagttatcgaacagcttctaatttggcgattgagaagatcaaagaattagctagtagcatagagggaaaaagcttggaagaaaagaaaaagctactggctaaatgtgctgctacaacactatcttcaaagctcattggtggtgagaaggagttttttgcaaccatggttgtggatgcagtccttgccataggaaacgaggataggttaaacatgattggaatcaagaaggttcctggaggtacaatgagggattcttttcttgtgaatggtgttgctttcaaaaagacattctcgtatgctggttttgagcagcaaccgaagaaatttgtaaatcctaagatacttttgctaaacatagaattggagttaaaatcagagaaagagaatgcagagattaggctgtcagatccattacagtatcagtcaattgtagacgcagaatggaatatcatttacgacaagttggataaatgtgcgaagagtggagccaaggttgttctgtcacggctcgcaatcggtgatctggctactcagtattttgcagatcgtgatattttttgtgctggtcgtgttagtgaagaagatctgcagcgagttgcggcagctagcggtggaactgtgcagacaactgtgaacaatgttgttgacgaggtacttggaacatgtgacctatttgaagagaggcaagttggaaatgagcgatttaacatattcagtggatgcccatctggtcggactgccacatttgttcttcgtggtggtgcagatcagtttattgaggaggcagagcgaagtttacatgatgctattatgattgttagaagagctatgaaaaactcgactgtagttcctggtggcggtgctattgatatggagataagccggtacttgaggcagcatgcacgtacgattgctgggaagtctcaactctttataaactcttacgcaaaagcccttgaggttatcccacgacaactgtgtgataatgctgggttcgatgcaacggatgtgttgaacaaattgagacaaaaacacgcacttccatctggagacggtgcagcgtatggtgtagatatcaacaccggcggaattgccgattcatttgctaactttgtgtgggagccctcagttgtgaagatcaacgccataaatgcagctacagaagctgcttgcctcgtcttaagtgtcgacgaaacagtgaaaaaccccaagtctgagagtgcacaaggagaagctgctgcaagtgctatgggtggtagaggtcgaggtcgtggtcgtggaatgagaaggcgataaaatcgacttatttcgaagcatttattgctaaattttgtttgggtccattatttttaattaaatttaattcttattttaattttattttttactgaatgaaaaaaagatagctagtagaacataatctacacatctcattcgacaaaaccctgttttttgcttcgttttaaaatcaaatcgacctcataatttatcaaaaatcgtctaaaaagataagaaaaaacgagatgcataaatatccgcaagcaaccgttcctataaaagtcgaaagccagtggcatcatccaatcatccataaaaccactgtgtttatgaacgag

SEQ ID NO: 2098 - DNA, 2150 bp, Trifolium pratense
ctcatacaaaactcttcaaaacttaaaccctaaatctctctttctctttctctcttcatccatcatcatcatcaccttcaaccatgtcttctatgctgcaaccacagatcatactattgaaagaaggtacagatacatcgcaaggtaaaccacaacttgtaagcaacatcaatgcttgcaccgccgtcgctgatgtcgtcagaaccaccttaggtcctcgcggtatggacaaactcatccacgacgataaaggttcagtcaccatttctaacgacggcgctactatcatgaagcttctcgatatcgttcatcccgccgctaaaatcctcgttgatattgcttagtctcaggactctgaggttggcgatggaactaccactgtggtattgcttgcagctgagttcttaagagaagctaagcctttcattgaagatggtgttcactctcaaaatttaataaggagctataggactgcaggcaccttggcaattgaaaagattaaagagctagctgttagcattgagggaaaaagtattgaagagaagaaaactttgctcggaaagtgtgctgctacaacactttcttcaaagcttataggtggtgaaaaggagttctttgcatctatggttgtggatgccgtaattgcaattgggactgatgataggttgaacatgattggaataaagaaggttcctggtggtaacatgcgcgactcatttcttgtcaacggcgttgccttcaagaagacattttcatatgccggatttgagcagcagcccaagaagtttctcaatccaaaactactattacttaatgttgagttggagctaaaatctgagaaagaaaatgctgaaataagattatcagatccttcacagtatcaatcgattgttgatgcagaatggaatattatttatgacaaactggataaatgtgtccaaagtggtgccaaagttgttctgtcacgtctggctattggtgatttggctactcagtattttgcagatagagacattttctgtgctggtcgtgtagcagaggaagatctaaaaagagttgctgctgctactgggggaactgtacaaacatctgtcaataacattattgacgaggttcttggaacttgtgagatttttgaggaaaagcaagtaggaaatgagaggttcaacatattcaatggatgtccatctggccaaacagccactatagttcttcgtggtggagccgatcagttcattgaggaagcagagcgaagtttgcatgatgcaatcatgattgtcagaagggctatgaagaattcaactgtagtcgccggtggaggtgctatagacatggaaataagccggtacctaaggcaacatgcacgcacaatagctggaaagtctcagcttttcatcaactcctatgcaaaagctcttgaggttattcctcgccaattatgtgacaatgctggatttgatgcaactgatgtgctgaacaaactaagacagaaacatgcgcttccttctggtgagggggcaccatatggggtcgacatagccactggtggaattgctgattcatttgccaactttgtctgggagcctgcagttgtaaagattaatgctataaatgctgccacagaggcagcttgccttgtcttaagtgtggatgaaacagttaaaaatcccaagtctgagagtgcacaaggagaggctgctgcaagtgccatgggaggcagaggtcgcggaggcggtttccgtggtcgtggacgaggaatgcgtagatgatgagacatgtattctaattggtcagcattagtctcatgcattgaatgtctgtaatatgcgcaatgccactgcatgaatgtttctgctactggtggttgctagaagcatgccatattttattgacttacagatgatgatatgaaatgatggtaatatggggattctgggagcattatctaatcaacctaggttttgatggtagcaattttcaggcattgtctttttgacatttgttcagtttatacgttggaggggttgaatttattattagatggttgttgttggggacttcgattttgtgtgaaattttgcttaaccttgttcccctcactaaactatttttgttaccaagtatttatatatgcatcttatttcatctgt

SEQ ID NO: 2099 - DNA, 2170 bp, Trifolium pratense
acagtgaaaacattctcactcacatcacactgcgaaagaaaaggagccagaaaccgcttcttctagactcatacaaaactcttcaaaacttaaaccctaaatctctcttttctctcttcatccatcatcatcaccttcaaccatgtcttctatgctgcaaccacagatcatactgttgaaagaaggtacagatacatcgcaaggtaaaccacaacttgtaagcaacatcaatgcttgcaccgccgtcgccgatgtcgtccgaaccaccctaggtcctcgcggtatggacaaactcatccatgacgataaaggttcagtcaccatttctaacgacggcgccactatcatgaagcttctcgatattgttcatcccgccgctaaaatcctcgtcgatattgctaagtctcaggactctgaggttggcgatggtactaccactgtggtattgcttgcagctgagttcttaagagaagctaagcctttcattgaagatggtgttcactctcaaaatttaataaggagctataggactgcatgcaccttggcaattgagaagattaaagagctagctgttagcattgagggaaaaagtcttgaagagaagaaaactttgctcggaaagtgtgctgctacaacactttcttcaaagcttataggtggcgaaaaggagttctttgcatctatggttgtggatgccgtaattgcaattgggactgatgataggttgaacatgattggaataaagaaggttcctggtggtaacatgcgcgactcatttcttgtcaacggcgttgccttcaagaagacattttcatatgctggatttgagcagcagcccaagaagtttcttaatccaaaactactattactaaatgttgagttggagctaaaatctgagaaagaaaatgctgaaataagattatcagatccatcacagtatcaatcaattgttgatgcagagtggaatattatttatgacaaactggataaatgtgtccaaagtggtgccaaagttgttctgtcacgtctggctattggtgatttggctacacagtattttgcagatagagacattttctgtgctggtcgtgtagcagaggaagatctaaaaagagttgctgctgctactgggggaactgtacaaacatctgtcaataacattattgacgaggttcttggaacctgtgagatttttgaggaaaagcaagttggaaatgagaggttcaacatatttaatggatgtccatctggccataccgccactatagttcttcgtggtggagccgatcagttcattgaggaagcagagcgaagtttgcatgatgcaatcatgattgtcagaagggctatgaagaattcaactgtagtcgccggtggaggtgctatagatatggaaataagccggtacctaaggcaacatgcacgcacaatagctggaaagtctcagcttttcatcaactcctatgcaaaagctcttgaggttattcctcgccaattatgtgacaatgctggatttgatgcaactgatgtgctgaacaaactaagacagaaacatgcgcttccttctggtgagggggcaccatatggggtcgacatagccactggtggaattgctgattcatttgccaactttgtctgggagcctgcagttgtaaagattaatgctataaatgctgccacagaggcagcttgccttgtcttaagtgtggatgaaacagttaaaaatcccaagtctgagagtgcacaaggagaggctgctgcaagtgccatgggaggcagaggtcgcggaggcggtttccgtggtcgtggacgaggaatgcgtagatgatgagacatgtattctaattggtcagcattagtctcatgcattgaatgtctgtaatatgcgcaatgccactgcatgaatgtttctgctactggtggttgctagaagcatgtcatattttattgacagatgatgatatgaaatgatggtaatatggggattctgggagcattatctaatcaacctaggttttgatggtagcaattttcaggcattgtctttttgacatttgttcagtttatacgttggaggggttgaatttattattagatggttgttgttggggacttcgattttgtgtgaaattttgcttaaccttgttcctcactaaactttttttgttac

SEQ ID NO: 2100 - DNA, 2052 bp, Trifolium pratense
tcatcatcatcaccttcaaccatgtcttctatgctgcaaccacagatcatactattgaaagaaggtacagatacatcgcaaggtaaaccacaacttgtaagcaacatcaatgcttgcaccgccgtcgctgatgtcgtcagaaccaccttaggtcctcgcggtatggacaaactcatccacgacgataaaggttcagtcaccatttctaacgacggcgctactatcatgaagcttctcgatatcgttcatcccgccgctaaaatccttgtcgatattgctaagtctcaggactctgaggttggcgatggtactaccactgtggtattgcttgcagctgagttcttaagagaagctaagcctttcattgaagatggtgttcactctcaaaatttaataaggagctataggactgcatgcaccttggcaattgaaaagattaaagagctagctgttagcattgagggaaaaagtattgaagagaagaaaactttgctcggaaagtgtgctgctacaacactttcttcaaagcttataggtggcgaaaaggagttctttgcatctatggttgtggatgccgtaattgcaattgggactgatgataggttgaacatgattggaataaagaaggttcctggtggtaacatgcgcgactcatttcttgtcaacggcgttgccttcaagaagacattttcatatgccggatttgagcagcagcccaagaagtttctcaatccaaaactactattacttaatgttgagttggagctaaaatctgagaaagaaaatgctgaaataagattatcagatccatcacagtatcaatcaattgttgatgcagagtggaatattatttatgacaaactggataaatgtgtccaaagtggtgccaaagttgttctgtcacgtctggctattggtgatttggctacacagtattttgcagatagagacattttctgtgctggtcgtgtagcagaagaagatctaaaaagagttgcggctgctactgggggaactgtacaaacatctgtcaataacattattgacgaggttcttggaacctgtgagatttttgaggaaaagcaagtaggaaatgagaggttcaacatattcaatggatgtccatctggccaaacagccactatagttcttcgtggtggagctgatcagttcatagaggaagcagagcgaagtttgcatgatgcaatcatgattgtcagaagggctatgaagaattcaactgtagttgctggtggaggtgctatagatatggaaataagccggtatctaaggcaacatgcacgcacaatagctggaaagtctcagcttttcatcaactcctatgcaaaagctcttgaggttattcctcgccaattatgtgacaatgctggatttgatgcaactgatgtgctgaacaaactaaggcagaaacacgcgcttccttctggtgagggagcaccctatggggtcgacatagccactggtggaattgctgattcatttgccaacttcgtctgggagcctgcagttgtaaagattaatgctataaatgctgccacagaggcagcttgccttgtcttaagtgtggatgaaacagttaaaaatcccaagtctgagagtgcacaaggagaggctgctgcaagtgccatgggaggcagaggtcgcggaggtggtttccgtggtcgtggacgaggaatgcgtagatgatgagacatgtattctaattggtcagcattagtctcatgcattgaatgtctgtaatatgcgcaatgccactgcatgaatgtttctgctattggtgttgctagaagcatgccatattttatcgacttagatgatgatgatgatatgaaatagtaatatggggattctggtaatatcatctgatcaacctaggttttgatggtagcaattttcaggcatcgtctttttgacatttgttcagtttatacgttggaggggttgaatttattagagatggttgttgttggggacttcgattttgtgtgaaattttgcttaaccttgttcctcactaaactttttttgttac

SEQ ID NO: 2101 - DNA, 1858 bp, Centaurea maculosa
aaacaaacgaaccaccgaacacacactcacgtaaacacacagtgggcaccaagcgacgccattaaaccctagcgccaacccttaccacctcacctccaatctccactcttctccgccgcaaatctcctcttccaatggcgtccatgatgcaacctcagatcatactgcttaaagaaggcacagacacttcgcaagggaagccgcagctgataagcaacatcaatgcgtgtatggcggtcgctgatgtcgtccgtacaaccctaggtcccagaggtatggataagctgatccatgacgataagggcaacaccaccatctctaacgatggggccaccatcatgaagcttcttgacgtcgttcatcccgccgctaagatccttgttgatatagccaagtcacaggattcagaggttggtgatggaaccactacagttgttctccttgctggcgagttcttgaaggaggccaagccgttcattgaagatggtgttcatcctcaaaatctgatacgaagttatcgaactgcttcttttatggcaattgagaagattaaagaattagctgtaagcatagagggtaaaagctcagacgagaaaagaagcttattagttaaatgtgcagctacaacactgtcttcaaagctaataggaggagagaaggagttttttgcaacaatggtcgtggatgctgtctttgcaatcggaaatgaagataggttgaacatgatcggaattaaaaaggttcctggcggtacaatgcgagactcatttcttgtgaatggtgttgcttttaaaaagactttttcatatgccgggtttgaacagcaacccaagaagtttttgaaccccaggatactcctgttgaacattgaactggaactaaaatccgaaaaagaaaatgctgagataagactttcagatccgttgcaatatcagtccattgttgatgctgaatggaatatcatatatgataagttagacaaatgtgtgcagagtggtgccaaaattgttttgtcacgccttgctattggtgatctggcaacacagtattttgcagatcgggatatattttgtgctggtagggttgccgaagatgatctgcatcgtgtagcagctgcaactggtggtactgtccagacatcagtcaacaatgttatagatgagattcttgggtcttgtgaggtttttgaggaaaagcaagttggaggtgaacgtttcaacatatttagcggatgtccttcaggccagacagccactattgttctccgaggtggagctgatcagtttatcgaggaagcagagcggagtttacatgatgcaatcatgattgtaagaagggccacgaagaattccacagtggttgccggtggtggtgcaatcgatatggagttaagccgattcttgtggcaacatgcacgaaatatagctggaaagtcccagctatttataaattcctatgctaaggcccttgaggttattccacgacaactgtgtgataatgctggatttgatgcaactgatgtacttaataaactgaggcagaaacatgcacttcccggaggtgagggtgccctttatggagtggatattaacacaggtggaatttctgattcctttgccaactttgtgtgggagccagcagttgtcaagatcaatgctataaatgctgcaactgaggcagcatgccttattttaagtgtcgatgagacagtgaagaatccgaagtcggagagtgcacaaggagaagctgcaggcggtatgggtagaggacgtggtggtggcggcatgcgtggtggacgtggaagagggatgcaaagacgttgattatcattaagtcatttattacgatacaaacaaac

SEQ ID NO: 2102 - DNA, 2361 bp, Cicer arietinum
aaaaagacaaaaatgaagcttcggttcaaaatagacagattgtaaagaaaaagaatcactcactcatttcacactgcgaaagagaaggagccataaactgctacttctagacccattcgaaactcttgaaacttaaaccctaataactctctctctctttttctcttccttctacatcaccgtcttcaaccatgtcagctatgctgcaacctcagatcatactattgaaggaaggtacagacacatcgcaaggtaagccacaacttgttagcaacatcaatgcctgcaccgccgtcgccgacgtcgtccgaaccaccttaggtccccgcggtatggacaaactcatccacgacgataaaggctccgtcaccatttctaatgacggcgccaccattatgaaacttctcgatatcgttcatcccgctgctaaaatcctagttgatattgctaagtctcaggactctgaggttggtgatggtaccaccactgtggtattgcttgcggctgagtttttaagagaagcaaagcctttcattgaagatggtgttcattctcaaaatttaatacggagctataggactgcatgcaccttggcgattgagaagattaaagagctagctgttagcatcgagggaaaaagtctagaagaaaagaaaaacttgcttggaaagtgtgctgctacaacactttcttcaaagcttataggtggagaaaaggagttctttgcatccatggttgtggatgctgtaattgcaattgggactgatgataggttaaacatgattgggataaagaaggttcctggtggtaacatgcgtgactcatttcttgtcaatggtgttgcgttcaaaaagacattttcatatgctggatttgagcagcagcccaagaagtttctcgatccaaaaatacttttacttaatgttgaattggagctaaaatccgagaaagaaaatgctgaaataagattatcagatccatcacaatatcaatcaattgttgatgcagaatggaatattatttatgacaaactggataaatgtgtccaaagtggtgctaaagttgttctttcacgtttggctatcggtgatctcgctacacagtattttgcagatagagacattttctgtgctgggcgtgtagccgaagaagatctaaaaagagttgctgctgcaactgggggaactgtacaaacatctgtcaataacattattgatgaggttcttggaacttgtgagatttttgaggaaaggcaagtaggaaatgagaggttcaacatattcaatggatgtccatctggccaaacagccaccatagttcttcgtggtggagccgatcagttcatagaggaagcagagcggagtttgcatgatgcaatcatgattgttagaagggctttgaagaattcaactgtagttgccggtggaggtgctatagatatggaaataagccggtacctaaggcaacatgcacgcacaattgctggaaagtctcagcttttcatcaactcctatgcaaaagctcttgaggttattcctaggcagttatgtgacaatgctggatttgatgccactgatgtgctgaacaaacttaggcagaaacatgcacttgctactggtgagggggcaccatttggggtggacatagccactggtggaattgcggattcatttgccaactttgtctgggagcctgcagttgtgaagatcaatgctataaatgctgccacagaggcagcttgccttgtcttaagcgtggatgaaacagttaaaaatcccaagtctgagagtgcacaaggagaggctgctgcaagtgcaatgggaggcagaggtcgtggaggtggtttccgtggtcgtggacgaggaatgcgtaggtgatgagaaatgtgctctagttggttagcatttttctcatgcgttgaatgtctaatatgcacaaggccactgcatgtatgtttctgctattgattggtgttgctagaagcataccatatttatcgacttacagatgatgatatgaaatggtataatatggggattgtgggagcatcatctggtcaatttaggatttgatagttgcaattttcaggccttgtctttttgaaatgtggtcattttatacgttggaggggtcaagtttattagatggctgttgttggggactgatattttgtgtgaaattttgcttcactttgttcaaacactacttaactctttttactaccaagtatttatgtgcatgtgatttttttatctgtagctttacgttgcaatctgtggaaagatcctttagaacattgcacacaaattgcagaaactaatttatgggaaaataatccatcacgttaccgtcaaattaaac

SEQ ID NO: 2103 - DNA, 1942 bp, Arachis hypogaea
ctgaaggaaggtacagacacgtctcaggggaaggctcagctagtcagcaacatcaacgcctgcaccgccgtcgccgacgtcgtcaggtccaccctcggcccacgcggcatggacaagctcattcacgacgacaagggatccgtcaccatctctaacgacggcgccaccatcatgaagcttcttgacatcgtccaccctgccgccaagatcctcgtcgacatcgccaagtcacaggactccgaggttggtgatggaaccaccactgtggttttgcttgctgctgagtttttgaaggaggccaagcccttcattgaagacggtgttcactctcagaatttgattaggagctataggactgcatgcacattggcgattgagaagattaaagagctggcggttagcatagagggtaaaagtttggaagagaagaaaagcttgcttgcaaagtgtgcttctaccacgctctcttcgaaacttattggtggagagaaagaattctttgcatcgatggttgtggatgctgttattgcaattggaaatgatgatagattgaacatgattggaatcaagaaggttcccggtggtaacatgcgggactcatttctagtaaatggtgttgccttcaaaaagacattttcatatgctgggtttgagcaacagccaaagaagtttctcaatccaaagatactactgctaaacgttgaattggagctaaaatcggagaaagaaaatgctgaaatcagattatctgatccatcacaatatcaatcaattgttgacgccgaatggaatattatttatgacaaattggataaatgtgtcaacagtggtgcaaaagtagttctttcacgattggctattggtgatcttgctacacagtattttgcagatcgagacattttctgtgctggtcgtgtagcagaagaagatttaaaaagggttgctgctgcaactggtggaactgtacaaacatctgtcaataacatcattgatgaggtacttggaacttgtgaggtttttgaggagaagcaggttggaaatgaaaggttcaacatattcaatggatgtccatctggacaaacagccaccatagttcttcgtggaggagctgatcagttcatagaggaagcagagcgaagtttgcatgatgcaatcatgattgttcggagggctttgaaaaactcaactgtagttgctggtggaggtgctatagatatggagataagtcgatacctgaggcaacatgcacgaacaatagcaggaaagtctcagcttttcattaactcatatgcaaaagctctagaggttatacccagacaattatgtgacaatgctgggtttgatgcgactgatgtgctgaacaaactaagacagaaacatgcacttccatctggtgagggagcaccatatggagtggatataagcactggtggaattgctaactcatttactaactttgtctgggagcctgcaattgtcaagattaatgctataaatgctgctacagaagccgcatgcttaatactaagtgtggatgaaacagttaaaaaccccaagtctgagagtgcacaaggagatgctgccgcaagtgctatgggcggtagaggtcgtggaggtgccttccgcggccgtggccgtggacgaggaatgcgaagatgatgagaaatgtggtataatgggttggcttttatcttagttaatttgtatgtttgtctaatacatggaaggccagtgcatatttatatctgctagttgatactgctagaagcatgccttattttttggatctacaaatgatgatatgaaattgtaatgcggtatatgggatcatcatcagagtgggatttgatggtaacaattttcaagaattttgtcgttacgacatttactcattttatacgctggaggattgggatggtagttaattttgcatcttattaaa

SEQ ID NO: 2104 - DNA, 2165 bp, Trigonella foenum-graecum
actcacactgcaaaaaagaaggagccagaaactgctactccaaaactcttcaaatcttaaaccctaacttcatctctctctcttcctccatcatcatcttcaaccatgtcttctatgctgcaaccacagatcatactattgaaagaaggtacagacacatcgcaaggaaagccacaactcgtaagcaacatcaatgcttgcaccgccgtcgccgatgtcgttcgaaccaccctaggtcctcgcggtatggacaaactcatccacgatgataaaggctcagtcaccatttctaacgacggcgccaccatcatgaagcttctcgatattgttcatcctgcggcgaagatcttagttgatattgctaagtctcaggactctgaggttggcgatggaaccaccactgtggtattgcttgctgctgaatttttaagagaagcaaagcctttcattgaggatggtgttcactctcaaaatttaatacggagttataggactgcatgctccttggcgattgagaaggttaaagagctagctgttagcattgagggaaaagtttggaagagaaaaaagtttgcttggaaagtgtgctgctacaacactttcttcaaagcttattggtggagaaaaggagttctttgcatctatggttgtggacgctgtcattgcaattgggactgatgataggttaaacatgattggaataaagaaggttcctggcggtaacatgcgtgactcatttcttgtcaatggtgttgccttcaagaagacattttcatatgctggattcgagcagcagcctaagaagtttctcgatcctaaaatactattacttaatgttgagttagagctaaaatctgagaaagaaaatgctgaaataagattatcagatccatcacagtatcaatcaattgttgatgcagaatggaatattatttacgacaaactggataaatgtgtccaaagtggtgccaaagttgttctctcacgtcttgctattggtgatctagcgacacagtattttgcagatagagacattttctgtgctggtcgtgtagcagaagaagatctaaaaagagttgctgctgcatctgggggaactgtacaaacatctgtcaataacattattgatgaggttcttggaacttgtgagatttttgaggaaaggcaagtaggaaatgagaggttcaacatattcaatggatgtccatctggccaaacagccaccatagttcttcgtggtggagccgatcagttcatagaggaagcagagcgaagtctgcatgatgcaatcatgattgttagaagggctatgaagaattcaactgtagttgctggtggaggtgctatagatatggaaataagccggtacctaaggcagcatgcacgcacaatagctggaaagtctcagcttttcatcaactcttatgcaaaagctctagaggttattccccggcaattatgtgacaatgctggatttgatgcaacggatgtgctgaacaaactaagacagaaacatgcgcttccttctggtgagggagcaccatatggggtcgacatagccactggtggaattgctgattcatttgccaactttgtctgggagcctgcagttgtgaagatcaatgctataaatgctgctacggaggcagcttgccttgtcttaagtgtggatgaaacagttaaaaatcccaagtctgagagtgcacaaggagaggctgctgcaagtgccatgggaggcagaggacgcggaggccgtggtcggggaagaggaatgcgtagatgatgagagatatgttcttaatttgtctcttgtgttgaaatcctgtctgatacacgcaaggctgctgcatgtatgtttctgctattggtattgctagaagcaaacaatattaatcgacttacaggtgatgatatgaaatggtaatgtgggggattttgggagcatcatctgatcataactaggttttgatagtaggaattttcaggcagtcttttttttgtatttgttcattttataagttggagggattggatttattagatggctgttgttggggactaatgttttgtgtgaaattttgcttcaccttcaacaccaagaatttatctatgcatgtgattttatctatagctttatgtagcaaattgcagtaactgattaacat

SEQ ID NO: 2105 - DNA, 2120 bp, Brassica rapa
ccgctcggttccagatttatcggttcgaccggccggactagatctgaaatcactgctcatcctcgtcactcgtatatgaaaaacaagacctaaattaaaaaaccctaaatcactctctcccacactccattccctcccatttctccgtaagctatttcacgcatctacgatggcgtcgatgatgcaaccgcaaatcatactgctcaaggaaggcacagacacttcccaggggaaagcgcagctactgagcaacatcaacgccgtcactgccgtcggcgatgtgcttcgaaccactctgggtccacgagggatggacaagctcatccacgacgataagggatccgtcaccatctccaacgacggcgctaccatcatgaagctcctcgacattgtccatcccgccgctaagatcctcgtagatatcgccaaatcgcaagattccgaggttggtgatgggacaactacggttgttcttcttgctgctgagtttttgaaggaggctaagccgtttgttgaggacggtgttcactcccagaatctgattaggagttatcgcactgcaagcactttggcaattgagaaagttaaagaacttgttgttagcatcgagggtaaaagtgttgaggagaagaaaggtatgttggctaaatgtgctgctaccactctttcctctaagcttattggtggagaaaaagagttctttgctactatggttgttgatgctgttatggccattggggatgacgacaggctaaatttgatcggaatcaaaaaggttcctggtggtaacatgcgagactctttcctagttgatggtgtggatttaaaaaagacattctcatatgcgggttttgaacaacagccaaagaagtttcttaatcccaaaatcctcttgcttaacatcgaattggagttgaaatctgagaaggaaaacgctgagattagactgtcagatccgtcacagtaccagtctatagttgatgcagaatggaatatcatttatgacaagctagacaaatgtgtcgaaagtggagctaaagttgttctttctcggttggctattggtgatctagctactcagtattttgccgatcgtgatattttctgcgctggccgtgtagcagaagaagatcttaaccgcgtggctgctgcggctggaggaacagttcagacaagtgttaacaatataatacccgaggttctcggaacttgtgagatatttgaggaaaaacaagttggtggggagaggcttaacatattcagtggttgtccttcaggacgtacagctactattgtcctccgtggtggagctgatcagttcatcgaagaagctgagcgtagtttacatgatgcgattatgatagtgagaagagccgtgaagaactcaactgttgttcctggaggtggagcgatagatatggaggtaagcaagtacctgaggcagcattcaagaacaattgctgggaaatcacagcttttcatcaactcgtatgcaaaggccttggaggttattccacggcaattgtgtgacaatgctggatttgatgcaacggatgtcctgaataagttaagacaaaaacacgccatgcaaagcggtgaaggagcttcttatggagtggacattaacactggtggaatcgctgattcctatgctaactttgtctgggaaccagcagttgttaagattaatgccataaacgctgcgactgaagcagcttgccttattcttagcgtggacgaaactgtgaagaaccctaaatctgagagcgcacagggagacgctgccgcaggtgctatgggaagaggacgcggtggaggtggaggtcgtggccgtggtatgaggaggcgataagttttgttattttttttagtcttatggcaaaacttgcaagcttcttctctgaattttagttttgttgaattttgtcttgaaatcaaaaggagctagtgtctcgtgtttgtgtttatttgacttatgtccatacaatttttgaaattgaaatttcagtgtgggtttttgttacacttgagaaactacttttgctttattggatcaagacggagatgaatcaaactgtagtagctggcgatgtatctctcaactacatattggcctgtag

SEQ ID NO: 2106 - DNA, 2221 bp, Mimulus guttatus
cagaaaccacccctcccaaagaaaggagttaaaccctagaactttcccccgttgcactctcagctctctctctctctctctctctctctctctctctctctttgaactctcacgaaaaactcatttcgcgcaaacagtaactgaatccacaatgtcgtccatgatgcaaccccagattatccttctcaaggaagggactgatacatcccaagggaaaccacaactaataagcaacatgaatgcgtgcatggctgtggctgatgttgtacgaacgactcttggtccaagaggcatggacaaattgatccatgatgacaaggggaccaccatatctaatgatggtgccaccataatgaaacttcttgacatcatccatcctgctgcaaagatccttgtagatattgcaaagtcccaagattctgaggttggtgatggaaccactagtgtagttctgtttgctggagaattcctgaaggaagcaaagccgtttattgaagatggggttcatcctcagaaccttattcgcagttaccgaacagcttctaatttggctattgcaaagattaaagatttagctgttagcatagagggaaaaagcatggaagaaaagaagagtttactggctaaatgtgctgctacaacactatcctctaagctcattggtggtgaaaaggagttctttgcaaccatggtggtagatgctgtcattgccattgggaatggtgataggttgaacatgattggaatcaagaaggttcctggaggtaccatgagggactcttttcttgtgaatggtgtggccttcaaaaagaccttctcgtatgccggttttgagcaacagccaaagaaatttgtaaatcccaagatacttttgctaaacatagaattggagctaaaatcggagaaagaaaacgctgagataagattgtcagatccattacaatatcaatcaatcgtagatgcagaatggaatatcatttatgacaagttggataaatgtgtggaaagtggagctaaaattgttctgtcacgacttgctattggtgatctggcaactcagtattttgcagatcgtgacatattctgcgctggtcgtgttactgaagaagatttgttgagggttgcagcggctacaggtggaactcttcagaccactgtgaacaacgtaatcgacgaggttcttggaacttgtgacctgtttgaggagaggcaagttggaaacgagcgatttaacatatttagtggatgcccatctggtcagactgccacaattgttcttcgtggtggagcagatcagtttattgaggaggctgagcgaagtttacacgatgcgattatgattgttcgaagggctatgagaaattctactgtagttgctggtggcggtgctattgatatggagataagccgatatttgaggcagcatgcacgtaccattgctggaaagtcccagctctttataaatgcttatgctaaagcccttgaggtaatcccaaggcaactgtgtgacaatgctggttttgatgcgactgatgtgttgaacaaactgaggcagaagcatgctcttgcatctggtgagggtgcctcttatggtgtggacatcaacactggtggaatttccgattcctttgccaactttgtgtgggagcctgcagttgtgaagattaatgccataaatgcagctactgaagcagcttgcctggtcttgagtgttgatgaaactgttaaaaaccccaagtctgagagtgcacaaggagatgctggtgctatgggtggtggtagaggtaggggtcgtggccgtggaatgaggaggaggtaaattcatagataagccctgttcaacttctctctctatgatgatactctcaaccaattttactttcccctcttattttgttccgaattttatatgttttggctaaatctaagttttggtagttttgtatgtttatttgatgtgtttgtattttgccaattttgaactttattgcagcgtttagattgctattcacaaacaattaattgcttttaagttatttggtatttcggattgtagcaggtctgatttttgtttttttctgatggattaatagcttagatggatgtggctttgatctttgttttatttattttcaaaagtatacataccatgacttttgattggattgtctcccttgaattgacctttaattaggcctgaaattttattttaagtttatta

SEQ ID NO: 2107 - DNA, 2217 bp, Papaver somniferum
agttagttactagtctttagttttggtttgtttagctggtggcgagataatcgctcactaagattgtggttatgccgtgtcagtttgagaacacacttagcatgagacatttagatggccactttgaaaacgagaactacacactcctccgtagaacatttttccagagtcttcttctctccgaaaaagcctcaactaaaacccttccgccagcaactatataatccctagttcatacttctcaaatcttggatcttcgatctcacaaagatgtcgaacatgatgcaaccgcagatcatattattgaaagaaggaacagatacatcacaagggaaagcgcaactaattagtaacatcaatgcgtgtactgctgttgcagatgtggttagaacaactttaggtccaagaggaatggataaacttattcatgatgataagggtaatactaccatatctaatgatggtgctactattatgaaactacttgatatagtacatccagctgctaaaatccttgttgatatcgctaaatctcaagattctgaggttggtgatggaaccacaaccgtagtgcttctttgcggggagttcttaaaagaggctaaacctttcattgaggacggagttcatccaagaaatctcataaggagtttccgaactgcagctgacttggcgattgagaaaatcaaagaccttgctgtgagcattgaaggtaaaagtatggaagaaaagaagttgttattggctaaatgtgcttccacaacactttcctcaaagctcattggtggagaaaaggagttcttttcaactatggttgtagatgctgtcactgccatcggcaatgatgatagactcaatctaattggtatcaagaaggttccaggaggtacaatgcgtgattcttttcttgtaaacggtgttgcatttaagaagacattctcgtatgctggttttgagcagcaaccaaagcagttttcgaatccaaagatactcatactcaacattgaacttgaattgaagtcagagaaagagaatgccgagatcagactttctgatcctttacagtatcaatcaattgttgatgctgagtggaacatcatatacgacaagttggataagtgtgcccaaagtggtgccaaaattgttctatcacggttggctattggtgatctagcaactcagtattttgcagatagagatattttctgcgctggtcgtgttacagaagaggatttgcaacgggtttctgcagccactggggcaatggttcagacatcagttaacaacgtcattgatgagattcttggaacctgtgaggtttttgaggaaaaacaagttggaaatgagcgctttaatatcttcagtggatgcccatcaggtctgacagcaactattgttcttcgcggaggagctgatcagtttatcgaggaagctgaacgaagtttgcatgacgccattatgatagtcagaagagccatgaagaactctactgttgttgctggtggcggtgcaatcgatatggagataagccggtacttgaggcagcatgcacgaacaatagctgggaagtctcagctgtttataaattcttatgccaaagcacttgaggtaataccaaggcagctctgtgataatgctggatttgatgccactgacgtgttgaacaaactcagacagaaacatgcacttccatctggtgaaggttccctttacggagtggacatcaacactggtggcattgtagattcatatgctaactttgtatgggagcctgcagttgtgaagataaatgctatcaatgctgcaactgaggcagcttgccttgttctaagtattgacgagacagtcaaaaatcccaagtctgagagtgcacaaggagacgctgctgcaagcgctatgggtcgaggtcgtggacgtggacgaggaatgagacggtgattaaatgaaggaggacattttatttccttctaggatgtgtgtgtgggttagctgtcgggatttttggaatagttggaaagacaaatccagtttttggagcttgtcttatgttagtgtattatctttagaatgggtatgtttgtttagttaaagttgtactcctgttttatcctatcttaaagttaaagtgcatgtttgaacgagctttttgtctatggaagttttccccaatttttgattcacgaactcagtagcctttccaatggaaaccccagtttt

SEQ ID NO: 2108 - DNA, 1778 bp, Chrysanthemum coronarium
cccctttaatctaacttcttcttccttcattagcaaaccctacttcactccacttcttcttcttgttccatttcaaaaccctacatccaaacaccacccttaacctcctccatccacaatggcatccatgatgcaacctcagataatattattgaaagaaggaacagacacatcacaagggaaacctcaattaataagtaacataaatgcttgtatggctgttgctgatgttgtccgtacaacgttgggcccacgaggtatggataaactgatccatgatgatagaggtgttactactatttccaatgatggtgctactattatgaagcttcttgatattgttcaccctgctgctaagatccttgtcgatatcgccaagtcgcaggattccgaggttggtgatggaaccaccagtgtagttcttcttgctggcgagttcttaagagaggccaagccattcattgaagatggcgtgcatcctcaaaatctgatacgcagttatagaactgctgcttttatggcgattgagaagattaaagaattggctgtaagtatagagggaaaaagtttggatgaaaagagaagcttgttagctaaatgtgctgctacaacactctcatcgaagctgataggaggagagaaagatttctttgcaacaatggtcgtcgatgctgtcgttgcaattgggaatgaggatagactgaacatgattggaataaaaaaggttcctggtggtacaatgcgggactcttttctggtaaatggtgttgcgtttaaaaagaccttctcatatgctgggtttgagcagcaaccaaagaagtttttgaatccgaagatattactgttgaacattgaattagaattaaaatcagaaaaagaaaatgctgagataagactttcagacccgttgcaatatcagtccatagttgatgccgaatggaatatcatatatgataagttggataaatgtgtacagagtggtgccaaaattgtcttgtcgcgtctggctattggtgatctggcaacacagtattttgcagaccgagatatcttttgcgctggtcgagttgctgaagatgatctgcatcgtgttgcagctgcaactggtggtactgtacagacatcagtcaacaatgttattgatgaggttcttgggtcttgtgaggtgtttgaggaaaagcaagttggaaatgaacggttcaacatattcagtggatgtccttctggccagacagccactattgtacttcgaggtggagctgatcagtttattgaggaagctgagcggagtctacatgatgcaatcatgattgttagaagggccatgaagaattccacagtggttgctggtggtggtgcaatagacatggagataagccggcacttgtggcagcatgcacgaaagatagctggaaagtctcagctattcataaatgccttcgccaaagcccttgaggttattccacgacaactttgtgataatgctggattcgatgcaactgatgtacttaacaaacttaggcaaaaacatgcacttgagtctggtgagggtgctctttatggagtagatatcaacaccggtggtatatgtgattcctttgctaactttgtgtgggagccagcagtcgttaagatcaacgctataaacgctgcagccgaagcagcatgccttatcttaagtgttgatgaaacagtgaagaacccaaagtcagagagtgcacaaggagatgctactgctatgggcagaggacgtggcggcggcggcatgcgtggtggac

SEQ ID NO: 2109 - DNA, 2063 bp, Fragaria vesca
ctcgctgagactcttatctctctctctcttctccatcgatcaatcggtaacaatggcgggtatgctgcaaccgcagatcatacttctgaaggagggaacggacacctctcaagggaaggcgcagctcgtcagcaacatcaacgcctgcaccgccgtcgctgacgtcgtcaggaccaccctcggcccacgtggcatggacaagctcattcacgacgacaagggcaatgtcaccatctccaacgacggcgccaccatcatgaagctcctcgatattgttcatcccgccgccaagatcctcgtcgacatcgccaagtctcaggactccgaggtcggtgatggaacaactacagttgttctgcttgcaggcgagttcctcaaggaggccaaaccttttgttgaggatggggtgcacccgcagaatttgatcaggagttatcggaccgctagctatttggcaattgagagaatcaaacagcttgcttccagcatcgaggggaagagtctcgaagagaagaaggagctactggctaactgtgctgctacaactctctcttcaaaactcatcgggggagagaaggtgttcttttcaaaaatggttgtggatgctgtcattgcgataggcgatgaggatcgtcttaacatgattggtataaagaaggttgctggtggcaacatgcgtgattcttttctagtaaaaggtgttgcctttaagaagacattttcttatgccggtttcgaacagcaaccaaaaaagtttcttaatccgaagattctaatactaaatattgaattggagcttaaatctgagaaagaaaatgctgagataagattgtcagacccatcccagtatcagtccattgttgatgctgaatggaatatcatttatgacaagctggataagtgtgtgcagagtggagccagagttgttctttcacggttggctattggtgatctggcaactcagtattttgcagatcgagatatattctgtgctggccgtgtagctgaagaagatctgcaaagggtagctgcagccactggtggcaccgtacagacatccatcaatgatgttattgatgaggtcctgggaacatgtgagtgttttgaagaaaagcaagttggaaatgagaggtttaatatctttagtggatgtccatctggtaggactgctacaattgttcttcgtggtggagctgatcagttcattgaggaagctgaacgtagcttacacgatgcaatcatgattgttagaagggctttaaagaattcaactgtagttcctggtggtggtgctatagatatggagctcagtcgttacttgagggacaaagcgcgtgaaattgctgggaggtctcaattttttatcaactcatacgcaaaagctttggaggttattccacgacaactatgtgacaatgcgggattcgatgcgactgatatgctaaacaaactaagacagaaacactcgacaggtgagggtgcaccttatggagttgacataaacacaggaggaatagctgattcgtatgccaactttgtctgggagccagcagttgtaaagatcaatgctataaatgctgctactgaggctgcttgccttgttttaagtgtcgacgagacagtgaaaaatccaaagtctgagagtgcccagggagatgctgctgctagtgccatgggaggtagaggacgtggaggtgctgcttttcgtggtcgtgggcgtggaacgcgaagacgatagtcgcatttggccaagcattagtcatgaccaagcaggctgggttttatacagttttgtcattctggttgatggtgtgctctggagtgctactttcatttgaactgatattgtggaatgtaacttggaacatgaatgatttcttgtaacatgtttaggtagcagcaatgtacgtgtagtttgaaccaactttaagctgagatcttgcctagtggcctcgtttaacatttcccctccccttgtctccttgttttgttgattgatgaagagaactgctgcacatttggtcacgtgtctgtttatcgaatctgtagtcttgaatggtaag

SEQ ID NO: 2110 - DNA, 2115 bp, Papaver somniferum
gaacatttttccagagccttcttctctctgagaaagcctcaactaaaacccttccgccagcaactatataatccgtagttcatacttctcatatcttggatcttcgatctcacaaagatgtcgaacatgatgcaaccgcagatcatattattgaaagaaggaacagatacatcacaagggaaagcgcaactaattagtaacatcaatgcgtgtactgctgttgcagatgtggttagaacaactttaggtccaagaggaatggataaacttattcatgatgataagggtaacactaccatatctaatgatggtgctactattatgaaactacttgatatagtacatccagctgctaaaatccttgttgatatcgctaaatctcaagattctgaggttggtgatggaaccacaaccgttgtgcttctttgtggggagttcttaaaagaggccaaacctttcattgaggatggagttcatccaagaaatctcataaggagtttccgaactgcagccgacttggcgattgagaaaatcaaagaccttgctgtgagcattgaggtaaagtatggaagaaaagaagttgttattggctaaatgtgcttccacaacactttcctcaaagctcattggtggagaaaaggagttcttttcaactatggttgtagatgctgtcactgccatcggcaatgatgatagactcaatctaattggtatcaagaaggttccaggaggtacaatgcgtgattcttttcttgtaaacggtgttgcatttaagaagacattctcgtatgctggttttgagcagcaaccaaagcagttttcgaatccaaagatactcatactcaacattgaacttgaattgaagtcagagaaagagaacgccgagatcagactttctgatcctttacagtatcaatcaattgttgatgctgagtggaacatcatatacgacaagttggataagtgtgcccaaagtggtgccaaaattgttctatcacggttggctattggtgatctagcaactcagtactttgcagatagagatattttctgcgctggtcgtgttacagaagaggatttgcaacgggtttctgcagccactggggcaatggttcagacatcagtcaacaacgtcattgatgagattcttggaacctgtgaggtttttgaggaaaaacaagtcggaaatgaacgctttaacatattcagtggatgcccatcaggtctgacagcaactattgttcttcgcggaggagctgatcagtttatcgaggaagctgaacgaagtttgcatgatgccattatgatagtcagaagagccatgaagaactctactgttgttgctggtggcggtgcaatcgatatggagataagccggtacttgaggcagcatgcacgaacaatagctgggaagtctcagctgtttataaattcttatgccaaagcacttgaggtaataccaaggcagctctgtgataatgctggatttgatgccactgacgtgttgaacaaactcagacaaaagcatgcacttccatctggtgaaggttccctttatggagtggacatcaacaccggtggcattgtagattcatatgctaactttgtatgggagcctgcagttgtgaagataaatgctatcaatgctgcaactgaggcagcttgccttgttctaagtgttgacgagacagtcaaaaatcccaagtctgagagtgcacaaggagatgctgctgcaagtgctatgggtcgaggtcgtggacgaggacgaggaatgagacggtgattaaatgaaggaaaacattttatttccttcctaggatggtgtgtgtgggggttagcagtcaggatttttggaatagttggaaagacaaatccagtttatggagcttgtcttatgttagtgtattatctttagaatgggtttgtttgtttagttgaagttgtactcctgttttatcctatcttaaagtgcatgattgaagtagcattttttgtctatggaagtttttcccaatttttgattcacgaactcagtagcctttccaatggaactgagaatggaaaccccagtttttgatgagagcagaggaatgtactttaggagctatttttttt

SEQ ID NO: 2111 - DNA, 2089 bp, Panax ginseng
tgctactactactggcttcacctcatttcatcctatttctctttatacgcctcgccattaacgatggcagctatgatgcaacctcagattatattgctgaaagaagggacagatacttcccaagggaaggcccagttgatcagcaacatcaatgcgtgtatggcagtagcagatgtggtgcgcaccactcttggaccgaggggtatggataagttgatccatgatgacaagggaaataccaccatttctaatgatggtgccactattatgaagcttcttgacattgtccaccctgcagctaagatccttgtggacattgccaaatcacaagactctgaggttggtgatggaaccaccaccgtagttctacttgcgggggagttcttgaaggaggctaagcctttcattgaggatggggtgcacccacaaaatctgatacggagttatcggaatgcttcctatttggcaatcgagaagatcaaagaattagctgttggtatagaggggaaaagtttagaagaaaagaaaagtctactagctaactgtgccgccacaacattatcttcaaagctcataggcggagagaaggaattctttgcatcgatggttgttgattctgtccttgcaattgggagtgatgatagactaaatatgattggaataaagaaggttcctggaggtacgatgcgggactctttccttgtaaatggtgttgccttcaaaaagacattttcatatgccggttttgaacaacaaccaaagaagtttgaaaatcccaaaatactcttactaaacattgaactggaactaaaatcagaaaaagaaaatgcggagataaggctttcagacccattgcagtatcagtcgattgttgacgctgaatggaatatcatttatgataagttggataaatgtgtgaagagtggagccaaaattgttctttcacggttggctattggcgatttagcaacacagtattttgcagatcgggatatattttgtgctggtcgggtttctgaagaggatttgcatcgagttgcagctgcaactggtggaactgtacagacatctgtcaacaatgttatcgatgaggttcttgggtcttgtgagatttttgaggaaaggcaagttggaaatgagcggtttaatatatttggtggatgccccctgggccagacggccactattgttctccgcgggggagctgatcagttcattgaggaagcagaacggagtttacatgatgcaattatgattgttaggagggctgtgaagaactctactgtagttgctggtggtggtgctatagatatggagataagtcgatacttgaggcagcatgcacgcacaattgctggaaagtcccagctatttataaactcatatgcaaaagctcttgagattatcccccggcagctgtgtgacaatgctggatttgatgcaactgatgtgctgaacaaactaagacagaagcatgctcttccatcaggtgagggtgcactttttggggtcgatatcaacactggtggaattgctgattcatacgccaactttgtgtgggagccagcagttgttaagatcaatgctataaatgcagctactgaagcagcttgccttatcttaagcgtggacgagacggtaaagaacccaaagtctgagagcgcacagggagaagctgcttcaagtgcaatggggtagagggcatggtggtgggtggtctccgtggtcgtggaagagggatgcgtaggcgataagactttccaggtgtaaatttacacaagaatcaagtggttttactaatcaaattttgaagtcatgattggcttgcgtgttcaactatctttcttttctcctcttctcttttttctttctccctggcccttataacttgaatatagagttcaaaggtgtaattctatggtggttcttttcctagatgtacaccttttaccctttgcttgcttctgacttttgaaccttgtgtggtactagtcaattttgggtatcaggaacttacacatctattcttgtatgtattgaattggcagtactactcccactggggtgtgctaatgtatcagcattagat

SEQ ID NO: 2112 - DNA, 1955 bp, Plantago ovata
gcccctctctcactaaaacaaccctccttcgctctgcaatttgcatctgacaatggcgtctatgatgcaaccacaaatcatactactgagggaagggactgatacgtcgcaagggaaaccgcaactgattagtaacattaatgcttgcacggctgtcgctgatgtcgtgcgaactacacttggtcctaggggcatggacaaattgatccatgatgataaggggaacaccacaatctctaatgatggtgccaccataatgaagcttctcgacattattcatcccgctgccaagatccttgtagatattgccaagtctcaggattctgaggttggtgatggaacaaccactgttgttctgcttgctggagagttccttaaggcagctaaaccttttattgaagaaggtgttcatcctcaaaatcttataagaagttatagaacagcttctctttggcacttcagaggatcaaagaattagctgtcagcatagaaggtaaaagcttggaagagaagaagagtttgctggctaaatgtgctgctacaactctttcttcgaagctcattggcggtgagaaggagttctttgcaaccatggttgtagatgctgttgttgccattggagttgaggatagactaaacatgattggaataaagaaggttcctggaggtaccatgagggattctttctttgtgaatggtgtggcttttaagaagacattctcgtatgctggttttgagcaacagccaaagaaatttgttaaccctaagattcttctgctaaacattgaactggaactgaagtcagagaaagaaatgcagagataagactctcagatccattacagtaccaatcaattgtagatgcagaatggaatattatatatgataagttggataaatgtgtaagcagtggagctaaagttgttctctcacggctagctattggtgatctggcaactcagtattttgcggatcgtgatatattttgcgctggtcgtgttactgaggatgatttgcggagagttgctgctgcttcaggtggaacagttcagacaaccgtgaataacgtaattgatgaggttcttggaacttgtgaactatttgaggagaggcaagttggaaatgagcgttttaatatatttagtggatgcccagctggtcgtactgccactattgttcttcgtggtggagcagatcagtttattgaggaggctgagcgaagtttacatgatgcaattatgattgttagaagagctctgaaaaactcaactgtcgttgctggtggaggtgctattgatatggagataagccgatacttgaggcagcatgcccgcatgattgctgggaagtccatgctctttataaatgcttacgctaaagcccttgaggtaatcccgaggcaactctgtgacaatgctggtttcgatgcaacagatgtgctgaacaaactgagacaaaagcatgcccttccatctgatgagggtgcactctatggtgttgacatcaacactggtggaattgctgattcattcgctaattttgtgtgggaaccagcagttgtgaagattaatgccataaatgcagcaacggaagctgcttgtcttgtcttaagtgtggatgaaactgtgaaaaatcccaagtctgagagtgctcaaggcgaagctggtatgggtggcagaggccgaggtggaggtgctctccgtggcggccgtggccgaggcatgagaagatgattgaacatttgagtggctaattgtatttgggaagcatttggctaaattttgattccaactttcggtttgtcttttaagttattttctagttctcacacttgaagaacatagaagggagatatggatactggttgccacaagtgtctgattagttgattttcctatgttgatctcctctatctttagtgaattctgttttatttgtaatgataaatatgtttt

SEQ ID NO: 2113 - DNA, 2108 bp, Chrysanthemum coronarium
tcgccatctccactctccgccgccgtcaacaacaacaacaatggcatccatgatgcaacctcagatcattctattgaaagaaggaacagacacatcacaagggaaacctcaattgattagtaacataaatgcttgtatggctattgctgatgttgtccgtacgacgttgggcccacgtggtatggataaattgatccacgatgatagaggtgttaccactatttccaacgatggtgctactattatgaagcttcttgatattgttcaccctgctgctaagatccttgtcgatatcgccaagtcgcaggattccgaggttggtgatggaactacttctgtggttcttcttgctggtgagtttttgagagaggctaaaccgtttattgaagacggtgttcatcctcaaaatttgatacgaagttacagaaccgctgcatttatggcgattgagaaagttaaagaattggctgaaagtattgagggaaaaagtttggatgaaaagagaaccttattagctaaatgtgctgcaacgacgctttcatcaaagctaatcggaggagagaaagacttttttgcaaagatggttgtagatgctgtcattgccattggaaatgatgatagattgaacatgattgggataaagaaggttcctggtggtacaatgagggattcgtttcttgtaaatggtgttgcatttaagaagactttttcatatgctgggtttgagcagcaacctaagaagtttttgaatccaaagatcttattgttgaacattgaactagagctaaagtctgaaaaagaaaatgccgaaataagactttcagatccactgcaatatcagtccattgttgacgcagaatggaacatcatatatgacaagttggataaatgtgtaaagagtggtgctaaaattattctgtcccgtcttgctattggtgatctggcaacacagtattttgcagaccgagatatattttgtgctggtcgagttgctgaagatgatctgaatcgtgttatggctgcaactggtggagctgtgcagacatcggtcaacaatgttatagatgaggttcttgggtcttgtgagatttttgaagaaaaacaagttgggaatgaacgatttaatatatttagcggatgtccttcaggtctgactgccactattgttctccgaggtggagctgatcagtttatcgaggaagctgagcggagtctacatgatgcaatcatgattgttagaagggccatgaagaattccacagtggttgctggtggtggtgcaatagacatggaggtaagccgacacttgtggaagcatgcacgaaatatagctggaaagtctcagctattcataaatgcctttgctaaagcccttgaggttattccacgacaactttgtgataatgctggatttgatgcaactgatgtacttaacaaactcaggcaaaaacacgcccttccttctgacgagggtgctcgttatggagtagatatcaacactggtgggatatgtgatacctttgctaactttgtttgggagccagcagtggttaagatcaatgccataaacgctgctgctgaagcggcatgccttatcttaagtgttgacgaaactgtgaagaacccaaagtcggagagtgcacaaggagatgctgctgctatgggcagaggacgtggtggcggcggaggcatgcgtggtggacgtggaagagggatgcgtagacgttaagctttgctgttttggtttatcattaaaactaccaaggcacgggcatggaaaatgtttctcatatgtgagagatgaagtgattttgttttttaagtgaagtgatttttcttacttattcgctgtattgattttgcaacgacttgtattttgtagctgcgggtttagtaggaatattttgaagtctagtcacatttaagttgccttatttttgtaaaacttggattagtaagaaattagtagttggttgcttgttaaacgattgcaaagttggcatacaagctacatgcataaaacgtgttttgtcatgtatctaatcccaaaacttgtctcaaggaactttcacttgacatctcggtttatatggattcatttacatgcc

SEQ ID NO: 2114 - DNA, 1766 bp, Echinochloa colona
acacgacgactgtgcgcaccacgctggggcccgcggcagtggacaagctcattccacgacgacaagggcggcgtcaccatctccaacgacggggccaccatcatgcgcctcctcgacatcgtccaccccgccgccaagatcctggtcgacatcgccaggtctcaggactccgaggttggtgatgggactactactgtagtgcttcttgctggtgaattcctgaaggaggcaaagccttatattgaggacggcgtacaccctcatagtctaattcgtagttacaggactgctggctatttggcaactgagaaagttaaagaactggcggtcagcatagaagggaaaagccttgaagaaaagaaatcactgctagccaaatgtgctgcaacaacgctctcttcgaagttaataggtggcgagaaagaattctttgctactatggttgttgatgctgtgcttgctatcggcaatgatgacaggctcaacatgattggaattaagaaggttcctggaggtactatgagagattccttccttgttaatggtgttgccttcaaaaagacgttttcgtatgctgggtttgagcaacagccaaagaaattcttgactccaaagattcttttgcttaacattgagcttgagctgaaatctgagaaagaaaatgcagaaattagattgtctgaccctctgcaataccagtcaattgttgacgctgaatggaacattatttatgacaaattggataagtgtgtaaaaagtggggccaaaattgtgctttctcggttggcaattggtgatcttgcaacacaatattttgcagatcgtgatattttctgtgctggccgtgttacggaagaggatttacagcgtgttgcagcagcaactggtggaaccgttcagacatctgtgaacaatgtcattgacgaggttcttggatcatgtgaagtattcgaggaaaggcaagtgggaaatgaacggtttaacatattcagcggatgtccttctggtcaaactgcaaccatagtccttcggggtggtgcagatcagttcattgaagaagctgaaagaagtctccatgatgccatcatgatcgttaggagagcgcttaagaattcaacagttgtgcctggtggtggtgctattgatatggaagtaagtaagtatctcaggcaacatgcacggaccatagccgggaagtctcagttttttgttaattcatttgctaaagcccttgaggttatcccgagacagctttgcgacaatgctggatttgatgcaactgatgtgctaaataagctcagacagaagcatgcatccggtgaaggtgctaactatggtgtggacatcaacactggtggaattgccgattcctttgctaactttgtgtgggaacctgcagtcgtgaagatcaatgctataaatgctgcaactgaagctgcttgtcttatcctcagcgtggatgagactgttaaaaaccccaagtctgagagcgcacaaggtgatgctgccgctatggctggtcggggccgtggtggaggggcaatgcgcggccgtggcggaaggggtatgaggaggcggtaatcgatccatgcctcgttgtatcttacggtcacttgagtgggtcaaattttgaactttggcccttcctcttcctatatccatgcactctgcttagtgttgtttgtgagctccgtgatttcttagatgtgttaattggaacagcaaaaggattgaaaatattgcttgaaaatattgctgttatgtaa

SEQ ID NO: 2115 - DNA, 1912 bp, Taxus baccata
aatggcgtccatgctgcaaccccaaataattttgctcaaggaaggcaccgatacttctcaggggaaaccccagctgatcagtaacataaatgcgtgcacggtggttgtggatacggtgcgtacgacgctggggcctcgcggaatggataaacttattcacgatgacaggggctctatcacaatttctaacgacggagcaactatcatgaagcttctcgacattgttcaccctgccgctaaaatcctagtcgacattgccaaatctcaggactcagaggttggtgatggaactacaactgttgtactccttgcgggagagttccttaaagaggcaaagccttttatagaagagggagtccatcctcagaaccttattcggagttataggacagcagcttatttggctatcaacaaagttaaagatctttctattagtatagaaggaaaaagtctcgaggaaaagaaaagtcttcttgagaaatgcgctgccacaacgctctcatctaaactgattggtggagagaaggaattctttgccaaaatggttgttgatgctgtaattgcaattggtcatgaagatagattgaatatgataggcataaagaaggtacagggaggaaatatgcgtgactcatttttagttaaaggcgttgcttttaagaaaacattttcatatgccggttttgaacaacaaccaaagaaattttcgaatcccaaactgcttctattgaatgttgagctggagcttaaatcagaaaaagaaaatgcagaagtgaggctgtcagatccaacaaaatatcaatcaattgtagatgcagaatggaatataatatatgataagttggataagtgtgtgaagagtggggctaaaattgtactatctcgattggcaattggtgatttggcaactcaatactttgctgatcgagatgttttctgtgctggtcgcgtaacagaggaggatctacaacgtgttgctgctgccactgggggagcagtgcaaacctctgtgaacaatatagtgcccgaggttcttggaacctgtgaagtttttgaagagaagcaagtgggtaatgagagattcaatctattcagtggatgcccatctgggttgactgcaactatagttttgcgtggtggggcggatcagttcattgaagaagcagaaagaagtttgcatgatgccatcatgatagttcgaagagcattgaagaactctactgtggtagctgggggcggtgctattgatatggaaattagtagatatttgagacagcatgctcgaacaatagcaggaaagtcacaactgtttatcaactcatatgcaaaagcccttgaggttatccctcgtcaactttgtgacaacgctgggtttgatgcaaccgacgtgctaaacaaactcagacagaagcatgcactcccatctggtgagggtgcaccttatggtgtggatataaatacaggtggaattgctgattcttttaccaactttgtatgggaacctgcagttgtaaagataaatgcaatcaatgctgccacagaagcggcttgtcttattctgagtgtggatgaaacaattaaaaatccgaagtctgaaagtgctcaaggagaaggagcagccaatgcaatggctggccgaggacgtggtggtggcttccgtggtcgaggtcggggcatgcgtaggcgatgagggttacttgagatgaatatgatccagtttgtagtacattccattctagtttagtgaagctgtttggaggaatcagttttgtactttgctgaattaacgaatgatttgcttgtttttctcattttcatagcagaaaatggaaaatagtatttactatagaattttgtattggtgaggttttcggtttttcgatgatgactaatgcaccattgaaattagttt

SEQ ID NO: 2116 - DNA, 1860 bp, Cephalotaxus harringtonia
accccaaataattttgctcaaggaaggcacagatacgtctcagggtaaaccccagctgatcagcaacataaatgcgtgcacggtggttatggatacggtgcgtacgacgctggggcctcggggcatggacaaacttattcacgatgacaggggctccatcaccatttctaacgacggagcaaccattatgaagcttctcgacattgttcaccctgccgcaaaaatcctagtcgacatcgcaaaatctcaggactcagaggttggtgatggaactacaactgttgtactccttgcgggagagttccttaaagaggcaaagccttatatagaagagggagtccatccacagaaccttattcggagttatcggacagcagcttatttggctatcaacaaagttaaagagctttctaaaagtatagaaggaaaaagtcgtgaggaaaagaaacaccttcttgagaaatgtgctgcgacgacgctttcatctaaactgattggtggagagaaggaattctttgccaaaatggttgttgatgctgtaattgcaattggtcaagaagatagattgaatatgataggcattaagaaggtacaaggaggaaatatgcgcgactcttttttagttgaaggtgttgcttttaaaaagacattttcatacgctggttttgaacaacaaccaaagaaatttttgaatcctaaactgctcctattgaatgttgagctggagcttaaatcagaaaaagagaatgcagaagttaggctgtcagatccgacaaaatatcaatcaattgtagatgcagaatggaacattatttatgataaattggataagtgtgtgaagagtgaggctaaaattgtcctatctcgattagcaattggtgatttggcaactcaatattttgccgatcgagatgttttctgtgctggtcgtgtaacagaggaggatctacaacgtgttgctgctgccactgggggagtagtgcaaacctctgtgaacaatatagtgcccgaggtgctcggaacctgtgaagtttttgaagagaagcaagtaggtaatgagagattcaatgtattcagtggatgcccgtctgggctgactgcaactatagttttacgtggtggggcagatcagttcattgaagaagcagaaagaagcttgcatgatgccatcatgatagttcgaagagcattgaagaactctactgttgttcctgggggtggtgctattgatatggaaattagtagatatttgagacagcatgctcgaaccatagcagggaaatcacaactttttattaactcctatgcgaaagcgcttgaagttattccgcgtcaactttgtgacaatgctggttttgatgcaaccgacgtgctaaacaagctcagacagaagcatgcactctcatctggtgagggtgcaccttatggtgtggatataaatacagggggcattgctgattcttttgcaaactttgtatgggagcctgcagttgtaaagataaatgcaatcaatgctgccacagaagctgcttgtcttattctgagtgtggatgaaactattaaaaatccgaagtctgaaagtgctcaaggagaaggagcagcaaatgcaatggctggccggggacgtggtggtggcttccgtggccgaggtcggggaatgcgcaggcgatgagggttacatgagacaaatacaatctgatttgtagtacattcaaatctagtttagtgaagcttcttggaggaatcagttttgtaccatttcgaatgaacaaatgatttgtgcatctttctcatttgccttatggatttcatgacggtatatggaaaatattattttataatggaattttgtatcggtag

SEQ ID NO: 2117 - DNA, 2080 bp, Amborella trichopoda
ccgaatcgcactctgttctctgcaatggcggccatgatgcaaccccagatcatacttttgaaggagggaacagacacttcacaggggaagccacaactgatcagtaatatcaatgcttgcacagctgttgttgattcagtgagaacaaccctaggtcctcgaggaatggacaagcttatccacgatgataaggggaacaccaccatttcgaatgatggagccaccattatgaagcttcttgatattgttcatccggctgctaagatcctcgttgccattgctaattctcaagattcagaggtcggtgatgggactactactgtagtccttcttgcaggagaatttttaaaagaggctaagcctttcattgaggatggggtgcatcctcggaatctaatacgcagttatcgtattgcatcctatttggcaataaacaaaattaaggaactagcagtaagcatagaggggcgaagttttgaagagaagaaagatctgttgcaaaagtgtgctgcaacaaccctctcttcaaaactcataggtggtgaaaaggaattttttgcttcaatggttgtggatgctgtaatggccataggacagggtgataggttgaacttaattggtgtgaaaaaggttcctggtggaaacatgagagattcttttcttgtaaagggagttgcatttaaaaagacattctcatatgccggctttgaacaacaaccgaaagcgttttcggatcctaaaattctattattaaacattgagttagagctgaaatcagagaaagaaaatgccgaaatcaggctcacagatccattgcagtatcaatctattgttgatgctgagtggaatatcatttatgacaagttggataaatgtgtcaaatctggggcaaagatagttctctcacgtctggctattggtgatctggcaacacagtactttgccgatcgcgatatcttttgtgctggtcgtgtaacagaggaggatttgcagcgggtcgctgccgcaactggtgggactgtgcaaacttctgtcaataacatcattgatgaatctcctgattctaaactgctccaagttacaggaaaggtacttggatcctgtgagctttttgaagaaaagcaagtaggaaatgagaggttcaacatttttagtggatgtcccagtggccagacagcaaccattgttctacgtggtggtgcagatcagttcatcgaggaagcggaacgaagccttcatgatgccattatgattgtgagaagagcactgaggaactcgactgttgttgctggtggtggtgctattgatatggagataagtagatacctgagacagcatgcgaggactatagctgggaaatctcaattgtttattaactcatatgccaaagcacttgagattatcccacgccaactatgtgataatgctggttttgatgcaactgatgttctgaacaagctcagacagaaacatgcactaccatctggggaaggtgcccgttatggtgtggacataaacaccggtggcatcactgatacgtttgctaactttgtatgggaacctgcagttgtgaaaatcaatgccataaatgctgcaacagaagcagcttgccttgttcttagtgtggatgagactgtaaaaaacccaaagtcagagagtgctcaaggtgaggctgctgcaagtgctatgggccgtggacgtggtggtgggcctgccttccgtggccgtgggaggggcatgcgccgccggtaaatttcaacgtttaattttttgtatagtaatgttaaccaaatttgctggtgctttatttcctatatcatctggtttttttattatgaaacaattttgtagttttcctaagaaaccatgttgaggtatttttggctctgtcctttgtttttgcatttggcacattgagtttacgacgcagaccaatgccttgccaagggattgtcttgtatggaaaattttctttgtttttttttgtgttctaacttctgagctttgtcacaagaatttgagctgccgctgtagattttgatacctggctatgacaaatttatatggccatttcacatct

SEQ ID NO: 2118 - DNA, 2301 bp, Picea glauca
agttccctcaagttccctccccctcatctagacatctaggtcgtgacattctagaagaggtggtctcattccctctactttttgcctttctctttctctgtaagtattcaacactgaagcagggaacaagagttttaagggttttaagctaccttctctgttatattcggtccggcgacgcctctgcatattcgccatgtcgaccatgatgcaaccccaaataatcttgctcaaggaaggcacagacacttcccagggaaaggctcagctgatcagcaacataaatgcctgcacggccattgtcgatgctgtgcgtagcacgctcggcccgcggggtatggacaagctcattcatgacgacaagggcaccaccaccatttctaacgacggggcgactattatgaagcttctcgacattgttcatcccgcggctaaaattctggtggacattgccaaatcacaggattctgaggttggtgatggaactacaaccgttgtactttttgcgggagagtttctgaaagaggcaaaaccttttattgaagatggagtccatcctcagaaccttattcgaagttttcgaacagcagcttatttggcaatcaacaaagttaaagagcttgctgtcagtatagaaggaaagagtcttgaagaaaagaaaggtcttcttgagaaatgtgctgcaactacactttcatcaaaacttatcggtggggagaaggatttttttgctaagatggttgttgaagctgttatttcaattggtcaagaagatagattgaatatgataggcataaagaaggtacaaggaggaaacatgcgtgactcatttttagtgaagggcgttgctttcaaaaagacgttttcatatgctggttttgaacaacaaccaaagaagtttctgaatgctaaaattcttcttctaaatgttgagttggagcttaaatcagaaaaggaaaatgcggaagttaggctgtcagatccaacaaaatatcaatcaattgtagatgcagaatggaatattatatatgataaactggacaagtgtgtaaaaggtggggctaaaattgtgctatctcgtttggcgattggtgatctggcaactcaatactttgccgatcgagatattttcgctgcggggcgtgtagcagaggaggatctacagcgtgttgctgctgccactggtggatcagtgcaaacttctgtgaacaacattgtgcctgaggtacttggaacctgtgaactttttgaagaaagacaagttggcaatgagcgattcaatatattcagtggatgcccatctgggcagactgcaacaatagttttacgaggtggtgcggatcagttcattgatgaggcagagaggagtttgcatgatgccatcatgatagttcggagagcaatgaagaattctaccattgtttctggtggcggtgcaattgatatggagattagcagatatttaagacagcatgctcgaaccatagcaggaaagtcacaattatttatcaattcctatgcaaaagccctagaggttattccacgccaactctgtgaaaatgctgggtttgatgcaacggatgtgctaaacaaactgagacagaagcatgctctcccatctggtgagggtgcaccttatggagtggatataaatacaggaggtattgctgattcttttgcaaactttgtctgggagcctgctgttgtaaagataaatgcaatcaatgctgccacagaagccgcttgtctcattctgagtgtggatgaaacggtgaaaaatccaaagtctgagagtgctcaaggagaaggggcagcaaatgcaatggctggacgaggtcgcggtggtggcttccgtggtcgaggtcgaggcatgcgcaggcgatgagagaattggagcttgttggtggctgccattttagtggagttgggttgcttggatttgtcagttttgtactcacatgcattcctatttacacacagggatgtcatcatggaaaacaattctactttttttttattaaattttgtattgtgggtgatctcattttttccaggatgacttcatcgccagtgagattgttttctggttaccagatttaaataggttgcctctctggatgcattttctcaagcattcatttctgctccagttgtattccttgaacaccaacggaatctatttggagactcatctatattgtatgtttgacttgtcagtagaagaatgagttgcatgtaataacccaattaattgtaaatgatgttggtgaaagtgcaggttagataatctgctgttgcact

SEQ ID NO: 2119 - DNA, 2328 bp, Sequoia sempervirens
ccaaattccgttttccctcttttcctttgcaagccctaaacccatattttcttttctgcctgaacttctccttgtccactggccttggggagaacaaagacatatattacaatatagattgtgtttaacaaagcagtcagcgagggttttagtattcttttccagaaaaaactggtttccagtcgttgcggttcatccatggcgaccatgctgcaaccgcaaataattttgctcaaggaaggaacggatacatctcaagggaaagcccagctgatcagcaacataaatgcgtgcacggcggttgtggatacggtgcggacgacgctggggcctcgtggaatggacaaacttattcacgatgacaggggctccatcaccatttctaatgacggggcaactattatgaagcttcttgatattgttcaccctgctgccaaaatcctcgtagacattgcgaaatctcaggattcagaggttggtgatggaactacaaccgttgtcctgttggcaggagagttccttaaagaagcaaaaccttttatagaagagggagtccatcctcaaaaccttattcggagttatcggacagcagcttatttggctattaacaaagttagagagttttctatcagtatcgaaggaaaaagtattgaggaaaagaaaggccttcttgagaaatgtgctgctactacactttcatctaaactcattggaggagaaaaggaattctttgccaagatggttgttgatgccgtaatttcaattggccaggaagatcgattaaatatgataggcattaagaaggtacagggaggaaatatgcgtgactcatttttagttaaaggcgttgcttttaaaaagacattttcatatgctggttttgaacaacaaccaaagaaatttttgcatcctaaacttcttctattgaatgttgagttggagcttaaatcagaaaaagaaaatgcagaagttaggttgtcagatccaacaaaatatcaatcaattgtagatgcagaatggaatattatatatgataaattggataaatgcgtgaaaagtggggcaaaaattattttgtctcgattggcaatcggtgatttggcaactcaatactttgccgatcaagatgttttctgtgctggtcgtgtaacagaggaggatctacaacgtgttgctgctgccacagggggatcagtgcaaacttctgtgaacaatattgttcctgaggtgcttggaacctgtgaaatttttgaagagaagcaagtgggaaatgagagattcaatgtattcagtggttgcccatctggcctgactgcaactatagttttacgtggtggagcagatcagttcattgaagaagcagaaagaagcttgcatgatgccatcatgatagttcgaagagcattgaagaactcaactgttgtggctggtggtggtgctattgatatggaaattagtagatatttgagacagcatgcacgaaccatagcagggaagtctcagctgtttatcaactcctatgcaaaagccctcgaggttattccacgtcaactttgtgacaatgctgggtttgatgcgacagacgttctaaataagctcagacagaagcatgcactcccatctggtgagggtgcaccttatggtgtggatataaatacagggggtatagctgattctctagcaaactttgtatgggaacctgcagttgtaaagataaatgctatcaatgctgccacagaagctgcttgtcttattctcagtgtggatgaaacaattaaaaatccaaagtctgaaagtgcacaaggagaaggagctgcaaatgcaatggctggtcgagggcgtggtggcggcttcccaggccgaggtcgtggcatgcgcaggcgatgagagttacattagatgaataccatccaattcatgatacattcctttctagtgaagtaaagttgctcggagtcatcagtttggtaccatgctgaatggacaaatgatttgcatctcatttgtcagatgcactcgacgacaaaatggaacagtagttatcatgaaattttgtattggggtgggtatcatgttttccaggatggcttatgtgttgttgagatgatttgcttatgcctctgttgtggttaccagatttagatggattctgtttgtaattgtgatgccatatgcttccttttgggatcattctcttttttatgtgctatcctctgcacagaacgattattgattgcatgtgatagcccctctcaaactgaaaatgttgtcaattatagtttgcataacatctgctacctcaattttatattcaatagtatattttaa

SEQ ID NO: 2120 - DNA, 2316 bp, Pinus pinaster
aatctattttatctatgggacgattttttggtttttgaaaagcttccttcttcatctaggttgtgaaactctagaagagttctcattccctttactctttgctcctctctctctatactgtaagcttcaacgctccaccaggaaccagggttttaagggttttaagctactttctttgttatcttcggtcctctgcattttcgccatgtcgaccatgctgcaaccccaaataatcttgctcaaggaaggcacagacacttcccagggaaaggctcagctgatcagcaacataaatgcatgcatggccattgtcgatgctgtgcgtagcacgctcggcccgcggggcatggacaagctcattcatgacgacaagggcactaccacaatttctaatgacggggcgactattatgaagcttctcgacattgttcaccccgcggctaaaattctggtggacattgctaaatctcaggattctgaggttggcgatggaactacaactgtcgtactttttgcgggagagtttttgaaagaggcaaaaccttttattgaagatggagtccatcctcagaaccttattcgaagctttcggacagcagcttatttggcaatcaacaaagttaaagagcttgctgtcagtatagaaggaaagagtattgaagaaaagaagggtcttctggagagatgtgctgcaactacactttcatcaaaacttattggtggggagaaggaattttttgcaaagatggttgtcgaagcagttatttcaattggtcaagaagatagattgaatatgataggcataaagaaggtacaaggaggaaacatgcgtgactcatttttagtgaagggtgttgcttttaaaaagacattttcatatgctggttttgaacaacaaccaaagaagtttctgaacgttaaaattcttcttctaaatgttgagttggagcttaaatcagaaaaggaaaatgcagaagtcaggctgtcagatccaacaaaatatcaatcaattgtagatgcagaatggaatattatatatgataaactggacaagtgtgtaaaaagtggggctaaaattgtgctatctcgattggcgattggtgatctggcaactcaatactttgcagatcgagatattttctgtgcggggcgtgtaacagaggaagatctacagcgtgttgctgctgctactggtggatcagtgcaaacttctgtgaacaacattgtgcctgaggtactaggaagctgtgaactttttgaagaaagacaagttggcaatgagcgattcaatatattcagtggatgcccatctggcctgactgcaacaatagttttacgaggtggtgcagatcagttcattgatgaggcagagaggagcttgcatgatgccatcatgatagttcggagagcaatgaagaattctaccattgtttctggtggtggtgcaattgatatggagattagcagatatttaagacagcatgctcgaaccatagcaggaaagtcacaattatttatcaattcctatgcaaaagctcttgaggttattccacgccaactctctgaaaatgctggttttgatgcaacagatgtgctaaacaagctgagacagaagcatgctctcccatctggtgagggtgcaccatatggagtggatatcaatacaggaggtattactgattcttttgcaaactttgtatgggagcctgctgttgtaaagataaatgcaatcaatgctgccacagaagctgcttgtctcattttgagtgtggatgaaacggtgaaaaatccaaagtctgagagtgctcaaggagaaggggcagcaaatgcaatggctggacgaggtcgtggtggtggcttccgtggtcgaggtcgaggcatgcgtaggcgatgagagaattggagcttgttggtgggtgccattatagtggagttgggttgcttggagtagtcagttttgtagtcatgctgaagagatgaatgttttgcatgcattcctctttaaacacagggatgtcatcatggcaaactatctacttgtttttaattttgtattgcaagtgatctcattttttccatgatgacttatcaccgttgagattgtttggtgggtactagttttaaatagttttcctctggatgcattttctgaagcattcatttctgctccagttgtattccttgaacagcgacagaatctatgtggagactcatctatattgtatgtttgacttgtcactagaagaatgagttgcatgtaataacccaattaatttcacatgatgttgatgaaagtgcaggttagataatctgctg

SEQ ID NO: 2121 - DNA, 2008 bp, Sciadopitys verticillata
attttgcttaaggaaggcacagatacttcccaggggaaaccccagctgatcagcaacataaatgcctgcacagccattgtcgatactgtgcgcaccaccctcggccccagaggaatggataaacttattcacgacgacaggggttccattactatttcgaacgatggggcaactattatgaagcttctcgatattgttcatcctgccgcaaaaattttagtcgatattgccaaatctcaggactctgaagttggtgatggaactacaactgttgtactccttgcgggagagttcctgaaagaggcaaaaccttttatagaagagggagtccatcctcaaaaaccttattcggagttatcgtacagcagcttatttggctatcaacaaagttagagagctttctatcagtatagaaggaaaaagtattgaagaaaagaaaagccttcttgagaaatgtgctgcaacaacactctcctctaaactgattggcggagagaaggaattctttgccaagatggttgttgatgctgtggttgcaatttgtcaagaagatagattgaatatgataggcatcaagaaggtacaaggaggaaatatgcgtgattcatttctagtgaaaggtgttgcttttaaaaagacattttcgtatgctggttttgaacaacaaccaaagaaatttttgaaccctaaactgcttttattgaatgttgagctggagcttaagtcagaaaaagaaaatgcagaagtcaggctgtcagatccaacaaagtatcaatcaattgtagatgcagaatggaatattatatatgataaattggataagtgtgtgaaaagcggggctaaaaattgtactatctcgattggcaattggtgatttggcaactcaatattttgccgatcgagatgttttctgtgcgggtcgtgtaacagaggaggatctacagcgtgtttctgctgccactgggggagcagtgcaaacctctgtgaacaatattgtgcctgaggtgcttggaacctgtgaatgttttgaagaaaaacaagtgggcaatgagcgattcaatatattcagtggatgtccatctgggttgactgcaactatagtattgcgtggtggggcggatcagttcattgatgaagcagaaagaagtttacatgatgccatcatgatagttcgaagagcattgaagaactctactgttgtagctggtggtggtgctattgatatggaaattagcagatatttaagacaacatgctcgaactatagcagggaagtcacagctatttatcaattcctatgcaaaagcccttgaggttattccacgtcaactttgtgataatgccgggtttgatgcaactgatgtgttaaacaagctcagacagaagcatgcactcccatctggtgagggtgcaccttatggtgtagatattaatacggggggcattgctgattcttttgcaaactttgtatgggagcctgcagttgtaaagataaatgcaatcaatgctgccacagaagctgcttgtcttattttaagtgtggatgaaacggttaaaaatccaaagtctgagagtgcccaaggagaaggagcagcaaatgcaatggctggacgaggacgtggcggtggcttccgtggccgaggtcggggcatgcgcaggatgaggtagttaaactagatgaatccaagagaggatttatagtacagtccactgaatttggaggctgattattggagtctgctttgtattaatgaacgaatgatctgcatgcatttatcatttttggatttatgatgaaaacagcaaacagtattgataatgaaattttgtattggtggggatatcaaattttccaggatggccttcagtgtgcttgagattgtttgcctgttgcttctgctgtggcaattagatttatatgggttgtctgtttgtatacaccatgcctgacattcattatctggattctgatccagttcaatttttaagaactggctttttcatagaat

SEQ ID NO: 2122 - DNA, 1860 bp, Euphorbia peplus
ggtaccgacacgtcgcagggaaaggcgcagctgattagtaacattaatgcgtgtactgcggtagcggatgttgttcgaactaccctcggaccgagagggatggacaagcttattcatgatgataagggcaatgttaccatttctaacgatggagcaactattatgaagttgctcgatattgttcatcccgcgtctaagatccttgtcgatattgctaagtctcaggactctgaggttggtgatggaaccactacagtagttctgcttgcagcagagtttctgaaggaggctaaacctttcatagaggatggggttcacccacagaatttgatacggagctatagaactgcgtgcaatttggctattgacaagattagagaactagctgttagcatagaagggaaaagtctagaagaaaagaagagtttacttgctaagtgtgctgctacaaccctttcttcaaagcttattggtggagagaaggatttctttgcacagatggttgttgatgctgtcattgcaattggagatgaagataggctaaatatgattgggataaaaaaggtgcctggtggcaacatgcgagattcctttctagtaaatggagttgcctttaagaagacattctcatatgctggatttgaacaacaaccaaagaagttcttaaaccccaagctactcttactcaacatcgagttggagttgaaatctgaaaaagaaaatgcagagataaggttgtcagacccgtcacaatatcagtcaattgttgatgcagaatggaatatcatttatgacaagttggataaatgtgtacaaagtggggccaaggttgtcctttcacgcttggctattggagatttggcaacacagtattttgcagaccgagatattttctgcgctggtcgtgttgctgaagaagatttgcaaagggttgctgctgcaactggcggaactgtgcagacaaccgtcaacaatataattgatgaggttcttgggacctgtgaggttttcgaggaaaagcaagtcggaaatgagcgatttaatatattcagtggatgcccttctggacggactgcgactatagttcttcgtggtggagccgatcaattcattgaagaagctgaaaggagtttacatgatgctatcatgatagtcagaagagctatgaagaactcgactgttgttgctggtggaggagcaatagatatggaaataagtcgataccttcggcagcatgctcggacaatagctgggaagtcgcagctttttatcaactcatatgcaaaagcgcttgaggttatcccacgacaactatgtgataatgcagggtttgatgcaactgatgtgctgaacaaattaagacaaaagcattcaagcccatctggtgaaggtgcttcttttggagtggatatcaatgctggtgttgttgcagattcatttgccaactttgtctgggaaccagcagtagttaagatcaatgctataactgccgcttcagaggctgcttgccttgtattgagtgtggatgagacagtcaagaaccccaagtctgaaagtgctcaaggggaggctgctgcgagtgctatgggtggtagaggtcgtggaggtggccgaggccgtggaatgcgaagacgatgagcattcaatttgattgggtgggaacttgcaaatttgttgaaagagcatcttccgaaaaattttcctcttgatttttagttggttaaaatattgtatcatcaattggctctattgttctgttcaacaaatgaatccaaccgggtgtgtaattttactgcttatatttgaggcaggttggtgggttttcagaatgctgctgctgcttaattttgctgggtgtag

SEQ ID NO: 2123 - DNA, 1824 bp, Flaveria ramosissima
cagctaataagcaacatcaatgcgtgtatggccgtggctgatgtcgtccgtacaaccctaggtcccaggggtatggataaattgatccatgatgacaagggtaacaccactatttctaacgatggagccactatcatgaagcttcttgacattgttcatcccgctgctaagatccttgttgatatcgctaagtcacaggattcggaggttggtgatggaaccactactgtagttctccttgctggtgagttcttgagagaggccaagccgttcattgaagatggtgttcatcctcaaaatctaatacgaagttatcggtccgcttccaatatggctattgagaagattaaagagttagctgtaagcatagaggggaaaagtttagatgaaaaaagaagcttattggctaaatgtgctgctacaacactctcatcgaagctaataggaggagagaaggacttttttgcaacaatggttgtggatgctgtcattgcaattggatatgatgatagactgaacatgattggaataaaaaaggttcctggtggtacaatgagggattcctttcttgtgaatggtgttgcttttaaaaagaccttttcatatgctgggtttgagcagcaacctaagaaatttcaaaatccaaagatattactgttgaacattgagcttgaactaaaatcagaaaaagaaaatgccgagataagactttcagatccgttgcaatatcagtccatagttgatgcagaatggaatatcatatatgataagttggataaatgtgtaaagagtggtgccaaaattgttttgtcgcgtctggctattggtgatctggcaacacagtattttgcggaccgggatatattttgtgctggtcgagttgctgaagatgatctgcatcgtgttgcagctgcaactgggggtatggtacagacatcggtcaacaatgttatagatgaggttcttgggtcttgtgaggtatttgaggaaaagcaagttggaaatgaacggttcaacatatttagtggatgtccttcaggccagacagccaccattgttcttcgaggaggagctgatcagttcattgaggaagctgagcgcagtttacatgatgcaatcatgattgtgaggagggccatgaaaaattccacagtggttgccggtggtggtgcaatagatatggagataagccggtacctgtggcaacatgcacgcaatatagctggaaagtcccaattatttataaatgcctttgctaaagcacttgaggttattccacggcaactttgtgataatgctggatttgatgcaactgatgtactcaacaaactgaggcaaaaacacgcactcccttctggtgaaggtgctctttacggagtagatatcaacacaggtggaatttctgattcatttgccaactttgtgtgggagccagcagtggtaaagatgaacgctataaatgctgcaacagaggcagcatgccttgtcttaagtgttgatgaaacagtgaagaacccaaagtcggagagtgcacaaggagaagctgctgctggcatgggtagaggacgtggtggtggtggtatgcgtggaagaggtatgcgtagacgttgaacgtggtataatatcatttaagtttgaaccttactgtgagatgtagttttgagtgaggattttcttccgacctattatactgttttgttggtgtatttgttctgttctgtatgggggtttcattctaaacagaatttgtagttggttgaagcagttgaagtcgatttctataaacattgttctagttattgtattaactgaggaggaggtagt

SEQ ID NO: 2124 - DNA, 1951 bp, Cucumis melo
ggtaagcaacatcaatgcctgcacagcagtggccgatgtggtgcgtaccaccttgggacctagaggtatggacaaactcatccatgacgataagggtaatgtcaccatttctaatgatggcgctactattatgaagcttcttgatattgttcatcctgctgctaagatccttgtggatatcgctaagtcgcaggactccgaggttggtgatgggacaacaactgttgttcttctcgctgctgagtttttgaaggaggccaagccttttatagaggatggagttcactctcaaaatttaatacggagctataggactgcaagctatttggcaattgagaaagtaaaagagttggcaatcagtatagaggggaagagcttggaggaaaagaaaagcttgttggctaaatgtgctgcaacaacactttcatctaagctcattggcggagagaaggatttctttgcatcaatggttgttgattctgttattgctattggcaatgaagataggctaaatatgattggcataaagaaggttcctggagggaccatgcgtgactccttcttggtaaacggtgttgccttcaagaagacattttcttatgcaggttttgaacagcagcctaagaagttctcaaatccaaaaattctcttgctaaatattgaattggaattgaaatcagagaaagaaaatgcagagatacggctctccgatccgtcacagtatcagtccattgttgatgcagaatggaatattatttatgaaaaattagacaaatgtgtagagagtggagccaaggtggttctttcacgtttggctattggtgatcttggcacacagtattttgcagaccgagatattttctgtgctggccgtgtggccgaggaagatctacaaagggttgctgctgcaactggtggaactatacagacatctgttaacaacgttattgatgaggttcttgggacatgtgaggtttttgaggaaaagcaagttggtaatgaaagatataatatattcagtggctgcccatcaggtagaacagccaccatagtccttcgaggcggagccgatcagtttattgaagaagcagagcgtagcttgcacgatgcaatcatgattgtaagaagagcactgaaaaattctactgttgttgctggtggcggagcaatagatatggagatcagtcgatatttgaggcaacatgcacgcacaatagctggcaagtctcaactttttatcaactcatatgccaaagctcttgaggttatccccagacaactgtgtgacaatgctgggttcgatgctactgatgtgctcaacaaattgcgacaaaagcatgctcatccttcaggtgagggtgcaccgtttggggtggacatcaacactggtggagttgccgattcatttgcaaactttgtatgggaacctgctgttgtgaagataaatgctattaatgctgctacagaggcagcttgtctcatactaagtgttgacgaaactgtgaagaatcccaagtccgagagtgcacagggggaagctgcagccagtgccatgggtggaagacgtggtggggctgcattccgtgggcgtggacgtggaatgcgaagacgataggcaatttcattgtcacgagaagcacagtttggttagttcaatttttttttttttatctttttgcctgcgtgtgcttttcaaattgtagtagaatcagattttaatcttatttggccaatagacaaaaccttgagttatacatccgttgggaattaatttggtcatatagtactttacgggtggagagtgattttgatggcatctgattgcccttttttcttctttccttttgtggaccctacatattcattttgtagttttgaattatttgtagagaaacatttcttcttttctttttctttttcttgaattatagatctgttatgttaaaaaaaa

SEQ ID NO: 2125 - DNA, 2279 bp, Pinus taeda
tcttcatctaggttgtgaaattctagaagagttctcattccctttagtctttgctactctctctctactgtaaagcttcaacactccaccaggaagcagggttttaagggttttaagctactttctttgttatcttcggtcctctgcatcttcgccatgtcgactatgctgcaaccccaaataatcttgctcaaggaaggcacagacacttcccagggaaaggctcagctgatcagcaacataaatgcatgcatggccattgtcgatgctgtgcgtagcacgctcggcccgcggggcatggacaagctcattcatgacgacaagggcactaccacaatttctaatgacggggcgactattatgaaacttctcgacattgttcaccccgcggctaaaattctggtggacattgctaaatctcaggattctgaggttggcgatggaactacaactgtcgtactttttgcgggagagtttttgaaagaggcaaaaccttttattgaagatggagtccatcctcagaaccttattcgaagctttcggacagcagcttatttggcaatcaacaaagttaaagagcttgctgttagtatagaaggaaagagtattgaagaaaagaagggtcttctggagagatgtgctgcaactacactttcatcaaaacttattggtggggagaaggaattttttgcaaagatggttgtcgaagcagttatttcaattggtcaagaagatagattgaatatgataggcataaagaaggtacaaggaggaaacatgcgtgattcatttttagtgaagggtgttgcttttaaaaagacattttcatatgctggttttgaacaacaaccaaagaagtttctgaacgttaaaattcttcttctaaatgttgagttggagcttaaatcagaaaaggaaaatgcagaagtcaggctgtcagatccaacaaaatatcaatcaattgtagatgcagaatggaatattatatatgataaactggacaagtgtgtaaaaagtggggctaaaattgtgctatctcgattggccatcggtgatctggcaactcaatactttgcagatcgagatattttctgtgctgggcgtgtaacagaggaagatctacagcgtgttgctgctgctactggtggatcagtgcaaacttctgtgaataacattgtgcctgaggtacttggaacctgtgaactttttgaagaaagacaagttggcaatgagcgattcaatatattcagtggatgcccatctggcctgactgcaacaatagttttacgaggtggtgcagatcagttcattgatgaggcagagaggagcttgcatgatgccatcatgatagttcggagagcaatgaagaattctaccattgtttctggtggtggtgcaattgatatggagattagcagatatttaagacagcatgctcgaactatagcaggaaagtcacaattatttatcaattcctatgcaaaagctcttgaggttattccacgccaactctctgaaaatgctggttttgatgcaacagatgtgctaaacaagctgagacagaagcatgctctcccatctggtgagggtgcaccttatggagtggatatcaatacaggaggtattactgattcttttgcaaactttgtatgggagcctgctgttgtaaagataaatgcaatcaatgctgccacagaagctgcttgtctcattttgagtgtggatgaaacggtgaaaaatccaaagtctgagagtgctcaaggagaaggggcagcaaatgcaatggctggacgaggtcgtggtggtggcttccgtggtcgaggtcgaggcatgcgtaggcgatgagagaattggagctcgttggtgggtgccattatagtggagttgggttgcttggagtagtcagttttgtagtcatgctgaagagatgaatgttttgcatgcattcctctttaaacacagggatgtcatcatggcaaacaatctacttggtttttaattttgtattgcaggtgatctcattttttccatgatgacttatcaccgttgagattgtttggtgggtactagttttaaatagttttcctctggatgcattttctgaagcatacatttctgctccagttgtattccttgaacagcgacagaatctatctgaagactcatctatattgtatgtttgacttgtcactagaagaatgagttgcatgtaataacccaattaatttcacatgatgttgatgaaagtgcaggttagataatctgctgttgcatttttt

SEQ ID NO: 2126 - DNA, 2045 bp, Podocarpus macrophillus
gcaaccgcaaataattttgttgaaggagggcaccgactcctcgcaaggaaaaccgcagctgatcagcaacatcaatgcctgcactgccattgtggacacggttcgaaccacgctgggccctcgcggcatggacaaactcatccacgatgacaggggctctattaccatttccaacgatggtgccactatcatgaagcttcttgatattgttcatcctgccgctaaaattcttgttgacatcgccaagtctcaagactctgaggttggtgatggaactacaactgttgttattcttgcgggagagttcttgaaagaggcaaaacctttcatagaagagggagtccatcctcagaaccttattcggagttatcggacagcagcttacttggccatcaacaaagttaaggagctgtctgtcagtatagaaggaaaaagtcttgaagaaaagaaaggtcttcttgagaaatgtgctgaaacaacactttcatctaaactgattggtggagagaaggaattctttgccaagatggttgttgatgctgtgattgcaattagtcaagaggatagattgaacatgataggcattaagaaggtacaaggaggaaatatgcgagactcatttctagtgaaaggtgttgcttttaaaaagacattttcttatgctggttttgaacaacaaccaaagaaatttttgaaccctacaatactcctattgaatatagagctagaacttaaatcagagaaagaaaatgcggaaattaggctttcagatcctacaaagtatcagtcaattgtagatgcagaatggaatattatttatgataaattggataaatgtgtaaagagtggggcaaaaattgtgctatctcgattggcaattggtgatttgggaactcagtactttgccgatcgagatgttttctgtgcgggtcgtgtagcagaggaggatctacagcgtgttgctgctgccaccgggggatcagtgcagacctctgtgaacaatattgtgcccgaggtgcttggaacatgtgagtgttttgaagagaagcaagtgggcaatgagcgtttcaatatatttagtggctgtccatctgggctaactgcaactatagttttacgtggaggtgcagatcagttcattgatgaagcagaaagaagtttgcatgatgccataatgattgttcgaagagcattgaagaactccactattgtagctggtggtggtgctattgatatggaaattagcagatatttaagacaacatgctcgaacaatagcagggaagtcacaactgtttatcaattcctatgcgaaagcccttgagattattcctcgtcaactttgtgataatgctgggtttgatgcaacggatgtactaaacaagctcagacagaagcatgcactcccatcaggtgaaggggctccttatggcgtggatataaatacagggggcattgcagattctcttgcaaattttgtatgggagcctgctgtcgtaaagataaatgctattaatgctgccacagaagctgcttgtcttgttttgagcgtggatgagactattaaaaatcctaagtctgaaagtgctcaaggagaaggagcagcaaatgcaatggctggtcggggacggggtgctggcttccgtggtcgaggccggggtatgcgtaggcgttgaagtgtttgagataatagaaatctgtttcatagtacatgctattctagcggattcaggctgcttgaattggccagttttgtactatgctgatcgaatccctgatttgcatgtcttgttcatcttacatggatttttacgaaaaatggttacagaatttattatggaattttgtaattggcgggaaatcaatttaacaggatggcttagtgtcattgagattgtttttcgtttttgtatgttgtggctactagattacatgggttctctgattgtgtagacttccaagaatgtatttttgattcaaactattttcttgacttccaagaatatatgttttagccttgtctagatgtataatttgtctattcag

SEQ ID NO: 2127 - DNA, 2207 bp, Cedrus atlantica
gcctttgcattttcaccatgtcggccatgctgcaaccccaaattattttgcttaaggaaggcacagacacctcccagggaaaggctcagctgatcagcaatataaatgcctgcatggccattgtcgatgctgtgcgtagcacgcttggcccgcggggtatggacaagctcattcatgacgacaagggcaccaccaccatttctaatgacggggcgactattatgaagcttcttgacattgttcatcctggggctaaaattctggtggacattgccaaatctcaggattcagaggttggtgatggaactacaactgttgtactttttgcgggagagtttctaaaagaggcaaaaccttttattgaagatggagtccatcctcagaaccttatacgaagttttcgaacagcagcttatttggcaatcaacaaagttaaggagcttgctgtcagtatagaaggaaaaagccttgaagaaaagaaaggtcttcttgagaaatgtgctgcaactacactttcatcaaaacttattggtggggagaaggatttttttgctaagatggttgttgactccgttatttcaattggtcaagaagatagattgaatatgataggcataaaaaaggtgcaaggaggaaatatgcgtgactcatttttagtgaggggtgttgcttttaaaaagacgttttcatatgctggttttgaacaacaaccaaagaagtttctgaaccctaaaattcttcttctaaatgttgagctggagcttaaatcagaaaaggaaaatgcggaagttaggctgtcagatccaacaaaatatcaatcaattgtagatgcagaatggaatattatatatgataaactcgacaagtgtgtaaaaagtggtgccaaaattgtgctatctcgattggcagttggtgatctggcaactcaatactttgccgatcgagatattttctgtgcggggcgtgtagcagaggaggatctacagcgtgtttctgctgctactggtggatcagttcagacttctgtgaacaacattgtgcctgaggtacttggaacctgtgaacttttcgaagaaagacaagttggcaatgagcgattcaatatattcagtggatgcccatctgggctgactgcaacaatagtttacgaggtggtgcggatcagttcattgatgaggcagagaggagcttgcatgatgccatcatgatagttcgaagagcaatgaagaattctaccattgttgctggtggcggtgcaattgatatggaaattagcagatatttaagacagcatgctcgagccatagcaggaaagtcacaattatttatcaattcctatgcaaaagcccttgaggttattccacgccaactctgtgaaaatgctgggtttgatgcaacggatgtgctaaacaagctgagacagaagcatgctctaccatctggtgagggcgcgccatatggagtggatataaatacaggaggtattgctgattcttttgcaaactttgtctgggagccagctgttgtaaagataaatgcaatcaatgctgccacagaagctgcttgtctcattttgagtgtggatgaaacggtgaaaaatccaaagtctgagagtgctcaaggggaaggggcagcaagtgcaatggctggacgaggtcgtggtgctggcttccgtggtagaggtcgaggcatgcgcaggcgatgagagaattggagcttgttggtgggtgccattttagtgcagtcgggttgcttggagtaatctgttttgtacttgtgctgaagagaggaatgttctgtgtgcattcctctttacacacagggatgtcatcatggaaaacagttctacttattttcaattttgtattgtgggtgatctcattttttacaggatgacatcactgccattgagattatttgctgcttgctagatttgaatggattgccttttaggatgcattttctcaagcaatcacttctgctccagttgtatttcttgaacatcaacagaatatatttggagattcgctagattgtatgtttgacttgttagtagatgaatgagttgcatttaataacccaattaattgtaaatgatgttgatgaaagtgcgggttagataatctgctgttgcactttttacagtgcttgagactatttgactggaagcacctggagggccttgaaacttgtgttttctctgtgaa

SEQ ID NO: 2128 - DNA, 2139 bp, Abies balsamea
atagttttaagggttttacctaccttctttgtgttttttcggtccggcgaagcctctgcattttcgccatggcgggcatgctgcaaccccaaataattttgctcaaggaaggcacagacacttcccagggaaagtctcagctgatcagtaacataaatgcctgcacagccattgtcgatgctgtgcgtaccactctaggcccgcggggtatggacaagctcattcacgacgacaagggcaacaccaccatctctaatgatggggcaactattatgaagcttctcgacattgttcatcctgcggctaaaattctggtggacattgccaaatctcaggattcagaggttggtgatggaactacaactgttgtactttttgcgggagaatttctgaaagaggcaaaaccctttatcgaagatggagtccatcctcagaaccttattcgaagttttcgaacagcagcttatttggcaatcaacaaggttagggagcttgctgtcagtatagaaggaaagagtcttgatgaaaagaaaggtcttcttgagaaatgtgctgcaactacactttcatcaaaacttattggtggggagaaggatttttttgctaagatggttgttgaagctgttatttcaattggtcaagaagatagattgaatatgataggcataaagaaggtacaaggaggaaatatgcgtgactcgtttttagtgaagggtgtagcttttaaaaagacattttcatatgctggttttgaacaacaaccaaagaagtttctgaaccctaaaattcttcttctaaatgttgagctggagcttaaatcagaaaaggaaaatgcggaagttaggctgtcagatccaaccaaatatcagtcaattgtagatgcagaatggaatattatatatgataagctggacagatgtgtaaaaagtggtgctttaattgtgctatctcgattggcgattggtgatctggcaactcaatactttgcggatcgagatattttctctgcggggcgtgtagcagaggaggatctacagcgtgttgctgctgctactggtggatcagtgcaaacttctgtgaacaacattgtgcctgaggtacttggaacctgtgaactttttgaagaaagacaagttggcaatgagcgattcaatatattcagtggatgcccatccggacagactgcaacaatagttttacggggtggtgcagatcagttcattgatgaggcagagaggagtttgcatgatgccatcatgatagttcgaagagcaatgaagaattctaccattgtttctggtggcggtgcaattgatatggaaattagcagatatttaagacagcatgctcgaaccatagcaggaaagtcacaattatttatcaattcctatgcaaaagcccttgaggttattccacgccagctctgtgaaaatgctgggtttgatgcaacggatgtgctaaacaagctgagacagaagcatgctctcccagctaatgagggcggaccttacggagtggatataaatacaggaggtattgcggattcttttgcaaactttgtatgggagcctgctgttgtaaagataaatgcaatcaatgctgccacagaagctgcgtgtctcattttgagtgtggatgaaacggtgaaaaatccaaagtctgagagtgctcaaggggaaggggcagcaaatgcaatggctggacgaggtcgtggcggtggcttccgtggtcgaggtcgaggcatgcgcaggagatgagagaattggaaattgttggtgggtgccattttagtggagttggtagtcagttttgtactcatgctgaagagtggaatgctctgcttatttttcaattttgtattgtgggcaatctcattttgttccggatgacttcattgccaatgagactgtttgctggttactatatttaatgggttacctttttggatgcattttctcaagcattcacttctcctccagttgtattccttgaacatcaacagaatatatttggagattcatctagattatatgtttgacttgttagtaggagaatgagttgcatgtattagcccaattaattgtaaatgatgtcgttgaaagtgtggtttagataatccactgttgcactttttacgat

SEQ ID NO: 2129 - DNA, 1907 bp, Olea europaea
cgaccttttctacatctttctttcccaagcccttgagtgtccgaacaaaaacaggaacctgaaacctctataagaaagacttaaaaccctagaatcttctctctcaagctcccatctaacaatggcagctatgatgcaacctcaaataattctgctgaaggaggggacagattcatcccaagggaaaccacaattagtaagtaacataaatgcctgcatggctgtggcagatgtggttcggaccaccctcggtccaaggggtatggacaagttgatacatgatgagaagggaaataccactatttctaatgatggtgccacaataatgaagcttcttgacattgtacaccctgctgcaaaaatccttgtcgacatcgctaagtctcaagactctgaggttggtgatggaaccactacagtagttctgctcgcaggagagtgtttgaaggaggccaagccttttattgaagatggggttcatcctcaaaatcttatacggagttatcggacagcttctcaattggccattgagaagatcaaagaattagcttttagcattgagggaaaaagtttagaagaaaagaagagtttattaggtaaatgtgctgctacaacgctctcttcaaagctcattgggggtgagaaggaattcttcgcatccatggttgtggatgctgtcattaccattggaaatgatgatcgactgaatatgattgggattaagaaggttcctggaggtaacatgagggactcttttcttgtaaatggtgttgccttcaaaaagacattctcgtatgctggttttgaacagcaaccaaagaaatttgtgaatcccaaaatacttttgctgaatatagagttggagttaaaatctgagaaagaaaatgcagagataagactgtctgatccattacagtatcagtcaattgttgatgcagaatggaatattatttacgacaagttggataaatgtgtaaaaagtggagccaaaattgttttgtcacgacttgctattggtgatctggccacacagtattttgcagaccgagatatattttgtgcaggtcgtgtgactgaagaagatctgcagcgggttgcagctgctactggtggaactgtgcaaacaactgtgaataatataattgacgagatacttggatcttgtgagctttttgaggagagacaagttggaaacgaacggttcaatatatttagtggatgcccatcaggtcagactgctactattgttcttcgtggtggagcagatcagttcattgaagaggctgaaagaagtttgcatgatgcaataatgattgttaggagggctctgaaaaattctactgtagttgctggtggcggtgctattgatatggaaataagtcgatacttaaggcagcatgcacgcacaatagctgggaaatcccagctcttcataaactcttacgccaaagcacttgaggttattccacgacagctgtgtgacaatgctggttttgatgcaactgacgttttgaacaaactgagacagaaacatgctcttccatccggtgagggtgcaccttatggtgtagatattaacactggtggaattgctgattcattcgccaactttgtctgggagccagcagtcgtgaagataaatgcagtaaatgcggccaccgaagcagcttgccttgtcttaagcgttgatgaaaccgtgaaaacccaaagtctgagagtgcacaaggagaagctgctgcaagcgctatgggcggcagagggcgtggtggagctgcttttcgggggcgtgggcgtgggatgaggaggcgataggctctttgaagcttctcttaccttcccaactcatttcagttttgttcttttgtctctgcatttgttaattttgtaacttaagcatgtggagtggt

SEQ ID NO: 2130 - DNA, 2352 bp, Nicotiana benthamiana
actgttcccactctttagcgaacgaactagaaaaagtataaaccctaacgagtagggaaaaaccctagaaagttccacttgtacccaggcttctgcttcttcggccatttgctaactcaccaagtagcctgctttctcgctcaattgatctccctcgccatcaacaatggcgtctatgatgcaacctcagatcatattgctgaaggaagggactgatacatcccaagggaaggcacagttggtgagcaacataaatgcttgtatggctgtggctgatgtggtgcgtaccacccttggtcctaggggtatggacaagctgatccacgacgagaagggaaacacgactatttcgaatgatggtgccactataatgaagcttctagacataatacatcccgctgcaaaaatacttgttgacatcgccaagtcccaagactctgaggttggtgatggaaccactacagtagttctgcttgcaggagaatttttgaaggaagccaagccttttattgaagagggtgtccaccctcaaaatcttattcgcagttatcgagccgcttctaatatggcaatagagaaggtaaaagaattggctgttagcattgagggaaaaagtttggaagaaaagaaaagtctgcttgcaaagtgtgctgctacgactctgtcgtcgaagcttattggaggggaaaaggaattctttgcacccatggttgtggatgccgttcttgcaattggaaatgatgataggctgaacatgattggaattaagaggtggccggaggtaatatgcgggattctttccttgtaaatggtgttgcctttaagaagacattctcctatgctggttttgaacagcagccaaagaagtttgtagaccccaagatacttttactgaacatagaggcctttaagaagacattctcctatgctggttttgaacagcagccaaagaagtttgtggaccccaagatacttttactgaacatagaattagagctaaaatcagaaaaggaaaatgcagagataaggctttcagatccagcgcaatatcaatcaattgttgatgcagagtggaatatcatttatgacaagttggataaatgtgtaaagagtggggccaaagttgtgttgtctcgacttgctattggggatctggccacacagtattttgcagatcgggatatattttgtgctggtcgtgtcgctgaagaggatctgcagcgggtagcagctgccactgggggaacagtacagacaactgtgaataatgtcattgatgaggttcttggctcttgtgagctttttgaggagaagcaagttggaaatgagagattcaatatattcagtggatgtccctcgggcaagaccgccactattgtccttcgtggtggagcagatcagttcatagaggaatccgagagaagcttgcatgatgctattatgattgttagaagggctttgaaaaactctacagtcgttcctggaggtggtgctatagatatggaaataagccgtttcttgaggcaccatgctcgaacgatccaagggaaatctcagctctttataaactcttatgcaaaagctcttgagattattccacggcagctatgtgataatgctgggtttgatgcaactgatgtgctgaataagctcagacaaaaacacgctcttccatctggtgagggtgcaccttatggagttgacatcaatactggtggcattgccgatgcgtttgccaactttgtttgggagccagcagtcgtgaagattaatgccattaatgcagccacagaagcagcatgcctcattttgagtgtggatgagacagtgaagaatcctaagtccgagagtgctcaaggagatgctgctgccagcgctatgggtggtagagggcgtggaggtggtcgtggccgtggaatgaggcgacgatagatttcacaagttctttgcagattttgctatgattttcatttagacttttttgcattgttcagtcctgctgggatgaaatcgaaagaatgcaaggaaatgaaagatgggaagcaaggtggttgaccccttgatggtatgccatctttgtatgtgatgattcccaaaattggtgtctaaattttggctgatgagtttatttttatttgtgaactaatttcccggttttgcaactgtcatatttccatcggctgctaatgtaatgtatttctagttgtctcccctgtcgtagtgagatcagtgcagaactcccttgtaagccaatggagaaaaatgcatccttgaccaaaatgttaaaatttggacattgattcttttgtagttgtcgaaaaagatcaaagcattattatgttaataatctgg

SEQ ID NO: 2131 - DNA, 1967 bp, Gnetum gnemon
gtcgaaatggcggccatgctgcaaccgcaaataatattgctgaaggagggcacggatacatcgcaggggaagccgcagctaataagcaacataaatgcttgtactgccattgccgacactgtgcgaacgacgctgggccctaggggcatggataagcttatctatgatgagaagagcactaccatttccaacgacggtgctacgataatgaagctcctcgacattgttcaccccgctgcaagaattcttgtcgatatcgccaagtcccaggactctgaggttggcgatggaacaacaacagtggtacttcttgcgggagagttcctgaaggaagcaaaaccttttattgaagatggagtgcatcctcagaaccttattcggagctttcgcacagcctcatatttggcaattaacaaagtaaaggagatagcttttagtatagaagataagagccttgaggaaaagaaaaggctgctggaaaaatgtgcacgaactacgctttcctctaagttgattggaggggagaaagaattttttgctcagatggttgttgaagctgttattgcaattggtgaagaagacagattgaatatgataggcattaaaaggttcaaggtggaaatatgcgagattcatttttagtaaagggcgttgcatttaaaaagacattttcttatgctggatttgagcaacagccaaaaaagtttgttgatccaaaaattcttcttctgaatgttgaacttgaacttaaatcagagaaagaaaatgctgaagtcagactttcagatccaaccaaataccagtcaatcgtggatgcagagtggaatatcatctatgataagttagagaaatgtgtgaaaagtggtgcggaaattgtgctttccaggctggcaattggtgatttggcaactcagtactttgccgatcgggatatcttctgtgctggccgtgttactgaggaagacttacaacgtgttgctgctgctacaggtggtgcagttcaaacaactgtgaacaatatcattccggaggtattaggtagctgtgaactatttgaagagaaacaagtgggcaatgaaaggtttaatatattcagtggatgcccatctggccagactgcaaccatagttttgcgtggtggagcagatcagtttattgatgaagcggagagaagtttgcacgatgctatcatgatagttcgaagagccttaaagaactccacaattgttcctggcggtggtgcaattgatatggaaattagtagatatttaagacagcatgctcgcacaattgcgggcaagtcacagttatttatcaattcttatgctaaggcccttgaggttattcctagacaactttgtgaaaatgctggatttgatgcaacagatgttctaaacaagcttagacaaaagcatgcccttccgtcgggtgagggtgaatcatttggagtagacataaacgcaggaggtatttgtgattcccttatgagctttgtatgggagcctgcagttgtaaagataaatgcaatcaatgctgcgacagaagctgcgtgtctcatattaagtgttgatgaaactgtgaaaaatccaaagtcagagagtgctcaaggagaaggagcggcaaatgcacttgctggacgaggacgtggtggaggttttcgtggtagaggccgagggatgcgtcgacgatgagcttctttgtttctttttgtcagttgtgtgttattattaaatattttctgaacaaaaaatgatcagggaaagtactctggtagttttgcggctgcctgcttgtagaggtgcttttaaatgcatatttctttcggaatgtgttttgaaggacagtttttaacactaccgtgtttgtcctctattgaggtccttttgatatttactcggtgttgcatgccctaccttctttacatgttttatttctcaattacaaggaaattaattcatgacaactga

SEQ ID NO: 2132 - DNA, 2303 bp, Prunus persica
ccagaagtcactttgaacataaaaccctagctctctctctctctctctctctctctgatttgaacactacctttactctcactccctctctctgtctctgtttctgtctctctcttcccctcttgtccgcgtgaacatctacatcggcaacaatgtcatccatgctgcaaccccagatcatactgttgaaggagggaacggacacgtcgcaagggaaggcgcagctggtgagcaatataaacgcttgcacagcggtggccgatgtggtgaggaccacgctggggcctaggggcatggacaagctcatccacgacgacaagggcagcgttactatttccaacgatggcgccaccatcatgaagttgcttgatatagttcaccccgccgccaagatccttgtcgacatcgccaagtcgcaggactctgaggttggtgatggaacaacaacagttgttctgcttgcaggggagtttttgaaggaggccaagcctttcatagaggatggggtgcacccacaaaatttgataagaagttatcgaaccgctagctatttggcaattgagaaaatcaaagaacttgctgtaagcatagaggggaaaagccttgaagagaagaaaacactgctagctaaatgtgccgctactacactttcttcaaaacttattggtggagaaaaggatttttttgcatccattgtcgtggatgctgtcatcgcaattggtgatgaagatcgtctcaacatgattggaataaagaaggtttctggtggcaacatgcgtgactcctttttagtaagtggtgttgccttcaagaagacattttcatatgctggttttgaacagcaaccaaagaagtttcttaatcccaaaatacttctactaaacattgaattggaactgaaatctgagaaagaaaatgctgagataagattgtcagatccatcccagtatcagtccattgttgatgcagaatggaatattatttatgacaagttggataagtgtgtgcagagtggggccaaggtagttctttcacggctggctataggtgatctagcaacacagtattttgcagatagagatatattctgtgctgggcgtgtaactgaagaagatctccaacgggtagctgctgccactggtggcactgtgcagacatccatcaacaatgttattgatgaggtccttggaacatgcgagtgttttgaggaaaagcaagttggaaatgagaggtttaatatatttagtggatgtccgtcgggtaggacagctacaattgttcttcgtggtggagctgatcagttcattgaggaagctgagcggagtttacatgacgctatcatgattgttagaagagcgctaaaaaattcgactgtagttgctggtggtggtgctatagatgttatcccacgacaactctgcgacaatgcgggatttgatgcgactgatgtgttaaacaaacttagacagaaacatgcgcttccatctggtgagggtgcactttatggagtggacatcaacacaggtggaattgctgattcatttgctaactttgtctgggagccagctgttgtgaagatcaatgctataaatgctgctacagaggctgcttgccttgttttaagtgttgatgagacagttaaaaaccctaagtccgagagtgcgcagggagaagctgctgcgagtgccatgggaggtagagggcgtggaggtggtcttcgtggtcgtgggcgagggatgcgaaggcgatagttgtgagagttttctcaaaggtggttaaagcatacagttttgtcattctggtttatggtgtgcttacacattgtacttccatttgaatggactgatgaacgtggctgtatcaacttgcatacctgaatgattcgcttctcaaatggctgagaactgtttgtggattctgagaatgatagtcttatgttagttggatgtgcaaattagtaacttgtgggtagctgcaacgtaccaagagttgtgatatatttggctagtgtttttgttctggcattgaactaagacaaattttgggacctctaggtccattttccctctaccctgtgttctcttaatacacgatgaaatttgtattcgtggcttctttgggatatgcagtagcatagcctgtctggacgtgcttctgtaggaagtgcttctgcttggtagccgttctggaagtgcttttgttagaagcatgttgaatcatttattacaagttcagttgaagtgcgttctgcaatggactaaaatgtgctcaacgcttttaaataaaagctcttttcgcacctt

SEQ ID NO: 2133 - DNA, 2156 bp, Pseudotsuga menziesii
ttttaagctaccttctctgttgtattgggtccggcgaagcatctgcattttcgccatgtcgaccatgatgcaaccccaaataattttgcttaaggaaggcacagacactacccagggaaaggctcagctgatcagtaacataaatgcctgcacggccattgtcgatgctgtgcgtagcacgcttggcccgcggggtatggacaagctcatccatgatgacaaaggcaccaccaccatttctaacgatggggcgactattatgaagcttctcgatattgttcatccagcggctaagattctggtggacattgccaaatctcaggattcagaggttggtgatggaactacaaccgttgtactttttgcgggagagtttctgaaagaagcaaaaccttttattgaagatggagtccatcctcagaaccttattcgaagttttcgaacagcagcttatttggcaatcaacaaagttaaagagcttgctatcagtatagaaggaaagagtcttgaagaaaagaaaggtcttcttgagaaatgtgctgcaactacactttcttcaaaacttattggtggggagaaggatttttttgctaagatggttgttgatgctgttatttcaattggtcaagaagacagattgaatatgataggcataaagaaggtacaaggaggaaatatgcgtgactcgtttttagtgaagggtgttgcttttaagaagacattttcatatgctggttttgaacaacaaccaaagaagtttctgaatgcaaaaattcttcttctaaatgtcgagctggagcttaaatcagaaaaggaaaacgcagaagttaggctgtcagatccaacaaaatatcaatcaattgtagatgcagaatggaatattatatatgataaactggacaattgtgtaaaaagtggggcggaaattgtactatctcgattggcgattggtgatctagcaacacaatactttgctgatcgagatattttctctgcggggcgtgtagcagaggaggatctacagcgtgttgctgccgctactggtggatcagtgcaaacctctgtgaacaacattgtgcccgaggtacttggaacctgtgaagtttttgaagaaaaacaagttggtaatgaacgattcaatatattcagtggatgctcatctgggcagactacaacaatagttttacgaggtggagcagatcagttcattgatgaggcagagagaagtttgcatgatgccatcatgatagttcgaagagcaatgaagaattctaccattgttgctggtggtggtgcaattgatatggaaattagcagatatttaagacaacatgctcgaaccatagcaggaaagtcactattatttattaattcatatgcaaaagcccttgaggttattccacgccaactttgtgaaaatgctgggtttgatgcaacggatgtgctaaacaagcttagacagaagcatgctctcccatctggtgagggtgcaccttatggagtggatataaatacaggaggtattgctaatactattgcaagctttgtatgggagcctgctgtcgtaaagataaatgcaatcaatgctgccacagaagctgcttgtctcattttgagtgtggatgaaacggtgaaaaatccaaagtctgagagtgctcaaggagaaggggcagcaaatgcaatggctggacgaggtcgtggtggtggcttccgtggtcgaggtcgaggcatgcgcaggcgatgagagaatttgagcttgttggtgggtgccattttagtggagttgggttgcttggagaagttaattttctactcccgctgaagagatgaatgttctgcatgcatttctctttgcacaaaggaatgtcatcatggaaaacatttctacttattttcaattttgtattgtgggtgatcttttttcttccaggatgactttatcaccgttgagattgtttgctggttactagatttaaatgggttgcctttttggatgcattttctcaagcattcatttctgctccagttattttccttgaacatcaacagaatatatttggagactcatctagattgtatgtttggcttcttagaggaagtatgagttgcatgtaataacctaattaattgtaaatgattttgatgaaactgagggc

SEQ ID NO: 2134 - DNA, 1914 bp, Ambrosia trifida
taattaaacactcactactgaaacactaaaacccctaatttcacccctctgcataaccaccaccgttctccgccgcaccaaatccgctaacaatggcatcaatgatgcaaccacagatcatactattaaagaaggcacagacacatcacaaggaaagccacagctaataagcaacatcaatgcgtgtatggcggttgctgacgtcgtccgtacaaccctaggtcctcgaggtatggataaattaatccatgacgacaaaggtaacaccactatttccaacgacggagctactattatgaagcttctcgatattgttcatcctgctgctaagatccttgttgatattgctaaatcacaggattctgaggttggtgatggaaccactaccgtagttctccttgctggtgagtttttgagagaggccaaaccattcattgaagatggtgttcatcctcaaaatctgatacgaagttatcgagctgcttccaatatggcaattgagaagattaaagaattagctgtaagcatagagggaaaaagtttagacgagaaaagaagcttattagctaaatgtgctgctacgacgctctcatcaaagttaataggtggagagaaagacttttttgcaaaaatggttgtcgatgccgtcattgcaattggaaatgatgatagattgaacatgattggaataaaaaaggttcctggtggtacgatgagggattcctttcttgtgaacggcgttgcctttaaaaagaccttttcttatgctgggtttgagcagcaacccaagaagtttgaaaatccaaagatattactgttgaacattgagctggaactaaaatcagaaaaagaaaatgctgagataaggctttcagatccgttgcaatatcagtctatagttgatgcagaatggaatatcatatatgataagttggataaatgcgtgaagagtggtgccaaaattgttttgtcgcgtctggctattggtgatctggcaacgcagtattttgcagaccgtgatattttttgtgctggccgcgttgctgaagatgacctgcaccgtgttgcagctgcaaccggaggtactgtccagacatcggtcaacaacgttatagatgaggttcttgggtcttgtgatgtttttgaggaaaagcaagttggaaatgaacggttcaacatatttagtggatgtccttcaggccagacagccacgattgttcttcgaggtggagcagatcagtttattgaagaagctgagcgcagcttacacgatgcaattatgattgtgaggagggctatgaagaattccacagtggttgctggtggcggtgcaatagatatggagataagccgatacctgtggcaacatgcgcgcagtatagctgggaagtcgcagctttttataaacgcctttgctaaagcacttgaggttattccacgtcaactttgtgataatgctggattcgatgcaactgatgtactaaacaaactgaggcaaaaacacgcacttccttctggtgagggtgctctttacggagtagatatcaacacaggtggaatttgtgattcatttgccaattttgtgtgggagcctgcgttggtgaagataaatgctataaatgctgcaacagaggcagcatgccttgtcttaagtgttgatgaaacagtgaagaacccaaagtcagagagcgcacaaggagaggcggctgctggtatgggtagaggccgtggcggtggcatgcgtggaagagggatgcgcaggcgttaagcatcttcattgtggtatttaaacgtttaacctactactactgctttgctgggtttttttttcttctgtatggaactagttgccccgaggtttattttaaaaacatttgtaggtagttgaagaatttcaaagttgattttgtaaaa

SEQ ID NO: 2135 - DNA, 1742 bp, Festuca arundinacea
acgacggcgccaccatcatgcgcctgctagacatcatccaccccgccgccaaggtcctcgtcaacatcgcaaagtcacaggactccgaggttggcgatgggacaactactgtggtgcttcttgcttcggaattcatgaaggaagcaaaaccttatgttgaggatggagtgcaccctcatagtctaatccgtagctataggattgctggcaacatggcgatccaaagggtcaaggaactggcagtcagcatagaggggaaaagcctggaagagaagaaatcgttgttagccaagtgtgctgccacaacactctcgtctaaactgataggcggggagaaagaattctttgcttctatggtagtggatgctgtccttgccatcggacatgatgacaggcttaaccttattggaattaagaaggttcctggaggtaccatgagagattccttccttgtcaatggtgttgctttcaagaagacattttcgtatgctggatttgagcagcaaccaaagaaattcctgaatccgaagattctgttgttgaacattgagctagaattgaagtccgagaaagaaaatgcagagatcagattgtcagaccctctacagtaccaatcaattgttgatgctgaatggaacattatttacgacaagttggacaagtgtgttcagagtggggcaaaaatagttctgtcgcggctagctattggtgatcttgcaacacagtattttgcagaccgagacattttctgcgctggtcgtgtcacagaagaggatttgcaacgcgtaagctctgcttcaggcggaactgttcagacatctgttaacaatgtcattgatgaggtccttggcacatgtgaggtttttgaggaaaaacaagtaggcaatgaaaggttcaacatatttagtggctgcccatctggtcagactgcaactattgttctacgtggtggagctgatcagttcatagaggaagctgaacgaagtcttcatgatgccatcatgattgtgaggagagctgttaagaattcaacagttgtgcctggtggtggtgccattgatatggagataagcaagtatctccgacagcatgcacggacaatagctggaaagtctcagttttttgtgaattcatttgctaaatctctcgaggttattccaaggcaactttgtgataatgctggatttgacgcaactgatgtgctcaataagcttaggcagaagcatgcatctggtgatggtgctaattatggtgttgatatcaacactggtggaattgcggattctttcgctaattttgtgtgggaacctgctgttgttaagattaatgcgatcaatgctgcgacagaagctgcctgccttattctgagtgttgacgaaacagtgaaaaacccaaagtcggagagcgcacaaggtgatgccgctgcgatgggtgggcgtggtggtggtggaatgcgaggacgaggcgggaggggcatgcgcaggcggtaattctagtcaagtgtgtcctgtaatgttgttctgccctgccgggtcaggttttgagttccctttgtatgcgccatcggtcctcattacctgcatccaggttgtggaatttgtatgtctagtgcgagaatttctagtgttgaaaatgtgctatgtttttttctgggtgtttttttttctatgtagcttttaccaggttgtggtattatagcacgttctacctatacttgctcattcttggcgatcggtcttttc

SEQ ID NO: 2136 - DNA, 1856 bp, Allium cepa
tagttacggggttttgttctgtttagttataacatgtctatgctacaaattttgattgccattcatatcaacgcttcgaccatgtgctctccgcacactagtacataaatcaaaaccctagcgctaaactaatccaacaactcagtccggatttacaaatacctaactgaaaccattaaggaacctagaaccaactagatcaattctgagcctgctactctcacttcagaaactgtaataactcgctcgctacatttttccgtctctcgttcaagccctaaccaaaccctagatcttaagaaatttctagaaatcgaaaacaatgtcgtcaatgctacagcctcagataatccttctaaaagaaggcactgacacatcccagggtaaggcgcaagtgatcagcaatatcaacgcctgcaccggcgtcgccgactgcgtccgtacaaccctcggtccacgtggcatggacaagcttattcacgacgacaaggggaatacgacgatatcgaatgacggtgccacgatcatgaaactgcttgatattgttcatcctgctgctaagattttggttgatattgccaagtctcaggattctgaggttggagatggtacaactacagtagtactccttgctggagaattcttgaaagaggcaaaaccatttatcgaagatggagtccatcctcagaatctcattaggagctatcgtgctgcaagcaatttggccataaacaaagttaaagaacttgctgtaagcattgaagggaagagccttgaagaaaagaaatccttgttggcaaaatgtgctgctacaacactttcatcaaaattaattggcggggagaaggaattctttgctactatggttgtagatgctgtacttgctattggaaacgacgacagattaaatttaattgggattaaaaaagttcccggtggcaccatgagagattcattcctcgtcaatggcgttgcttttaaaaagactttctcatatgctggctttgaacaacagccaaagaaatttctcagtccaaagatacttctgttgaacgttgaactagaactgaagtcagaaaaagaaaatgctgagatcagattgtctgatccattgcaataccaatcaattgttgatgctgagtggaatatcatttatgataaactagataagtgtgttcagagtggagcgaaaattgttctctcaagattggctattggcgaccttgcaactcagtattttgcagatcgagatatcttttgtgctggtagagtagctgaagaagatttgaaacgtgttgctgctgctacaggtggaactgtccagacttctgttaacaatatcattgatgaggttatggggtgttgtgaagtttttgaagaacgacaagtagggaacgagaggttcaatatattcagtggctgcccatctggtcaaactgcaactattgtcctccgtggtggggcagatcagttcattgaagaagctgaaaggagtctgcatgatgctatcatgatagtaagaagggctgtaaagaactccactgttgtcgctggtggtggcgctattgatatggagattagtggatatctacgacagcatgcacgaacgatagctggaaagtctcaactttttataaattcatttgccaaggccctcgaggttattcctagacaactatgtgacaatgctggttttgatgcaaccgatgtcttgaataaactcagacagaagcatgcatctggtcaaggtgcgaactatggtgttgacatcaacactggtggaattacagattctttcgcgaattttgtatgggaaccttctgttgttaagataaatgctataaatgctgctgctg

SEQ ID NO: 2137 - DNA, 1764 bp, Brassica napus
cacgctcgggccgcgtgggatggacaagctcatccacgacgataagggatccgtcaccatttccaacgacggcgccaccatcatgaagctcctcgacatcgttcaccccgccgctaagatcctcgtcgacatcgccaaatctcaagactcagaggtaggtgatgggacgactacagttgtgcttcttgcagctgagtttttgaaggaggctaagccgtttgttgaggatggtgttcactctcagaatctcattaggagttatcgcactgcgagcactttggcgattgagaaggtgaaagaactcgctgttagcattgaggggaagagtgtggaggagaagaaaggtctgttggctaagtgtgcggctactactctttcgtcgaagcttattggtggagagaaggagttttttgctacaatggttgttgatgctgttatggccattggggatgacgacaggcttaatttgattgggatcaaaaaggttcctggtggtaacatgagagactctttcctagttgacggtgtggctttcaaaaagacattctcatatgcgggttttgaacaacagccaaagaagtttcttaatccgaaaatccttcttcttaacatcgagctggagttgaaatctgagaaggaaaacgctgagattaggctatcggatccatcacagtaccagtcaatagtcgatgcagaatggaatatcatttatgacaagctagacaaatgtgtcgaaagtggagcaaaagttgttctttctcggttggctattggtgatctagctactcagtattttgcagatcgtgatattttctgcgctggccgtgtagcagaagaagatcttaatcgcgtggctgctgccgctggtggaacagtccagacaagtgttaacaatataatacccgaggttctcggaacttgtgagatatttgaggaaaaacaagttggtggggagaggtttaacatattcagtggttgcccttcaggacgtacagcaactattgtccttcgtggtggagctgatcagttcatcgaagaagctgagcggagtttacatgatgctattatgattgtgaggagagctgtgaagaactcaactgttgttcctggaggtggagctatagatatggagataagcaagtacctgaggcagcattcacgaactattgccgggaagtctcagcttttcattaactcgtatgcaaaggccctggaggttattccacgacaattatgtgacaatgctggatttgatgcaactgatgtgctgaataaattaagacaaaaacacgccatgcaaagcggtgaaggagcttcgtatggagtggacattaacactggtggaatagctgattcatttgctaacttcgtctgggaaccagcagttgtgaagattaatgctataaacgctgcgactgaagcagcttgccttatccttagtgtggacgaaaccgtgaagaaccctaaatctgagagcgcacagggagatgctgccgcaggtgctatgggaagaggacgcggtggaggtcgtggccgtggtatgaggagacgataagttttctctatcttatggcaaaacttgggggtcttcttctctgaacttttaattttgttgaattttgatcttgaaatcaaaatgctagtatggtgtttgtgtttatttgacgtatacaattattgacactggagaaactatatttgcttaattagaccaagacaaggatgaatcattgtattaaattcagttagtgatgtatctctcta

SEQ ID NO: 2138 - DNA, 1997 bp, Beta vulgaris
tctttcctctacttcctcttcatctctcccctctctctgcgcgaaaacctaacaatgtcggcgatgatgcagccacagatcatccttctaaaagaaggcacagacacatctcaaggaaaagctcaactaatcagcaacattaatgcttgctctgccatcgccgatgtcgtgcgtacaactctaggtcctcgaggaatggacaagcttattcatgacgataaaggtaacaccaccatttctaatgatggcgctactattatgaagctccttgatattattcatcccgctgctaagattctcgtcgatatcgcccgttctcaagattctgaggtgggtgatggtaccacaacagttgttatactagctggtgaatttttgaaggaggcaaagccttttattgaagatggagtccatccacaaaatttgatccgaagttatcgaattgctgcccatttggctatcgagaaggttaaagacttggctaccagcattgaaggacatagtttggaagaaaagaaaagcttattagccaagtgtgcagcaacaacactcagctcaaagcttataggtggagaaaaagatttctttgcacaaatggttgttgatgcggttcttgctgttggaattgatgacaggttgagcatgattggaattaaaaaggtaccaggaggcaatatgcgagactcatttctcgtcaatggtgtagcttttaagaagacattctcttatgctggttttgagcaacaacctaagatgtttctgcaacctaagatactccttttgaacattgaattggaactgaaatctgagaaagaaaatgcagagataaggctttcagatccatcccagtatcagtcgattgttgatgctgaatggaatataatctatgataaattggagaaatgtgtgcagactggtgctaaaattgttctttcacggttggcaattggggacttgggaacacagtattttgctgatagagatatcttttgcgctggtcgtgttgctgaagaagatctgcagcgtgttgctgctgcaactggtggaaccgtccaaacatcagtcaacaacataattgatgaggttcttggaacatgtgaggtatttgaggagaagcaagttggaaatgagaggttcaatattttcagtggatgtccaactgggcatacagccactattgttcttcgtggtggagctgatcagttcattgaagaagcggagcgcagcctgcatgatgctattatgatagttagaagagctgttaagaactctactgttgttgctggtgggggagccatagatatggaagtaagtcgtcacctaagacagcatgcgaggactatagcaggaaaatctcagctgttcataaactcttatgccaaagcgttggaggttatcccaagacagctttgtgacaatgctggatttgatgcaactgacgtgctgaacaaattgagacagaagcatgcacttccctctggtgagggtgctaattacggggtggacatcaacactggaggcatatctgattcatttgccaattttgtttgggaaccagcagttgtaaaaattaatgcaataaatgcggcaacagaggcagcctgtcttgtcttaagtgttgacgagactgtgaaaaatcccaagtcataaagtgctcaaggagatgctgccgcaagtgccatgggaggtagaggacgaggaggaggtgcattccgtggtcgtgggcggggaatgagaaggcgatgagcataatctagcagatcttgcagtgttgtaggaatctgttaaagttttggtgtgatgctatcctttttgtggcatgtcaagttatctggaagggctatatctgtcgagcgtatcttactgaacagaaaagtacgtatacgcttgacaatctgtgcttcagacacagtgggttcgagttggttcgagttaatgaagccctgtcttgctatgtgtattgtgcttctagtttgtgccacaagtagattctattt

SEQ ID NO: 2139 - DNA, 1802 bp, Selaginella moellendorffii
gagagcgatggcggcgatgctgcaaccatcgattattctcctcaaagaaggcaccgacacatcgcaagggaagccgcagctcatcagcaatatcaatgcgtgtatcgctgtggtggatgtggtgaggaccactttgggtcctcgaggaatggacaagctcatccacgacgacaaggggactaccatttccaacgatggagccacgatcatgaagctcttggacgtagttcatcccggcgccaaagttcttgtcgacattgctaagtcgcaagacgcagaggtgggggatggcacgactaccgttgttgttctggctggtgagctcttgcgagaagcaaagccttttgtcgaggagaatgtccatccacagcttataatccggagcttcaggaccgctgctgacttggctgtccagaagatcaaagaaatagcagtcagcatagaggggaagagcatcgaagaaaagaagtcgctcctcgagaaatgtgcctcgactacgctaagctcgaagctcgtgggtggggagaaggagttttttgcgaagatggtcgtggaggccgtgacggacatgggagaggacagaggattgaagatgattggcgtgaaaaaagtacccggaggaacaatgcgcgactctttcttggttaacggagttgcgtttaagaaaacattctcgtacgctggttttgagcagcaaccaaagaagtttgacaacccgagtattttgcttttaaacattgagttagagctaaagtcggaaaaggagaacgctgaaatcaggctctcggatccctctcagtatcagtccattgtggatgcggaatggaacatcatttatgacaaactggacaaatgcgtcaaaagtggtgccaaagtggtcttgtcacgtttggctattggtgatctggctactcagtactttgcagatcgagatatcttttgcgctgggcgtgttgtagaagaggatttacaacgcgtggcccgcgcgactggaggggctgtgcagacttccgtcaacaatctcattcctgacgttcttggatcgtgcgaaagatttgaagagaagcaagttggaaatgagaggtttaatatttttacgggatgtcctaccggtgagactgcaacaattgttctccgtggcggggcggatcagtttatcgatgaagcagagcgtagccttcacgatgccattatgatcgttcgtagagctctaaaaaactccacggttgttgccggagggggcgctatagatatggaaataagtcgatacttgcgacagcatgcacggacaatccctggaaaagctcagcttttcattaacgcgtttgccaaggcactagaggtgatcccacggcaactgtgcgacaacgcaggatttgatgccacagatgttctcaacaagctcaggcagaagcatgctctcccttcaggagaaggtgccttgtatggtgtagacattaacaccggtggtataacagacacatacgctaacttcgtgtgggagcctgcagtggtgaagatcaatgcgattaccgctgcggcagaagctgcagcactggttctgagcgtcgatgagacaatccggaatccaaagtcggagagtgcccagggtgaagcagccgctaatgcaatggccggacgagggcgaggaatggggggaatgatgggcaggggccgaggaaggggaatgaggcggaggtgaccatttcaaaagggaaaaaaagaagaagaaaaaagaggaagaaagaagaaagatttttgttctttttgtaacacttttatttttactaaagcccaaaact

SEQ ID NO: 2140 - DNA, 1720 bp, Ocimum basilicum
gtccaagagggatggacaaattggtccatgatgataaggggaataccaccatctccaatgatggtgccaccataatgaaacttcttgacattgttcatcctgctgccaagatcctcgttgacattgccaaatcccaagattctgaggttggtgatggaacaactactgtagttctgcttgcaggggaattcctaaaggaagcaaagccttttattgaagatggagttcatcctcaaaatctcatacgaagttttcgcacagcttctaatttggcaattgcaaagatcaaagagttggctgttagcatagagggtaaaagcttggaagaaaagaaaagtttactggcaaaatgtgctgctacaacactatcttcaaagcttattggtggtgaaaaggaatttttcgcaactatggttgtggattccgttcttgctattggagatgaggataggttaaacatgattgggataaaaaaggttcctggaggtaccatgagggattccttttttgtgaatggtgttgcctttaaaaagacattctcatatgctggttttgagcagcaaccaaaaaagtttctaaatcccaagattcttctgctcaacatagaattagagttaaaatccgagaaagaaaatgcagaaatcaggctgtcggatccattgcagtaccagtcaattgtagatgcagaatggaatatcatttatgacaagttggataaatgtgtgaagagtggagccaaagttgttctgtcacggcttgctattggtgatcttggaactcagtattttgcagatcgtgatatcttttgtgctggtcgtgtttccgaggaagatctgcatcgagttgcagcagctactggaggaactgttcagacaactgtgaacaacgtaattgatgaggtccttggcacttgtgaaatatttgaagagaagcaagttggtaatgagcggtttaatatattcagtggatgcccttctggtcggactgccacaattgttcttcgtggtggtgcagatcagtttattgaggaggcagagcggagtttacatgatgcaattatgattgtcagaagggcgatgaaaaactcaactgtagttgctggtggtggtgctattgatatggagatcagccgatacttgaggcagcatgcccgcaccattgctgggaagtcacagctctttataaactcctatgcgaaagcccttgagattatccctcggcaactgtgcgataatgctggttttgatgcaactgatgttctgaacaaactgagacaaaagcatgccctttcatctggggagggtgcaccttatggcgtggacattaatactggtggaattgctgattcatttgcaaattttgtatgggagccagcagttgtcaagataaacgccataaatgctgctactgaagctgcctgcctagtcctaagcgttgatgaaactgttaaaaaccccaagtctgagagtgctcaaggagacgctgctgctatgggtggccgaggtcgaggcagaggtggcttcggtggtcgtggaatgaggcggcgatgagcctttatttggaagtatttccctgcatcttgttagactagctaattatttttgtctaaattttgtgctatgtttcgatcctcactggttacgtatttagtgtctgtttgtgttttttcaaatcatgctttgatcttgaattgattgatattctgtttttatgtggttct

SEQ ID NO: 2141 - DNA, 2121 bp, Cannabis sativa
gggcattcaaaaccctaactcagcctcactctctattcttcttcttcttcttcttcttcttcttgtaactgactctgtttcgccaactgtttgtgaaaatgcgtcaatggaaaacaacaacagcaaccccagatcttattgcttaaggaaggtacggatacttctcaagggaaacctcagttagtgagcaatattaatgcttgtactgctgtggcagacgtggttcggaccactcttggtcccaggggtatggataaactcatccatgatgataaaggtagtgtcactatttctaatgatggtgctactattatgaagcttcttgatattgttcatcctgctgctaagatcctcgttgatatcgccaagtctcaggattctgaggttggagatgggaccaccactgttgtcctgcttgcaggagagtttctaaaggaggccaagcctttcatagaggatggtgtccacccccaacttctgattagaagttaccgtgctgcatccactttggcaattgagagagtaaaagaactagcaactagcatagagggcaaaagtttagaagaaaagaaaggcctactggccaagtgtgccgctacaacactctcatcaaaactcattggtggagaaaaggagttctttgcatcaatggttgttgattctgttattgcaattggcagtgaggatcgactgaatatgattggaatcaagaaggttcctggtggcaacatgagagactcatttttagtaaatggtgttgcctttaagaagacattttcgtatgcaggatttgaacaacaaccaaagaagttcctaaatcccaaattacttctactaaacattgaattggaactgaaatctgagaaggaaaatgctgagataagacttacagatccatcacagtatcagtccattgttgatgcggaatggaatattatttacgacaagttggataagtgtgtacagagtggcgccaaagttgttctttctcggctggctattggtgatttagcaacacagtattttgcagatcgggatattttctgtgctggtcgtgtaactgaagaagatctgaaccgagtagctgctgctactggtggaacagtacagacatctgttaacaatgtcattgatgaggtccttggaacttgtgaactttttgaggaaagacaagttggaaatgagaggttcaatatatttagtggatgtccttcaggtagaacagcaactatagttcttcgtggtggagctgatcagtttatagaggaggccgagcgaagtttacatgatgcaatcatgattgttagaagagcattaaagaactctacagtagttgctggtggtggtgctatagatatggagataagccgatacttgaggcagcatgctcgcacaatagctggaaagtctcagcttttcattaactcttatgcaaaagctcttgaggttatcccacgacaactctgtgacaacgctggttttgatgcaaccgatgtgctaaacaaattgagacagaaacacgcgcttccctctggtgagggtgctccttatggagtagacatcaacactggtggaatcaccgattcatttgccaatttcgtctgggagccagcagttgtaaagatcaatgctataaacgccgctactgaggcagcttgccttgttttgagcgtggacgagacagtaaaaaaccccaagtccgagagtgctcaaggagaagccgctgcaagcgccatgggtagagggcgtggaggagctgctttccgcggtggtcggggacgtggaatgcgtaggcgatagggatttaatttttggaagttaggaaacttgcatttttgggagtatgagaaaatgggcaaggttttgttttgttttattgtttatgtttttgctcaagtctttgtgattggttatgttgtgtgttgttgtgcttagttattacactgaaatttattatgaattcattggaatatatcttttgagtgacccaatttagagttgaaattgaacacacaacacactttgttatttttgtttggattgggtatctctttactttgtttatatatctcttttaactacaaaaattgaatgaaaaaaatgatagttttaattataaaa

SEQ ID NO: 2142 - DNA, 2600 bp, Ceratodon purpureus
gagagagcgagagagaagtgttggttgtttcttcttcccgcaccaactgccccgctcggctttgctgcttcccattctgttgcgctccctcccgcactccactcgccatcgatccaccaggagcggtttcgtttcccgggagtttcttcgcttctgcatctcgtcgcctctcatcatgcaaccgcaaatcattttgttgaaagaggggaccgatgtgtcgcaagggaaggcgcaactcatcagcaacatcaatgcgtgcattgcggttgtcgatgtggtgcggaccacgttggggcccagggggatggacaagcttgtgcacgatgacaaggggacgactatctctaatgatggagctactattatgaagcttctggatattgtgcaccctgccgccaagatcctcgtggatattgccaagtctcaggattcagaggtcggggatgggactactactgtggttcttctggctggagagttccttagggaggcaaagccgtttatcgaagatggagtgcaccctcagctaattattagggcttttcgaactgcagcaaacctggttgttaggaaggtaaaagagctggcaataagcatcgaagggaagagcatgactgagaagaagagtctgttggagaagtgtgctgcgactaccttgagctcgaaacttgttggaggggagaaagagttttttgcaaaaatggtagttgatgcggttaccagcctaggagcagacagtcgtctgaacatgatcggcattaaaaaggtgcaaggtggaacaatgcgagattcgtttttggtaaatggagtcgctttcaagaaaacattctcctacgcaggattcgaacagcagccaaagaaattcgacaacccaaaaattcttctgctgaatcttgagcttgagcttaagtcagaaaaagagaacgctgaagttaggctttcggatcccactcagtatcaatctattgtagatgccgaatggaacattatttatgacaagcttgacaagtgtgtaaagagtggtgccaagattgtgctatcgcggttagctattggagacttgggcactcagtattttgccgaccgagatatcttttgcgctggtcgtgtgatggaagaagatttacatcgtgtggctacagctactggcgcttcagtacaaactaccgtgaataatgtcataccagatgtgcttggccaatgcgaacttttcgaggaaagacaagttggcaacgagcggtttaacatcttcactggatgcccaggtggtgagacggcaaccatcgtcttgcgtggaggtgctgatcagttcattgaggaggccgagcgcagtctacatgatgccattatgattgtgaggagagcgttgaagaattcgaatgttgtcgctggaggtggtgctatcgatatggagcttagtcgttttttgcgtcaacatgcccggactattgctggcaaatcgcagctctttatcaactcgtacgcaaaggctcttgaggttattcccagacagctgtgtgataatgctggatttgatgcgactgatgtgctcaacaagctgaggcaaaagcatgcattggcttcaggggagggtgctctttatggagtagacatcaactctggtggaattattgatacatttgccagcttcgtctgggaaccttctgttgttaagattaatgcactcactgctgcaacagaggcagcttgcattgtcctcagtgtcgatgagacaattaagaaccccaagtctgaggctgctcaagctgaaggtatgggcggtggcagaggccgaggtatgggaggcatgcgtggtggtcgtggaggccgtggcatgcgtagacggtagaaatgctgtagtttctttgacagtgatggcgtagttattgctgagatactaatttttgacttcgcatctggcatctttaaaacctcatcctgcaatcacaagcctatcaaatgggaacagtgcagtttcaattttagtctaaacttcgctcttctaattacctgcgcattcaagtaaattgaggtttatgttatattctctgtagacgaagatctgggtgagtcttttagtaagttacagggcatccgaacaggtcaaaagacaagtgcagtagcagctgcttgtactcgtagaagtgaagtttttattcggttctggtaggcaggaacctcttctaattataacgatgttgacatacttttttccacctcaatgaagcggctatttaattgcattgccttgtactccgagatggcacaccatcatttgcttgttgactgataaatggtaagaaatcactgtgttccactgcgaatgggaacctctactccataactcctggtccattcagcaacggctttttatgcacacaagatgttgccaagtgcatacaaactactaatcgattgttctcaatatttcacatcttttcacttctgtaggcatcacactcagaagttaacacttgtaacttgcaagcggacttgtcaaattttttcattactttcagtagttcgatactttaggagttattgtttcttattcactgtttaagtcttgaaattgcacgttattcatatcaagtgtcctt

SEQ ID NO: 2143 - DNA, 1658 bp, Brassica juncea
ctgagcaacatcaacgccgtcacggcggttggcgacgtgcttcgaaccacgctcggtcctcgagggatggacaagctcatccacgacgataagggatccgtcaccatttccaacgacggcgctaccatcatgaagctcctcgatattgtccatcccgccgctaagatcctcgtcgacatcgccaaatctcaagattccgaggtaggtgatgggacaactacggttgttcttctagcagcagagtttttgaaggaggctaagccgtttgttgaagatggtgttcactcccagaatctgattaggagttaccgcactgcgagcactttggcaattgagaaggttaaagaacttgctgttagtattgaggggaaaagtgtagaggagaagaaaggtttgttggctaaatgtgctgctaccactctttcctctaagcttattggtggagagaaggagttttttgctactatggttgttgatgctgttatggccattggggatgacgacaggctgaatttgattgggatcaaaaaggttcctggtggtaacatgcgagactctttcctagttgatggtgtggctttcaaaaagacattctcatatgcgggttttgaacaacagccaaagaagtttcttaatcccaaaatcctcttgcttaacatcgagttggagttgaaatctgagaaggaaaacgctgagattagactgtcagatccatcacagtaccagtcaatagttgatgcagaatggaatatcatttatgacaagctagacaaatgtgtcgaaagtggagctaaagttgttctttctcgattggctattggtgatctagctactcagtattttgccgatcgtgatattttctgcgctggccgtgtagcagaacaagatcttaatcgcgtggctgctgcggccggaggaacagttcaaacaagtgttaacaatataatacccgaggttctcggaacttgtgagatatttgaggaaaaacaagttggtggggagaggtttaacatattcagtggttgcccttcaggacgtacagcaactattgtccttcgtggtggagctgatcagttcatcgaagaagctgagcggagtttacatgatgctattatgattgtgaggagagctgtgaagaactcaactgttgttcctggaggtggagctatagatatggagataagcaagtacctgaggcagcattcacgaacaattgctgggaaatcacagcttttcatcaactcgtatgctaaggcccttgaggttattccacgacaattatgtgacaatgctggatttgatgcaactgatgtcctgaataaattaagacaaaaacacgccatgcaaagcggtgaaggagcttcttatggagtggacattaacactggtggaatcgctgattcctatgctaactttgtctgggaaccagcagttgttaagattaatgccataaacgctgcaactgaagcagcttgccttattctaagtgtggatgaaaccgtgaagaatcctaaatctgagagcgcacagggagatgctgccggagctatgggaagaggacgtggtggaggtcgtggccgtggtatgcgcaggcgattaagttttttttctctaatggcgaacttgcagattttttctctgaattttagtttggttga

SEQ ID NO: 2144 - DNA, 2733 bp, Physcomitrella patens
aagagcaagggagttcttgagggtgccgctcgttccaatgtcgctgtatcttctcgtctgtgcaactgcttaacacctcgccattgctcctcgtttgattcttcaggtatttcgtgctattcaccgatcgctgtaactctcactccgctccagatcgcccagcgaacggcgtggcgtggtgtagtgtgttgcctttggtgctgttcatggttattagggtttaaggtcgggttttagttagtgttttcacattctcagacacggaggaagtcacgaactagatcacgtacaagacctccatcctatgctacgaaaatcaaagaaacgtgagattgtatgtttaaggaaatgcagttatttgttgtgcgttgtgaggatatgtaggtgccgacctgttagggttcgagtttgaagcgatcctcatttcactccttcttgaacatcaggaagttccagtgctcgtattactgcactcattctccgccagcccttggttgctgagctccagcttctgctaccatgcaacctcaaatcatcttgctgaaagagggaacagatgtttctcaagggaaagctcaacttatcagcaacatcaatgcatgcattgctgttgtggatgtcgtgcggagcaccttagggcccaggggtatggacaagcttgtccatgacgacaaagggaccaccatttccaatgacggagcaactataatgaagctcttagatattgtgcaccctgctgccaaaatactcgtggatattgccaagtcgcaggattcagaggtaggtgatggaactactaccgtggtgctccttgccggagagttcctcagggaggccaagccttttgttgaagatggagtacacccccagctcattatacgggctttccgaaccgcagcagagttggttgtaaagaaagttaaagagcttgcagtaagcattgaaggaaagagcatggatgagaagaagagcttgcttgagaaatgtgctgccacaactttgagttctaaacttgtcggaggagagaaggatttctttgccaaaatggtagtcgatgcggtcgctagtcttggcccagatagccgtctaaatatgattggaataaaaaaggtgcaaggcgggactatgcgagattcttttctagtaaatggagttgctttcaagaagaccttctcttatgcaggatttgaacaacagccaaagaaattcgataatccaaaaattttgcttttgaatcttgagctagagcttaagtcggaaaaagagaatgctgaagtcaggctttctgatcccacccagtaccaaacaattgttgatgctgaatggaacattatttatgagaaacttgacaagtgtgtaaagagtggcgccaagattgtattatcacggttagctataggagacttaggtacccagtacttcgctgatagagatatcttttgtgcgggtcgtgtgatggaagaagatttacagcgtgtagcctcagctactggcgcttctgtgcagacgaccgtgaataatgtgattccagatgtccttggccaatgtgaattttttgaggaaagacaagttggaaacgagcgctttaacatcttcactggatgccctggtggtgagacagcaacaattgtcctgcgtggaggtgctgatcagttcatagaggaggctgagcgtagtctacatgacgcaattatgatcgtgaggagagcattgaagaactcgaatgtcgttgctggtggtggtgcgattgatatggaacttagccgatacttacgtcaacatgctcggacaattgctgggaaatcacagctctttatcaactcgtatgccaaggctctcgaggttattcctagacaactgtgtgacaatgcaggatttgatgcgactgatgtgctgaacaaactgaggcagaagcatgcattggcttcaggggagggtgctctttatggagtagacatcaacaatggtggaatcatcgatacgttttccagctttgtctgggaaccatctgtcgttaagatcaacgctctcaccgctgcaacagaggcagcctctattgttctaagtgttgatgagactatcaagaaccccaagtcggaggctgctcaaggtgaagctatgggcggcaggggtatgggcagaggcatggggggcatgcgtggtggtcgtggcggtcgtggcatgcgcaggcggtagcaagtcattaattttatttctgggagcaatgttttagttagtaatggaatcccttatttgaacgtagaacttctttctttagctttacacaacctgtcttcgcatgtggcatacttaaacctcaccctccgatctctagtacaacgacttgagaatgttcagttttgataatattctaccattggcccttactttttccttgcgtctaagtaatccaagagcagataagtcatttagtcatcatttcacagggtgcaatgttatttcgaagtatagctacgttaccactagctggttgtaatcaaatgacagttttttggttcaattcgcgcaggagatttggatttcttctttatacagtgtaacaccgttttctcgtgaccaagttttttgtttgataaggatattatttgtaatgaatctttatgtagccaaacacctgaacatagaagtatggaatcacagattaacaaaattgcacgagttttcaaagggtttgttattttcatatttgatatacaatagtagtagtttctg

SEQ ID NO: 2145 - DNA, 1535 bp, Flaveria ramosissima
gatccatgatgacaagggtaacaccactattctaacgatggagccactatcatgaagcttcttgacattgttcatcccgctgctaagatccttgttgtattattgctaagtcgcaggattcggaggttggtgatggaaccactaccgtagttctccttgctggtgagttcttgagagaggccaagccgttcattgaagacggtgttcatcctcaaaatctaatacgaagttatcggtccgcttccaatatggctattgagaagattaaagagttagctgtaagcatagaggggaaaagtttagacgaaaaaagaagcttattagctaaatgtgctgctacaacactctcatcgaagctaataggaggagagaaggacttttttgcaacgatggttgtggatgctgtcattgcaattggaaatgatgatagactgaacatgattggaataaaaaaggttcctggtggtacaatgagagattcctttcttgtgaatggtgttgcttttaaaaagactttttcatatgctgggtttgagcagcaacctaagaaatttcaaaatccaaagatattactgttgaacattgagcttgaactaaaatcagaaaaagaaaatgccgagataagactttcagatccgttgcaatatcagtccatagttgacgcagaatggaatatcatatatgataagttggataaatgtgtaaagagtggtgccaaaattgtattgtcgcgtctggctattggtgatctggcaacacagtattttgcggaccgggatatattttgtgctggtcgagttgctgaagatgatctgcatcgtgttgcagctgcaactgggggtatggtacagacatcggtcaacaatgttatagatgaggttcttgggtcttgtgaggtttttgaggaaaagcaagttggaaatgaacggttcaacatatttagtggatgtccttcaggccagacagccaccattgttcttcgaggaggagctgatcagtttattgaggaagctgagcgcagtttacatgatgcaatcatgattgtgaggagggccatgaagaattccaccgtggttgccggtggcggtgcaatagatatggagataagccggtacctgtggcaacatgcacgcaatatagctggaaagtcccaactatttataaatgcctttgctaaagcacttgaggttattccgcggcaactttgtgataatgctggatttgatgcaactgatgtactcaacaaactgaggcaaaaacacgcacttccttctggtgaaggtgctctttacggagtagatattaacacaggtggaatttctgattcatttgccaactttgtgtgggagccagcagtggtaaagatgaacgctataaatgctgcaacagaggcagcatgccttgtcttaagtgttgatgaaacagtgaagaacccaaagtcggagagtgcacaaggagaagctgctgctggcatgggtagaggacgtggtggcggtggtatgcgtggaagaggtatgcgtagacgttgaacgtgg

SEQ ID NO: 2146 - DNA, 1759 bp, Vinca minor
caagttgatccatgatgagaagggaaacaacaacgattccaatgatggtgctaccataatgaaacttctcgacattattcacccagcagctaaattcttgttgatatagccaaatcccaagactctgaggttggtgatggaacaactacagtagttttacttgcagcagagtttctgaaggaagccaaaccttttattgaggatggagttcattctcagaatcttatacggagctaccggatagctagctatttggcgatccagaaggtcaaggaattagctgttagcattgaaggaaaaagcttagaagaaaagaagggcttacttgctaaatgcgcagctactactctctcctcgaagctcattggtggtgagaaagacttttttgcacccatggttgtcgatgctgtctttgctattgggaatgatgataggctaaatatgatcggaatcaagaaggttccagggggcacaatgagggattctttccttgttgatggcgttgccttcaaaaagacattctcatatgcaggttttgaacagcagccaaagaagtttgagaatcccaaaatacttttgctaaacatagaattggaactgaaatcggagaaagagaatgcagagataaggctgtcagatccatcacagtatcagtcaattgttgatgccgagtggaatatcatttatgacaagttggataaatgtgtcaagagtggtgccaaaattgttctgtcacggcttgctattggtgatctagcaactcagtatttcgcagatcgagatatattctgtgctggtcgtgtcactgaagaggatctgcatcgggttgctgcagcaactggtggcgctgtgcagaccactgtgaacaatattattgatgaggtactcggtacatgtgagatctttgaggagaggcaagttggaaatgagcggtttaatatatttagtgggtgcccgtcaggtcgaacagccactattgttcttcgaggtggagcagatcagttcattgaagaagccgaacgaagtctccatgacgcgattatgatcgtcagaagggctttgaaaaactctactgttgttcccggtggtggagctattgatatggagattagtagatacttgaggcagcatgcccgaacaatagatggaaagtctcaactttttataaactcttatgctaaagcccttgaggtaatccctcgtcagctatgtgacaatgctggttttgatgctactgatgtcttgaacaaattgagacaaaaacacgctctgttgtcaggtgaaggtgcaccatatggggtggatattaataccggaggaatagctgattcatttgctaactttgtttgggaaccagcagtggtgaagataaatgccataaatgcagctactgaagcagcttgtcttatcttaagcgtggatgaaacagtcaagaaccccaagtcggagagcgcgcaaggggaagctgccgcaagtgccatgggtggtagagggcgtggaggaccagctttccgcggtcgtggaaggggaatgaggaggtgatagtctatcagtctatccataaacgaacttggctagttaactgaagttttgattgtattctcgactgctctgtattttctcttggtagttttttgcttttgatttttttctttctttctttagtagcttcaagctatgttgaaatcactgttttgtatgccttttggacacgcacaatttagattgtagaggagatgtttatcaaatctaaaaattt

SEQ ID NO: 2147 - DNA, 1507 bp, Arnica chamissonis
gcaacctcagatcatattgcttaaagaaggtacagacacttcgcaagggaaaccgcagttagtaagcaacatcaatgcgtgtatggcggtcgctgatgtcgtccgtacaaccctaggtccgaggggcatggataaactgatccatgatgataagggtaacaccactatttccaacgatggggctaccatcatgaagcttcttgacgttgttcatcccgctgctaagatccttgttgatatcgccaagtcacaggatttggaggttggtgatggaacgactaccgtagttctccttgctggtgagttcttgagagaggccaagcccttcattgaagatggtgttcatcctcaaaatctgatacgaagctatcgtacagcgtccaatatggcaattgagaagattaaagaattagctgtaagcatagagggaaaaagtttagatgaaaaaagaagcttattagctaaatgtgctgctacaacactctcatcaaagcttataggaggagagaaggacttttttgcagcaatggttgtggatgctgtcattgcaattggaagtgatgatagattgaacatgattggaataaaaaaggttcctggtggtacaatgcgtgattcatttcttgtaaatggtgttgcgtttaaaaagacattttcttatgctgggtttgagcagcaacccaagaagttcctaaatccgaagatattactattgaacattgaattggaactaaaatcagaaaaagaaaatgctgagataagactgtcagatccgttgcaatatcagtccatagttgatgcagaatggaatatcatatatgataagttggataaatgtgttaagagtggtgccaaaattgttttgtcacgtctggctattggtgatctggcaacacagtattttgcagacagagatatattctgtgctggtagagttgctgaagatgatctgcatcgtgttgcagctgcaactggtggtactgtacagacgtcggtcaacaatgttatagatgaggttcttgggtcttgtgaggtttttgaggaaaagcaagttggaaatgaacgttttaacatatttaaaggatgtccttcaggccagacagctactattgttcttcgaggtggagctgatcagtttattgaggaagctgagcggagtttacatgatgcaatcatgattgtgaggagggcaatgaagaattctacagtggttgctggtggcggtgcaatagatatggagataagccggtacctgtggcaacatgcacgcaatatagctggaaagtcccagctatttataaattcctttgccaaagcacttgaggttattccacgacaactttgtgataatgctggattcgatgcaactgatgtactcaacaaactgaggcaaaaacatgcccttccttctggtgagggtgctctttatggagtagatatcaacacgggtgggatttctgattcatttgccaactttgtgtgggagccagcagtggtgaagatgaat

SEQ ID NO: 2148 - DNA, 2027 bp, Fagopyrum esculentum
gggactcttcggtttctctctcgctctctttacccactctccccactcgctaccagcgaagaaaacctaaaaccctccgggcttctcatcaatggcgtcgatgatgcagccacagatcatactcctcaaggagggaactgacacttcgcaaggcaagctcggaccgtagtaagcaacatcaacgcttgctgcgctgtcgctgatgtcgtccgcactactctcggccccagaggaatggacaagctaatccacgatgaaagaggtaacaccaccatctccaacgatggcgccactatcatgaagcttctcgacatcgttcaccccgccgccaagatcctcgtcgacatcgccaagtctcaggactctgaggttggtgatgggactactaccgttgttcttcttgctggtgaattcttgaaagaggcaaagcctttcattgaggatggtgtccacccacaaaatctgattcgtagttacagaactgcatccctattggcaattgagaagatcaaagagttggctgttagcattgaagggaaaagtttggaggataagaaagagcttcttgccaagtgtgcggctactacactcagctcaaagcttattggtggagagaaggatttctttgcaactatggttgttgaggctgtactagcgattggtgctgatgacaggatgaatttaattgggataaaaaaggttcctgggggcaccatgagggactcctttttggttgatggagttgcttttaagaaaacattttcttatgctggttttgagcaacaaccaaagaaatttaagaatccaaagatacttctgttgaacattgaattggaactgaagtctgagaaggaaaatgctgaaataaggctgacagatccatcacagtatcagtcaattgttgatgcagagtggaatatcatctatgacaaattggataaatgtgtgcaaagtggtgctaagattgttctttcacggttagccattggggatttggcaactcagtattttgctgaccgagatatattttgtgctggtcgtgtcactgaagaggaccttcaacgtgttgcagctgcaaccggtggtacagtccagacaagtgtcaacaacattattgaagaggtccttggttcatgtgaggtgtttgaggagaagcaagttggaaatgaaaggtttaatttgtttaatggatgcccttgtggccggacagccactattgttctccgtggtggagcagatcagttcattgatgaagctgagcgcagtctacatgatgcaatcatgatagtcagaagggccgttaagaactcaactatcgttcctggtggtggtgccatagatatggagattagtcgacatttgaggcagcatgctcgtactatagctggaaagtctcagcttttcataaattcttatgcaaaggctctagaggtcattccccgacagctttgtgacaatgcaggatttgatgctactgacgtattgaacaagctgaggcagaagcatgcactcccatctggtgagggagcaaattatggtgttgatataaatactggaggaatcgctgattcatatgctagttttgtttgggagcctgcagttgttaagttaaatgcactaaatgctgccaccgaagcttcctgtttggtattaagtgtggacgaaactgttaaaaaccccaaatcggagagtgcacaaggagatgctgcggccagtgcaatgggaagaggacgtggtcgtggccgtggaatgcgaagacggtagatttcttgtgccaaatttgtgaaggattccatactgctatcctttcttgtaagccctatttgtttttgagcttccttttgcactattttattcccttgttgacgatattatgttgcttaggtgtttttagcactcctattattttgttctgtgaaattttgtgggtcaagaaacaactccttgaagcttcgtttgtgttttttgacaatgttatatttggcacataccttgaattctctgtgctaatttttatcaggattatt

SEQ ID NO: 2149 - DNA, 1914 bp, Distylium racemosum
catttacgctctctgaggctttttgcgattcagccatggcggccatgcttcaaccccaataatattgttgaaggaagggacagacagttcgcaagggaaggcgcagctgatcagcaacataaatgcgtgcactgccatcgtggatacggtgcgcacgacgttgggtccccgcggaatggacaagctcatccacgacgaaaggggctccgttactatctccaacgacggcgcaaccatcatgaagctcctcgacattgttcatcccgccgcaaaaattctagtcgacatcgccaaatcccaggactctgaggttggtgatggaactacaactgttgtgctctttgcgggagagtttttgaaagaggcaaagccttttatagaagagggtgtccatcctcagaaccttattcgaagttatcgcacagcagcttatttggctatcaacaaagtgaaagagctggccatcagtatagaagggaaaagtctcgaagaaaagaaatatcttcttgagaaatgtgccgcaacaacactctcatcgaaactgattggtggagagaaggaattttttgccaagatggtagttgattctgtgctggcaattggtcaagatgatagattgaatatgataggcattaaaaaggtgccaggaggaaatatgcgtgactcatttttagtgaaaggtgttgcttttaaaaagacattttcatatgctggtttcgaacaacaaccaaagaattttttgaatcccaaattgcttctattgaatgttgagctggagcttaaatcagaaaaagagaatgcagaagttaggctgtcagatccaacaaagtatcaatcaatcgtagatgcagaatggaatattatatatgataaattggataagtgtgtcaaaagtggggctaaaattgtactatctcgattggcaattggtgatctggcgactcaatactttgccgatcgagatgttttctgtgccggtcgtgtaacagaggaggatctacagcgggttgctgcagccactgggggggctgtgcagacctctgtcaacaatattgtgcctgaggtacttggaacctgtgaatgttttgaagagaaacaagtgggcaatgagcgattcaatatatttagtggctgcccatctgggaagactgcaactatagtattacgtggtggagcagaccagttcattgatgaagcagaaagaagcttgcatgatgccatcatgatagttcgaagagctttgaagaactctactgttgtagctggtggtggtgctattgatatggaaattagcagatatttaagacagcatgctcgaaccatagcaggaaaatcacagctgtttattaattcctatgcaaaggcccttgaggttatcccacgtcagctttgcgataatgctggttttgatgccacagatgtgctaaacaaactcagacagaagcatgcactctcatctggtgagggtgcatcttatggtgtggatataaatacggggggtattgccgattcacttgctaactttgtgtgggagccggcagttgtaaagataaatgcaatcaatgctgcaacagaagccgcatgtcttattttgagtgtggatgaaacagttaaaaatccaaagtctgagagtgctcaaggggaaggggcagcaaatgcaatggctggacgaggacgtggtggtggtggcttccgtggccgaggtcggggcatgcgaaggcgatgaaagagttgcatgaaatgaattaaagttggtttgtagtaaatgccattccagcagtgtcagcctgctcagtggaagcagttttgtattatgatgagtgaaagaatgatgtgcacgcatttctcatttatcacatggatttcttgatgaaacttgaacaactatatttgttgtggaattttggatcaggc

SEQ ID NO: 2150 - DNA, 2450 bp, Physcomitrella patens
gcttgcgtactctcgttgagtgttgctgttgctgttgctgttgtgctttgcaactgttgctgcacttgctcctccgtccctctcttgattcatccagggaggttcagtgtacgtgctgttgcagtcgctgttccgcaggcgcttggttgctgaggtccgtcgactgtcaccatggtacacctttctcaccgtttgcagtattttacagttatttttctttgtgtctttaaatgcttgagttcttgttattgtggttgcgttcgaaggacgtggatttttcgtcgatgaccaactttataacctcctatgttgtgctagatttttggtttttggtcgttggtctttgttttgttttgaagtatcatctgcgatttttttgttacgatgatgtcctttcttcgtgttttggtcttggaacagcaacctcaaatcattctgctgaaagaagggacggatgtctctcaagggaaagcgcaacttattagtaacatcaatgcttgcattgctgttgtggatgtcgtgcggagcaccttaggtcccagagggatggacaagcttgtacatgatgacaaaggtactaccatctccaatgacggggccacgataatgaagctccttgacattgtgcatcctgcagctaaagtgctcgtggatattgcgaagtcacaggattcagaggtgggtgatggaactactaccgtggtgctccttgccggagagttccttagggaagccaagccatttattgaagatggagtgcacccacagcttatcatacgggctttccgaactgcagtaaatttggttgtaaagaaagttaaagagctcgcagtaagtatcgaaggaaagagcatggttgagaaaaagaatttgcttgaaaaatgcgcggcaacaactttgagctctaagcttgtcggaggagagaaggaatttttctccaaaattgttgttgacgcggttacaagtcttggagcagatagccgcctcagcatgataggaataaagaaggttcaaggtggaacaatgagagattcttttctggttaacggagtagctttcaagaagactttctcttatgccgggttcgaacaacaaccaaagaaatttgataatccaaaaatcctgctgttgaatcttgagttagaactcaagtccgaaaaagagaacgctgaagtcaggctctccgatcccactcagtatcaaactattgtagatgctgagtggaacatcatttatgagaagcttgacaagtgcgtaaagagtggtgccaagattgtcctatcaaggttggctataggagacttaggcactcagtattttgccgatagagatatcttttgtgccgggcgtgtgatggaagaggatttacagcgcgtagcaacagcgactggcgcgtcagtgcagacaaccgtcaataatgtgattccggatgtacttggccaatgtgaactttttgaggaaagacaagttggaaatgagcgctttaacatcttcacgggatgtccaggcggtgagacagcaaccattgtcctgcgtggaggcgctgaccagtttatagaagaggcggagcggagtctacatgatgcaattatgattgtgagaagagcactcaagaactcgaatgttgttgctggtggtggtgctattgatatggaacttagtcgatatttgcgtcaacatgcccggactattgccgggaaatcacaactctttatcaactcgtatgctaaggccctcgaggttatccccagacaactttgtgacaatgcaggatttgatgcgactgatgtgcttaacaagctgaggcagaagcatgcgttagcttcaggggaaggtgccctttacggagtagacatcaacagtggtggaattattgatacattttccaactttgtctgggaaccctctgttgtgaagatcaacgccctcactgctgcgacagaggcagcctgcattgttcttagtgtagatgagacaattaagaaccccaagtctgaggctgcccaaggggaagccatgggcggcagaggtatgggtagaggtatgggcggcatgcgtggtggtcgcggcggtcgcggtatgcgcagacggtagaaagtgtacttctcgttgaggacgatggcgtagtttgtgattcgaaaccaattttgaacgcgacggttctttctttcacttagcaacactctgcatctggaatttgttaacctcatccctcatcacgagtacagcgatgtgcagtttcaatctgagtgtagtcttcgcttttccatttgcctcgtgtttaagtactgtgaggttattcaatgtattctctgtacacaaagaagttcagttttatggccagttacagagttttcattcagtgcaacatcatatctaagtgtagttttgcttgttatcaagtgacggttttcttgttctactcatatctgattttaagaaccactcag

SEQ ID NO: 2151 - DNA, 1719 bp, Lactuca sativa
attgaatcctaacagcccgggttcgagcgcacggaagaatgttccaagagacgcagtactaaaacaaactaaacaccgaaacaacagtgggaaggaagctgaatacaccaagtctaaaccctagcgccaccattaccatttgccatcacctcctgtattacctccacccttctccgccgcaaatcccctcgcaatggcatctatgatgcaaccccagatcatactgcttaaagaaggtacagacacttcgcaagggaaaccgcagttgataagcaacatcaatgcgtgtatggcggtggctgatgtcgttcgtacaaccctaggtccgagaggtatggataagttgatccacgatgataaaggtaacaccactatttctaacgacggcgccaccatcatgaagcttcttgacatcgttcaccccgctgctaagatccttgttgatatagccaagtcacaagattctgaggttggtgatggaaccactacagtagttcttcttgctggtgagttcttgaaggaggcaaaaccattcattgaagatggggtccaccctcaaaatctgataagaagttatcgaacagcttcctttatggcaattgagaagatcaaagagttagctgtaagcatagagggaaaaagtttagatgaaaaaagaagcttattagctaaatgtgctgctacaacactctcttccaaactaataggaggagagaaggatttttttgcaaaaatggtggtggatgctgttattgcaattggaaatgaagataggttgaacatgattggaataaaaaaggtgcaaggtgggacaatgagggattcatttcttgtgaatggtgttgcatttaagaagactttttcatatgctggatttgaacaacaacccaagaagtttttgaatccaaagatacttttgttgaacattgaactggaactaaaatcagaaaaggagaatgctgagataaggctttcagatccattgcaatatcagtctatagttgatgcagaatggaatatcatttatgacaagttggataaatgtgtcaagagtggtgccaagattgttctttcacgtcttgctattggtgatctggctacacagtattttgcagacagagatatcttctgtgctggaagagttgctgaagatgatctgcacagagttgcagctgcaactggagctactgtacagacatctgttaacaatgttatcgatgaggttcttggatcttgtgagatttttgaggaaaaacaagttggaagcgaacgattcaacatatttagtggatgtcctttaggtcagacagccactattgttcttcgaggtggagctgatcagtttattgaggaagcagaacggagtttacatgatgcaatcatgatagtaaggcgggccatgaagaattccacggtggttgctggcggtggtgcaatcgatatggagataagcaggtacctgtggcaacatgcaaggaatatagctggaaagtcccagctatttataaatgcttatgctaaagcacttgaggttatcccacgtcaactttgtgataatgctggatttgatgcaattgatgtgcttaacaagctcaggcagaaacatgcacttgctgctggtgagggtgctctttatggagtggatattaacacaggtggaatttcagattcctttgccaactttgtgtgggagccagcagttgtaaaggtaaactaaat

SEQ ID NO: 2152 - DNA, 1800 bp, Catharanthus roseus
taggaccgaggggtagtggacaagttgatcacgatcaaagggaaacacaacaatttctaatgatggtgccaccataatgaaacttcttgacattattcacccagcagctaagattcttgttgatatagcgaaatcccaagactctgaggttggtgatgggacgactacggtagttttacttgcagctgagtttctgaaggaggcaaagccttttattgaagatggagtacatccacagaatctgatacggagctaccgtacagctagctatttggcaattgagaaggtaaaggaattggctgttagcattgaaggaaagagcttagaagaaaagaagagcttgctagctaaatgtgcagctactactctctcctcgaagctcattggtggtgagaaggatttttttgcacccatggttgttgatgctgttcttgctattgggaatgatgataggctaaatatgatcggtattaagaaggttccaggtggtacgatgagggattctttccttgttaatggtgttgccttcaaaaagacattttcatatgcaggtttcgaacagcagccaaagaaatttgttaatccccagatactcttgctgaacatagaattggaactgaaatctgagaaagagaatgcagagataaggctatctgatccatcacagtatcaatcaattgttgatgcagagtggaatatcatttatgacaagttggataaatgtgtcaagagtggtgccaaaattgttttgtcacgtcttgccattggtgacctagcgacacagtacttcgcagatcgagatatattttgtgccggtcgtgtcactgaagaggatctgcaacgtgttgctgcagcaactggtggaactgtgcagactactgtaaacaatattattgatgaggttcttggtacatgcgagtgttttgaggagaaacaagttggaaatgagcggtttaatatattcagtggttgtccatcaggtcaaacggccactattgttcttcgaggcggagcagatcagttcattgaagaagctgaacgcagtctccacgatgcaattatgattgtcagaagggctttgaaaaactctactgtcgttcctggcggtggtgctatagatatggagatcagtagatacttgaggcagcatgcccgcacaatagctgggaagtctcaactctttataaactcttacgctaaagcccttgaggtaatcccacgtcagctctgtgacaatgctggctttgatgctactgatgtcctgaacaagttgagacaaaaacacgcgctgccgtcaggtgaaggtgcaccttatggggtggacattaatactgggggaatttctgattcatttgctaattttgtttgggagccagcagtggtgaagataaatgccataaatgccgctacagaagcagcttgtcttatcttaagtgtcgatgaaacagtcaagaatcccaagtctgagagtgcacaaggggaagctgcagcaagtgccatgggtggtagagggcgtggaggaccagctttccgaggccgtgggaggggaatgaggagacgataggctattcagaaaaaaattgggctagttagtcggaagttttgattgtattgttgattgttgctctatattttctcttcctagttttttggtctctctttagtagcttcaagctatgttgaaatctccaacttgtatgcttttttgaaaaagttaacttgtatcagctgatttgttacctaacacaatacgagagtctgattctgcttggttgcaaatatccagaattgctagttgtg

SEQ ID NO: 2153 - DNA, 1509 bp, Olea europaea
aaatggcgactatgatgcaacctcaaatcatactgctgaaggaagggacagacacgtcccaaggaaaaccacagttaataagcaacataaatgcatgtatggctgtggctgatgtagttcggaccactcttgggccaaggggtatggacaagctaatccatgatgagaagggaaacactaccatttcgaatgatggggccaccataatgaagcttcttgacatcgttcaccctgctgcaaagatccttgtggacattgccaagtcacaagactcggaggttggcgatggaaccactacagtagttctgcttgctggagaatttctaaaggaagcgaagccattcattgaggatggagttcactctcaaaatcttatacggagttatcgaacagctagtcatttggccattgagaaagttaaagaattagctatcagcatagaggggaaaagcttagaagaaaagaagaatttgctggctaaatgtgctgctacaacactctcttcgaagcttattggtggtgagaaggagttctttgcatccatggttgtggatgctgtcatcgctattggatacgaagataggctaaatatgattggaattaagaaggttcctggaggtaacatgagggattcttttcttgtgaatggagttgccttcaaaaagacattctcatatgctggttttgaacagcaaccaaagaaatttgaaaatcccaagatacttttgttaaacatagaattggagctaaaatcagagaaagaaaatgccgagataaggttgtcagatccattacagtatcaatcaattgttgatgcagaatggaatatcatctacgacaagttggataaatgtgttaagagtggagccaaagttgttctgtcacggcttgctattggtgatctggcaacacagtattttgcagatcgagatatattttgtgcaggacgtgttactgaagaagatctgcaacgggttgctgctgctactggtggaacagtgcaaacaactgtgaacaacgttattgatgaggttctcggtttttgtgagcttttcgaggagaatcaagtagggaatgagcgatttaatatatttagtggatgcccatctggcctcactgccactatagttctgcgtggtggagcagatcagttcattgaggaggctgagagaagtttacatgatgcaattatgattgtcagaagggctctgaaaaactccaccatagttgctggtggtggtgctattgacatggaagtaagccgatacttgaggcagcatgcacgtacaatagctgggaagtctcagctctttataaactcttatgcaaaggctcttgaggttatcccgcggcaactgtgcgataatgctggttttgatgcaactgatgtgttgaacaaactaagacaaaaacatgctcttccatctggagagggtgcaccttatggtgtagatatcaacactggtggagttgctgattcgtttgctaactttgtgtgggagccagcag

SEQ ID NO: 2154 - DNA, 1736 bp, Cichorium intybus
gacggcgccaccatcatgaagcttcttgacatcgttcaccccgccgctaagatccttgtcgatatcgctaagtcacaggattcagaggttggtgatggaacgactacggtagttcttcttgctggtgaatttttgaaggaggcaaaaccattcattgaagatggtgttcatcctcaaaatctcataagaagttatcgaagcgcttcctttatggcaattgagaagatcaaggagttagctgtaagcatagagggaaaaagtttagatgaaaaaagaagcttattagctaaatgtgctgctacaacactctcttcaaagctaattggaggagagaaggacttctttgcaaaaatggtggtggatgctgttattgcaattggaaatgatgataggttgaatatgattggaataaaaaaggtgcccggtggtacaatgagggattcatttcttgtgaatggtgttgcatttaaaaagacattttcatatgctggattcgaacaacaacccaaaaagtttctgaatccaaagatactcttgttgaacattgaacttgaactcaaatcagaaaaagaaaatgctgaaataagactttcagatcctttacaataccagtccatagttgatgcagaatggaatatcatttatgataaattggataaatgtgtcaaaagtggtgccaaaattgttctctcacgtcttgctatcggtgacctggcaactcagtattttgcagacagagacatattttgtgctggtagagttgctgaagatgatctgcatcgtgttgcagctgcaactggagctacagtacagacttctgtcaacaatgttatcgatgaggttcttggatcctgtgaagtttttgaagaaaagcaagttggaagtgaaagattcaacatatttagtggatgcccttcaggccaaacagccactattgttctccgtggtggagccgatcagtttattgaggaagcagaaaggagtttacacgatgcaatcatgatagtcaggcgggccatgaaaaattccacggtggttgctggtggtggtgcaatcgatatggaaataagccggtacctatggcaacatgcacgcaatatagccggaaagtctcaactatttataaatgcctacgctaaagcacttgaggttattccacgtcaactttgtgataatgctggattcgatgcaactgatgtactcaacaaactgagacagaaacatgcacttgctgctggtgagggtgctctttatggagtggatataaacacaggtggaatttctgattcttttgccaactttgtgtgggagcctgcagtcgtaaagattaatgctataaatgctgcaactgaggctgcctgtcttatcttaagtgttgatgagactgtaaagaatccaaagtcggagagtgcacaaggggaagctgccgccggaatgggtagaggacgcggtggcggacgtggcagagggatgcgaagacgttagtatttcttaggatacaaaacttgagccgaggagggtatgatggtaattttgggttttgatcgaaaacgtttccaatttgctgtgttttgtaggattatgttcaagtttgattatggttttgagattttttttttgtaagttgatccatgagctttggtttagaccgggacactgaaattctatgtgagtttattatttttattattaaaatggtattgttggaaactaatagcagtattgagaatttctgt

SEQ ID NO: 2155 - DNA, 1425 bp, Sorghum bicolor
atcagagccgactcgcccgcgtcgcccccttgttggcgaacgggcgcgcgtcgcgccacgccagcacgccgtaaccgctgccacccaccaccacaccgaccccctccgcggcgagcgctcgctgttcgccaagacaccaatccaagcccgcaggcagctccgtctcagatcggtcgctgtgctgcgcgccatggagctgcagctgctggtacgacccgcggcgaccgcgccctcctccgcgcgagcgcgaccctcgctgcggctccccgcccctgccgcgggcccatcccgtccccgtcggcccgggttccctactctccgcgccgccgccgccgcagccgcggcgatcgccgcggagccggaaacaaaagagcagcagcaaaatagcattatggaaactgaggtgtttgcctgccctgtctgctacgaaccactgatgagaaaagggccaccaggcataaacttgccagcaatttataggtcgggattcaagtgttcaaagtgcaacaagtcatttaccagcaaagacatcttcttggacctcactgtaactgcagggacaaaagaatatagtgaacagaagcccgctagaactgagctgttccggagtccacttgtctcatttctttatgagagagggtggcgacaaaactttaatcggagtggtttccctggtcttgatgaagagtttgaaatggctcaagactattttcaacccgttgctggtggtatccttcttgatgtcagctgtggcagtggcttgtttactaggaagtttgcaaaatctgggacatactcagctgtgattgctttggacttctctgagaatatgctccgccaatgctatgagttcattaagcaagatgatactctcctcaatgcgaatctagcacttgtgagagcagatatttcaaggctccctttcgcttcttgttcagtagatgccattcatgctggagcggctatccattgttggccctcaccctctaatgcggtagctgaaataagccgtgtcctgaggcctggtggagtttttgtgggaaccacctttttatcctctcccaggaacaacccattctctgttgaagcactaaggccacttagacagattgttggaccagttaacaccagctacaactattttactgaaggagagctcgaagacttgtgcaaatcctgtggccttgtcaactacagcagcaaagttcagagatcgtttataatgttctctggacaaaagccatattgaagaactctgtccaagtccaagctcttttgtttcttcaggattccttgtaaaacacgtttaaaagtatttgcatatatttgtgccatattgtgcataggttccttaatttctgtacattgttcctgatcgtattcagtacaaaaatgcacaaaaaaatgcatgctgcagactctgaa

SEQ ID NO: 2156 - DNA, 1304 bp, Zea mays
tggcgccacgccacgccataccgctgccacccaccgcaatccaagcaagcagccccgctatgtcggtcgctgtgctgcgagtgcgagccatggagctactggcacgacccgcagcggcagcgtcgtcctcctgcgcgcgaccctcgctacagctccccgccccgggcacatcccgtccccgtcggcccgggttccctactctccgcgcagctgcggcggcagcggcggcgatcgccgcggagccgcaatcgaacgagcagcagaatatcattatggaaactgaggtgtttgcctgccctgtctgctacgagccattgatgagaaaagggccaccaggcataaacttgccagcaatttataggtcgggattcaagtgttcaaagtgcaacaagtcatttaccagcaaagacatcttcctggacctcactgtaactgcagggacaaaagaatatagcgaacagaagcccgctagaactgagctgttcaggagtccacttgtctcatttctttatgagagagggtggcgacaaaactttaatcggagtggtttccctggtcttgacgaagagtttcaaatggctcaagactattttcaacccattgctggtggtatccttcttgatgtcagctgtggcagtggcttgtttactaggaagtttgcaaagtctgggacatactcagctgtgatcgctttggacttctctgagaatatgctccgccaatgctatgaattcattaagcaagatgattctctcctcaatgtgaatctcgcactcgtgagagcagatatttcgaggctcccttttgcttcttgttcagtagatgccattcatgctggagcggctatccattgttggccctcaccctctaatgcggtagctgaaataagccgcgtcctgaggcctggtggagtgtttgtgggaaccaccttcttatcctctcccaggaacaacccattctctgttgaagcactaaggccacttagacagattgttggaccagttaacaccagctacaactattttactgaaggagagctagaagacttgtgcaaatcctgtggccttgtcaactacagcagcaatgttcagaggtcatttatcatgttctccgggcaaaagccatactgaagaatcctgtcaaatccaaactctgttgtttcttcaggattccttgcaaaaacacgtttagaagtatttgcgtatatttgtgccatactgtgcataggttccttaatttctgtactattccttaatgtattcagtaccaaaaaaaaatgcatgctgcagactcttagaaaagcc

SEQ ID NO: 2157 - DNA, 1504 bp, Oryza sativa
cgcgggattcccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcctccttggccaccgccgcctccccgctcgccgggtggctgtcgaggccgccgcgatcgccgtcgagccggaaaacaaagtaccgcagagtaacaattcagaagccgaggtgtttgcatgccctgtttgctatgagccattgataaggaaaggcccatcgggcataaacttgccatcaatttataggtctgggttcaaatgttcaaagtgcaacaagtcattcaccagcaaagatatcttcttggatctcactgtcacttctggaacaaaagaatatagtgaattgaagccagctagaactgagctgttcaggagcccactcgtctcatttctttatgaaagagggtggcgtcaaaatttcaatcgaagtggattccctggacttgacgaagagtttcaaatggctcaagattatttccaatcagttgctggtggtgtacttcttgatgtaagctgtggcagtggcttgttcacaagaaaatttgcaaaatctggatcgtactcagctgtgattgctttggacttctccgagaatatgctttgccagtgttatgaatttattcagcaagatgatactcttgtaaacacaaatcttgctcttgtaagggcagatatttcgagactcccttttgcttcatcttcaattgatgccattcatgctggagctgctatccactgctggccctccccttcgaatgcggtggctgaaataagtcgagtcctgaggcctggtggtgtctttgtagcaacaaccttcttatcttctcccaggaacaatcccttctctgttgaagcgttgcggccactgagacagattgttggaccagttaacaccagctacaattacttcaccgaaggagagctcgaagacttgtgcaaatcctgcggtcttgttaattacagcagcaaggtccagaggtcgttcatcatgttttctgggcagaagccgtagcctaaaattacatcaaaacctttgtagccaaagtatagctgtcaattctacaaaagtctttgtaaaatgccattcaccgatacctgcatagattagacccagcagaagtttttgctgcgaattcctctccctgttatgaagatatagttgtcacatgtatactgtgcttcagtacagtgatgtaccacagccagggtgtatttcacacctggaagaaaaaaaaaacgttctagtactattttcccaacttgtatagggcctcttttggaatggaggattttttcaggaattgaactataattcctgtggaattcctataagattcctacgttcgaaagggccttaaatgatttatttaggc

SEQ ID NO: 2158 - DNA, 1337 bp, Brachypodium distachyon
gccgactgcctcgcgcgggtcctccaatccgcgcgcgcccatggacctcgcggtgagagcgtctgccgccgcggcttcctcctgctccccctaccccacctcgctccagcaccagcagcccccccgcgcgcgcgccactcaccacctccgccgccggcgccccggcctcacactgccagctcgccgggtcgtcgccgccgccgccgcgtccatcgccgtggacccggaaaccaacgccgagcggaatgacatctcagaagctgaggtgttcgcgtgccctgtttgctatgaaccgttgatcaggaaaggccctccaggcataaacctgccagcaatttataggtctggattcaagtgttcgaaatgcaagaagtcgttcaccagcaaagacatcttcttggacctcactgtcacctcgggaacaaaagagtacagcgagctgaagcctgctagaaccgagctgttcaggagcccgctcgtctcgttcctttacgagagagggtggcgccaaaacttcaaccggagtggcttccctggtcttgatgaagagttccaaatggctcaagattattttcaaccggtagctggcggtatactcatcgatgtcagctgcggcagtggcctgtttacaaggaagtttgcaaagtctggggcatactcagctgtggttgctttggacttctctgagaatatgctccgccaatgctatgaatacatcaagcaagatgatacccccctaaacacgaaccttgcactcgtaagggctgatatttcgaggctcccttttgcttcatgttcaattgatgccattcacgctggagctgctatccactgttggccatccccttcaaatgcggtagctgagatcagccgtgtgctgaggccaggcggcgtctttgtggcaacaaccttcttatccacccccacgaacagcggccccttctccgttggaccattaaggccactaagacagattgttggaccagtgaacagcagctacaatttcttcactgaagcagagctggaagacctgtgcaaatcctgtggcctggttaactacagcagcaaggtgcagaggtcgttcatcatgttctctgggcaaaagccttagccaggaattccatccaaacattgtatagccacagtttactactccgtaccccatgagatatggaaggccggaacccggaagttgtagatgcagaggccggaagaaactctttgcacatattaattcggttgcaccgtatatatgtcaggtatcagttgatgcatgcgatgcgaaagcaaggagatgcgcaaaataccttgaaaagttgaaatcaaagtccctcgtt

SEQ ID NO: 2159 - DNA, 1386 bp, Brachypodium distachyon
cgccataggaagagcacgtcgtcccgtcctcgctttcttcttctgccgactgcctcgcgcgggtcctccaatccgcgcgcgcccatggacctcgcggtgagagcgtctgccgccgcggcttcctcctgctccccctaccccacctcgctccagcaccagcagcccccccgcgcgcgcgccactcaccacctccgccgccggcgccccggcctcacactgccagctcgccgggtcgtcgccgccgccgccgcgtccatcgccgtggacccggaaaccaacgccgagcggaatgacatctcagaagctgaggtgttcgcgtgccctgtttgctatgaaccgttgatcaggaaaggccctccaggcataaacctgccagcaatttataggtctggattcaagtgttcgaaatgcaagaagtcgttcaccagcaaagacatcttcttggacctcactgtcacctcgggaacaaaagagtacagcgagctgaagcctgctagaaccgagctgttcaggagcccgctcgtctcgttcctttacgagagagggtggcgccaaaacttcaaccggagtggcttccctggtcttgatgaagagttccaaatggctcaagattattttcaaccggtagctggcggtatactcatcgatgtcagctgcggcagtggcctgtttacaaggaagtttgcaaagtctggggcatactcagctgtggttgctttggacttctctgagaatatgctccgccaatgctatgaatacatcaagcaagatgatacccccctaaacacgaaccttgcactcgtaagggctgatatttcgaggctcccttttgcttcatgttcaattgatgccattcacgctggagctgctatccactgttggccatccccttcaaatgcggtagctgagatcagccgtgtgctgaggccaggcggcgtctttgtggcaacaaccttcttatccacccccacgaacagcggccccttctccgttggaccattaaggccactaagacagattgttggaccagtgaacagcagctacaatttcttcactgaagcagagctggaagacctgtgcaaatcctgtggcctggttaactacagcagcaaggtgcagaggtcgttcatcatgttctctgggcaaaagccttagccaggaattccatccaaacattgtatagccacagtttactactccgtaccccatgagatatggaaggccggaacccggaagttgtagatgcagaggccggaagaaactctttgcacatattaattcggttgcaccgtatatatgtcaggtatcagttgatgcatgcgatgcgaaagcaaggagatgcgcaaaataccttgaaaagttgaaatcaaagtccctcgttaattg

SEQ ID NO: 2160 - DNA, 1289 bp, Avena sativa
gtccaggctccagccccagcgcgctactgcttcgattgcagctcacatggagctcgcggtgagagcggccgcagcttcgtgctcctcctacccgtccctccagcgcgccggcgttccccgccgcctccgtcgtagcccaggcctgccgccgctgccggctcgccgagtggccgtcgccgcggccatcgccgtcgacccggttcaggatatcaaaaccgagcagaatgacgttccagaaaccgaggtgttcgcatgccctgtttgctatgaaccactgataaggaaagggccgccaggcatgaacttgtccgcaatttataggtccggtttcaagtgtttgaaatgcaaaaagtcattcaccagcaaagatatcttcttagatctcaccgtcacctcgggaacgaaagagtacagcgagctgaagcctgctaggactgagctgtttaggagcccgctcgtgtcgtttctttacgagagaggatggcgtcagaacttcaaccggagtggcttccctggtcgcgatgaagagttccaaatggctcaagattatttcgaaccagtcgctggtggtatactagttgatgtcagctgcggaagtggcttgtttgcaaggaagttcgcaacctctggggcatactcatcagtgattgctctggacttttctgagaatatgctccgccagtgctatgattacattaagcaagacgatacccccctaaacacgaaccttgcacttgtaagggctgatatttcaaggctcccttttgcttcatgttcaattgatgctattcatgctggggccgctatccactgttggccatccccttcaaatgcggtagctgaaatcagccgagtgctgaggcctggcggcgtctttgtggggacgaccttcctatcctcccccacgaacagcggcccgttctcttccggggcgttgaggccactgagacagattgttggacccgtgaacagcagctacaatttcttcacggaaggagagctggaggatctgtgcagatcctgcggcctggtcaactacagcagcaaggtgcagaggtcgttcatcatgttctccgggcagaagccgtcgtagcccaagaaccccgtccaggctcactatgtatatagccgcatgcagtatatatggccacagcactgttctcgacaactgtatatacggtagtagagtatataggcgatgaaagtgtaaaaaacttaaatacacatattggacaactgaaacaaaatgtgttatggtctctgactagagaattcagtatacattccga

SEQ ID NO: 2161 - DNA, 1769 bp, Sorghum bicolor
cctctcctccgcagtcctactcggctactcctacccgcgcggccgccgccgacccgcgccctcgcagctctccccctccgcttctcctcctcaccaggaatggcgtcggcgggattcccctcccgaatcgccgggattagtgtccgtcccgactccagttcggcctgccttattcacaaggttggagcgccgtcgaattctctccctggagcggtggctgttcaggttcaaggccaccagaacagggtccgcaatggccaagctatcaggtgtgcaatggcaactggaaaagagcagggtgcaatttccactgctagtagtggtgatcaaaccaagggtggattgcgtggaaaattaaataaagttgttttagcttacagtggtggtttggatacttccgttattgttccatggctcagggagaactatggttgtgaagtcgtctgtttcactgctgatgttggccagggtgccattgaattggaagggttagagaagaaggcaaaagccagtggtgcatgccagcttgttgtgaaggacctgagagaagaatttgttagtgaatatatatacccctgcctgcgtgcaggtgcagtttatgaaagaaagtatctgcttgggacttcgatggctaggcctgttattgctaaggcaatggttgatgttgccaaggaagttggtgcagatgcagttgcccatggatgcactgggaaaggcaatgatcaggttcgctttgagcttacgttctatgctttaaatcctgaacttaaagtggtggcaccttggagggagtgggatatcacaggacgtgaagatgctattgaatatgcaaagaaacataatgtacctgttccagtttcaaagaaatcaatatacagccgagatcgaaacttgtggcaccttagccatgagggtgacatcctggaggacccagcaaatgagccaaaggaagatatgtatatgatgtctgttgctccggaaaatgcaccctcggaacctgagtatctggagattggtatcattgccggtgttcctgtttcaatcaatggtcgagacctctcaccagcttccctcctctcggagctcaatgaaatcggtggaaagcatgggattgggcgtatcgacatggtggaaaaccggctggtcggcatgaagtcacgtggtgtgtatgagacccccggtggcaccatcatggcagccgcggtgcgtgagttggagtccttgactctggacagggagacaatgcagtggaaggacatcattgcccttaagtacgctgagctggtctacgcaggccgctggtttgacccgcttcgtcagtcctttgacgccttcatggagaagattaccgcgacgaccactggttcggtgaccctgaagctgtacaaggggtcggtgaacgtcgcgtcccggaagagcccctacagtctgtacagggaagatatctcctcgtttgagaatggggagatctacaaccaggctgacgcggaggggttcatcaggctgtatggtctaccgacacgggtccgggcaatgctggaaaagggtatctgagtagttgtctggttgattgttagaaataaaaatctctttcatgggagtttcctagtgattgcagactgatgggtatttgatgggattgtgttgtacactttctttgagtttgtcccaatgtatttgggtgacaattgagtttaccatgccatgttaccatccgtttatgctatacagtccaatgcaaaatattatgattaatacatcagctggtt

SEQ ID NO: 2162 - DNA, 1740 bp, Saccharum officinarum
gcaccagcgccaacccgtgttctcgcagcccccctccgcttctcctcctctgcgggaatggcgtcggcgggattcccctcccgaatcaccgggattagtgcccgtcccgactccagttcggcctgccttattcacaaggttggagccccgtcgaattctcttcctggcgcggtggctgttcaggttcaccgccaccagaacaaggtccgcaatggccaagctatcaggtgtgcaatggcaactggaaaagagcagggtgcaatttccactgctagtagcggtgatcaaactaagggcggattgcgtggaaaattaaataaagttgttttagcttatagtggtggtttggatacatccgttattgttccatggctcagggagaactatggctgtgaagtcgtctgtttcactgctgatgttggccagggtgccattgaattggaagggttggagaagaaggcaaaagccagtggtgcatgccagcttgttgtgaaggacctgaaagaagaatttgttagtgaatatatatacccttgcctgcgtgcaggtgcagtttatgaaagaaagtatctgcttgggacttcgatggctaggcctgttattgctaaggcaatggttgatgttgccaaggaagttggtgcagatgcagttgcccatggatgcactggaaaaggcaatgatcaggttcgctttgagcttacattctatgctttaaatcctgaacttaaagtggtggcaccttggagggagtgggatatcacaggacgtgaagatgctattgaatatgcaaagaaacataatgtacctgttccagtttcaaagaaatcaatatacagccgagatcgaaacttgtggcaccttagccatgagggtgacatcctggaggacccagcaaatgagccaaaggaagatatgtatatgatgtctgttgctccagaaaatgcaccctcgaaacctgagtatctggagattggtatcattgccggtgttcctgtttcaatcaatggccgagacctctcgccagcgtccctcctctcggagctcaatgaaatcggtggaaagcatgggattgggcgtatcgacatggtggaaaaccggctggtcggcatgaagtcacgtggcgtgtatgagacccccggtggcaccatcatggcagccgcggtgcgtgagttggagtccctgacactggacagggagacaatgcagtggaaggacatcattgccctcaagtacgccgagctggtctacgcaggccgctggtttgacccactccggcagtcctttgatgccttcatggagaagattactgcgacgaccactggttcagtgaccctgaagctgtacaagggatccgtgaacgtcgcgtcccggaagagcccctacagcctgtacagggaggatatctcctcgtttgagaatggggagatctacaaccaggctgacgctgaggggttcatcaggctgtacggtctaccgacacgggtcagggcgatgctggagaagggtatctgagtagttgcctgtttgatttattattagaaaataaaagtatctttcatgggagtttcccagtgattgcagacagatgggtatttggtgggattgtgttgtacactttgtttgagtctgtcccgatgcatttgggtgacagaatggagtttaccatgccatgttaccatccgtttacggtatgcactgtccaacccaaaatactatcattaatacatcagctgttttctt

SEQ ID NO: 2163 - DNA, 1670 bp, Panicum virgatum
gcagggatcagtgtccgtccgaacaccaatgtggcctgccttgttcagaagggtggagccctgtcaaattccctccctactggagccgctgttcaggttcgccggcgtcacaacaaggcccgcaatggccaagctatcaggtgtgcaacggcaactggaaaagagcagggtgcagtcacccctgctagtagtggtgatcaaaacaaaggtggattgcgtggcaaattaaataaagttgttttagcttatagtggtggcttggatacatctgttatcgttccatggctcagggagaactatggttgtgaagttgtttgtttcactgctgatgttggccagggtgccattgaattggaaggattggagaaaaaggcaaaagctagcggagcatgccagcttgttgtaaaggacttgagagaagaatttgttagtgaatatatatacccctgcctgcgagctggtgctgtttatgaaagaaagtatctgcttgggacttcaatggctaggcctgttattgctaaggcaatggtcgatgttgccaaggaagttggtgcagatgcagttgctcatggatgcactgggaaaggcaatgatcaggttcgctttgagcttacgttttatgctttaaatcctgaactcaaagttgtggcaccttggagggagtgggacatcacaggacgtgaagatgcaattgagtatgcaaagaaacacaatgtaccagtaccagtttcaaagaaatcaatatacagccgagatcgaaacttgtggcaccttagccatgagggtgacatcttggaggacccagcaaatgagccaaaggaagatatgtatatgatgtctgttgctccagagaatgcaccttcagaacctgagtatctggagattggcatcgttgcaggtgttcctgtttccatcaacggacgggagctctcgccagcatccctccttgcggagctcaatgaaattggtgggaagcatgggatcgggcgcattgacatggtagagaaccgccttgtaggcatgaagtcccgtggtgtctatgaaacccctggtggtaccatcatggcagccgcggtgcgggagctcgaggccttgactctggacagggagaccatgcagtggaaggacatggtggccctcaagtatgctgagctggtctatgcaggccgctggtttgaccctctccggcagtcctttgacgccttcatggagaagatcaccgcgacgaccactggttcagtgaccctgaagctgtacaaggggtcggtaaatgttgcatcccggaagagcccctacagcctctacagggaggacatctcatcatttgagaacagggagatctacaaccaggctgatgctgagggattcatccggctctatggtctcccgacacgggtccgggcgatgctggagaagggcatctaagctcctctgtttgttttagaaataaaagccatcattcagaaactgtcaaatagtttcgagtgattgcacacacatcattttgtaccaatcgttttaagtttgtcccagtgaactctgaatgcatttggatgacagaatggatatgaatattattagtaatctgctggctgctgatgtaggacacaagttcagacgtataaataaatggtaaatataaattttacattggagcctctcaacctgcc

SEQ ID NO: 2164 - DNA, 1733 bp, Zea mays
aggtaaacctctccgtagtcctactcttgtccgacccgcgcggccgccgccagcccgcgccctcggagcccccttccgcttctcctctccgggaatggcgtcggcgcgaggaccttgcggaattagtgtccgttctgacttcagttcagcctgccttattcacaaggctggagccccatcgaattctgtttctggcgtgatggctgttcaggttcaccgccaccgtaacaaggtccgcaatggccaagctatcaggtgtgcaatggcaactggaaaagagcagggtgcaatttccactgccagtagcggtgatcaaaccaagggcggtttgcgtggaaaattaaacaaagttgttttagcttatagtggtggtttggatacatccgttattgttccatggctcagggagaactatggttgtgaagtcgtttgtttcactgctgatgttggccagggtgccattgaattggaagggttggagaagaaggcaaaagccagtggtgcatgtcagcttgttgtgaaggacctcaaagaagaatttgttagtgaatatatatacccctgcctgcgtgcaggtgcagtttatgaaagaaagtatctgcttgggacttcgatggctaggcctgttattgctaaggcaatggttgatgttgccaaggaagttggtgcggatgcagttgcccatggttgcactggaaaaggcaatgatcaggttcgctttgagcttacattctatgctttaaatcctgaacttaaagtggtggcaccttggagggagtgggatatcacaggacgtgaagatgctattgaatatgcaaagaaacataatgtacctgttccagtttcaaagaaatcaatatacagccgagaccgaaacttgtggcaccttagccatgagggtgacatcctggaggacccagcaaatgagccaaaggaagatatgtatatgatgtcgattgctccagaaaatgcgccctcgaaacctgagtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcatcaggctgtacggcctaccgacacgggtccgggcgatgctggagaagggtatctgagtagttgcctgcttgatttagaaataaaaacatctgtttcccagtgattgcagacagatgggtgtttggtggggagttcaccatgctgttttaccatccgtttacattgtccaaaccaaaatattatcattgctacatcagctgcttttctcattggtttatattgagcagaccattctggtcgattatcgtc

SEQ ID NO: 2165 - DNA, 1831 bp, Oryza sativa
cacaaatactcccccaccaacctcctcctccgccgccgccgccgccgcctcccctctcgcctcgccgcgcttaaaccctcgccgccttcccgctccgaacgcccctcccttcgccgccgcccccgaccatggcgcacgccctcggctgcggcgccgccaccgcccccgccggggtgggtctcctccaccaccacgagaaggctggggcgttgttcagtgccgcaggctccatcgttcgggttcagcagctcagcgggaaggggagcaaaagccaagctataagatgtgcaatgccaagtgcaagtgagcatggtggaatttcaaccgcaacagctaatagtagtgatcaaaagaaaggtggactgcgtggcaaactgaataaagttgttctagcttacagtggtggtttggatacatcagttattgttccatggctccgggagaactatggttgtgaagttgtctgtttcactgctgatgttggccagggtgacattgaattggaagggctagagaagaaggcaaaagctagtggtgcaagccagcttgttgtgaaggacttgaaagaagagttcgttagtgaatacatatacccctgcttgcgtgctggtgcagtttatgaaagaaagtatctgctggggacttcaatggctaggcctgttattgccaaggcaatggttgatgttgcaaaggaagttggtgcagatgcagttgctcatggatgcactggaaaaggcaatgatcaggttcgttttgagcttacattctatgctttaaaccctgagcttaaagtggtggcaccttggagggagtgggatatcacaggacgtgaagatgctattgagtatgcaaagaaacacaatgtgccaattcctgttacaaagaaatcaatatacagccgtgatcgaaatttgtggcaccttagccatgagggtgacattttggaagatccagcaaatgagccaaaggaagatatgtatatgatgtcagttgcaccagaaaatgcaccttcaaaacctgagtatttggagattggtattattgcaggtgttcctgtttccatcaatggaaaagatctctcaccagcatctctccttgccaagctcaatgaaatcggtggaaagcatggtattgggcgcattgatatggtggaaaaccgcctcgtaggcatgaagtcccgtggtgtatacgagacccccggtggcaccatcatggcagctgctgtccgtgagctcgagtccttgactttggacagggagacaatgcagtggaaggacatgcttgccctcaagtacgccgagctggtctacgctggccgttggttcgacccgctccgacaatccattgatgcgttcatggagaacattaccgcgacaacaaccggctccgtgactctcaagctgtacaagggctccgtaaacgtcgcgtcccggaagagcccatacagcctgtacagggaagacatctcctcatttgagaatggggagatctacaaccaggctgatgctgaagggttcatcaggctatatggtctccctaccagagtccgggcaatgctggagaagggcatctaagcccctgttttctgcttaaaatgtacttctgtgctttggagaaaatgtagcaccacctcatgcagtgttgcctgcaggtaggcactgaatactttccgagttgtattagcgttcgaaagcttaactgccatctcaattcgattacaactttcgtgaagtgttgcatgatcatgtaatgaataatggggttgtacctgattttgacttggttgtctaaattgcaataagattgtctcatgtggtgccgtcgttgtgtt

SEQ ID NO: 2166 - DNA, 1377 bp, Echinochloa colona
ccgaccaccccgcgccgccaccaccccctgccgaagcacgccgcctccggtgctcctctctctctcaaggaatggcgtttgctggagacgcctcccggctcgccgggattagtgtccgcccggactccagcgcggcccgcctcgttcagaaggtcggagctctgtcgaattccctccctggcgctgccgcagtccaggttcgccggcgccagaaccaggcccgcaatggccaagctatcaggtgttcaatggcaactggaaaagcgcagggttcagtcaccactgctagtagtggcgatcaaaacaaaggtggattgcgtggcaaattaaataaagttgttttagcttatagtggtggattggatacatctgttattgttccttggctcagggagaattatggttgtgaagtcgtatgttttactgccgatgttggccagggtgccattgaattggaaggattggagaagaaggcaaaagctagtggagcatgccagcttgttgtgaaagacttgaaagaagaatttgttggtgaatacatatacccctgcctgcgagctggggcagtttatgaaagaaagtatcttctggggacttcaatggctaggcctgttattgctaaggcaatggtcgatgttgccaaggaagttggtgcagatgcagttgctcatggatgcactggtaaaggcaatgatcaggttcgctttgagcttacgttttatgctttaaatcctgaactcaaagtggtggcaccttggagggagtgggacatcacagggcgtgaagatgctattgagtatgcaaagaaacataatgtaccagttccagtttcaaagaaatcaatatacagccgagatcgaaacttgtggcaccttagccatgagggtgacatcttggaggacccagcaaacgagccaaaggaagatatgtatatgatgtctgttgctccagaaaatgcaccttcagaacctgagtatctggagattggcatcgttgcaggtgttcctgtttccatcaatggacgagacctctcacccgcgtctcttcttgcggagctcaatgaaatcggtggaaagcatggaattgggcgcattgacatggtggagaaccgccttgtaggcatgaagtcccgtggtgtttacgagacccctggtggcacaatcatggcagccgcggtgcgtgagctggagtccctgacgctggacagggaaaccatgcaatggaaggacatggtcgccctcaagtacgccgagctggtctatgcaggccgctggtttgacccgcttcggcagtcctttgatgctttcatggagaagatcactgcgacaaccacaggttcagtaaccttgaagctgtacaaggggtcggtaaacgtcg

SEQ ID NO: 2167 - DNA, 1790 bp, Secale cereale
gtctgacccgagccttccacttccacccagtcgcccgccccccatgccgctcccgatgcgccgcctcgccgccgctccctccctcccagccgtgcacccgcacgactcccctgcgccgccctccgttcgcctccggcgacagcatggccgggtctcgatggagaggtcctcgacgacgacggcccgaggtgttagttgcgtgatggcaagtggtaaggagcatgcagcaactactagtggtgatgaaaagaaaggtggactacgtggcaaactgaaaaaagttgttctagcttacagcggtggcttggatacatcagtaattgttccatggcttagggagaactatggctgtgaagtcgtctgtttcactgctgatgttggccagggtgacattgaattggaaggattggagaaaaaggcaaaagctagcggtgcaagccagcttgttgtgaaggacttgacagaagaatttgttggtgaatatatatacccctgcttgcgtgctggtgcagtttacgaaagaaagtatctgcttgggacttccatggctaggcctgttattgctaaggcaatggttgatgttgccaaggaagttggcgcagatgcagttgctcatgggtgcactggaaagggcaatgatcaggttcgctttgagcttacattctatgccttaaatccggaacttaaagtggtggcaccctggagggaatgggatatcacaggacgtgaagatgcaattgagtatgcaaagaaacacaatgtgccaattccggtttcgaagaaatcaatatacagccgagatagaaatttgtggcaccttagccatgagggtgacattttggaagatccagcgaatgagccaaaagaagatatgtatatgatgtctgtttctccagaaaatgcaccttcaaaacctgagtatctggagattggtatagtcgctggtgttcctacctctatcaacggtaaagatctctcgccagcaactctcctcgccaagctcaacgagatcggcggaaagcacggtatcgggcgcattgacatggtggagaaccgcctggtggggatgaagtcccgtggcgtctacgagacccccggcggcaccatcatggcggccgcggtccgcgagctcgagtccctgacactagacagggagacgatgcagtggaaggacatgctggccctcaagtacgcggagctcgtctacgcggggcgctggttcgacccgctgcggctgtccatggacgccttcatggagaccatcaccgcgacgacgaccggctcggtgaccctgaagctgtacaaggggtcggtgacggtcgcgtcacggaagagcccctacagcctgtacagggaggacatctcgtcgttcgagaacggagagatctacgaccaggctgatgctgagggcttcatcaggctgtacggcctccccacccgggtccgtgcgatgctggagaagggcatctaagctcgtcttcgcgtctcgaataaattgttttctcattgaaaactgtccgaagtgtcttgagtaactgtggacaaagggaagatttccaggcgggtgggctttgagcacattgtggagttttccgttttggttggtagccttttcatctggtgtgcgttgatatatgtattgaggagttgctccaacttgccgtaatatactgcttggtgctgcggtgcagtccttgtctacttacgctttggtcgtgtttggttactcgtgtcatttttggcttccgcctggtagtctgaatgggccatgaggtgtgtgtgccaagttg

SEQ ID NO: 2168 - DNA, 1757 bp, Triticum aestivum
cttccacccagccgcccgccccccatgccgctcccgatgcgccgcctcgccgccgctccctccctcccagccgtgcacccgcacgactcccccgcgccgccctccgttcgcctccggcgacagcatggccgggtgtcgatggagaggtcctcgacgacgacggcccgaggtgttagttgtgtgatggcaagtggaaaggagcatgcagcaactactagtggtgatgaaaagaaaggtggactgcgtggcaaactgaaaaaagttgttctagcttacagcggtggcttggatacatcagtaattgttccatggcttagggagaactatggctgtgaagtcgtctgtttcactgctgatgttggtcagggtgacattgaattggaaggattggagaaaaaggcaaaagctagcggtgcaagccagcttgttgtgaaggacttgacagaagaatttgttggtgaatatatatacccctgcttgcgtgctggtgcagtttacgaaagaaagtatctgcttgggacttccatggctaggcctgttattgctaaggcaatggttgatgttgccaaggaagttggcgcagatgcagttgctcatgggtgcactgggaagggcaatgatcaggttcgctttgagcttacattttatgccttaaatccggaacttaaagtggtggcaccctggagggagtgggatatcacaggacgtgaagatgcaattgagtatgcaaagaaacacaatgtgccaattccggtttcaaagaaatcaatatacagccgagatagaaatttgtggcaccttagccatgagggtgacattttggaagatccagcaaatgagccaaaagaagatatgtatatgatgtctgtttctccagaaaatgcaccttcaaaacctgagtatctggagattggtatagttgctggtgttcctacttctatcaacggtaaagatctctcgccagcaactctcctcgccaagctcaacgaaatcggcggaaagcatggcatcgggcgcatcgacatggtggagaaccgcctggtggggatgaagtcccgtggcgtctacgagacccccggcggcaccatcatggcggccgcggtccgcgagctcgagtccctgacactggaccgggagacgatgcagtggaaggacatgctggccctcaagtacgcggagctcgtctacgcggggcgctggttcgacccgctccggctgtccatggacgccttcatggagaccatcaccgcgacgacgaccggctcggtgaccctgaagctgtacaaggggtcggtgacggtcgcgtcccggaagagcccctacagcctgtacagggaggacatctcgtcgttcgagaacggggagatctacgaccaggctgacgctgaaggtttcatcaggctgtacggcctccccacccgggtccgcgcgatgctggagaagggcatctaaaggtcgtctttgcgtctcgaataaattgttttctcattgaaaactgccgagtgtgtctttgagtaactgtggacaaatggaagatttccaggcgggtgggctttgagcacattgtggagtttctgttttgtttggtagccttttcatccggtgtgcctggatatatgtattgaggagttgctccaacttgccgtaatatactgtttggtgctgccgtgcattccttgtctatttactttacacttggtgccttcgaatcatccaagtatgtgaggctaaaacgaagcatccgccattttagttcc

SEQ ID NO: 2169 - DNA, 1977 bp, Brachypodium distachyon
gaaaggtgcccttgggttctcgctcggtcagacagacttggaaacatgaatcccgtcgcttgtcttcgtcttcgagcgagcgccgccacctctccctccccatcccaacgccagccccctcgctccgtctatcgtcttcctcctcgtgcgagcgcctccaccgcagctgttagttgcgtaatggcaagtggaaaagagcatgccacaactgctagtgctgatcaaaagaaaggtggattgcttggcaaattaaataaagttgttctagcttacagcggtggcttggatacatcagtaattgttccctggctcagggagaactatggttgtgaagtcgtatgtttcactgctgatgttggccagggtgccattgaaatggaaggattggagaaaaaagcaaaagctagtggtgcaagccagcttgttgtcaaggacctgacagaagaatttgttggccaatatatatatccctgcctgcgtgctggtgcagtttacgaaagaaagtatctgcttggtacatcaatggctaggcctgttattgctaaggcaatggtcgacgttgccaaggaagttggtgcagatgcagttgctcatgggtgcactggaaaaggcaatgaccaggttcgctttgagcttacattctatgccttaaatccggaacttaaagtggtggcgccttggagggagtgggatattacaggacgtgaagatgcaattgagtatgcaaagaaacacaacgtgccagttccagtttcaaagaaatcaatatacagccgtgatcgaaatttgtggcaccttagtcatgagggtgacattttggaagacccagcaaatgagccaaaagaagatatgtatatgatgtctgtttctccagaaaatgcaccttcaaaacccgagtatctggagattggtatagttgccggtgttcctacttctatcaacggaaaggatctctcgccggcatctctccttaccaagctcaatgaaatcggtgggaagcatggtattggccgtatagatatggtggaaaaccgccttgtggggatgaagtctcgtggtgtttacgagacccctggtggcaccatcatgtcagctgcggtccgcgagcttgaggccctaacacttgatagggagacaatgcagtggaaggacatgcttgccctcaagtacgcggagctggtgtacgctgggcgttggtttgacccgctccgacagtccatggatgcgttcatggaaacaatcacggcgacaacgacaggttctgtgaccctgaagctgtacaagggctcggtgactgtcgcgtctcggaagagcccctacagcctgtacagggaagacatctcatcgtttgagaacggggagatctacaaccaagcggatgctgaaggtttcatcaggctgtacggtctgcctacccgagttcgcgcaatgttggagaagggtatctaagatcccaagtctgttgtgtgtttgaataattgtctctctcgacaactgttgggtgtattctagaaatattttggacagaatttgggttgaacacaatttgggttttcagttagtatggtaacttgcagtaagatgccatttggtgccgtggatgatgcagtccttatgttattgcacttgattacatttttagtcagaagccctcaacctttgtagccatggagaaagaagtaatgacaggaaagaatgcgtacgtggcctcagcatgcacttgcaaacgcacttttcttctgacggaatatctccagctcggctgtttttcattgattagtaaggatgtataagaaagagtttacaatactcgattagatgcaatcagggtgggttgaattacctttttcgaactgccctagctaagtccaacaatactgataagtttgctgcacaccatcagagtcaactgattgtttgtgaacactctaccattcctctcagtccaccagagcagcataatatggttgcattcca

SEQ ID NO: 2170 - DNA, 1704 bp, Festuca arundinacea
acccctagccagcgtggtctgcaccaaacttttccacccagccgccaccatgccgctccccatgcgccgcctcgccgctgccccatccctcccagcggtacacccgcacgactccgccgcgccgccctccgttcgactccggcgacaacatggccgggtggcgatggagaggacgtcgacgacgacggcccgaggtgttagttgtgtagtggcaagcgggaaagagcatgcagcaactactagcggtgatgaaaagaaaggtggactgcgtggcaaactaaaaaaagttgttctagcttacagtggtggcctggatacatcagtaattgttccgtggctcagagagaactatggctgtgaagtcgtctgcttcactgctgatgttggccagggtgacattgaaatggaaggattggagaaaaaggcaaaagctagtggtgcaagccagcttgttgtaaagaacttacaagaagaatttgttggtgaatatatattcccctgcttgcgtgctggtgcagtttacgaaaggaagtatctgcttgggacttcaatggctaggcctgttattgctaaggcaatggttgatgttgccaaggaagttggcgcagatgcagttgctcatgggtgcactggaaagggcaatgatcaggttcgctttgagcttacattttatgccttaaatccggaacttaaagtggtggcaccctggagggaatgggatatcacaggacgtgaagatgcaattgagtatgcgaagaaacacaacgtgccagttccagtttcaaagaaatcgatatacagccgagacagaaatttgtggcaccttagccatgagggtgacattttggaagatccagcaaatgagccgaaagaagatatgtatatgatgtctgtttctcctgaaaatgcaccttcaaaacctgagtacctggagatcggtatagttgctggtgttcctacttctatcaatggaaaggacctctcaccagcatctcttcttgccaagcttaatgaaatcggtggaaagcacggtatcgggcgtattgacatggtggaaaaccgcctcgtggggatgaagtcccgtggtgtctacgagacccctggtggcaccatcatggcagcggcggtccgtgagctggagtccctaacactggacagggagacaatgcagtggaaggatatgctcgccctcaagtacgctgagcttgtctacgctgggcgctggttcgacccgctccggcagtccatggacgcgttcatggagacgatcacagcgacaacgaccggttctgtgaccctgaagctgtacaagggctcggtgaacgtcgcgtcccggaagagcccctatagcctgtacagggaagacatctcttcgtttgagaatggggagatctacaaccaggctgatgctgagggtttcatcaggctgtacggtcttcccacccgagttcgcgcaatgctggagaagggtatctaaggtcactttgtgtcttgaataaaattttctgtttgagaactgctgggtgtattctagtaattctggacaaatccaagatgtcctggtgggctctgagtacatttttcagtttctttttgagttagtagccttatcttcatgaggtgtgcctggatatatgcattgaagagttgctccagtcctggagtggtaacttggagtaatataccgtttggtgctgtggtaaa

SEQ ID NO: 2171 - DNA, 2252 bp, Lolium multiflorum
agctagtgggcatcacacgggcttcctattccccgacccgtctactttccccctcatcttgcttcctatttgccgttgccctacctactccctcagcgtcagcacaaccttccaccccgccgcctccatgcctctccctatgcgccgcctcgccgctgccccatccctcccagcggtacacccgcacgactccgccgcgccgccctccgttcgactccggcggcagcatggccgggtggcgatggagaggacgtcgacgacgacggcccgaggtgttagttgtgtagtggcaagcgggaaagagcatgctgcaactactaccggtgatgaaaagaaaggtggactgcgtggcaaactaaaaaaagttgttctagcttacagtggtggcctggatacatcagtaattgttccgtggctcagagagaactatggctgtgaagtcgtctgcttcactgctgatgttggccagggtgacattgaaatggaaggattggagaaaaaggcaaaagctagtggtgcaagccagcttgttgtaaagaacttacaagaagaatttgttggtgaatatatattcccctgcctgcgtgctggtgcagtttacgaaaggaagtatctccttgggacttcaatggctaggcctgttattgctaaggcaatggttgatgttgccaaggaagttggcgcagatgcagttgctcatgggtgcactggaaagggcaatgatcaggttcgctttgagcttacattttatgccttaaatccggaacttaaagtggtggcaccctggagggaatgggatatcacaggacgtgaagatgcaattgagtatgcgaagaaacacaacgtgccagttccagtttcaaagaaatcgatatacagccgagacagaaatttgtggcaccttagccatgagggtgacattttggaagatccagcaaatgagccgaaagaagatatgtatatgatgtctgtttctcctgaaaatgcaccttcaaaacctgagtacctggagatcggtatagttgctggtgttcctacttctatcaatggaaaggacctctcaccagcatctcttcttgccaagctcaatgaaatcggtggaaagcacggtatcgggcgtattgacatggtggaaaaccgcctcgtggggatgaagtcccgtggtgtctacgagacccctggtggcaccatcatggcagcggcggtccgtgagctggagtccctaacactggacagggagacaatgcagtggaaggatatgctcgccctcaagtacgctgagcttgtctacgctgggcgctggttcgacccgctccggcagtccatggacgcgttcatggagacgatcacagcgacgacgaccggttctgtgaccctgaagctgtacaagggctcggtgaacgtcgcgtcccggaagagcccctatagcctgtacagggaagacatctcttcgtttgagaatggggagatctacaaccaggctgatgccgagggtttcatcaggctgtatggtcttcccacccgagttcgcgcaatgctggagaagggtatctaaggtcactttgtgtcttgaataaaattttctgtttgagaactgctgggtgtattctagtaattctggacaaatccaagatgtcctggtgggctctgagtacatttttcagtttctttttgagttagtagccttatcttcatgaggtgtgcctggatatatgcattgaagagttgctccagtcctggagtggtaacttggagtaatataccgtttggtgctgtggtacactccctgtctcgttgcatttcttttgaaatttgaccatcaagcaagaatagcaataactgaggagaaaaatggaatccacacatatgtcactgaagctttgattgatcctatacaatattgtgaagttccaccgaaatcttggaaagactggccatttggttttagcttctcttcaccactgctcatgaaacttgttttgcagttcgcagttttttagaccacagtagaatcatacaccaacaccatagtaaggaggtcttgtggattaccctcacaaactagtgctcactcagtttctaaatataagatgttttgacaagccaaattgataagtagtgcagaattaaaaagtgggcagtttgttctttcttattttgaagaaacgaaaggccatagatgcaatgctcaataaaatgaaagaaaggaaacctttctcttgcagtgtagtgaggactctactgtatgtggc

SEQ ID NO: 2172 - DNA, 1659 bp, Avena sativa
cgccgcctccatgcctctcccaatgcgccgcctcgcttctgctccatcccttccagctgtacacccacacgacgccgccgccccaccctccgctcgactccggcgacaacatggccgggtggcgatggagaggacctcgtcgacgacgcgccgaggtgttagttgtgtgatggcaagtgggaaagagcatgcatcaactactactggtgatgaaaagaaaggtggactgcgtggcaagcttaaaaaagtcgttctagcttacagtggtggcctggatacatcagtaattgttccgtggctcagggagaactatggctgcgaagtcgtctgtttcactgctgacgttggccagggtgacattgaaatggaaggattggagaaaaaggcaaaagctagcggtgcaagccagcttgttgtaaagaacttgcaagaagaatttgttggtgaatatatatacccctgcctgcgtgctggcgcagtttacgaaaggaagtatctgcttgggacttcaatggctaggcctgttattgctaaggcaatggttgatgttgccaaggaagttggggcagatgcagttgctcatgggtgcactggaaagggcaatgatcaggttcgatttgagcttacattttatgcgttaaatccggaactcaaagtggtggcaccctggagggagtgggatatcacaggacgtgaagatgcaattgaatatgcaaagaaacacaatgtgccagtcccagtttcaaagaaatcaatatacagccgagacagaaatttgtggcaccttagccatgagggtgatattttggaagatccagcaaatgagccaaaagaagatatgtatatgatgtctgtttctccagaaaatgcaccttcaaaacctgagtatctggagattggtatagttggtggtgttcctacttctatcaacggaaaggacctctcgccagcatctcttcttgccaagctcaatgaaatcggtggaaagcacggtatagggcgtattgatatggtggagaaccgcctagtggggatgaagtcccgtggtgtctacgagacccccggcggcaccatcatggcagccgcggtccgtgagctggagtccctaacactggacagggagacgatgcagtggaaggatatgctcgccctcaagtacgccgagctcgtctacgcagggcgctggtttgacccactccgacagtccatggacgcgttcatggagacaatcaccgcgacgacgactggctccgtgaccctgaagctgtacaagggctcggtgaatgtcgcgtcccggaagagctcctacagcctgtacagggaggacatctcttcatttgagaacggggagatttacaaccaggctgatgctgaagggttcatcaggttgtacggtcttcctacccgcgttcgtgcaatgctggagaagggtatctaaggctgtttcgtgtcctgaataagattttctcattgaaaactgctgggtgtattagtaattgtggacaaatctaagatgtcctggtggtctttgagtacatttttcagttttttaggggttagtacccttttcatgaggtgtgccaggatatatgcgttgaagagttgctccagtcctggagtggtaacttggagtaatataccgtttggtgctgtggttcg

SEQ ID NO: 2173 - DNA, 1614 bp, Secale cereale
cgctccctccctcccagccgtgcacccgcacgactcccctgcgccgccctccgttcgcctccggcgacagcatggccgggtctcgatggagaggacgtcgacgacgacggcccgaggtgttagttgcgtgatggcaagtggtaaggagcatgcagcaactactagtggtgatgaaaagaaaggtggactacgtggcaaactgaaaaaagttgttctagcttacagcggtggcttggatacatcagtaattgttccatggcttagggagaactatggctgtgaagtcgtctgtttcactgctgatgttggccagggtgacattgaattggaaggattggagaaaaaggcaaaagctagcggggcaagccagcttgttgtgaaggacttgacagaagaatttgttggtgaatatatatacccctgcttgcgtgctggtgcagtttacgaaagaaagtatctgcttgggacttccatggctaggcctgttattgctaaggcaatggttgatgttgccaaggaagttggcgcagatgcagttgctcatgggtgcactggaaagggcaatgatcaggttcgctttgagcttacattctatgccttaaatccggaacttaaagtggtggcaccctggagggaatgggatatcacaggacgtgaagatgcaattgagtatgcaaagaaacacaatgtgccaattccggtttcgaagaaatcaatatacagccgagatagaaatttgtggcaccttagccatgagggtgacattttggaagatccagcgaatgagccaaaagaagatatgtatatgatgtctgtttctccagaaaatgcaccttcaaaacctgagtatctggagattggtatagttgctggtgttcctacctctatcaacggtaaagatctctcgccagcaactctccttgccaagctcaacgaaatcggcggaaagcacggcatcgggcgcatcgacatggtggagaaccgcctagtggggatgaagtcccgtggcgtctacgagacccccggcggcaccatcatggcggccgcggtccgcgagctcgagtccctgacactggaccgggagacgatgcagtggaaggacatgctggccctcaagtacgcggagctcgtctacgcggggcgctggtttgacccgctgcggctgtccatggacgccttcatggagaccatcaccgcgacgacgaccggctcggtgaccctgaagctgtacaaggggtcggtgaccgtcgcgtcccggaagagcccctacagcctgtacagggaggacatctcgtcgttcgagaacggggagatctacgaccaggctgatgcggaaggcttcatcaggctgtacggcctccccacccgggtccgcgcgatgctggagaagggtatctaagctcgtcttcgcgtctcgaataaattgttttctcattgaaaactgccgagtgtcttgagtaactgtggacaaagggaagatttccaggcgggtgggctttgagcacattgtggagttttccgttttggttggtagccttttcatctggtgtgcgttgatatatgtattgaggagttgctccaacttgccgtaatatactgcttggtgctgcggtg

SEQ ID NO: 2174 - DNA, 1708 bp, Avena sativa
gacctacctgcacccttagccatcctcgttgcacctagccttccttccaccccgccgcctccatgcctctcccaatgcgccgcctcgcttctgctccatcccttccagctgtacacccacacgacgccgccgccccaccctccgctcgactccggcgacaacatggccgggtggcgatggagaggacctcgtcgacgacgcgccgaggtgttagttgtgtgatggcaagtgggaaagagcatgcatcaactactactggtgatgaaaagaaaggtggactgcgtggcaagctaaaaaaagtcgttctagcttacagtggtggcctggatacatcagtaattgttccgtggctcagggagaactatggctgcgaagtcgtctgtttcactgctgacgttggccagggtgacattgaaatggaaggattggagaaaaaggcaaaagctagcggtgcaagccagcttgttgtaaagaacttgcaagaagaatttgttggtgaatatatatacccctgcctgcgtgctggcgcagtttacgaaaggaagtatctgcttgggacttcaatggctaggcctgttattgctaaggcaatggttgatgttgccaaggaagttggggcagatgcagttgctcatgggtgcactggaaagggcaatgatcaggttcgatttgagcttacattttatgccttaaatccggaactcaaagtggtggcaccctggagggagtgggatatcacaggacgtgaagatgcaattgaatatgcaaagaaacacaatgtgccagtcccagtttcaaagaaatcaatatacagccgagacagaaatttgtggcaccttagccatgagggtgatattttggaagatccagcaaatgagccaaaagaagatatgtatatgatgtctgtttctccagaaaatgcgccttcaaaacctgagtatctggagattggtatagttggtggtgttcctacttctatcaacggaaaggacctctcgccagcatctcttcttgccaagctcaatgaaatcggtggaaagcacagtatagggcgtattgatatggtggagaaccgcctagtggggatgaagtcccgtggtgtctacgagacccccggcggcaccatcatggcagccgcggtccgtgagctggagtccctaacactggacagggagacgatgcagtggaaggatatgctcgccctcaagtacgctgagctcgtctacgcagggcgctggtttgacccactccgacagtccatggacgtgttcatggagacaatcaccgcgacgacgaccggctccgtgaccctgaagctgtacaagggctcggtgaatgtcgcgtcccggaagagctcctacagcctgtacagggaggacatctcttcatttgagaacggggagatttacaaccaggctgatgctgaagggttcatcaggttgtacggtcttcctacccgcgttcgtgcaatgctggagaagggtatctaaggccgtttcgtgtcttgaataagattttctcattgagaactgctggttgtattagtggtaattgtggacaaatcttagatgtcctggtgagtacatttttcagttttttgggggggttagtagccttttcatgaggtgtgccaggatatatgcgttgaagagttgctccagtcctggagtggtaacttggagtaatataccgtttggtgttgtggttc

SEQ ID NO: 2175 - DNA, 1917 bp, Hordeum vulgare
ctattttcccacctcagctcgccctccttttgccctacctacccccattagccgcctcgtctgacccaagtcttccacccccgccgcccaccatgccgctcccgatgcgccgcctcgccgctgctccgtcgctcccagccgtgcacccacacgactcccatgcgccaccctccgttcggctccggcgacaacatggccgggtgtcgatggagaggacctcgacgacgacgggccgaggtgttagttgtgtaatggcaagcggaaaagagcatgcaacaactactactgctgatgaaaagaaaggtggattgcgtggcaaactaaaaaaagttgttctagcttacagcggtggcttggatacatcagtaattgttccatggcttagggagaactatggctgtgaagtcgtctgtttcactgctgatgttggccagggtgacattgaattggaaggattggagaaaaaggcaaaagctagcggtgcaagccagcttgttgtgaaggacttgacagaagaatttgttggtgaatatatatacccctgcttgcgtgctggtgcagtttacgaaagaaagtatctgcttgggacttccatggctaggcccgttattgctaaggcaatggttgatgttgccaaggaagttggcgcagatgcagttgctcatgggtgcactggaaagggaaatgatcaggttcgctttgagcttacattttatgccttaaatccggaacttaaagtggtggcaccctggagggagtgggatatcacaggacgtgaagatgcaattgagtatgcaaagaaacacaatgtgccaattccggtttcaaagaaatcaatatacagccgagatagaaatttgtggcaccttagccatgagggtgacattttggaagatccagcaaatgagccaaaagaagatatgtatatgatgtctgtctctccagaaagtgcgccttcaaaacctgagtatctggagattggtatagtcgctggtgttcctacctctatcaacggaaaagatctctcgccagcaactctccttgccaagctcaacgaaatcggtggaaagcacgggatcgggcgcatcgacatggtggagaaccgcctcgtggggatgaagtcccgtggcgtgtacgagacccccggcggcactgtcatggcggccgcggtccgcgagctcgagtccctgacactggaccgggagacgatgcagtggaaggacatgctcgccctcaagtacgcggagctcgtctacgcggggcgctggttcgacccgctccggctgtccatggacgccttcatggagaagatcaccgcgacgacgaccggctccgtgaccctgaagctgtacaagggctcggtgaccgtcgcgtcccggaagagcccctacagcctgtacagggaggacatctcatcgttcgaaaacggggagatatatgaccaggctgatgctgaaggtttcatcaggctgtacggcctccccacccgggtccgcgcgatgctggagaagggtatctaaggccgttttcgtgtctcggaataaaatgttctgttttcgtgtctcgaataaaatgttcgcattgggaactgccgagtgtattttctagtgatttcaaggtgggcttagagcactttgtcgagtttttgttttgtttcatctggtgtgcgtggatatgtgtatcgaagggttgctccagcttgcagtactatacgcattgtggtgctgcggtgcagtccttgtctcattgcacttcaggcgtgtttggttactggcgtcatttttggcttcctggtagtctgtatgggttaataccaagtctgtgccaagttgtgtagttcgtttggttgctcgcatggaactagtcttcttgcatcggttcgggtctccattgcttgatgggacccgccaatttgag

SEQ ID NO: 2176 - DNA, 1425 bp, Pennisetum glaucum
ttgccacgcaatccacctttctgttgatcactactagcagtggtggcttggatacatcggttattgttccgtggctcagggagaactatggttgtgaagtcgtttgtttcactgctgatgttggccagggcgccattgaattggaaggattggagaagaaggcaaaagctagtggagcatgccagctcgttgtgaaggacttgagagaagaatttgttagtgaatatatatacccctgcctgcgagctggtgcagtttatgaaagaaaatatcttcttggcacttcgatggctaggcctgttattgctaaggcaatggttgatgttgccaaggaagttggtgcagatgcagttgctcatggatgtactgggaaaggcaatgatcaggttcgctttgagcttacattttatgctttgaatcctgaactcaaagtggttgcaccttggagggagtgggacatcacagggcgtgaagatgctattgagtatgcaaagaaacataatgtgccagttccagtttctaagaaatcaatatacagccgagaccgtaacttgtggcaccttagccatgagggtgacattttggaggacccagcgaatgagccaaaggaagatatgtacatgatgtctgttgccccagaaaatgcaccttcggaacctgagtatctggagattggcatcattgcaggtgttcctgtttccatcaacggacgggacctgtcgcctgcatccctccttgcggagctcaatgaaatcggtggaaagcatggaatcgggcgcattgacatggtggagaaccgccttgtaggcatgaagtcccgtggtgtctacgagaccccgggtggcaccatcatggcagccgcggtgcgcgagctggaggccctgaccctggacagggagaccatgcagtggaaggacatgatcgccctcaagtacgctgagctggtctacgcaggccgctggtttgaccctctccgtcagtccttcgactccttcatggagaacatcactgcgaccactactggttcggtgacgctgaagctgtacaaggggtctgtgaacgtcgcgtccaggaagagcccctacagcctctacagggaggacatctcgtcgtttgagaacggggagatctacaaccaagctgatgccgaggggttcatcaggctctatggtctcccgacccgggtccgggcgatgctggagaagggcatctaagttccccacttgttctggaaataaaagcaatcatttggaaacactgtcaaagagtttccagtgattgcatactgattgttttgtacacattgtttgagtttctcttaaaaaactctgaatgcattttgactttggcattgggtgatcagctggctgccgatgtaagacattagtttagaggcgtgaaatgaaatgtggaaaccaaatttac

SEQ ID NO: 2177 - DNA, 2461 bp, Sorghum bicolor
gcgctgccctccctctccctgtggccttctgcttcttgttgtgtctgtcgcctccgggcggttgaaattaacgacgcccagaccgcgacgagccccgggcggacagccggacaccagcgttaacggcagtgacacgcccgacgaagaaaacaagcaacccaccgtaccacgcccctcccccgtcggtggccaagccacagctttgctcgctagcgtagcgagccaaccagcctccggcaaagggaggaagcgagcgaggattcgatcggagcggggtgcttctcgtcatccgccagaaggagcatcgaagagccgagtggaggccggtcccgccacggccgggatggtggtggcgaggaagcagcagcagcatccgccgccgctgcacgccggcggcgcgcgtcggcggggaggctgtggcgtgagggtcgggcccgcgaggctggagggcctccccgccgcgtggccgggcgccgccgccgtcaaggtcaagtggcccgcgcccgggggcgcgctctcgcagatgctcacggggaagtgggcgcgcggggtcaccgccgttgaggccgtcggcgccggcgggaccgtccgctgggagccgcgcgacggcaaccggttcaggctcgacgtcgtcgaccccgccggctcccgtggacgcccggagcgcggggtcttcttctccgtcctctatggattccaagaacaaggccggggcaaggagctggtgaggctggaggagatcgggacagccatgataagcctggaggagtgctgctgggagatgcaactgcagcagcaacgccagcagctggtggttgtccccatcagggtcaggaaggacggatgggcaagtgatgccatgctttatgtgaacgtggagctcgtggatgcgaacacgcgctctgacatcgaaagggcagtctcgtttagggagaagccgagaacgaacatggcgccacggccaacaatgcgagatagccggaagagcttggaggcagcggcctacgatgttcttgacctgaagcagctgcttgatctggctgagaaggaaggccgggtggccgtgtatgggaacaaaaggaactctgacaccagcagcgtgagcagcatcagtagtagtagtagcagcagcagcagcagcagcacgatcagtatcagcagtgctagcaccagcggcggcgcgagcccagagccggcatcgacgtcgaaacgccggttcctgccatggatgaggaggagcagggacttcgacaagaggagcaccgagtcgctctcccaagaactgtctatgaagtgcatggatgacgatccgatcggcagctgggagatgcgcgagttcacgagcagggacgccgagacgaagctcaagacgccggtgttcttcgcgtccatcgaccagcgcgacgacagcgccggcggggagagcgcgtgcacggcgctcgtcgccgtcctcgcggcggcgctccacgccaaccacccgacgatgcccacccggccggagctggacgcgctcatccgggacggctcgtcggagtggaggaagctctgcgacgacgaggcgcacatggcgcagttcccgaaccggcacttcgacctggacaccgtcctcgcgtcccggacgcggcccatcgcggtgcagcacgacagggccttcgtcggcttcttccagcctgagagcttcgcgtcgctgtccggcgccatgtcgttcgacgacatctggcgcgagatcagcggcggcgaacgcgagccgggccgcgccgacgtgtacatcgtcagctggaacgaccacttcttcgtgctcaaggtggagagcgactgctactacatcatcgacacgctcggcgagaggctgcacgagggctgcgacaaggcctacatgctgaggttcgacggctcgtcggagatgcaggccgagggcacacaggaggtgatcgtcaccgggaaggaatgctgcagggagttcatcaagagattcttggccgccatcccgctcagggaggagctggagatggagaaaaggggcgccggcagcatcgacggtggtggcgcgccgcaccggcggctgcagatcgagttccacttcacagtcctacgagacgacgataggtgatacgacagcagttgggggatgttccttcctccctgattgcagcattgtactaacataatgtaaattcatctgtatatctgtatacagtttaaaagggaaaaaaaatacagggtaggattgttggttctggttttataattttagataggaaacaaaacatgaagaggattacagaatacagagtgctggtcgagtacttgtgtgtgtgtgtgtgttttggctagggtttgggcttgaacctatctcaggatcatccctgcaataccattttgtaagctcaggccttgtttagttctaaaaaactttgcaaaagttttccccatcacatcgaatcttgcggcacatgctaag

SEQ ID NO: 2178 - DNA, 2346 bp, Zea mays
cggcaacgggcggccctgcccgcgctcttcttcttgtgttgcctgtcgcctcggggcggttgaaaattaaccgaagcggacaccgcgacgaggccgcggcggacacacagccggaccggacaccagcgccagcgtagcggcagcggcacgcccgaggaagcaagcaagccaccacgcccctgcgtcgtcgcgtcggtgcccaaggggcagccgccgggagggagggaggggcatcgaagcggaggccacggcggtcgggatggtggtggcgagaaaaccgcagcagcagcccgcaggcgtcgcccgccggcgcggtggcggcgtcagggtggggcccgcgaggctcgagggcctccccgcggcgtgggcgggcgccgccgccgccgccgtcaaggtcaagtggcccgcgcccgggggcgcgctgtcgcagatgctgacggggcggtgggcgcgcggggtgaccgccgtcgaggccgtcggcgccggcgggaccgtccgctgggagccgcgcgacggcaaccggttcaggctcgacgacgtcgtcggccccgccggccggccggagcgcggggtcttcttctccgtcctctatggattccaagaacaaggccggggcaacaaggagctggtgaggctggaggagatcgggacagccatgataagcctggaggagtgctgctgggagatgcagctgcagcagcaccaccaccagctggtggctgtccccgtcagggtcaggaaggacggatgggcaagcgatgccatgctttatgtggacgtggagctcgtggacgcgaacacacgcccggacgtcgatagggcagtctcgttcagggagaagccgagaacgtacatggcgcctccgccgacaatgcgaggtagccgcaagagcttggagtcagcgacgtgccatgatgtccttgacctgaagcagctgcttgatctggctgagaaggaaggccgggtggccgtgtatggcaacataaggagctccgacaccagcagcgtgagcagcactagcagcagcagcagcacgattagcgtcagcagtgctagcaccagcggcggcgcgagcccggaaccggcctcgacgtcgaagcgccggttcctgccatggacgaggaggagcagggacttcgacaagaggaccgccgagtcgctctcccaagaactgcccacaaagtgcacggacgacggtccgggtccggccggcggctgggagacgcgcgagttcacgagcagggacgccgagacgaggctgaggacgccggtgttcttcgcgtccatcgaccagcgcgacggcagcgctgggggggagggcgcgtgcgcggcgctcgccgccgtcctcgcggcggcgctccacgccggccacccggcgatgcccacccgcccggagctggacgcgctcatccgggacggctcgtcggagtggaggcggctctgcgacgacgaggcgcgcgcggcgcggttccccaaccggcacctcgacctggacaccgtgctggcgtcccgggcgtggcccatcgcggtgcggcacgacagggccttcgtcggcttcttccagccggagagcttcgcgtcgctgtccggcgccatgtcgttcgacgacatctggcgcgagatcgccggcggcggcggacgtgggcgcgggccgggcggccgcgcggacgtgtacatcgtcagctggaacgaccacttcttcgcgctcaaggtggagagcgactgctactacgtcgtcgacacgctcggcgagaggctgcacgagggctgcgacaaggcctacatgctgaggttcgacggctcgtcggagatgcgggccgaaggcaccgaagaggtggtcgtcgccgggaaggaatgctgcagggagttcatcaagaggttcctggccgccatcccgctgagggaggagctggagatcgagaaaaagggcggcagcggcatcgacggtggcggcgcgccgcaccagcggctgcagatcgagttccacttcacagcctttacaagacgacaatagatgatgagttggcgatccgacagcagttgggggatgttccttcctcctccctgatcacagcatcatactaaccttgtgtaaattcgtctgtatatctgtatacagtttacaagataaaaatttacagggtaggatttggttctcgtttcacaattttagataggaaacaaaacatgaagaggaataccattttgtaagcgagctcagtattacatgattttgcttctgttgaatgatgactcaggcaggcaagctcctcttcctactgaaaataaattttctgatcaagaaaccatattgtgacattacattcaagaataatgactgcaggc

SEQ ID NO: 2179 - DNA, 1727 bp, Zea mays
gccactgcccctgccaccagcccaccaccagacccgccaccttcgcgctccacggcagcggcatgtccgtcgcctcctcccaccgcctgcgaccgtcgccgtcgggcccggcgcggcgcccgggatccgcggcgccgcgcgtagcgttctggccagccggtgcctcgcccccgtatcgcggccgctgcaccgtcgtggcggcggcggctgccgctggcgccggcggcgaggcatcttcggcccccgtggctgtgtcggctgtcgcccccgcgggcgctgccagggacaaggtgcggcgccacacgatttcggtgttcgtcggggacgagagcggcatgatcaaccggatcgcaggggtgttcgccaggagaggctacaacatcgagtcgctcgccgtggggctcaacaaggacaaggccctcttcaccattgtcgtctccgggaccgacagggtgctcaaccaagtcatcgagcagctcaataagcttgtcaacgtcctgagtgtggaagatctatctaaagaacctcaggttgaaagagagctgatgcttataaaactaaatgttgaacctgatcagcgtcctgaggtcatggttttagttgatattttcagagcaaaagttgttgatatatctgagaaaacacttaccatggaggtagctggagatcctggcaaaattgctgcagtgcagaggaatctatggaaatttggaatcaaagaaatttgcaggacaggaaaaattgctttgagacgtgaaaggattggtgcaacagcccgtttctggcgattttctgctgcttcttacccagacctgatagatgcgttgccgaaaaatccacttacatctgtaaataggacagttaatggcagttttggtcaaccatccaatgctgggggtgatgtttatcctgtggaatcttacgagagcttatcagtgaaccatgtacttgatgctcattggggtgttctggatgatgatgatgcgactggacttcgctcgcatactctctccatccttgtgaatgactgtcctggtgtcctcaacattgtaacaggagtctttgctcgcaggggctacaatatacagagccttgctgttggcccagctgagaaggaaggcatttcgcggattacaacagttgttcctggtactgttgaatccattgagaagttagttcagcagctttacaagcttattgatgtgcacgaagttcatgacattacccactcaccttttgctgaaagggaacttatgcttattaaggtttctgtcaacactgctgctcggaaggaaatcctagatattgctgaaatcttccgagcaaaacctgttgatgtttctgaccacacagtaacgcttcagcttactggagatcttgacaagatggttgcactacaaaggttattggagccatatggcatctgtgaggtcgccagaactggacgagtagcactggtccgcgaatcgaaggtggactccaagtacctccgcggctactctcttccactgtagccttgcagtcgtgatgatgatggcaccatgaagagctcggctggttgtttatagagcagaccatctcgcgctgggttgtgttgtgcgattacaggacttgtttctttcatgtcgtgaactcccccggcctgcgtgtccaataacgcgtgttgaggctgcatgtgtattccaacgactgtcagaataagatgcatatcgtatctgtttacttca

SEQ ID NO: 2180 - DNA, 2234 bp, Sorghum bicolor
accaaccactactccactagtccacctccggccaccgagcaagccccgcccgcgtcccggcccaagtgccactggccccagcaacccccgccaccttagcgcgcccgacggcaggcatgtctgtcgcctcctcccaccacctgcggccgtcgccgtcgccggcagcggccggcccggcgcggcgcccgggctgcgccgcggcgccacgcgtgtcgctctggccagccggtgcctcgcccccgtaccgcggccgctgcaccgtcgtggcggcggctgcgcctgccgcgggcgccggcggaggcgaggcagcctcggcccccgctgctgtgtcggcggtcgcccccgcggccgccgccgctagggacaaggtgcggcgccacacgatttcggtgttcgtcggggacgaaagcggcatgatcaaccgcatcgccggggtcttcgccaggagaggctacaacatcgagtcgctcgccgtggggctcaacaaggacaaggccctcttcaccattgtcgtctccgggaccgacagggtgctcaaccaagtcatcgagcagctcaataagcttgtcaacgtccttagtgtcgaagatctatctaaagaacctcaggttgaaagagagctgatgcttataaaactaaatgttgaacctgatcagcgccctgaggtcatggttttagttgatattttcagagcaaaagttgttgatatatctgagaaaacacttaccatagaggtagctggagatcctggcaaaattgctgcagtgcagcggaatctaaggaaattcggaatcaaagaaatttgcaggacaggaaaaattgctttgagacgtgaaaagattggtgcaacagcccgtttctggcaattttctgctgcttcttacccagaccttatagaggcattgccaaaaaatccaattacatctgtaaataagacagtgaatggcagttttgatcaatcatccaatgctgggggtgatgtctatcctgtggaatcttacgagagcttaacagcaaaccatgtacttgatgctcattggggtgttctggatgatgatgatgatgcaactggacttcgctcgcataccctctccattcttgtgaatgactgtcctggtgtcctcaacattgtaacaggagtctttgctcgcaggggctacaatatacagagccttgctgttggcccagctgagaaggaaggcatttcacgtattacaacagttgttcctggtactgttgaatccattgagaagttagttcagcagctttacaagcttgttgatgtgcatgaagttcatgacattaccccctcaccttttgctgaaagggaactgatgcttattaaggtttctgtaaacactgctgctcggagggaaatcctagatattgccgaaatcttccgagcaaaacctgttgatgtttctgaccatacagtaacgcttcagcttactggagattttgacaagatggttgcactacaaaggttattggagccatatggcatctgcgaggtcgccagaactggacgagtggcactggtccgcgaatcgaaggtcgactccaagtacctccgcggctactctcttccattgtaacctggcatttgtgatggtgatggcctgatgaagagcttggttggttgttatagagcagaccatctggtgctgggttgtgttgtgcagttacaggacttgtttctttcatgtcgtgaactccctcgcctgcgtgtccaataatgttctccccggtaatatgcgtgttgaggttgcatgtgtatcccaacgactgtcagaataagatgcatatacctgtttgcttcagcggagagagatgccaatcgtttgaaacgcgtcaatagtggtatgctctggttgggacttgggacttgggaggctgccggcggcaggccagtcctggcttgcacggaaaaaaaaaaaagatccctcgctgtgcttgggtcgccaggtttcagggctttttctcaactctgcggcttgagaaattttctccaggggtcagagtttttacctcgatcgaggtcattccgaaggggttgagtttttttttagtttatataaatatatgtttatactacttgatacggtgaggcagcctggcgcatgctgcgctgagggcgcatctctcctacgaggctgctaaaacggtacggatattttttaactgtattcgagatcgaatttgtttagaagagtttagatttatctgtattcgag

SEQ ID NO: 2181 - DNA, 1716 bp, Zea mays
gcaacccccgccaccttagcgcccgacggcatgtctctcgcctcctcccaccacctgcggccgtcgccggcgggcccggcgcggcgcccgggctgccccgcgccgcgcgtggcgctctgccggccacccggtgcctcgcccccgtaccgcggccgctgctgcaccatcgtggcggcggcggcgcctgccgcgggcgccggcggagaggcagcctcggcccccgccgccgctgtgccggcggtcgcccccggtgccgccgccagggacaaggtgcggcgccacacgatttcggtgttcgtcggggacgagagcggcatgatcaaccggatcgccggggtgttcgccaggagaggctacaacatcgagtcgctcgccgtggggctcaacaaggacaaggccctcttcaccattgtcgtctccgggaccgacatggtgctcaaccaagtcattgagcagctcaataagctcgtcaacgttcatagtgttgaagatctatctaaagaacctcaggttgaaagagagctgatgcttataaagctaaacgttgaacctgatcagcgccctgaggtcatggttttagttgacattttcagagcaaaagttgttgatatatctgagaaaacacttaccatagaggtagctggagatcctggcaaaattgctgcagtgcagaggaatctaaggaaattcggcatcaaagaaatttgcaggacaggaaaaattgctttgagacgtgaaaagattggtgcaacagcccgtttctggcgattttctgctgcttcttatccagaccttatagaggcattaccaaaaaaaccgcttacatctgtaaataagacagtgaatggcagttttgttcgaccatccaatgctgggggtgatgtttatcctgtggaatcttacgagagctcagctaaccaagtacttgatgctcactggggtgttctggatgatgatgatgcaactggactttgctcgcataccctctccatccttgtgaatgattgtcctggtgttctcaacattgtaacaggagtctttgctcgcaggggctacaatatacagagccttgctgttggctcagctgagaaggaaggcatttcacgtattacaacagttgttcctggtactgttgaatccattgggaagttagttcagcagctttacaagcttattgatgtgcatgaagttcatgacattacccactcaccttttgctgaaagggagctgatgcttattaaggtttctgtaaacactgctgctcggagggaaattctagatattgctgaaatcttccgagcaaaacctattgacgtttctgaccatacagtaacccttcagcttactggagatcttgacaagatggttgcactacaaaggttattagagccatatggcatctgcgaggtcgccagaactggacgagtggcactggtccgtgaatcgaaggtcgactccaagtacctccgcggttactctcttccattgtagcctggcatttgtgattggtggtggacccgataaagagcttggtttgttgttatagatcagaccatctcgcgctgggatgtgttgtgcaattacaggacttgtttctttcatgttgtgaactccctggcctgcgagttcaataatgcccctttttaatgcgcgttgaggttgcatatgtatcccatcgactgtccgaataagatgcatagcataactgtttacttc

SEQ ID NO: 2182 - DNA, 1568 bp, Echinochloa colona
ccgtcgcgtcggcggcggcgggcgctggaggcgaggcggcttccgcccccgccacggtgacggcggtcgcccccgcggccgccgccagggacaaggtgcggcgccacacgatttcggtgttcgtcggggacgagagcggcatgataaaccggatcgccggggtgttcgccaggagagggtacaacatcgagtctctcgccgtggggctcaacaaggacaaggccctcttcactattgtcgtctccgggactgacagggtgctcaaccaagtcatcgagcagctcaataagcttgtgaacgtcctgagcgtcgaagatctatctaaagaacctcaggttgaaagagagctgatgcttataaaactaaatgttcaacctgatcagcgtcctgaggtcatggttttagttgatattttcagagcaaaagttgttgatatatctgataacacacttaccttggaggtagctggagatcctggaaaaattgctgcagtgcagaggaacctaaagaaatttggaatcaaagaaatttgccgaacaggaaaaattgctttgagacgtgaaaagattggtgcaactgctcgtttctggcgattttctgctgcttcttacccagaccttatagaggcattgccgaaaaatccacttacatctgtaaataggacagttaatggcagttttgatcaaccatccaatgctgggggtgatgtttatcctgtggaaccttatgacagctcatcgatggaccgagtgcttgatgcccattggggtgttctggatgatgacgatgattcaaccggacttcgctcacataccctctccatccttgtgaatgattgtcctggtgtcctcaacattgtaacgggggtctttgctcgcaggggctacaatatacagagccttgctgttggcccagctgcgaaggaaggcatttcgcgtattacaacagttgttcctggtactgatgaatccattgagaagttagttcagcagctttacaagcttgttgatgtgcatgaggttcatgacattactcgcttaccttttgccgaaagggagctgatgcttattaaggtttctgtaaatactgctgctcggagggacatcctagatattgctgaaatcttccgagcaaaacctgtggatgtttctgaccacacagttacactacagctcactggggatcttgacaagatggttgcattacaaaggttattggagccttatggcatctgcgaggtcgccagaacaggtcgtgtggcgctggtccgcgaatctggagtggactccaagtacctgcgtggctactctcttccattgtagactggcacttgtgatgatggcccaagaaaactatcgcttggttgctagaacaaaatgtgtaggcgtcttcggttgtgtgtacttgcaagacttgtttctttcatctcatcgactccttgatttgtttacttaataatatgctccctggtggatgcaatctgatgttgtataagtatcccgttgacagccagaataagatacatgtgcatcctcttaattcaataaggggagatgtagccagcgtcc

SEQ ID NO: 2183 - DNA, 2074 bp, Oryza sativa
caaacccgagcggctcggtgacacgtacacggtacaccctccaaacccttaagaaaagaaaacctcgcaaattcagccatttcgacgcatcatcatgagttggatgggttgggtctttttatttttcgaagataaccatgttgacccatagagagcgtagacacggagccgaattgccgaaagcctccaaagcaaaagcaggcagctgtgggagccgcagccgccggggccgtcgacgtcagaccaagataccgaatatcggtcggtcccccacgccgcccagccgctgccgctgcccggccaagtagtgccccaacgcgaacgcagggccacccgtgacccatcgcgagcggatcgcgccgcggccgcgcgcggcgggtggtgtcacgctcgcactcgcactcgcacacgccgcacacgccgtctccccccaaagccaagcggcgcgcggccgcgcgggggccagcccagtaattttccaccagccgccttcgcccctccactccgcataaaccctactagtgcaaccatggcttaacccaaaaactaaaccgagtgccccgtgcccactgtcacacaatacagaccagccccccgtcaccttcgagctcgagccaagccaaacgatgtccgtcgcctccccgcaccatctccgcccctcgccgctggcgccggcatgccgtgctggcggcgtccccgcgcgcgccgcggcggcgcaccggccatggtgcccgcgcgtccgccgggccgtcgccgcggcctcctccggcggcggcggcggcgaggcggtgacggcggtgagcgcggcggcggtgggggcgcccgcgagcgccgcgagggacacggtgcggcgccacacgatctctgtgttcgtcggcgacgagagcgggatgataaaccggatcgccggggtgttcgccaggagagggtacaacatcgagtcgctcgccgtggggctcaacaaggacaaggccatgttcaccattgtcgtctccggcacggacagggtgctcaaccaagtcatcgagcagctcaacaagcttgtcaacgtcttgaatgtggaagatctatctaaggagccacaggttgaaagagagctgatgcttataaaaattaatgttgaaccagatcagcgtcctgaggtcatggttttagttgatattttccgagcgaaagttgttgatatttcggagaacacccttaccatcgaggtaactggagatcctggcaaaattgttgctgtgcaaaggaacctcagcaaatttgggataaaagaaatttgtagaacgggaaaaattgctttgagacgtgaaaaaattggagcaactgcccgcttctggggattttctgctgcttcttacccagatctcatagaggcattgcccaaaaattctcttcttacttctgtaaataagacagtcaatggaagttttgatcaaccatccaatgctgggggcgatgtctatcctgtggaaccttatgagggttcatccatgaaccaagtacttgatgctcactggggcgtccttgatgatgaagattcaagtggacttcgatcacatactctatccatccttgtcaatgattgccctggtgttctcaacattgttacaggggtctttgctcgcagaggctacaatatacagagtcttgctgtaggcccagctgaaaagtcaggcctttcgcgtattacaacagttgctcctggaacagatgaatccattgagaagttagttcagcagcttaacaaacttgttgatgtgcatgaggttcaagatataactcacttgccttttgctgaaagagaacttatgcttatcaaggtttctgtgaacactgctgctcggcgagacatactagatattgctgaaatcttccgggcaaaatctgttgatgtttctgatcacactgttacgttacagcttactggggatctcgacaagatggttgcattacaaaggctgttggagccttatggcatctgtgaggtcgccagaacagggcgagtggcgctggtccgcgaatccggtgtcgattccaagtaccttcgtggctactcctttccgttgtaatc

SEQ ID NO: 2184 - DNA, 1645 bp, Panicum virgatum
gcgggcgctgggggcgaggcggcttcagcccacgccgccgtcgcggcgtcggcagtctcccccgcggcggccgccgccagggatagggtgcggcgccacacgatttcggtgttcgtcggggacgagagcggcatgatcaaccggatcgccggggtgttcgccaggagagggtacaacatcgagtcgctcgccgtggggctcaacaaggacaaggcgctcttcaccatcgtcgtctccgggactgacagggtgctcaaccaagtcatcgagcagctcaataagcttgtcaacgtcctcagtgtcgaagatctatctaaagaacctcaggttgaaagagaactgatgcttataaaactaaatgttaaacctgatcagcgcccagaggtcatggttttagttgatattttcagagcaaaagttgttgatatatctgatagcacacttaccatggaggtagctggagatcctggaaaaattgctgcagtggagaggaaccttaggaaatttggaatcaaagaaatttgccgaacgggaaaaattgctttgagacgtgagaagattggtgcgactgcccgtttctggcgattttctgctgcttcatacccagaccttatagaggcattgccaaaaaatccaattacatctgtaaataagacagttaatggcagttttgttcaaccatccagtgctggtggtgatgtttatcctgtggaaccttatgagagctcatcgatgaaccaagtacttgatgcccattggggtgttcttgatgatgatgatgatgattcaactggacttcgctcacatacgctctccatccttgtgaatgattgtcctggtgtcctcaacatagtaacaggggtatttgctcgcaggggctacaatatacagagccttgctgtcggcccagctgagaaggcaggcatttcacgtattacaacagttgtccctggtactgatgaatccattgagaagttagttcagcagctttacaagcttattgatgtgcatgaggttcatgacattactcactcaccttttgccgaaagggagctgatgcttattaaggtttctgtaaacactgctgctcggagggagatcctagatattgctgaaatcttccgcgcaaaacctgtcgatatttctgaccacacagttacactgcagctcactggggatcttgacaagatggttgcattgcaaaggttattggagccttatggcatctgtgaggtcgccagaacaggccgtgtggcgctggtccgtgaatccagagtggactccaagtacctccgcggctactctcttccgttgtagcctctggcgtttgtgatgatggcccaggaaagcgcatgcctggttgctagagcagaatgtgtaggactcatttgttaggttgtgtgtatctgcaagagttgtttcctccatctcgtcaactccttgatttccttgcttaataatatgctccttggtggatgtaagctgaagtagcatatgtatcccgttgacagtcataataagatacatgtgcatcctcttatttcagtgattcagtgaatcagtggggacttggggagatgtagccagcatccaaaattaactggcagcatttttcctattattccttctgtccgcggtgatttgg

SEQ ID NO: 2185 - DNA, 1791 bp, Saccharum officinarum
gcaccgtcgtggcggcggcggcgcctgccgcgggcgccggcgccggcgaggcagcctcggcccccgccgccgccagggacaaggtgcggcgccacacgatttcggtgttcgtcggggacgagagcggcatgatcaaccggatcgccggggtcttcgccaggagagggtacaacatcgagtcgctcgccgtggggctcaacaaggacaaggccctcttcaccattgtcgtctccgggaccgacagggtgcttaaccaagtcatcgagcagctcaataagcttgtcaacgtcctcagtgtcgaagatttatctaaagaacctcaggttgaaagagagctgatgcttataaaactaaacgttgaacctgatcagcgccctgaggtcatggttttagttgatattttcagagcaaaagttgttgatatatctgagaaaacacttaccatagaggtagctggagatcctggcaaaattgccgcagtgcagaggaatctaaggaaattcggaatcaaagaaatttgcaggacaggaaaaattgctttgagacgtgaaaagattggtgcaacagcccgtttctggcaattttctgctgcttcttacccagaccttatagaggcattgccgaaaaatccaattacatctgtaaataggacagtgaatggcagttttgatcaaccatccaatgctgggggtgatgtctatcctgtggaatcttacgagagcttatcagcaaaccatgtacttgatgctcattggggtgttctggatgatgatgatgcaactggacttagctcgcataccctctccatccttgtgaatgactgtcctggtgtcctcaacattgtaacaggagtctttgctcgcaggggctacaatatacagagccttgctgttggcccagctgagaaggaaggcatttcgcgtattacaacagttgttcctggtactgttgaatccattgagaagttagttcagcagctttacaagcttgttgatgtgcatgaagttcatgacattaccccctcaccttttgctgaaagggaactgatgcttattaaggtttctgtaaacactgctgctcggagggaaatcctagatattgccgaaatcttccgagcaaaacctgttgatgtttctgaccatacagtaacgcttcagcttactggagattttgacaagatggttgcactacaaaggttattggagccatatggcatctgcgaggtcgccagaactggacgagtggcactggtccgtgaatcgaaggtcgactccaagtacctacgcggctactctcttccattgtagcctggcatttgtgatgatggcgggcccgataaagagctttggttggttgtcatagagcagaccatctcgcgctgggttgtgttgtgcagttacaggacttatttcttttatgtggtgaactccctggcctgcgtgttcaataatgtccccccggtatatgcgcgttgaggttgcatatgtatcccatcgacggtcagaataagatgcatagcgtacctgtttacttcagcgaagagagatgcaggcatcgttcgaaatcagctttgcctgcgttttgtagttcagttctatttatatatactgtatggtgatttctgatttggtgagaagcggaacatgtggagtcgtggaccatctccaaatccacagcgacatcaaacggctagggtatggggagaaattattttacccattagaaacgggtaggttatgggtaatacatatatctatatctattactaatattaaagaagcaaaatttttt

SEQ ID NO: 2186 - DNA, 1833 bp, Brachypodium distachyon
atctcccaccagcttcgccctcgctgctgctcatgctcagctcctcccacagcctccggccgtcgcccccggcggcggcggcggcaggccctgacagtcgccctggctgcgccgcgcgcgtctcgctccggccctgggcccaagccccgctccgccgcgccgtcgctgcgggggcgagcgccggcggcgaggcggccgccgccgtgtcggcggtgagcgctggatccaccgcggccgccaagagggacacggtgcggcgccatacgatttcggtgttcgtcggggacgagagcggcatgataaaccggattgcaggggtgttcgccaggagagggtacaacatcgagtcactcgccgtggggctgaacaaggacaaggccctcttcaccatcgtcgtctccgggacggatagggtgctcaagcaagtcattgagcagctgaataagctcgtcaacgtcttgaatgttgaagatctatctaaggagccacaggttgagagagagctcatgcttataaaactcaatgttggaccagaccaacgtgctgatgtcatgtttgtagctgatgttttcagagcgagagttgttgatatttctgagaacagcctaaccctggaggtaactggagatcctggaaaaattgttgcggcacaaaggaacctaagcaaatttgggatcgaagaaatctgtaggacgggaaaaattgctttgacgcgtgaaaagcttggagcaactgcccgtttctggggattttctgctgcttcttacccagacctcatagaagcattgcccaaaaatcctcttcttacttcggtgaaaaagacggttaatggcagttttgaccaaccatcgagtgctgggggtgatgtttatcctgtggaaccttatgagagcttgtccatgaaccaagtacttgatgcccattggggtgttcttgacgatgaagattcaagcggactttgctcacatactctctccatccttgtgaatgattgtcctggtgtcctcaacattataacaggggtctttgctcgcaggggctacagtatacagagtcttgctgttggccgagctgaaaaggaaggcatttcgcgtattacaacagttgttcctggaactgatgagtccattgagaagttagttcagcagctctacaagcttattgatgtacataaggttcatgacctaacgcacttaccttttgccgaaagagaactgatgcttattaaagtatctggaaacactgctgctcggagggaaatactagatattggggaaatcttcagggcaaaatgtgtggatctttctgatcacacggttacgttacagcttaccggagattttgccaagatggttgcactacaaggactgttggagccttatggcatatgtgaggtcgccagaacaggtcgagtggcgctggtccgtgaatccggggttgattccaagtacctgcgtggttactctcatccactgtaattcgaagttgtgtgtgacggcccaataggcaataggccactttggttcgttgagctgagtagaatgtgtaggcagcttttcgttcggtcgtgttcttgtttaggatgactctcggtagtgtccccctgttgtggtgtgttgaacctctgacttgtcaaataattatgctcggtagatgcaagttggtgtttgtccatgtattgtaatgacagacagagtaagtgcatggttccttgcctcttcattgcttgtaacctgtaactgtcagttggaactatcgccagctagagggtactattggagcgttttatggtgcatcgcataacaaatatgaataagagcaatattctacctc

SEQ ID NO: 2187 - DNA, 2258 bp, Brachypodium distachyon
gccacaagagaactcgctgctcgccgcccacggtgatgggcacgccacggttgctcgtgaatgatttggttatgttcatggagaacacgaattaaacgggctggacgccaccgtggccgtttacaggcctaattaacagcccggggcatgtgctgtacaaaaaaccacgaggaaacttaacgcgcacgatgtcggatgcgcagaggcacctttctcgcgcaactgaagcacaaacacggtggcctttggaacgtcccgaagcttcgccctcgctgctgctcatgctcagctcctcccacagcctccggccgtcgcccccggcggcggcggcggcaggccctgacagtcgccctggctgcgccgcgcgcgtctcgctccggccctgggcccaagccccgctccgccgcgccgtcgctgcgggggcgagcgccggcggcgaggcggccgccgccgtgtcggcggtgagcgctggatccaccgcggccgccaagagggacacggtgcggcgccatacgatttcggtgttcgtcggggacgagagcggcatgataaaccggattgcaggggtgttcgccaggagagggtacaacatcgagtcactcgccgtggggctgaacaaggacaaggccctcttcaccatcgtcgtctccgggacggatagggtgctcaagcaagtcattgagcagctgaataagctcgtcaacgtcttgaatgttgaagatctatctaaggagccacaggttgagagagagctcatgcttataaaactcaatgttggaccagaccaacgtgctgatgtcatgtttgtagctgatgttttcagagcgagagttgttgatatttctgagaacagcctaaccctggaggtaactggagatcctggaaaaattgttgcggcacaaaggaacctaagcaaatttgggatcgaagaaatctgtaggacgggaaaaattgctttgacgcgtgaaaagcttggagcaactgcccgtttctggggattttctgctgcttcttacccagacctcatagaagcattgcccaaaaatcctcttcttacttcggtgaaaaagacggttaatggcagttttgaccaaccatcgagtgctgggggtgatgtttatcctgtggaaccttatgagagcttgtccatgaaccaagtacttgatgcccattggggtgttcttgacgatgaagattcaagcggactttgctcacatactctctccatccttgtgaatgattgtcctggtgtcctcaacattataacaggggtctttgctcgcaggggctacagtatacagagtcttgctgttggccgagctgaaaaggaaggcatttcgcgtattacaacagttgttcctggaactgatgagtccattgagaagttagttcagcagctctacaagcttattgatgtacataaggttcatgacctaacgcacttaccttttgccgaaagagaactgatgcttattaaagtatctggaaacactgctgctcggagggaaatactagatattggggaaatcttcagggcaaaatgtgtggatctttctgatcacacggttacgttacagcttaccggagattttgccaagatggttgcactacaaggactgttggagccttatggcatatgtgaggtcgccagaacaggtcgagtggcgctggtccgtgaatccggggttgattccaagtacctgcgtggttactctcatccactgtaattcgaagttgtgtgtgacggcccaataggcaataggccactttggttcgttgagctgagtagaatgtgtaggcagcttttcgttcggtcgtgttcttgtttaggatgactctcggtagtgtccccctgttgtggtgtgttgaacctctgacttgtcaaataattatgctcggtagatgcaagttggtgtttgtccatgtattgtaatgacagacagagtaagtgcatggttccttgcctcttcattgcttgtaacctgtaactgtcagttggaactatcgccagctagagggtactattggagcgttttatggtgcatcgcataacaaatatgaataagagcaatattctacctcaggacctcttaagatgatcgaagccgcgagcatgatgcttaatttgcattcaactagttttctgttttccgatgtaaggatgtgatggttcagagcgtgaggatgtgcttgcgccttgggccatatccctgtggactatgggatgcatttatggaaattttcggtacacatgaata

SEQ ID NO: 2188 - DNA, 1475 bp, Pennisetum glaucum
ggacaaggtgcggcggcacacgatttctgtgttcgtcggggacgagagcggcatgatcaaccggatcgccggggtcttcgccaggagaggctacaacatcgagtcgctcgcggtggggctcaacaaggacaaggcactcttcaccattgtcgtctccgggactgacagggtgctcaatcaagtcatcgagcagctcaataagcttgtcaacgtccacagtgtcgaagatctatctaaagaacctcaggttgagagagagctgatgcttataaaattaaacgtcaaacctgatcagcgccctgaggtcatggttttagttgatattttcagagcaaaagttgttgatatatctgataccacccttaccctggaggtagctggagatcctggaaaaattgctgcagtacagaggaacctgaggaaatttggaatcaaagaaatttgccgaacgggaaaaattgcattgagacgtgaaaggattggtgccaccgcccgtttctggcgattttctgctgcttcttacccagaccttatagaggcactgccaaaaaatccacttacatctgtaaataggactgttaatggcagtttggatcaatcatccgatgctgggggtgatgtttatccagtggaaccttatgagagctcttcgatgaaccaagtacttgatgcccattggggtgtccttgatgatgatgatgatttaactggacttcgctcacataccctctccatccttgtgaatgattgtcctggtgtcctcaacattgtaacaggggtgtttgctcgcaggggctacaatatacagagccttgctgttggcccagctgagaaggaaggcatttcgcgtattacaacagtcgttcctggtactgatgaatctattgagaagttagttcagcagctttataagcttattgatgtgcatgaggttcaagacattactcacttaccttttgctgaaagggaactgatgcttattaagatttctgtaaacactgctgctcggagggagatcctagatattgctgaaatcttccgagcgaaacctgtcgatgtttctgaccacacagttacgctgcagctcacaggggatcttaacaagatggttgcattacaaaggttattggagccttatggcatttgtgaggtcgccagaacaggtcgtgtggcgctggtccgcgaatccggggtagactccaagtacctccgcggcttctctctcccgttgtagcgtgacatttgtgatgatggcccaggaaagcgcattcctggttgctagagcagattgtgtagggatccacccttgttcggttgtgtgtatctgcaaaatttgtttccttcatctcgtcgactccttgactcgctgtcgtaataatatgctcccttggtgggatgcaagctgaggttgtatatgtatcccgttgacagtcagaataagatgcatgtgtgtcctcttggttgaattgggagtt

SEQ ID NO: 2189 - DNA, 1896 bp, Secale cereale
ccagcacttcccgatagccacccaccaacttcgccctcgaccaccatccatgtccgtcgccaccgcccaccacctccgcccgtcgccaccagcggcccgcgaccgcctccccttatgcgccgcgcgcgcctccttccggcccctgcgccgccgcggagtcgccgcgggggcgagcgccggcggcgaggcgaccgccgccgtgtcggcggtcaccgcgagcgccaagagggatccggtgcggcgccacacgatttcggtgttcgtcggcgacgagagcggcatgataaataggatcgcaggggtgttcgcaaggagaggctacaacatcgagtcgctcgccgtcgggctcaacaaggacaaggccctctttaccatcgtcgtctcagggacggatagggtgctcaagcaagtcattgagcagctcaataagctcgtcaacgtcttgaatgttgaagatctatctaaggagcctcaggttgaaagagagctcatgcttataaaactcaatgttgaaccagatcaacgtgctgacgtcatgtttgtagctaatgttttcagagcgaaagttgttgatatttccgagaacagcctaaccctggaggtaactggagatcctggaaaaattgttgcggcacaaaggaacctaaggaaattcgggatcgaagaaatttgtagaacgggaaaaattgctttgaggcgtgaaaaaattggagcaactgctcgtttctggggattttctgctgcttcttacccagaccttgtagaagcatcacgcaaaaatccgcttacctctgtgaataagacagttaatggcagttttgatcaaccatcaagttcagggggtgatgtttatcccgtggaaccttatgagagcttgtccatgaaccaagtacttgatgcccattggggtgttcttgatgatgaagattcaagcgggcttcgctcacatactctctccatcctcgtgaatgattgtcctggtgtcctcaacattataacaggggtctttgctcgcagggggtacagtatacagagccttgctgttggcccagctgaaaaggaaggcatttcacgtattacaacagttgttcctggaactgatgaatccattgagaagttagttcagcagctttacaagcttatcgatgtacataaggttgatgacttaactgacttaccttttgccgaaagagaactgatggttatcaaagtatctggaaacaccgctgctcggagggagatactagatattggtaatattttccgggcggaatgtgtggatctttctgatcacacagttacactacagcttactggggatcttgacaagatggttgcactacaaagactgttggagccttatggcatatgtgaggtcgccagaacaggtcgggcggcactactccgtgaatccagggttgactccaagtacctccgcggctactctcttccgctgtaataagaagccatgtgcaacgacgacccaagaagggtcacactaggttggttgagcttgagcagaatgtgtaggcagcacagcttttcgttcggctgtgttcttgtttaggatgacttgtttcctctgtggtaatgtgttgacttgtcgaataaattgttctcggtagatgcaagccgaggtttgcccatgtattgcaccgacaagcagaataaggagtacatgcttccttgtctctgcattgcttgaaagctgtaattgtcagttggaactatctgctaaaaataaaatgcactcttcaagcgtttgtggtatatcgcgtactaaatgaacaagggcggtgatttacctagttgatgccggttcgggagtacaagaaggcggccgccccctaggaactccgatgtaaattttttaatttccagagctgtttatgctag

SEQ ID NO: 2190 - DNA, 1560 bp, Panicum virgatum
ggctggtcgggtttctggcggcaaatgcagggtgcggcgccacacgatttcggtgttcgtcggggacgagagcggcatgatcaaccggatcgccggggtgttcgccaggagagggtacaacatcgagtcgctcgccgtggggctcaacaaggacaaggcgcttttcaccatcgtcgtctcggggaccgacagggtgctaaaccaagtcatcgagcagctcaacaagcttgtcaacgtcctcagtgtcgaagatctatctaaagaacctcaggttgaaagagagctgatgcttataaaactaaatgttaaacctgatcagcgccctgaggtcatggttttagttgatattttcagagcaaaagttgttgatatatctgatagcacacttaccatggaggtagctggagatcctggaaaaattgctgcagtggagaggaaccttaggaaatttggaatcaaagaaatttgccgaacgggaaaaattgctttgagacgtgagaagattggcgcgactgcccgtttctggcgattttctgctgcttcttacccagaccttatagaggcattgccaaaaaatccaattacatctgtaaataagacagttaatggcatttttgttcaaccatccagtgctgggggtgatgtttatcctgtggaaccttatgagagctcatcgatgaaccaagtacttgatgcccattggggtgttcttgatgatgattcaactggacttcgctcacatacgctctccatccttgtgaatgattgtcctggtgtcctcaacatagtaacaggggtatttgctcgcaggggctacaatatacagagccttgctgttggcccagctgagaaggaaggcatttcacgtattacaacagttgtccctggtactgatgaatccattgagaagttagttcagcagctttacaagcttattgatgtgcatgaggttcatgacattactcactcaccttttgctgaaagggagctgatgcttattaaggtttctgtaaacaccgctgctcggagggagatcctagatattgctgaaatcttccgagcaaaacctgtcgatgtttctgaccacacagttacactgcagctcactggggatcttgacaagatggttgcattgcaaaggttattggagccttatggcatctgtgaggtcgccagaacaggccgtgtggcgctggtccgcgaatccagagtggactccaagtacctccgtggctactctcttccgttgtagcctctggcgtttgtgatgatggcccaggaaatcgcatacctggttgctagagcagaatgtgtaggactcctttgttaggttgtgtgtatctgcaagagttgtttcctccatctcgtcaactccttgactgtcttgcttaattaataatatgctccttggtggatgtaagctgaagttgcatatgtatcccgttgacagtcataataagatacatgtgcatcctcttagttcagtgattcagtcaatcagtgggggcttgggagagatgtagccagcgtccaaaattaactggcagcattttcctatta

SEQ ID NO: 2191 - DNA, 2014 bp, Zea mays
atccatcaactcaacatcatcagctcgcgttgcgtgctcggcccgcctaatcctctttctttagctcaagaccggcgactaaatttggcgccagccggcagcagggggtataagtagtcgccgccgccgtcttcctcgcacctccccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctaagcagcagctatagtagctgagcgagtgcgtccatcgatcggagtcgtccacctccgtctccctttgcgattcggcgtcgtgaactcgtgttcttgagcgtgggggcaaggggcagagcaacaaggagacacttcttcttcttctttacaacaaataagaaagcaacggcaatggagggagctggtctgcagtgacagtgacacgagccatggatcccgagccattcgtgcggctctcagttgggcagctcggtctgaagctccccggcgggaacgctagcaaggcggccggccggctctgcgactgcgagatccggctgggcgggttcccggtgcagaccgctccggtgccgctggtccactccccggcgttcaacctcgacccattcaccaacgcggcggttttctccctcgaggaatccgacctcaaggcgctggcggcgccggggtgcttccgggccccgcggtcgtcgtgccttgaggtcgcggtgtactacctggcccgcttcggcgcttcacgctgtggtgtcctcgcctgcgggaggaagcggctggttggcgtgttcagggtggagctcgcttcgtcggaatggcgggacggcaagcccgtgctgctgcaccatgggtgggcgggcatcggcaagggggcggccaggccggagctccacctcagggtgaagctggaggctgacccccgctacatcttccagtttgacgacgagatcgcgctcaacccgcaggttgtccagctccatggcagcatccggcagcccgtgttcagctgcaagttcatccgcgacaggcggccatctcagagtgaccctttgggcggcgggcagtactggtcgagctccagcagcgaggagcaggacatggagatggtgaggcgggagaggaaggcctggaaggtggtgatccacgacctgtccggctcggccgtagccgcggcgtttatggccaccccgtttgtgccggcgccgggcggggacacggtggcacggtccaacccgggcgcctggctcatcgtgcgcgccgacaccacggggtcctcggacagttggcagccgtggggccggctggaggcgtggcgcgaggcggcggcggcggcggcgagcagcggcaaggacacggtgcgcctgcggctgcacctgctcccggaccgccacgacgactgcgtgctcgtgtcggaggcgcccctgagcagcgacaagggcggggagttcttcatcgacatggacaggcaggcgccctccgccacggcggcggagcactgcgcggcgagcctgggcgccgcgtgcgccggcggcggcttcgtcatgagctgcagggtggagggggaggcgaggagcagcaggccgttcgtgcagcttgccatgcggcatgtcacgtgcatggaggacgccgccatgttcgtcgcgctcgccgcggccgtcgacctcagcgtcaaggcgtgccgcccgttccgcaggaaaccgaacaagaaggccgcctcgccgtcgcccgaccacctcgagctcgacacctaggaacgcagaacaggaaggccccgccgactagcacccatggccgcccatggatccatctaactcgacctgtaaattcacttaatttcaagagctggactgaatcgtttgccacaatcaaaactctgttgtttgactggcctcagcagttagtacatgtttggaa

SEQ ID NO: 2192 - DNA, 2239 bp, Sorghum bicolor
tgcatccatcaacaacgcacagcttgcgttgcgttgcgtgctctgcccgcgcggcgcggcgcctaatcctctttttctttagctcaaaaccggcgactaaatttcgcgccagccggcagccgggggggtataagtagtcgccgccgccgccgtcttcgtcgtcttcctccccgatccgcacctcccccgctcccctttttccttgacatcacgttctcacacctcatccacagccgattcctcctcctcctcctcctcctcctcctctgcccgggcggccggctggcctcgatctgcttccacctcccgatcgaccggctcaattcctccgtcggttcggcctctggcggcctgcacgcgatgaactcttgcttccagggcctatggagagccatggctggggctctgccgccgccgccgtcgtgctgcctcggagctgccgcgtgtaggttgcttgcaaggcagcagctatagcagctgcgtgactgcatcgtatccatcagtcgatcgagtccatatcggcctcccttgggcgtcgtcttcttgagcgcgggaacagaggcaaggcagcaaatcgaagaagccagtttttgaagaacataatagcaaaagcagcagcaacggcaatggagggagctggtttgcagtgacgcgcgcgcgccatggatcccgagccatttgtgcgtctctcagtcgggcagctcggtctgaagctccccggcgggaacgcctgcaaggcggccggccggctgtgcgactgcgagatccggctgggcgggttcccggtgcagaccgctccggtgccgctgatccactccccggcgttcaacctcgacccgttcaccaacgcggcggtcttctccctcgacgagtccgacctcagggcgctggcggcgccggggtgcttccgggccccgcggacgtcgtgcctcgaggtcgccgtgtactacctggcccgcttcggcgcttcttctcgctgcggcggcgtcgtcgctgccgcctgcaggaggaagcggctggtcggcgtgttcagggtggagctcgcgtcgtcggagtggcgggacggcaagcccgtgctgctccaccatgggtgggccggcatcggcaagggggaggccagcgccaggccggagctccacctcagggtgaagctggaggctgacccccgctacatcttccagtttgacgatgacatcgcgctcaacccgcaggtcgtccagctccatggcagcatccggcagcccgtgttcagctgcaagttcatccgcgacaggcggccgtctcagagtgacccgttgggcggcggcgggcagtactggtcgagctccagcagcgaggagaaggacatggagatggtgaggcgggagaggaaggggtggaaggtggtgatccacgacctgtccggctcggccgtcgcggcggcgttcatggccacgccgttcgtgccggcgccgggcggggacacggtggcgcggtccaacccgggcgcctggctcatcgtgcgcgccgacaccacggggtcctcggacagctggcagccgtggggtcggctggaggcgtggcgcgacgcggcggcggcgagcggcggcaaggacacggtgcgcctgcggctgcacctgctcccggaccgccacgacgactgcgtgctggtgtcggaggcgccactgagcagcgacaagggcggggagttcttcatcgacatggacaggcaggcgccctccgccacggcggcggagcactgcgcggcgagccttggcgccgcgtgcgccggcggagggttcgtcatgagctgcagggtggaaggggaggcgaggagcagcaggccgttcgtgcagctcgccatgcgccacgtcacgtgcatggaggacgccgccatgttcgtcgcgctcgccgccgcagtcgacctcagcgtcaaggcgtgccgcccgttccggaggaagccgaacaagaaggctggctcgccgtcgcccgaccttctcgagctcgacacgtaggaacacaacagcacagggacacaggagacgcccgcccgccgactagcatccatggccgggggccggccatgcatccatctaactcgatctgtaaattcacttaatttcaaagagctggaccggacctttttgcactttgcagcaatgcaaaactctctgttgtttgattgacgccttgtttagatgcacccaaaaatccaaaactttacaagattccctatcatatcgaatcttgcggcatatgc

SEQ ID NO: 2193 - DNA, 2491 bp, Sorghum bicolor
cgtcatcctccccagcctcgtgatggtggtggtgcaagcacgggtcgcctcgccgaatcgaatcctttccagctctcgcccgcccgcttcaaatagagagccctctgccacttcccgccggtgtcccgtgcccggcgccagtttgtccgcacctgcaccccgagacctgctcacctctctgccgcgccggcgcgccgcctgcgccgccgtcctcctatcctatcctacgcaacacgcacgccggtcgctggcggcggctcttaaaaaaacagcgagccgaccattcctatttcgtctcgacgcggccgctcgatctctggtgcggcgtcacgggccgcgggccgcgacccacagcgcaagcagccaagcgaacaaaagctcacgggggggcgctcgcgggcgcggcacacggacggcggacggccacctcggcctgctgccgatgatggccgctctgccgccgcggtggaggccgctcctcctcctcctcgtcgcgctgctccatgtcctcctaatcggcggggcggcggcgccgttccgggcgagggacgtgctgccgctgctgccgcggcggctggcgtggcagctgatgggcgccacggcccacagcgccgtggacctgctcccgtcgttcgtcgccgccgtggcgccgggcgggcccgccgccgcctggcgcggcgcgtgcttcgaggagaaccaggccgtgctcagcctcaccacccccggctcctccggcggccgcaatgggaccgccgccgggggactcaacagcaccacctctggccttggtggcgccgtcatccacctcaagactgcatcgcctcagagctggacatgcatggatctgtacgtgtttgcaacgccatacaggatagcctgggattactacatgaggtcaaatgaaaaccacacctttgagatcaaagcctgggaggaagcagcagaactggaatatgtaaagcagcatggaattgccgtttttctcatgccatctggaatgcttgggacgttgttatccttggttgatgtcgtacctttgttttcaaacaccggttggggtcaggatgccaacttggcatttcttcagaagcatatgggaacttcatttcagaaacgttctgcaccctggtctgcgaatataaggagagaggatgtacattccggtgattttttggccctttcaaaaatccgagggcgatggggtggatttcagacattggagaaatgggtgaccggcgcattcgctgggcacactgcagttttcttgaaagatgagaatggcaccctctgggttgcagaatcaggctatgaaaataaaaagggtgatgaaatcattagtatgactccatgggatgaatggtggggaatggcacttaaagatgactcaaatcctcagatagcacttctgccattgcatcctgatgtacgggccagattcaatgaaagtgctgcatgggaatttgcccgaagcatgtatggaaaaccctacggttatcataacatgatatttagttggattgatacaatgtcagacaattatcctcctcctcttgacgctaacctggtaatggctattatgtccatgtggaccagattgcagccacactatgcttctaacatgtggaatgaagcccttaataaacgacttgggactgagaaactggaccttcatggggtcatttcagagaccgagaaacgcggcttgtctttcaaccagctgctcaccatacctgaacgagatgattgggaatacagcgatggcaaatcaacgacgtgtgtcgccttcatcctgtcaatgtacaaggcggccggagttttcgcgcccttcacggagtcaatccaggtcactgaattcaccatccgggacgcgtacatgctcaagatcttcgaggacaaccagacgaggctgcccagctggtgcaacgcggcggcagacaggctccccttctgccagatcctcggggagtataagatggacctgccggagtacaacacgattgagccctacgccaacatgaacgagaactgcccctcggcgccgcccacctacaatcggccgtcgcgctgctagctgatcggcgtaccatatactataagcataggcggcggcaaagaggttagcgtcagttggagtgtaagtgtaaatagaccacgctgttgctgtatgcatgcagtggtttcacttgcagatgcaggtgagagtatgttgtgttgtaggtggtcagctgttcgttcatatgctaattcagccagtcagctacggcctactggcagcagtgtgcttagccttcgttggtgtagagtgattgcttgtgcagatgatgacattcattccaaaattagtatgaaacggccgcgcatcaggccttcagtatgttcatggtctttgtaagaatataccgtttgtaagcatctctaagggttctccctattttgttcctcaaaatatagtgtttgccatctcctaaatgaatatggaagaaaaaaaaca

SEQ ID NO: 2194 - DNA, 1982 bp, Panicum virgatum
cgcgcgggcaggcgcggcgcgcggccagctcggccagttggcctccgcgtccgatggcggcttcgctgccgccgcggcgggggcggctcctctccccgcgctgctgctccacgccctggcggcggcggcggcgccgttccgggcgagggacgcgctgccgctgctgccgcggcgcctggcgtggcagctcatgggcgcgacggcgcacagcgccgtggacctgctgccgtccttcgtcggcgccgtcgcgcccggcggggccccggcggcctggcgcggcgcctgcttcgcggagaacgaggccgtcctcagcctcacccccggcgccggccgcagcggggccggcggcaacaccagctccagctccagcctcggcggcgccgtcctccgcctcaagactgcttcgcctgagagctggacatgcatggacctgtatgtgtttgcaactccatacaggatggcctgggattactatatgagatcaaatgaaaaccacacctttgagattaaggcgtgggaggaagcagcagaactggaatatgtaaagcagcatggcattgccgtctttctcatgccatctgggatgcttggaacactgttatccttgatcgatgtcatacctctgttttcaaacactggttggggtcaggatgctaacttggcatttctgaagaagcatatgggaacttcatttcagaagcgttctcagccctggtctgcaaatataagaaaagaagatgtacattcaggtgactttttggccctttcaaaaatccgaggacgatggggtggatttcagacattggagaaatgggtgaccggagcatttgctgggcacactgcagttttcttgaaagatgagaatggcaccctctgggttgcagaatcaggctatgagaacaaaaagggtgatgagatcattagtatgactccatgggatgaatggtggggaatggcacttaaagacgattcaaatcctcagatagcacttcttccgttgcatcctgatgtacgagccagattcaatgaaagtgctgcgtgggattttgcacgaagcatgtacggaaaaccctacggatatcataatatgatatttagttggattgacacaatgtcagacaattatccacctcctcttgatgctaacctggtaatggctattatgtcaatgtggaccagattgcaaccgcattatgcttctaacatgtggaacgaggcccttaataaacgactcgggactgagaaattggaccttcacgggatcatcaccgagaccgaaaggcgtggcctgtctttcaaccagctgctcaccattcctgagcgagacgattgggagtacagcgacggcaaatcgacgacgtgcgtcgccttcatcctttcgatgtacaaggcggccggtgtgttcgctccgttcacggagtcgatccaggtgacagaattcactatccgggacgcgtacatgctgaagatcttcgaggacaaccggacgcggctgccggggtggtgcaacgcggcggcggacgggctccccttctgccagatcctgggggagtacaagatggacctgccggagtacaacacgatcgagccctacgccaacatgaacgaaaactgcccgtcggcgccgcccgcctacagccgcccggcgcgctgctgatagccgccgccgccgtcggtcggggcggccgccgcgcatgcaaccgtgtgcaagtgtaaatagaccacgcacgcacgcacgcggcgcgtgtttacagtgccgtggtctcactctcgccgataattcttatgtcctggttcatttgaacaacaggaaacggaaacatcttcgagcaacaacgggtcttatgtagaatcttgtaaagcctctttcaagtatgaatttcccatgtactcagggaaaaaaaaccattcggatattgtaaaagactataaataattgtatagatttttttatttttttctactatattttctttcataaa

SEQ ID NO: 2195 - DNA, 2015 bp, Zea mays
tttgtctcgacgcggccgcgcgatctctggcgctgcatcacgggccggggccgcgagccacacacggagcaagcagccaagcgagcgaagcgaacaaaaagctcacgggggccagctaagcgcacggaccgacgcccgacgatggccgctctgccgcggcggaggctcctcctctttctcgcgctgctccgtgttctaatctgcggagcggcgccgttccgggcgagggacctgctgccgctgctgccgcggcggatggcgtggcagctcatgggcgccacggcccacagcgccgtcgacctgctcccgtcgttcgtcggcgccgtggcgccgggcgggcccgcggccgcctggcgcggcgcgtgcttcgacgaaaaccaggccgtgctcgacctcacccccggccgcaacgggaccgccgggggcctcggtggcgccgtcctccgcctcaagactgcttcgcctcagagctggacatgcatggacctgtacgtgttcgcaacgccctacagggtagcctgggactactacatgaggtcgaacgagaaccacaccttcgagatcaaagcgtgggaggacgcggcagagatggaatacgtaaagcagcacgggatcgccgtcttcctgatgccatctgggatgcttgggacgctgctgtccttggccgacgtggcgcctttgttctccaacaccggctggggccaggacgccaacttggcgttccttgggaagcacatgggggcgtcgttcgagaggcgtcgttccgcgaacacaattataaggagggaggacgtgcggtcgggcgacttcttggcgctctccaagatccggggccggtggggcgggttccagacgctggagaagtgggtcaccggcgccttcgccggccacaccgcggttgtcctcaaagatggtgacgccaacctctgggtcgcagaatcaggctacgaaaataacaagggtgacgagatcattagcatgactccgtgggacgagtggtgggggatggcgctcaaggacgagtccaaccctcagatagcgcttctgccgctgcaccccgatgtacgggcaaggttcgacgaaagcgccgcgtgggaattcgcccggagcatgtgcgggaaaccctacggctaccacaacatgatatttagctggatcgatacggcgtcagacaattacccgcctcctcttgacgccaacctggtaatggccattatgtccatgtggaccagactgcagccgcgctatgcttccaacatgtggaacgaagcacttaacaagcgacttgggactgagaaactggacctccatgggatcattagggagaccgagagacggggcctgtccttcaaccagctgctcaccgtacctgagcgagacgactgggagtacagcgacggcaagtccacgacgtgcgtcgccttcatcctgtccatgtacaaggcggccggagtcttcgctccctacacggagtccatccaggtcaccgagttcaccatccgggacgcgtacatgctcaagatcttcgaggacaaccagacgcggctgcccagctggtgcaacgcggcggcggacggcctccccttctgccagatcctcggggagtacaagatgggcctgccggagtacaacaccatcgagccctacgccaacatgaacgagaactgcccctcggcgccgcccacctacagccgcccgtcgcgctgctagctcggcgttgcctggggtgtgtgtaaactgtaaactaagctagctaagtgtaaatagaccacgctgtgtgcatgctattcatgcagtggtttcatttgcaggtaagtcgtcgtcgacgtcgtacgtgcagagtatatgttgttgttgttgttgttcgctcgtatgcttaattcagccattaattcagctacggcctagctaccggcacaagttaatttgcttagcctttagccttcgctgctgtaaagtgactgctcgtggaaatgattactacaaaattagtgtaaagcggccgcacatctggc

SEQ ID NO: 2196 - DNA, 1377 bp, Sorghum bicolor
atcatctcagaaaaaaaaaaaaatccccgaacccgagcaaaaggcccgctaaaccctcgacgccgccgccgccgccgcctccgcgccatggccgacgagctcgacgagctgatcggctttctctcggaccgcaacccccaggtgcggggcgcggcggtggacatagtgcgcgggctgacgggcggtgaggacggcctccgggcgctcacggcgcgcgccgaccgcgccctgccggcgctgctccgcctgctggcttccgcggccggcagcggcgcgggagaggccgcggcggactcgctcgtcaacctcagccaggacgcggacctcgcggcgcgcctcgtcgcgctcggggccgtcgatgccgccatggacgttgtggccaagcgaggcggggcgcagccggcccttgctcgcagcctcgtcatgctgctcgtcaacctcacccacgtcgagtccggcgtcgccgcgttcctccaggttggggatgagaaggtgcaaggcttgtatgttgcaaagcttgtgcgatcattctgtaggtcgtccagtgattctgaagaggaagacatttttgaatatgttgcctccatacttgtcaatatatctaaggttgaagctggaaggagaatattgatggagcctaagagaggtcttctgaagcagattattcgacaatttgattcaacaaatcaacttagaaagaaaggggttgctggtacaattcgtaactgttgctttgaggctgatactcagcttcagagtttgctttctttagcagaatatctttggccagctctacttttgcctgtagctggaaagaagatatatagtgaagaagacagatcgaaaatgccacttgagctatcgagtgcactctctcatgaacgggaagctgttgatgattctgaaattcggcagcaggcattggaggctatttatatgatcgtattgcaggatgatggccgcaggtcgttttggtcagttaatggtccacgaattctgcaggttggttatgaagatgaagaggacccgaaagtgatggaagcatatgaactgattggttccctgcttgttgggaagggtgaaggtgaacaagaacaagaacaaggagagaagccttaatgacccctcacccctgataaaaacggtgttgtatttctgtttgtctagaaaacatccctcgtcatgtgcaatagcaatactataatatcccaacttgtcagctgcaattgtcaactgcaaaagctctgcagtgttgcttctgtaattgacgaatgtatctggaaaatttgcagtgtcttttccatggttttgagagctctgacgattctttcacagcgtcacttcagaacatgggtaggcataccctgtagctttcgc

SEQ ID NO: 2197 - DNA, 1468 bp, Brachypodium distachyon
cccacccagacgaaaaccgaaaaccccaaccaaaggagaaggaacgctaaacctgcgccgccgcccctgccggctgccgctatggccgatgagctcaacgaactcatcgatttcctctctaatagctcccctcaggtgcgtggcgcggctgcggacatcgtgcgggggctcaccggagacggggagggcctgcgctccctcacggcgcgcgcggaccgagctctgccggcgctgctccgactgctcgcctccgtagggggcggcgcgggcgaggcggcggccgactcgctcgtcaacctcagccaggatggcgcgctcgccgcgcgcctcgttgcgctcggcgccgttgcggccgccatggacgtgatggtcaagcgcagcggagagcagcctaaactcgctcgcagcctcgtcatgctgctcgttaacctcactcaggtcgagtctggcatcgcagccctcctccaggttggtgatgagaaggtgcaagggttatatgttgcgaagcttgtgcggtcattctgtagatcatccagtgagtctgaagatgaagacatttttgaacacatcgcctctatacttgtcaacatctcaaaggtcgaagctggaaggagaatactgatggaacctaagagaggtcttctaaagcagattatacggcaatttgattcaacaaaccaacttagaaagaaaggggttgctggcaccatccgtaactgttgcttcgaagctgataccctgatacaaaatttgctttctatagcagaatatctttggccagctctacttttgcctgtagctggaaagaagatctatagtgaagaagatagatcgaaaatgcctcttgagcttgcaaatgcactttctcatgaaagagaagctgttgaggattctgaaattcgagaacgggcactggaggctatttatatgatcgtgatgcaggatgatggacgaagggccttttggtcagtcaatgggccgaggatactgcaggttggttatgaagaagaagaggacttgaaagtgatgggagcatatgagttgattggttctttgctcgttggcaagggtgagattgaacaagatcaagagcaaggacaagacaagccttaatgggccctccagtgtgtacaatattgttttgtgtacttgttgtaaaatctgggtttaaatctaatgcaatttatttgtctcaaaaaaaaatctaatgcaatttatcacttcaaattatcttaggcttgatttagatatactcttttaggtggtcttcgcggtttgttgctcgcagaacagtctacagatcttttgctttagaatactttgcagttaggactggcatcggtcgactctggcactgctatggtcagctgtatgaacacatgcatatctccttcgctgttctaaaacaagctgtatgcacaacacttttcaattggcacaggattacaaataacattgtttgatttga

SEQ ID NO: 2198 - DNA, 1337 bp, Leymus cinereus x Leymus triticoides
aagcaccctctttcctccgccgccgccccttctgctgccatggccgacgagctggacgaactcatcgacttcctctccaatagctcccctcaggtgcgcggcgccgcggcggacatcgtgcgggggctcaccggggacagcgacgggctacgctcactcacgtcgcgcgccgaccgcgcgctgccggcgctgctccggctgctcgcgtctgtggggggcggtgcgggcgaggcggcggcggactcgctcgtcaacctcagccaggacggcgagctcgccgcgcgccttgtggcgctcggcgccgtcgccgccgcgatggacgtgatggtcaagcgcggcggcgagcagcccaagctcgctcgcagccttgtcatgctgctcgtcaacctcacccaggtcgagtccggcatctcggccctcctccaggttggtgatgaaaaggtgcaagggttgtatgttgcaaagcttgtgcgctcattctgtaggtcatccagtgactctgaagatgaagatatatttgaacacattgcctctatacttgtgaatatctcaaaggtcgaagctggacggagaatactgatggaacctaagagaggtcttttaaagcagattataggacaatttgattcaacaaaccaacttagaaagaaaggggttgctggcaccatccgtaactgttgctttgaagctgatacccagatacaaaatttgctttctatagcagaatatctttggccagctctacttttgcctgtagctggaaagaagatctatagcgaagaagatagatcgaaaatgcctcctgagcttgcaaatgcactttctcatgaacgagaagctgttgatgattctgaaattcgtgaacgggcactggaggctatttatatgattgtgatgcaggatgatggacgaaaggccttttggtcagtcaatgggccacggatactgcaggttggttatgaagacgaagaggacttgaaagtgatgggagcatatgagttgattggttctttgcttgtcggcaagggtgaaattgaacaagatcaagagcaaggagaagataagcctcaatgatgggctcaactatgtacaatttgtattttgtcttatgtatttgctgcaagaaaacagggctatattgcttccaatcttaaaaatgttatgtcgtatgggtccaaatttctttgcagtaactggcttgttctatctcctggtttcagttttgttgtccacaatcttaatacaaccctgtaagagcgttaagaacatgtccagttttcaccacttattggggacagattgatttacagcatgatgtgtagatgataaaaaaaaaa

SEQ ID NO: 2199 - DNA, 1520 bp, Oryza sativa
aatccgtcacgtcgcgtgctttcggacttggagagaagccgaaccccacaaaacctcctcccccctcgccgccgccgccgccgccatggccgacgagctcgacgaactcctcggcttcctctcctctccccagccaaacgtgcgcggcgcggcggcgggcatcgtgcgggggctgacgggcgacgcggacggcctgcgcgccctctcggcgcgcgccgaccgcgcgctgccggcgctgctccggctgctggcgtccgcggggggcgagctgggcacggggggagcggcggcggactcgctcgtcaacctcagccaggatggcgcgctctcggcccgcctcgtgtcgctcggcgccgtcgtggccgccatggacgtcgtggccaagcgcggcggggagcagccgggcctcgcgcgcagcctcgtcatgctgctcgccaacctcacccaggtcgactccggcgtcgcggccctcctccaggttggagatgaaaagatgcaaggactgtatgttgcaaagcttgtgcggtcattctgcaggtcatccagtgagtctgaagaggaagatatctttgaacatgttgcttctatattagtgaacatctcaaaggttgaagctggaaggagaatactgatggaacctaagagaggccttttaaaacagattatacggcaatctgattcaacaaaccaacttagaaagaaaggggttgttagcaccatccgtaactgttgctttgaagctgatacccaaatacaaaatttgctctctctagcagaatatatttggccagctctacttttgcccgtagctggaaagaagatctacagtgaagaagatagatcaaaaatgcctcctgagcttgcaaatgcactctcccatgaacgagaggctgttgagaactctgaaattcggcaacaggcacttgaggctatttatatgattgtccttcaggatgaaggacgaagggctttttggtcagtcaatggtccgcgaatactgcaggttggttatgaagacgaggaggacccaaaagtgatggaagcatacgagttaattggatctctgcttgttggcaagggtgatgatgagcaagatcaagaacaaggaggacagaagccttaatttctgctgtttagaaaaaaaaaattcagtcctccatcgtgtacaatattcttctatttatcagttgttgcaaaaactgggctacattgcaatgctaccgtaatcaattgttgtattatggacaaaatttttttgcaccatttggcaggtttttccctggcttaaagctatcaagagttctccatacaattatgtaagaacatggagaaatatgcataaacagagcaatttgcccacttttcatcgaaagatcaggaaattggttaatgtgcacatgtcaccattaactgggggatttgcctcagggcagaggaatatccagcccccagttggaaaaacaactggattttggattaatgtcccgttttagtgttttgatttgtggtatgaaatgaag

SEQ ID NO: 2200 - DNA, 1516 bp, Secale cereale
gactcgtcgtgcttgcgctgaaaaattccccagaggaggacagccgcccgaaaaagcccaagcaaaaagaacccccttttcctcctcctcctcctccgccgccgccgcctccgccgccatggccgacgagctggacgagctcatcgacttcctctccaacggctccccgcaggtgcgcggcgccgcggcggacatcgtgcgggggctcacaggggacagcgacgggctgcgctccctcgcggcgcgcgccgaccgcgcgctgccggcgctgctccggctgctcgcgtccgtgggggccggcggcgcgggcgaggcggcggccgactcgctcgtcaacctcagccaggacggcgacctcgccgcgcgcctcgtggtgctcggcgccgtcgcggccgccatggacgtgatggtcaagcgcggcggcgagcagcccaagctcgctcgcagcctcgtcatgctgctcgtcaacctcacccaggtcgagtccggcatctcggccctcctccaggttggtgatgaaaaggtgcaagggttgtatgttgcaaagcttgtgcgctcattctgtcggtcatccagtgactccgaagatgaagatatatttgaacacatcgcctctatacttgtgaatatctcaaaggtcgaagctggacggagagtactgatggaacctaagagaggtcttctaaagcagattataggacaatttgattcaacaaaccaacttagaaagaaaggggttgctggcaccatccgtaattgttgttttgaagctgatacccagatacaaaatttgctttctatagcagaatatctttggccagctctacttttgcctgtagctggaaagaagatctatagtgaagaagatagatcgaaaatgcctcctgagcttgcaaatgcactttctcatgaacgagaagctgttgatgattctgaaattcgtgaacgggcactggaggctatttatatgatcgtgatgcaggatgatggacgaaaggccttttggtcagtcaatgggccacggatactacagcttggttatgaagacgaagaggacttgaaagtgatgggagcatatgagttgattggttctttgcttgtcggcaagggtgaaattgaacaagatcaagaccaaggagaagataaacctcaatgatgggctcaactatgtacaatttgtattctgtctcgtctactcgctgcaagaaaaaaagggctatattgcttccaatcgtaagaatgttctgtcgtatggatccaaatttcttgcagtaactggcttgttctacctcctggtttcagttatttgtccacaattttaatacaactgtgtaagagcattaagaacatgtccagttttcgcctgtgatggacagattgatttacagcatgatgtatgtgtagatgatagatgtggctgactagacctgtgttccttttattcttctgaggtactcctatatgtgctcatggtgtaattgttcagggatgtgcaaattgtggtctcatcagttct

SEQ ID NO: 2201 - DNA, 1344 bp, Secale cereale
gctggacgagctcatcgacttcctctccaacggctccccgcaggtgcgcggcgccgcggcggacatcgtgcgggggctcaccggggacagcgacgggctgcgctccctcgcggcccgcgccgaccgcgcgctgccggcgctgctccggctgctcgcgtccgtgggggccgcggcgcgggcgaggcggcggccgactcgctcgtcaacctcagccaggacggcgagctcgccgcgcgcctcgtggtgctcggcgccgtcgcggccgccatggacgtgatggtcaagcgcggcggcgagcagcccaagctcgctcgcagcctcgtcatgctgctcgtcaacctcacccaggtcgagtccggcatctcggccctcctccaggttggtgatgaaaaggtgcaagggttgtatgttgcaaagcttgtgcgctcattctgtaggtcatccagtgactctgaagatgaagatatatttgaacacatcgcatctatacttgtgaatatctcaaaggtcgaagctggacggagaatactgatggaacctaagagaggtcttctaaagcagattataggacaatttgattcaacaaaccaacttagaaagaaaggggttgctggcaccatccgtaattgttgttttgaagctgatacccagatacaaaatttgctttctatagcagaatatctttggccagctctacttttgcctgtagctggaaagaagatctatagcgaagaagatagatcgaaaatgcctcctgagcttgcaaatgcactttctcatgaacgagaagctgttgatgattctgaaattcgtgaacgggcactggaggctatttatatgatcgtgatgcaggataatggacgaaaggccttttggtcagtcaatgggccacggatcctacagcttggttatgaagacgaagaggacttgaaagtgatgggagcatatgagttgattggttctttgcttgtcggcaagggtgaaattgaacaagatcaagagcaaggagaagataaacctcaatgatgggctcaactatgtacaatttgtaatctgtctcgtctactctcgctgcaagaaaaaagggctatattgcttccaatcgtaagaatgttctgtcgtatggatccaaatttcttgcagtaactggcttgttctacctcctggtttcagtttgttgtccacaattttaatacaactgtgtaagagcattaagaacatgtccagttttcgcctgtgattgacagattgatttacatcatgatgtgtagatgatagatgtgtccaactagacctgttttccttttcttcttctgaaatatatgtgctcatggtgtaattgtt

SEQ ID NO: 2202 - DNA, 1487 bp, Secale cereale
gggcgcgggcggctcgacgagctcatcgacttcctctccaacggctccccgcaggtgcgcggcgccgcggcggacatcgtgcgggggctcacgggggacagcgacgggctgcgctccctcgcggcgcgcgccgaccgcgcgcttccggcgctgctccggctgctcgcgtccgtgggggccggcggcgcgggcgaggcggcggccgactcgctcgtcaacctcagccaggacggcgagctcgccgcgcgcctcgtggtgctcggcgccgtcgcggccgccatggacgtgatggtcaagcgcggcggcgagcagcccaagctcgctcgcagcctcgtcatgctgctcgtcaacctcacccaggtcgagtccggcatctcggccctcctccaggttggtgatgaaaaggtgcaagggttgtatgttgcaaagcttgtgcgctcattctgtcggtcatccagtgactctgaagatgaagatatatttgaacacatcgcctctatacttgtgaatatctcaaaggtcgaagctggacggagaatactgatggaacctaagagaggtcttctaaagcagattataggacaatttgattcaacaaaccaacttagaaagaaaggggttgctggcaccatccgtaattgttgttttgaagctgatacccagatacaaaatttgctttcgatagcagaatatctttggccagctctacttttgcctgtagctggaaagaagatctatagcgaagaagatagatcgaaaatgcctcctgagcttgcaaatgcactttctcatgaacgagaagctgttgatgattctgaaattcgtgaacgggcactggaggctatttatatgatcgtgatgcaggataatggacgaaaggccttttggtcagtcaatgggccacggatactacagcttggttatgaagacgaagaggacttgaaagtgatgggagcatatgagttgattggttctttgcttgtcggcaagggtgaaattgaacaagatcaagagcaaggagaagataaacctcaatgatgggctcaactatgtacaatttgtaatctgtctcatctactctcgctgcaagaaaaaagggctatattgcttccaatcgtaagaatgttctgtcgtatggatccaaatttcttgcagtaactggcttgttctacctcctggtttcagtttgttgtccacagttttaatacaactatgtaagagcattaagaacatgtccagttttcgcctctgattgacagattgatttacatcatgatgtgtagatgatagatgtgtccaactagacctgttttccttttcttcttctgaaatatgtgctcatggtgtaattgttcagagatgtgtaaactgtgctctcatcagttctttagggcaaaaatagagatcttgatgttgcacagaaatgcttagtcgtggactcgtggttgacatataatgcacaattcttgcttatttacaagatagtc

SEQ ID NO: 2203 - DNA, 2724 bp, Panicum virgatum
tggtgtggcgctcatggttgccggtatctttccacgctgcaaatggcggcatgcctactaggctactactgtacaataaaacagcagaggattcctccttcccctgcgctgcgcctgctcgtttcttctctagcgtttgttcctttgtcccctttacagtcctgctccgtttgttcgcttcctaaatcctcctcagttccagcatccccctgctgatttagctaccagtgtcccgctcgctcgcgccactgagctttgcgcgctctcaaccactccagatcacgcccgctggtgctgcagcagcgccggtgtccaagaaatgagcttgcggggcgacccggcggccgccggggacgagacggcggaggagctgctgaagcgtgtccgggggatggtgccgccggcgctggcggcggcggggccggcggccgggttcccgggccggtggaaggcgatcgccgccaagctggaggcgctcccggcgtgcctgtccgacctgtccagccacccttgcttcgccaagaacgcgctgtgccgcgagctgctgcagtccttggccgccacgctcgccgaggcggccgacctcgcgggccggtgccgggggccgccgccggacgggaagctgcggacgcagagcgccatcgacgcgctctccgggaagctggacctcaacctccgggactgcgcgctgctcgtcaggaccggcgtgctgtccgacgcctccggcccgtcgccgccggcggaggcgccggcgcacgcggacgtccgggagctgctcgcgaggctgcagatcgggcacaccgaggcgaagaaccgggccatggacgggctcctcgaggcgctgcgcaacgacgagaagagcgtgctctccgtgctcggccgcgccaacgtctccgcgatggtgcagctgctcacggcgtcggcgcccgtggtccgggagaaggccgccacggtgatatgccaggtcgcggagtcgggcagctgcgaggtactgctcgtgtcggagggcgtcctgccgccgctcatcaggctggccgagtccggcagcctcgtcgggcgcgagaaggccgcaatcacgctgcagcgcctgtccgccgtctcccctgacgttgcgcgcgcgatcgtcggccacggcggcgccggcccactcatcgagatctgccagacgggggactccatctcgcagcccgccgcggccggcgcgctcaagaacctctcggcggtgccggaggtgcggcaggccttggccgaccaaggaatcgtccgcgtcatggtccacctgctggactgcggcgccgtggccggctccaaggagcacgccgccgagtgcctgcagaacctgacgtcgagcaacgacggcttgcggcgcgccgtggtgtccgagggcgggctgcgcagcctgctgctctacctggacggcccgccgccgccggagtccgcggtgggcgcgctccggaacctcgtgggcgccgtgtcgcccgacagcctggtgtcgctgggcgtgctgcctcggctggcccacgtgctgagggtggggtcggtcggcgcgcagcaggcggcggcggcggcgatctgccggatgtcgagctccgcggagatgaagcgcgtggtcggcgagcacgggtgcgtgccgctgctggtgcggctgctggaggccaagtcgaacgcggcgcgcgaggtggcggcgcaggccctggcgagcctggcgagctggccgcccaacgcccgggaggtgaggaaggacgacaagggcgtgccgagcctggtgcagctgctggacccgagcccggcgaacacggccaacaagtacgccatcgggtgcctgctgacgctggcggcgagcaagcggtgcaagaagctgatgatctcgcacggcgccatcgggtacctgaagaagctctccgacatggacgtcgccggcgccaggaagctgctcgagaggctggagcgcggcagcctgcgcagcctcttcagtaggaactagcgtagtagcgtatagcggctgtaaaaatctaagcttcactcgttgcttatatggtgatgataccttggcattttcttttgtttttgctgtaacatgtataaaaatcaagtctagtttgacagttgacacacacaacactgtcgatgaaatggagctgtgcaggtgttcgtgttagatttatatatggagctgtaaaatagtagcaatttttttttccttttgcgaatgttggctctcgcatgtactacttcagatatcagacgccatgtttgatcgatgatttgacaacgtacaacgccctggtacatgtgagctccattattctgcatgaaatgaatcaaaacccctgctcggatcggagcagccatggccagcgcagatgttttttatttgaagaaagccagcgcagatgtaggagccacgtggtccatgcatgctcaagtatagctacctcaatttccagcgacggctacttccatagtagggaggacccggacccatctcacgccttgactttggccacggggccacgggaagggagttgctgcacaagccatggaaagcaacggagtacacgaagcattagcgtcgcacttcatgacacttgcacaacacagcagaggcaggagcccactactacggtactacctgatagcaggagatgagcgaggtgacgaatccgagagctcccgtcactctgggggtgaccttcttgggtgccagctgaagaagcccgatgg

SEQ ID NO: 2204 - DNA, 3411 bp, Panicum virgatum
gagttgcagcaaaaatacatatttggcagagctctgaccggagctgttggtggagctgctcatggaggcctgccaaacacagcctgaggcgaaccaacgaacgaacctgtcattggactcggtccccggtcggttcggtgctccggctccggcacgtcgctggccgatccggatcacggcggacgaggctccgctgcagttggccgccgtgcagttgagtcactgcgtgtggggcctgcacgagtggggcccacgtggcagtgacccaactacaggggaggtaactgcagcggatccggttcggatcacggcgccatccggtggcccaccaaccaccatacgtccacctcccacgcccgcacgcagatacgccgccgtggtcgcctcgcatgtgtgcccggccccgctggcgcccattatttatttattgggcgcgcaaagaagctgcccgcgactgcccgcggcacccctggcggttaatgatggggccatgagttttaagatctacagtactactagtagggcggaatgggttagcaatagcagcaggcaggcaggcaggcatccaatcgctttttgcctccatccccaagtccatcgtacaaggacaacacgtcatcgggttagattgctttttcacgctgctctttcttccctttgctgcatcaaagcaccgagtcttttacttattttgatttgattacaatacaagaaaaggcaaagcagcagctggtcatcagcgttagcgtcacattacgagctgagctgccaaatcttgctcctctcgccaagccaaggtaaaataccattcccacctcgcggccatgctttctaccgctgtgacacaactgttcagcaattgcctgcctcaccaagcaggaacagtgatgctacggccggtaacatgcagtagcatctttttttagttcccaatcgccttgtccctggtgcccgtcattccctcgagtccaaaacccacccagttctcaaccacgcctgattatgattaataaacaaacaaacaaacccaaacgtgatttgtgacgacaagacccctcgcctcgagctagcagcccgtaaatcaaatccccgtgccgtctcggcacgggcaccctcgcctccgaattgacacttcaccagactataaaaatctcttctctacgagtagcggtaggatcatcacggtggaaaagaaatttatattcagatcgctcggcttggtgtggcgctcatggttgccggtatctttccacgctgcaaatggcggaatgcctactactgtagagaaataataaaacagcagaggattcctcctccccctgcgctgcgctgcgcctgctcgtttcttctctagcgtttgttcccttctctcctgctccgtttgttcccttcctcctcctcctcctcctcagttccagcaatccccttcagatttattagctaccagtgtccccagtcgctcgcgccactgagctttccgcgctctcaaccactccagatcacggccgctggtgctgcataggcgccggtgtcaaagaaatgagcttgcggggcgacccggcggcggccggggacgagacggcggaggagctgctggagcgtgtccgggggatggtgccaccggcgctggcggcggcgggggcggcggccgggttcccgggccggtggaaggcgatcgccgccaagctggaggcgctcccggcgtgcctgtccgacctgtccagccacccttgcttcgccaagaacgcgctgtgccgcgagctgctgcagtcggtcgccgccacgctcgccgaggcggccgacctcgcggggcggtgccggggcccgccgccggacgggaagctgcggacgcagagcgccatcgacgcgctctccgggaagctggacctcaacatccgggactgcgcgctgctcgtcaggaccggcgtgctgtccgacgcctccggcccgtcgccgccggcgcacgcggacgtccgggagctgctcgcgaggctgcagatcgggcacaccgaggccaagaaccgggccgtggacgggctcctcgaggcgctgcgcagcgacgagaagagcgtgctctccgtgctcggccgcgccaacgtcgccgcgatggtgcagctgctcacggcgccggctcccgtggtccgggagaaggccgccacggtgatatgccaggtcgcggagtcgggcgcctgcgacgggctgctcgtgtcggagggcgtcctgccgccgctcatcaggctggccgagtccggcagcctcgtcggccgcgagaaggccgcgatcacgctgcagcgcctgtccgccgtgtcccctgacgctgcgcgcgcgatcgtcggccacggcggcgccggcccgctcatcgagatctgccagacgggggactccatctcgcagcccgccgcggccggcgcgctcaggaacctctcggcggtggcggaggtgcgggaggccttggctgaccagggaatcgtccgcatcatggtgaacctgctggactgcggcaccgtggccggctccaaggagcacgccgccgagtgcctgcagaacctgacgtcgggcggcgacagcttgcggcgcgccgtggtgtccgagggcgggctgcgcagcctgctgctctacctggatggcccgctgccgccggagcccgcggcgggcgcgctccggaacctcgtgggcgccgtgtcgcccgacagcctggtgtcgctgggcgtgctgccccggctggcccacgtgctgagggtcgggtcgatcggcgcgcagcaggcggcggcggcggcgatctgccggatgtcgagctccgcggagatgaagcgcgcggtcggcgagcacgggtgcgtgccgctgctggtgcggctgctggaggccaagtcgaaggcggcgcgggaggtggcggcgcaggcgctggcgagcctggtgagctggccacccaacgcccgggaggtgaggagggacgacaagggcgtgccgagcctggtgcagctgctggacccgagcccggcgaacacggccaacaagtacgccatcgcgtgcctgctgacgctggcggcggccaagcggtgcaggaagctgatgatctcacacggcgccatcgggtacctcaagaagctctccgacatggacgtcgccggcgccaggaagctgctcgagaggctggagcgcggcagcctgcgcagcctcttcagtaggaactagcgtatagcggctgtaaaaactaacaaagctgccttcactcgctgcttatacattggcatttttttttcttttttgctgtataacatgtataaaaatcaagtccagtttgacacacacacactctgttaactgtcgatgaaatggtgatgtgcaggtgttcgtgttaaccgaatatatatggagctgtaaaatagcagggtgatggctcgagtctgcacc

SEQ ID NO: 2205 - DNA, 2684 bp, Sorghum bicolor
cccagtgtctagtacttgattcttgatgcaggtagcacactgactggatgaatgcgctgtcaggctggcattggccaacgttcatttgccctgctgctgctggtaatgccattgccatgatgggtgtcgtacgtcgggctatatatcggtatcggtgcaagccaaggtccgagctcgatctcgtcggccggccgaaccgaacaacacaacggacagcagagaaagacgacggcccgagacagatacggaacccgacgtgctttgtcggccggcccgccgcacgcgtacgtgaccggcaagtgaagtgatgattcgccaatcctaccagccactcctgtattagtagtaggaggagtatcctcttgtgtacatcaccagcccttcttccctctccatcaggctgtcacacgcacgaggagagggtgggtttaaaaggcaccagcagctcaatcagctgatcaagttcagttcagctgctactactgggcttttgatgattgcagtcttgatcgcagctctgctggggctctgcgtcgcctcggccgtcgccgtcgctgcggcggagaagagacgacgtcgccgtcggcgagtcggcggcgccggagacgacgacgcggcggtgtcggccggactaagccaagggattattgcccaagctcccagtggcacaactcggaccactgagctctgaccactctctcctcaaccactccagatcacggcggacactggtgcatcagcagtatcagcggggtccaagaaatgagcttccgtgggggcgacccggcggcggccggggaggaggaggaggaggagctgctggagcgcgtccgtgggatggtgccggccgtggctgcagcggcgcgagcggcgggcgggttcccgggacggtggaaggcgatcgccgcgaagctggacacgctcccggcgtgcctgtccgacctctccagccacccttgcttcgccaggaacgcgctgtgccgggagctgctgcagtcggttgccgccacgctcgccgacgcggccgagctcgcggcgcggtgccgggagccgccggcggacggcaagctcaggacgcagagcgccatcgacgcgctgtccgggaggctcgacctcggactccgggactgcgcgctgctcgtcaagaccggcgtgctgtccgacgccgccggcccgtccccgtccccgtccccgccgacggcggaggccccgtctgcggcggtgcaggcggacgtccgggagctgctcgcgaggctgcaaatcgggcacgccgaggccaagagccgggccgtggacgggctgctggacgcgctgcgcagggacgagcggagcgtgctggcggcgctcggccgcgccagcgtctccgcgatggtgcagctgctcacggcgtcggcgcccgtggtccgggagaaggccgccacggtcgtgtgccaggtcgcggagtcgggcggcgccgcctgcgaggcgctgctcgtgtccgagggcgtcctgccgccgctcgtcaggctggcggagtccggcagcctcgtggcgcgcgagaaggccgtggtcacgttgcagcgcctgtccgcgtcgtcgcctgacgtcgcgcgtgcggtcgtcggccacggcggcgccggcgcgctcgtcgagatctgccagacgggggactccgtctcccagtccgccgcggccggcgcgctcaggaacctctcggcggtgccggaggtgcggctggcgttggccgacgaaggaatcgtccgcgtcatggtcagcctgctggaccgcggcgccgtggcgggcgccaaggagcacgccgccgagtgcctgcagaacctcacgtccggcaacgacgacctgcggcacgccgtcgtggcggagggcgggctgcgcagcctgctgctctacctggacggcccgctgccgcaggagccggcggtgagcgcgctccggaacctcgtgggcgccgtctcgcccgacagcctcgtggcgctcggcgtgctgcctcggctggtccacgtgctcagggtcgggcccagtggcgcgcagcaggcggcagcggcggcggtctgccggatctccagctccgccgagatgaagcgcgccgtcggcgagcacggctgcatcccgctgctggtgcgcttgctggaggccaagtcgaacggcgcgcgcgaggtggccgcgcaggcgctggcgagcctggtgagctgccctgccaacgcccgggagatgaagaaggacgacaagtgcgtgcccaacctggtgcagctgctggacccgagccctgcgaacacggcgaagaagtacgccatcgcctgcctcctcacgctgtcgggggccaagcgatgcaagaagatgatggtctcgcacggcgccatcgggtacctgaagaagctctccgacatggacgtggccggcgccaagaagctgcacgagaggctggagggcggcaggctacgcagcatgttcagtaggcactagcacctgtaactaaaactaataacaaccttgcctgtactattgccttgcaaaaatttcacctcggctgtatagaaatcaaacccagtttcacactctgtatgaaatgaaatgtctgttcaggaacttcgcctaattgtatcttcatctagcaagatcaaccgtgcaaatttgtacatcttgattcgttacggacgtgcggtatatcattatattttgatgaaaat

SEQ ID NO: 2206 - DNA, 2139 bp, Oryza sativa
gtttttgtgccttaaaaaaaacaggaggattccttcgtctccctgctcgtttcttctctagtgtttgttcccttgtttcttttccagtcttgctttgctttgttttgtttgtttgcttcctcctatcagatgagtctatggaagcatccggccgcggccggagacggcgaggtggtggagacggtggtcgagctgctcgcgcgcgtccgggggatggtgcctccggcgctgggcgcggccggcgcggcggagggcttcccggggcggtggaaggcgatcgccgcgaagctggaggggctcccggcgtgcctgtccgacctatccagccacccttgcttcgccaagaacgcgctgtgccgcgagctgctgcagtcggtggccgccacgctcgcggaggcggcggagctcgcggcgcggtgccgggagccgccggctgccgggaagctgcagatgcagagcgccatcgacgcgctcgccggtaagctggacctcaacctccgggactgcgcgctgcttgtcaagaccggcgtgctgtccgatgccttcacgccgccgcctccgaccgacgaggcgacgtcgacggcgacggcggcgcaggcggacgtgcgtgagctgcttgcgaggctgcagatcgggcacaccgaggcgaagagcctggcggtggatggtcttctcgaggcgctcaacaaggacgagaagagcgtcctctcggtgcttggtcgcgccaatgtcgccgctctggtgcagctgctcacggcgccggcgaccaaggtgcgggagaaggccgccacggtgatatgccagcttgcggagtccggcggctgcgaggggctactcgtgtcggagggcgcgctgccgccgctcatccggttggccgagtccggcagcctcctcggccgtgagaaggccgtcatcacgctgcagcgcctatccatgtcatctgacaccgcccgcgccattgccgggcacggtggcgcacgcccgctcattgagatgtgccagaccggggactccatctcgcagtccgcggcggccggcgcgctcaagaacctctcggcggtgccagaagtgcggcaagcattggccgacgaaggaatcgtccgcgtcatggtcggcctactggattgcggcaccgtgctcggctccaaggagcacgccgccgactgcttgcagaacctcacgtcgagcagcgacagcttccggcgcgccgtcgtgtcggacggcgggctccgcagcctgctcgtgtacctcgacggcccgctgccgcaggagtccgcggtgagcgcgctccggaacctggtgagcgcggtgtcccccgacagcctcgtgtcgctcggcgtgctcccgcggctggcgcatgtgctcagggtcgggtcaaccggcgcgcagcaggcggcggccgcggcgatctgcaggatctccaccaccacggacatgaagcgcgtcgtcggcgagcacggctgcgtgccgctgctggtgcggatgctggacgccaagtcgaacggcgcgcgcgaggtcgcggcgcaggccatggcgagcctcgtgggctaccctcccaacgccagggaggtgaggagggacggcaagagcgtgccatgcctggtgcagctgctcgacccgagccccgcgaacacggccaagaagtacgccatcgcgtgcctcctgtcgctcgccgcggccaagaggtgcaagaagctgatgatctcgcacggcgccattggctacctcaagaagctctccgacatggacgtcgccggcgccaagaagcttctggagaggctggagcgcggcaagctgcgcagcctcttcagtagggactaaagcagctgtaactacaaagcttcaccacttacacgttacgttgccaagttttttttttttgttgtataacctgtataaaagatcacatcttgttttcacagtctatggaacacggggcttgtgcagtgcaaatgctcatcttgactgaatatactgaggtgtaattttccctatattctttgtgatggatactactcctatgtaggaaagcaaattatactatctggttaaaccgaaattaatggataaccggtgtactcaagttattgtttaatgtgaacatttcagtaagctaatgtggacgacatgatgacgcta

SEQ ID NO: 2207 - DNA, 2267 bp, Zea mays
ttaaaaggcacacccagagctcagctcagctgctaggctctcttgatgattgcagtcttgatcgcggctctgctggggctggggctctgcgtcgccgtcgttgcggcggagaagaggcggcggctagtcggcgtcggcgccaccggcgacgaccacgcggcggcgtcggccggactaagccagggaactgtccaagtccaagatcacggcgggcactggtgcagcaatagcaaccgggtccaagtccaagaaatgagctcgcggggtcccgacccggcgccgcccggggaggagcaggagacggcggaggagctgctggagcgcgtccggggcatggtgccggcggcggcggccgcagcgcgggcggcgggcgggttcccgggccggtggaaggcgatcgccgcgaagctggacgcgctgccggcgtgcctgtccgacctgtccagccacccttgcttcgccaggaactcgctgtgccgggagctgctgcagtcggtggccgccacgctggccgacgcggccgagctcgcggcgcggtgccgggagccgccggcggacgggaagctgagggcgcagagcgccgtcgacgcgctctccgggaggctcgacctcggcctccgggactgcgcgctgctcgtcaagaccggcgtcctgtcggacgccgccggcccgtcaccgccgccggaggaggcgcccgacgtccgggagctgctcgcgcggctgcagatcgggcacgccgaggccaggggccgggccgtggacgcgctgctggacgcgctgcgcagggacgagcggggcgtgctggcggcgctcggccgcgccagcgtcgccgcgctggtgcagctgctcacggcgtcggcgcccgcggtccgggagaaggccgccacggccgtgtgccaggtcgcggggtcgggcgccgcctccgaggcgctgctcgtgtcggagggcgtcctgccgccgctcgtcaggctggcggagtccggcagcgccgtggggcgcgagaaggccgcggccacgctgcaccgcctgtccgcgtcgcccgacgtcgcgcgcgcggtcgtcgggcacggcggcgccggcccgctcgtcgagatctgccggacgggggactccgtctcccagcccgccgcggccggcgcgctcaggaacctctcggcggtgccggaggtgcgccaggcactggccgacgaaggagtcgtccgcgtcatggtcggcctgctggaccgcggcgccgtggtggcgggcgccaccaaggagcacgccgccgagtgcctgcagaacctcacgtccggcagcgacggcctgcgccgcgccgtcgtgtcggagggtgggctgcgcagcctgctgctctacctggacggcccggtgccgaaggagccggcggtgggcgcgctccggaacctcgtgggcgctgtctcgcccgacagcctcgtggcgctcggcgtgcttcctcggctggtccacgtgctcaaaatagggtcggttggcgcgcagcaggcggcggcggcggcagtctgccggatctccagctccgccgagatgaagcgcgccgtcggcgagcacggctgcgtagcgctgctggtgcgcatgctggaggccaagtcgaacggcgcgcgcgaggtggccgcgcaggcgctggcggccctggcgagctgccctgccaacgcccgagagatgaagaaggacgacaagtgcgtgcccagcctggtgcagctgctggacccgagccctgcgaacacggctaagaagtacgccatcgcctgcctcctcacgctctcggggaccaaacgatgcaggaaggtcatggtctcgcacggcgccatcggttacctgaagaagctctccgacatggacgtggccggcgccaagaagctgcacgagaggctggagcgcggcagtctacgcagcatgttcagtagatagtagcagctgttactattttattgccttgcgaaagtttcacctctactgtatagaaaccaaactcagtctcacactctgtatgaaatgaaatgaaaatgtctgttcaggaactaataagcctagtaagtgtatcttcaactagcaagatcagccgtccagatttgtgcaacttgatttgttacggacgtcaagatcacatctggtgagagttttccttcagaaatgcactcagctccatatgtcaatgctcacatctgtggctgaatgaaattggaacatcctttttaccatccagatagacaatgttccaacgaaaaaactattccaaatttagaaatgcgtga

SEQ ID NO: 2208 - DNA, 4196 bp, Sorghum bicolor
attgagtcctaaatactcaacgcacgcggcgcgaaccttatctcgtcccgtcgctccccgcctacgcagctctctttctctcggcttcaaccaggggacctatgccctgctccctgctctgcacgccggcgccctgcagctccccctcctcttcctcccagaacacagtcgcccctcccctcttttcctctccctgctgcgccaggaagggcgagccgccgccgccccagtcgggcaggctggccgccgagctgccgccctggccgggcaggcaggccggcgccgccgcgccgcggccggccagctggctggcgccactgccgctaggtcgggcgagctggctgcaggccgctgctgccacgcctgggtcgagtccctgcgctgcgcaccgctgccctggccaaccacagcagcagcgccacgccacgctcgtctcgtgccgggataggcctggacacgggcctgatcggcgttgtcctcgtccgctctgcgtcatccggtcagatgatttagccataacctgtaaaggattctgtacaatatcatggaacctgaaagcagatgtacaagatgggtgcttaatattcataacaggagacccagttaccctgggctgctgggaatccaacatggctgttcagttggctccttctgttgaaagcaataatatatggacagctgaaataaaggtaccatatggagtgcatttcaaatataattattttgttcgagaagaaatgggttcctcttctgatattatatggaggccaggtccggtatactccttatcaataccttcagttggccagaaaaagcaggtcattgttgtgaaggacctatggatgaaagccagtctagcaggtcttcctactccttcatggggatcatggctgatggaagctggttctcttgagggtgaactttttgatggtggaaataatcagagcattgtgaaagatcactctgccagggatacatcaaaccaaggtttatctgtaggtgatcatattatattcaagcttgggaatggcacacctttacatgcaaaactgttggataatcaatctagcatcatgcacaactctgtaactgaaataccaaatgccagttatataagtcaacatggaaggtctcaaatcgtagaggagccatggattcttgaatcaattgtggctgcaaagaaaccagttgcaaaagtcaaagataagaaagggcaaaagaagtttgtaaattataagcacactttgagtggagttagtaaaaacatgcatcaacaggatcagcctgttgaagagccatggttatttcaatctatgtttgaactaaatgaaactatagtccatgctaatggaaaaacagaagcaagggatattatcggaaaattaaggaaaatagaaaaacctccaacacctttggatgagagtaagccgagtggtggtgaaccttcatcaagagttatacttatgaactcctctgtctgcactattcagagaattgcagtattagaagatggaaaactagttgaactcttgctggaacccatcaagaacaatgtacagtgtgatagtatttatttaggtgtagtaacaaagctcgttcctcatatgggaggagcatttgtagatattggaatttcaaggccttcacttatgagcataaagcaaaaccgagatccttttgtgtatcctcaagtttttaagaaccgaggaacagatcctattgatgattcttattgtaatgaagagaaccttccaacttatgaaaacgatgatgatatgagtgatgacgagtttgcaaatgaagaaactcatgatggttcatcatttccagttgagaatattacagataatgaagaagctgtggtgctagcatctgatgctaagataaacaatgtcgatggtgatgaatttgacagcatttctgtttatgacgaagacaaggatgaagaaaatgatcacatggaagatgaatatagtgaggacatactgcaaggagatcaatcagaaatttccaatgatcttaagactttatcttcaattcaacatgctttaagagaatctaatgatgacacaaatggaagcaggtggtctcaagttcgtaagggcacaaaagttatggttcaagttgtcaaggaaggattgggtacgaaaggtccaacacttagtccatttccatgcctgcgaagtcgattttggatattggtttcccgtggcaacaaagttggggtatccaaaaagattaccggaatagagcgcaccaggttaaagggcatcacgaaattactgcgacctcctggatttactttgacagctcgtacagttgcagctggtcattcctgggaggaactgcagaaggaccttgatggcttgctatctacctggaaaggaataactgagcatgctcaatctgctgccttggctgctgaggagggtgtggaaggtgctgttcctgtaatgttgcacagagcaaagggtcaaactttatctgttgttcaagatgattttaatgaaaaggtcaagagactggttgtggattctcctcgaacatatcatgaggttacaagctatcttcaagaagttgcacctgagctctgcagccgagttgagctttatgagaaaagaaaacctatatttgatgtatataacatcgagaaggagatagacagcatcctttgcaaaagggtaccactatgcaatgggggttctctggtcatagaacagactgaagctctggtgtcaatcgatgtgaatggtggtcacagtatgtttggtcagggaacatcacaggagaaggctattttagaagtcaatcttgaagctgcaaagcaaattgcccgtgagctgcgcttgagggatattggtggcattataattgtggattttatcgatatgtcagatgattcaaacaaaaggctagtatatgaagaaatgaagaaagcagtagaaaaggatcgatcgacagttggtgtttcagaactatcaaagctaggtttgatggaaataactagaaaaagggtccgaccaagtgttactttcatgatcagtgagccatgtacatgctgccatggtactggtcgtgtggaagctcttgacacatccttttcaaagatcgaacgtgaaatatgtcgacgtcttgctacctcacgacgaaaatcagaccctgagaaaccaaaatcatggccaagatttgtgcttagagtggatcatgagatgtgcacgtatttgacgtcaggaaagaagacaaaactaggactcctgagtagctcccttaaagtgtggattttgttgaagattgccagaggtttctcccgtggtgcttttgaactactaccatactcagagaaagaaaattgtgcagagaaagaaacgtcatcagaattgccccagaaagaggggaggcccaagctatctgtttttcctatcaagaagtggatgagccgggcaaagcgtgctaagtgattctctttcaaaagcgtcaattttattagcatggggtcttccttgctattcacagcttagaacgagcaaagattcaggaagagggtcatgcttttcattcacggagatcccagcgtcggatatctagatatctcccgactagcttttgtttacagtattcttaagtttgtgatgcaaaatacctaggatttaggatggaagaaagagtagaaaacattttaggaaggaaactagacagatttatgtaggacgctgtcagggtagatgttgctcttatgctttagagcagttgaacttgggagaccgagtaattccagtgatttttttaattcgtttttgagaccctatattcaaattttgtgagcatgttcgcttgtctgaaaagtcatagctctgatttgttgtgagagaaaaatactgctgaacgactgactgatttggcaaataagttaaagcaaacatgcctcaataatttgttttttgctagatttcttttgatctgcgacaaattcgttccgacactgaaaggcttgcggtcttaaaagagtacctctgttgagagcagataacgtatacgccatttaccaatttcaaatcatttagggactagactaatttaggcatacgctcgaattcttgattatttatggaactgatattgggaaatggcttgttgatttcaattttgttttggacatgtttttagaagtttttgtgagagccggaatacacctgaac

SEQ ID NO: 2209 - DNA, 1128 bp, Pennisetum glaucum
cacgctgctcgtgctcgccgcctgctcctcgcgatcgtctccggggggcgccggctcaccgtcgctccgtcttcgtgtccccgctgctcttcccccgtgagcttaaagttcttgaggatgtcggaacgttctgagagtgcaactgaaaagattatgagcagtataatcgataccatcgctgacaatcttcctaagcagaagtctgggcaattcgatccaggttcggtctcagacaaggtgaagaacaagctctttggtcgtcagaagaccctgcatggagctctgggtggtggaaaacctgctgatgtgctgttatggaggaacaagaagatatcatcaagcgttctggctgttgcaacagctatttgggttttctttgagtggcttgattaccacttcctgacaatcatttcgtttgcccttgttcttggaatggtcggccagtttgtctggtccaatttctcaaacatgctaaacggatctccttctaaagtgccccgagttgagttgcctgatgagctgtttgtgaacattgctgttgcaatcggtgcccaagtgaacaagttcctgaacttccttcaagatgtgtcttgtgaaagaaacttgaagcattttgtagtggcgatcgctggactgtgggctgctgcagtgattggaagctggtgcaatttcctgacagttatatatatcggatttgtttgtgctcacacacttccagtgctctacgagaagtatgaagatcaagtggatgatttcctctacaaccttctcggtctgctgcgagatcagtaccagaaactcgaccaaggtgtcttgagcaaaatacccaaagggaacctgaaggctaagaagaatgagtagttcagcagctggatgtcaagaatgaatgggtgatgtgccgttttgtgtgttgcagttttgtatcaattgttacttgaacgctgggtgtggctttctgaacatgggcgctagttcactgcccactgccaccagatttagacttctaagctgcaatgcatgtggtctactattcgcataatgcgagtcgtttagttgattacattccttcctgctcctattgtacttgtgagatattggctaattggcatactgctcaagtaatgaagt

SEQ ID NO: 2210 - DNA, 1107 bp, Zea mays
ctcctccaaaccggccaagccaccaaccagcgccccccaccgccgcctttttatttcatccacgctgctcgtgctcgctgcctgcttctcgcgcgatcgtctcggcctctcgggactctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaacaagctgtttggtcgtcagaagaccttgcatggagttctgggtggtggaaaacctgctgatgtgctgttatggaggaacaaaaagatatcatcgagtgttctggctcttgcaacagctatttgggttttctttgagtggctcgactaccactttctgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaagtaaacaagttcctgtgcttccttcaggatgtttcttgtgaaagaaacttgaagcattttgtagtggcgatcgcaggactgtgggctgctgcggtgattggaagttggtgcaatttcctgactgtcatatatgtcgggtttgtttgtgttcacacgcttccggtgctctatgagaagtacgaagaccaagtggacgatttcctctacagccttcttggtctgctgcgagatcaatatcagaagctcgaccaaggcgtcttgagcaagattcccaaggggaacatgaaggctaagaagaacgagtagtttagcagatggtttctcgtgaatgagatcaatatcgttttgacttgtgtcgattattaatttattacctaaggcgtgtgtgccattctgaacctggctgctagttcatcgcccaccggggttttaaactactaagctgcaatgcacaagtaatgaagtgtgctagttcattgcccacaggtgtacta

SEQ ID NO: 2211 - DNA, 1130 bp, Saccharum officinarum
agctgagaatcaattgctagtacgatctcttctctccccaaagcggccaagccaccaaccaaccctctttctcgcgatcgtctcgggactccagagtgccggctctccgcctgttcgtgtcgtcgctgctcctttccccgtgagcttaaaatatatacaggatgtcggaaagttctgagagtgcaactgaaaagattatgagcagcatcatggatacaattgctgacaaccttcctaagcagaagtccgggcactttgacccaggttcagtctctgacaaagtgaagaacaagctgtttggtcgtcagaagaccttgcacggagttctgggtggtggaaaatctgctgatgtgctattatggaggaacaagaagatatcatcgagtgttctggctcttgcaacagctatttgggttttcttcgagtggcttgactaccactttctgacaattgtttcgtttgcccttgttcttggaatggttatccagtttgtctggtccaacttctcaaacatgctaagcggatccccttctcaggtgccccgagttgaattgcctgatgagttatttgtgaacattgctgttgcaatcggtgcccaagtaaacaagttcctgtgcttccttcaggatgtgtcttgtgaaagaaacttgaagcattttgtagtggcgattgccggactgtgggctgctgcagtgattggaagttggtgcaatttcctgacagtcatatatatcgggtttgtttgtgttcacacacttcctgtgctctatgagaagtacgaagaccaagtcgatgatttcctctacaacctgcttggtctgctgcgagatcagtatcagaagcttgaccaaggcgtcttgagcaagattcccaaggggaacatgaaggctaagaagaacgaatagtttagcagctggtttctcatgaatgaatgggttggtgaactgatgttgtgccctcttgtgcatcgcagacttgcgtcaattgttacttaagctgtgtgccattctgaacatgggtgttagttcattgcccacaggatttaaactattaagctgcaatgcatgttgtccactattcaagtccttggactcgtttaaattgctgatccgattacttgtgggatattg

SEQ ID NO: 2212 - DNA, 1204 bp, Sorghum bicolor
ctccccaagtggccaaagccaccaaccacgaccagcccctttttctcttctatttcatccacgctgctcgtgctcggctgctcgctgcctgcttctagcgatcgtctcgggactccagagtgccggccggctctccgcctgttcgtatcgtcgctgctcctttccccgtgagtttaaaatatacacagtacaggatgtcggaacgttctgagagtgcaactgaaaagattatgagcagcatcatggataccattgctgacaaccttcctaagcagaagtctgggcactttgacccaggttcagtctctgacaaagtgaagaacaagctgtttggtcgtcagaagaccttacatggagttctgggtggtggaaaacctgctgatgtgctgttatggaggaacaagaagatatcatcgagtgttctggctcttgcaacagctatttgggttttctttgagtggcttgactaccactttctgacaattgtttcgtttgcccttgttcttggaatggttgtccagtttatctggtccaacttctcaaacatgctaagcggatctccttctcaggtgccccgagttgaattgcctgaagagttatttgtgaacattgccattgcaatcggtgcccaagtaaacaagttcatgtgcttccttcaggatgtgtcttgtgaaagaaacttgaagcattttgtagtggcgattgccggactgtgggccgctgcagtgattggaagttggtgcaatttcctgacagtcatatatattgggtttgtttgtgttcacacacttcctgtgctctatgagaagtatgaagaccaagtcgatgatttcctctacaaccttcttggtctgctgcgagatcagtatcagaagcttgaccaaggcgtcttgagcaagattccgaaggggaacatgaaggctaagaagaacgagtagtttagcagctggtttctctgaatgaatgaatgggttggtgaactgatgttgcgccctcttgtgcatcgcagacttgcgccaattgttgcttaagctgtgtcccattctgaacatgggtgttagttcattgcccactgggtttaaaaactattaagctgcaatgaatgttgtccactattgaagttcttcgactcaattcacatttctgatctgatcacttatgggatattgacacactgctcaagtaatgaagtgtgcccataacc

SEQ ID NO: 2213 - DNA, 1595 bp, Panicum virgatum
aagacggaaaatctctcagacggaccacgcttccctcgggctctataccagcacttgatttgcccggagccccggacaaaccattcaggtgacgttggcctccccttactagcgggccccgccacgaccatccttccctccaggcccacctgtaagcggacacgccgcaaattcggcagcgtgcgcgtagcaactagcaaggcccctcctgtggggtccgccgaggcttttgcctcacgtacagcagcgcaacggccacttctccgttgggaactccaagagtggagtccgggatggtcccacaagccagtgacccgctcgtcagaatcacatgacccgccgctccccctcgccgaatcgagaatccaatattcaattgctagctgtacgatttcttcttcccccaggccaccaaaaccagcctttccctttccattgcacgctgctcgtgctcgccgcctgctcctcgcgatcgtctctgggggcgccgccggctcaccggcgcttcgtctccgtgccccggctgctctttcccggcgagcttaaaatctattgaggatgtcggaacgttctgggagtgcaaccgaaaagattatgagcagcatcattgatagcattgctgacaaccttcctaagcagaagtctgggcaattcgatccaggtgcagtctctgaaaaggtgaagaataagctgtttggtcgtcagaagaccctgcatggagttctgggtggtggaaaacctgctgatgtgcttttatggaggaacaagaagatatcatcaagcgttctggctcttgcaacagctatttgggttttcttcgagtggcttgattaccacttcctgacaatcgtttcgtttgcccttgttcttggaatggttgtccagtttgtttggtccaatttctctaacatgctaagcggatctccttctcaagtgccccgagttgagttgcctgatgagatgtttgtgaacattgctgttgcaatcggtgcccaagtaaacaaattcttgagtttccttcaagatgtgtcttgtgaaagaaacttgaagcattttctagtgtcgattgctggactgtgggctgctgctgtgattggaagctggtgcaatttcctgacagttatatatattggatttgtttgtgctcacacgcttcctgtgctctacgaaaagtatgaagaccaaattgatgatttcctctacaacctcctcggtctgctgcgagatcagtatcagaagctcgaccaaggtgtcttgagcaagatacccaaagggaacatgaaggctaagaagaatgagtagtttagctgctggattctcatgaatgagtgggttggtgaactattgttgtgtcgacttgtgcatcgcagactcgtgtcaattgttacttgaaagctgtgtgtgccttgctgaatatgggtgcttgttcattgcccagcaccactgggattaaacttcatgcaatgcatgtcatctactatattcgtgttcttcaactcatttacattcatgctcctatgacttgtgggatattggcatactgcttatgtaatgaggtgtgcccatgatccatttttaaaaagtggaaagttgcc

SEQ ID NO: 2214 - DNA, 753 bp, Panicum virgatum
tttccagcgagcttaaaatatattgaggatgtcggaacgctctgggagtgcaactgaaaagattatgagcagcatcattgatagcattgctgacaaccttcctaagcagaagtctgggcaattcgatccaggtgcagtctctgaaaaggtgaagaacaagttgtttggtcgtcagaagaccctgcatggagttctgggtggtggaaaatctgctgatgtgctgttatggaggaacaagaagatatcatcaagcgttctggctcttgcaacagctatttgggttttcttcgagtggcttgattaccacttcctgacaatcgtttctttgcccttgttcttggaatgtttgtccagtttgtttggtccaatttctcaaacatgctaagcggatctccttctcaagtgccccgagttgagttgcctgatgacctgtttgtgaacatcgctgttgcaatgggtgcccaagtaaacaagttcttgagcttccttcaatatgtttcttgtgaaagaaacttgaagcattttctagtggcaatcgctggactgtgggctgctgcagtgattggaagctggtgcaatttcctgacagttatatatattggatttgtttgtgctcacacgcttcctgtgctctacgagaagtatgaagaccaaatcgattatttcctgtacagccttctcggcctactgtgtgatcaatatcagaagctcgaccaaggtgtcttgagcaagatacccaaagggaacatgaag

SEQ ID NO: 2215 - DNA, 1149 bp, Oryza sativa
gctactagtccccttgaagaacacttccccatctactactactactactcctactttgaatacctgctcttgctcttcgcctcgttcgtctccaagaagctcgagagccgagggcttctccgtctcttcgttcatctgctgctgtgtctcccctggtgaggtacgacaagatgttggaacattcggagagtgcaacagaaaaaattatgagcagcatcatggataccattgctgagaaccttcctaagcagaaatctgggaaatttgacgtaggcgctgcctctgacaaaatgaaggagaagctgtttggtcgtcagaagaccattcatcgagttctgggtggtggaaagcctgctgatgtgttgctatggaggaacaagaagatatcctccagtgtcctggctcttgcaacagcaatttgggtattctttgagtggctcgactaccacttcctaacaattgtttcatttgcccttgtccttggaatggttgtccagttcgtgtggtccaatttctcaagtgctctaagcggatctccttctaaagtaccccgtgttgagctgccagaagagctgtttgtgaacattgcagttgcagttggtacccaagtaaataagttcttgagttttcttcaggatgtgtcttgtgaaagaaacctgaagcactttgtactggcaatcgttggactgtgggctgcggctgttattgggggctggtgcaatttcttaactgtcatttacattggatttgttagcgctcacacgctgcccgtgctctacgagaagtatgaagatcaagttgatgatttcctatacaatattcttggcctcctgcgtgaccagtatcagaaacttgatcaaggtgtcttgagcaagataccgaaggggaacatgaagttcaagaagagcgagtagattgtctgggttttaagaactgaaatcatagattagctgggttttcatcagtggaatgaatcaagaatttgtaccatgctcagttgcgtattgcagacattggttgtcagttgtcatctgagagctgtgtgctttcctgaatggggcgctcatttgctgcaatctgaattaatatttcaactgctctgccctgcatttcttctgttatgtagtgttattcaagtggctcaattaa

SEQ ID NO: 2216 - DNA, 856 bp, Echinochloa colona
gccatcttaattagctagtgtatggaatatttggcgtacgtcacggcctcacgggccaccatataccgacatcatctctgtttgtctgtactgcacttgtctttgttgtcagtttgcagcatcatggataccattgctgacaaccttcctaagcagaagtctgggcacttcgatccaagttcagtctctgacaaagtgaagaacaagctgtttggtcgccagaaaaccctgcatggagttctgggtggtggaaaacctgctgatgtgctgttatggaggaacaagaagatatcatcgagtgttatggctcttgcaacagctatttgggttttcttcgagtggcttgactaccactttctgacaattgtttcatttgcccttgttcttggaatggttgtccagtttgtttggtccaacttctcaaacatgctaagcggatctccttctcaagtgcccagagttgagttgcctgatgagctatttgtgaacattgctgttgcaatcggtgcccaagtaaacaagttcctgagcttccttcaagatgtgtcttgtgaaagaaacttgaagcattttgtagtggcgatcgccggactgtgggctgctgcggtgatcggaagctggtgcaatttcctgacagttatatatattggatttgtttgtgctcacacgcttcctgtgctctacgagaagtatgaagaccaagtcgatgatttcctgtacaaccttcttggtctgctgcgagatcaatatcagaagctcgaccaaggtgtcttgagcaagatacccaaagggaacatgaaggctaagaagaacgagtagtttagctgctggaatctcatgaatgactggggttggt

SEQ ID NO: 2217 - DNA, 1162 bp, Brachypodium distachyon
aaagccaccagcatttcttccaactgctcctcttgctcccccgctcgctctcgccgcctgctgatcctctcctcttcgggaggaccccgagcagcctccctccccgtccatctgctgctcgccccctcgtaacctcaaaatacttgaagatgtcagaacattctgagaatgtaactgaaaagatcatgggcagcatcatggataccattgctgacaacctccctaagcagaagtctgggcgttttgatccagctgcagtctctgataaagtgaacaagctgtttggtcgccagcagtcccttcatggagttttgggtggtggaaagtctgctgatgtattgctttggaggaacaagaagatatcttccagtgttttggctctcgcaacagctatttggattttcttcgagtggcttgattaccacttcttgacaatcatttcatttgcccttgttcttggaatggttgttcagtttgtttggtcgaacttcgcaagcagatcttctaatgtaccccgtgtcgagttaccgaaagagctctttgtgaacattgctgttgcggttggtgcccaagtaaacaagttcctgggtttccttcaagatgtgtcttgtgaaagaaacttgaagcattttgtactggcaattgtcggtttgtgggctgctgctgtagctgggagctggttcaatttcttaactgtcatttatattggatttgtctgcgctcatacccttcctgtgctgtacgagaagtacgaagaccaagtcgacagcttcctctacagccttcttgatctgctccgagatcagtacaagaaactcgacagcggtgtcttgagcaggatacccaaggggaacatgaagttcaagaagagcgagtagactagatgggcactcatgattacggagtgaaacccccgtatgtattattctgcttagtcgtgtgccagacctgtagtgtcaattgctgtttgagagctgtgtggtgtgcttcctggaccaggacaccggtttatcaccccaccagtttagattcaactgcaatgcattttcttctgttattctggatgctcctccacaaattagtgagaccataagttgtatccagaagttggatgttgagctgaaattcattgtgctgttccccaaacaaaatgttttcccca

SEQ ID NO: 2218 - DNA, 1169 bp, Brachypodium distachyon
cccaaagccaccagcatttcttccaactgctcctcttgctcccccgctcgctctcgccgcctgctgatcctctcctcttcgggaggaccccgagcagcctccctccccgtccatctgctgctcgccccctcgtaacctcaaaatacttgaagatgtcagaacattctgagaatgtaactgaaaagatcatgggcagcatcatggataccattgctgacaacctccctaagcagaagtctgggcgttttgatccagctgcagtctctgataaagtgaacaagctgtttggtcgccagcagtcccttcatggagttttgggtggtggaaagtctgctgatgtattgctttggaggaacaagaagatatcttccagtgttttggctctcgcaacagctatttggattttcttcgagtggcttgattaccacttcttgacaatcatttcatttgcccttgttcttggaatggttgttcagtttgtttggtcgaacttcgcaagcagatcttctaatgtaccccgtgtcgagttaccgaaagagctctttgtgaacattgctgttgcggttggtgcccaagtaaacaagttcctgggtttccttcaagatgtgtcttgtgaaagaaacttgaagcattttgtactggcaattgtcggtttgtgggctgctgctgtagctgggagctggttcaatttcttaactgtcatttatattggatttgtctgcgctcatacccttcctgtgctgtacgagaagtacgaagaccaagtcgacagcttcctctacagccttcttgatctgctccgagatcagtacaagaaactcgacagcggtgtcttgagcaggatacccaaggggaacatgaagttcaagaagagcgagtagactagatgggcactcatgattacggagtgaaacccccgtatgtattattctgcttagtcgtgtgccagacctgtagtgtcaattgctgtttgagagctgtgtggtgtgcttcctggaccaggacaccggtttatcaccccaccagtttagattcaactgcaatgcattttcttctgttattctggatgctcctccacaaattagtgagaccataagttgtatccagaagttggatgttgagctgaaattcattgtgctgttccccaaacaaaatgttttccccatgtg

SEQ ID NO: 2219 - DNA, 1807 bp, Cenchrus ciliaris
ttctcctcaacccaccggcgcggcggcagcaccgacaccgctgcgccatggccgcctcccaccaccacggcggccacctcgtcctcctcgccctctccctcgccgcggccctctacgccgccgacgcctcctcccacaacatcacggccgtcctcgacggccggtcggagtacacgctgtacaacagctacctctccgagaccaaggtgtgcgacgagatcaacagcgagcacacggtgaccgtcctcgtcctcaacaacggcgccatgtcctcgctcgtcgccaacctctccctcgccgacatcaagaacgcgctccgcctcctcaccctcctcgactacttcgacgagaagaagctgcactccctcgactccggctccgagctcaccacctcgctctaccagaagaacggccaggccgccggcaacatgggccacgtcaacatcaccgacctccgcggcggcaaggtcggaatcgcccccgccacgcccggcgcaaagttccagtccacctacaccaagcgcgtcgacgaagaaccctccaccctctccgtcctcgaggtctccgaccccatcaccttcccgggcctcttcggctccccgtcggcctcctcggtcaacctcacggacctcctcgagaaggccggctgcaagcagttcgcgcgcctcatcgtgtcgtccggggtgctcaagatgtaccaggccgccatggacaaggggctcacgctgctcgcgcccaacgacgacgccttcaaggccaaggacctgcccgatctgagcaagctctccagcgccgacctcgtcacgctgctgcagtaccacgcgctgccgcagtacgcgcccaagtcgtcactcaaggtcgccaagggccacattccgaccctggcctccagcggcgcgggcaagtacgacctctccgtcgtctccagcggcgacgacgtgtcgctggacaccggcaaggacaggtcccgcgtcgcgtccaccgtcctcgacgacaccccgacggtcatcctcacggtggacaaggtgctggtcctgcccgggctattcggcggcgcgccgtccccggcgccagcgcccggaccggccgccgacgtgcccgcttcggccccggctcccgaaacctccgcgccctcgccctctcccaagggcgccggcaagaagaagaagaagaaggccaagtccccttcgcactccccgcccgcgcccccgtcggactcgcccgacatggcccccgccgacgctcctgagggcgacgcggccgacaaggtcgagtcgaagaagaacggcgccgcggcagcggccgcgagcttcgcggccacggtggcctgtgtcgccctggccgtcgcggccttcttgtgagcgggcgagcggcaggtgctcgacgccgagcccgccgtagttctctctctgcgcatgcgtgatccgacgcggtgcaatctgttgctgctcgtgagttctcgtgggctccattgataatttgatatgctcatctcatctggtgtctcttctccttctggattgctgggtggtaggtagcagggattaggatttggtcctccacttttctggtggacggtgattgtgatgcccgttttgctagtgctagtctgctagagctcggaactctcatttcaggttgatgtgttgttactgtcttgtgctccttccacaggttccacctgcattccgtctgcatttcacatgatcaccattcacacccagaagtttccctttgcttcttgcaattccttgtgattctttgatctgtagccgtactaattagtggcaagtgctttccggtggct

SEQ ID NO: 2220 - DNA, 1832 bp, Panicum virgatum
cggagcctcgtccttatcccccacgctgcccatccttctccggtttctccccttctcctcaacccggacctcccctcaacccagcagcagccgccccgcaacgcgcggcgccatggccgccgccccccaccaccaccgcggccacctcgtcctcgccgtcctctcccttgccgcggcattcgccgccgccgtcgactcctcctcccacaacatcacggcggtcctcgacggccggtcggagtacacgctgtacaacagctacctctccgagaccaaggtgtgcgacgagatcaacagcgagcacacggtcaccgtcctcgtcctcaccaacggcgccatgtcctcgctcgtcgccaacctctccctcgccgaaatcaagaacgcgctccgcatgctcaccctcctcgactacttcgacgagaagaagctgcactccctcgactccggctccgagctcaccacctcgctctaccagaagaccggccaggccgccggcaacatgggccacgtcaacatcaccgacctccgcggtggcaaggtcggcttcgcctccgccgcgcccggcgccaagttccagtccacctacaccaagcgcgtcgacacggagccgtccaccctctccgtcctcgaggtctccgaccccatcaccttcccgggcctcttcggctccccgtcggcctcctccgtcaacctcacggacatcctcgacaaggccggctgcaagcagttcgcgcgcctcatcgtgtcgtccggggtcgtcaagatgtaccaggccgccatggacaaggcgctcacgctgctcgcgcccaacgacgacgccttcaaggccaagggcctgcccgatctgagcaagctctccagcgccgacctcgtcacgctgctgcagtaccacgcgctgccgcagtacgcgcccaaggcgtcgctcaaggtcgccaagggcgacatcccgaccctggcctctaccggcgcggggaaatacggcctctccgtcgtctccagcggcgacgacgtgtcgctggacaccggcttgggcaagtcccgcgtcgcgtctaccgtgctggacgacaccccgacggtcatcctcacggtggacaaattgctgctcccgtccgagctattcggcggcgcaccgtcccccgcgccggcgcccggaccggccgccgacgtgcccgcttcggccccggctcccgaaacatctgcgcccgcgccctctcccaaggccgccgccaagaagaagaaggccaagtccccttcgcattccccgcccgcgcccccggcggactcgcccgacctggcccccgccgacgcgccggagggtgacgccgaggataaggccgactcgaagaagaacggcgccgccgcagcggccgtgagcttggcggctacggtggcctgcatcgccctggccgtcgcggccttcttgtgagcgggcgagcggcaggtgttcgacgccgagcccggcgtagttgatctctctctgagcgcgtgctctgacgcaatgcaatctgttgttgctcgtgagttctcgtgggctccattgataatttgatatgctcatcaggtgtttctccttgttcctggtttgctggttggtaggtagttgaagtaagaattattaggatttgggtcgtccacttctcaggtggagacgaagagctcggaactgtcatttgagggtgatttgttcttcctagtactgtttggtgcttcttccagctgcattccactagctatttcacacgatcatatcctgtagtttcctgtagctactcggcgattactgtcgtgggctcgtggcaggggatgagattgatctggctaatttttgttag

SEQ ID NO: 2221 - DNA, 2098 bp, Sorghum bicolor
ccccgaaccttaacccatggtcaaaacccaacccaacccggcaacccccaacggcccaacccacccaaccccaaatagcactccaatacgcaaaacccacgcgccggccacgcagcataaacgccgcctaaacccctcgtcggttccccgtactcattccccccacgccacgctcgcgttcctcccgtgtggcctgtgtggctgtgtggccctgtcccctcctctcccaagcagcagcaccgcccgccaccaccgcgccatggccgcctcccaccacctaatcctcctagtcctctgcctcaccgccgccgcggcctccgcccacaacatcacggccatcctggacgggcgctccgagtacacgctgtacaacagctacctctcccagaccaaggtgtgcgacgagatcaacagccggagctcggtcaccgtcctcgtcctcaccaacggcgccatgtcctccctcgtcgccaacctctccctcgccgacatcaagaacgcgctccgcctcctcaccctcctcgactacttcgacgagaagaagctccactccatcggctccagctcccagctcaccacctcgctctaccagaccacgggccaggccgcaggcgacatgggccacgtcaacatcaccgacctccgcggcggcaaggtcgccttcgcctccgccgcgccaggcgccaagttccagtccacctacaccaagcgcgtcgccgacttcccgtccaacctctccgtcctcgaggtctccgaccccatcaccttccctggcctcttcggctccccgtccgcctcgtccgccaacatcaccgacctcctcgagaaggccgggtgcaagcagttcgcgcgcctcatcgtctcgtccggggtcgtcaagacgtaccaggccgccatggacaaggggctcaccctgttcgcgcccaacgacgacgcgttcaaggctaaggacctgcccgatctgagcaagctcaccagcgccgacctcgtcgcgctactgcagtaccacgcgctgccgcagtacgcgcccaaggcgtcgctcaaggtcgccagcggccgcatcccgaccctcgcctctaccggcgcggggaagtacgacctcaccgtcgcctccagcggcgacgaagtgtccctggacaccggcgtggacaagtcccgcgtcgcgtccaccgtgctcgacgaccccccgacggtcatcctcacggtcgacagcgtgctgctcccgcacgtgatcttcggcggcgcgccgtcccccgcgccggcgcccggaccggccgccgacgtgcccgcttcggccccggctcccgaaggctccgcaccggcgcccactcccaaggccgccggcaagaagaagaagaagaaggccaagtccccttcgcactccccgcccgcgccgccggcggactcgcccgacttggcccccgccgacgcgccagacgatgacgccgcggacaaggtcgaatctaaaaagaacggcgccgccgcagcggccgtgagcttcgtggcctcggtggcctctgccggcctggccgtcgcgctccttttgtgagcgagcggcaggcgtgttcgacgccgagcctcctccccgtagttttctctccaagaatctgcgcgtgcatgttgtgacgcggcgaaatctgttgttgctcgtgagtttctcgtgggctccattgatgatttgataatgctcatcaggtgtttcttaattcctcctggttggttagttaaggtttgttggaggaattctaggatttggtcctccagtcctctggtggagacggtgattgtgatgactgttttggtagtgttagagcccgaaagtgtcattcgatgttgatctgttgttgttcttcttgctgtgctgtgcttttcctctttgtgcatcctacctatccgtgactgcatttcacatgatcacatccggtagttttctgaatcttttttccgaggagttttctgaaacttcatgcaaatgctttgattctttcaacgttggccgtatcattcgttgtgccaatcgaactagggatccagtacgtagggactatagtgaagaaggcactcgaaacatgtgaatggtaaattaaactgattatgg

SEQ ID NO: 2222 - DNA, 2042 bp, Zea mays
ccacggtcacgcataaacaccgcttaaacccctcgtcggttccccgtactcattccccacgctcgccttccttcctctcgcgtgtgcgccgtgttcccctccttaccccagaccccagcagcgggccgcggcactgcccgccaccacagcgccatggccgcctcccaccgcctaatcctgctagtcctctgcctcaccgccaccgcggcgtccgcccacaacatcacggccatcctggacgggcgctccgagtacacgctgtacaacagctacctctcggagaccaaggtgtgcgacgagatcaatagccggagctcggtcaccgtcctcgtcctcaccaacggcgccatgtcctccctcgtcgccaacctctccctcgccgacatcaagaacgcactccgcctcctcaccctcctcgactacttcgacgagaagaagctgcactccatcggctccagctctcagctcaccacctcgctctaccagaccaccggccaggccgcgggcgacatgggccacgtcaacatcaccgacctacgcggaggcaaggtcgccttcgcgtccgccgcgcccggcgccaagttccagtccacctacaccaagcgcgtcgccgacttcccgtccaacctctccgtcctcgaggtatccgaccccatcaccttccccggcctcttcggcgccccgtcggcgtcgtccgccaacatcacggacctcctcgagaaggccgggtgcaagcagttcgcgcgcctcatcgtgtcgtccggggtggtcaagacgtaccaggccgccatggacaaggcgctcaccctgttcgcgcccaacgacgacgcgttcaaggccaaggacctgcccgatctgagcaagctcaccagcgccgacctcgtcgcgctgttgcagtaccacgcgctgccgcagtacgcgcccaaggcgtcgctcaaggtcgccagcggccgcatcccgaccctcgcctccaccgccgcggggaagtacgacctcgccgtcgcctccagcggcgacgaagtgacgctggacaccggcgtggacaagtcccgcatcgcgtccaccgtgctcgacgacccccccacggtcatcctcacggtcgacagcgtgctgctcccgcacgtgctctttggcggcgcgccgtccccggcgccggcgcccggaccggccgccgacgtgcccgcgtcggccccggctcccgaaggctccgcaccggcgcccgcccccaaggccgccggcaagaggaagaagaagaaggccaggtccccttcgcactccccgcccgcgcccccggcggactcgcccgacatggcccccgccgacgcgccaacggaggacgccgcggacaaggtcgaatctaaaaagaacggcggcgccgcagcggccgtgagcttcgcggcctcggtggcctctgtcgcccttgccgtcgcgtaccttttgtgagcgagagcggcaggcggtcgacgccgagcccccgtagctctctcctagactctgcgcgtgcggcgtgcatgtcgtgacgcgatgaaatctgttgttgttactcgtaagttctcgtgggctccgttgatgatttgattatggtcacctgatgtttgttcttcctcgtggttggttagttggtttgttggggggaattctaggatttggtcctccagtcctcctcaggtggagacggtgattgtgacggactgttttagtagtgttagagctcgaaggtgtcattcgatgttgatttgttcttgctcttacagagttgtgcttttcctccagcttcattttacctaccatccgtgactgcatttcacatggatcattctgagttctttattttccgaggagttttctgaagcttcttttgcaaatgctttttgattctttctagccgaatcattcttgtgccaaccgaagtagggattcagttattgctggtgcaatgttgtactacgacttgaaagaagacatgcgaagaatgtgaacggtataaattcaactgattaaaacttggaggcctagtctagttcgccaaatattcaagcaaa

SEQ ID NO: 2223 - DNA, 1585 bp, Panicum virgatum
gacgaggggggcgctgcacctgcggggacaggcgctgccccgacccagcgcctcccccggcccaatggaacaagaagacggatcggcagctgctgctgcggagcaacaggcgggcggagcagagcagcagctcgcagatctcgatctcctccaccacttcaagcgagtcctccactccgaccccctcatcgatgaggtgggtttcttgcatcccacacagttcaactcactaggctgcggccaggacggcgattccgcacccccaagctccggaattgcagcgcagatacttctggtgccgagaccacaagcttgccatctctgccgagatcctgcccgagctctaccgcgccgcccgcgatgcctactgcagctccagaaacgctccactaccagcgtctcatctgatgagccacaccaaggcgcttctcatactttgccctgacctgcttaccgcatggaactccaggaagatggttctgttggagaaatatgatttcacaaagatcaaggatgagctgcaactgtgtgcactgatcctttcctactcaccaaagaacgagagcacatggagccataggaggtgggtgttaaaacaagttgcagagcatcatcaagatatgacagagcttgtagagaaggaatctgtactagtgaaagagatagcagagaggtcaaagatgaactaccgtgcctggagacatcgctgctggcttattccttacatgacaaggaaacaggtgctggatgaactgaagaagtcaacaagatggagtgagttacatgttgctgacaactgctgctttcactaccgcaggtctctgcttcttgcactactagacgttcgcctagagaacagagaggattccctcagttgggagtcagaaacctacctgctctggaaggaggagctgaggtggaacgagatgctgatcagacgccaccaagggagagagtcactgtggaaccaccggcggttccttttgcagtggtggatacagcaattgcttgctgttgatgaaacccgctcctcaatgacattccaggtggatctgttcatcacccaggagatatgcctgctgtcagagtgcttgaatgagcctgcagatgagttcgaagagtcacgtgtccaagcagagctctcagcgctctacattctgtggatatcaaagcaagttccggctgtgaatgggaagctgaaagagaggctgcattccgtttccattatggggctgaaggacctgctggtaagagcctgccgaccggagaagacgaggctgtggatgaatgtgctcggtctggccgatccattacaatgacgacatgacatttcttattgacattgagggtgtctgctgcctcgagtcctcgactgccgttgtaacgaaacacatgtattgcattttgtaaccaaacacacacatgtagatctcaaccatttggttcgggtcctttgtaattgcaaaccagactaaacagggggttgggattgccggcaactcgttacaggcaaataggtggtgtgataatgttagcaaggcaaaattgggcatttaaataaagagataaatttaacaaacatatt

SEQ ID NO: 2224 - DNA, 1605 bp, Panicum virgatum
ggccgccgccgccgcacagctccacaacttccgccgcttgctccaatcctccgagcgggcgtttcccgccccgacccagcgctttcccgtccccgatggaacaagaagacggatcggcagctgctgcggcggagcaaccggcaggcggagcagaggagcagctcgccggagatctcctccaccacttcgagcgagtcctccactccgaccccctcatcgatgaggtggggttcttgcatcccacgcagttcaactcactaggctgcggccaggacggcgattccgcaccccaagattcggaattgcagcgcaggtacttctggtgccgagaccacaagcttgccatctctgccgagatcctgcccgagctctaccgcgccgcccgcgatgcctactacagctccagaaacgctccactaccaccgactcatctcatgagccacaccaaggcgcttctcgtactttgccctgacctgcttaccgcatggaactccagaaagagggttctctcggaagaatatgatttcacaaagctcaaggatgagctgcaactgtgtgcgctgatcctttcttactcaccaaagaacgagagcacatggagccataggaggtgggtgttaaaacaacttgcagagcatcatcaagatatggcagagcttgtagagaaggaatctgtactagtgaaagagctagcagagaggtcaaagatgaactaccgtgcatggagacatcgctgctggcttattccttacatgacaaggaaacaggtgctggatgaactgaagaagtcaacaagatggagtgagttacatgttgctgacaactgctgctttcactaccgcaggtccctgcttcttgcactactagacagtcgcctagagaacagagaggattccctgtgttgggagtcagaaacgtacctgctctggaaggaggagctgaggtggaatgagatgctgatcagacgctaccaagggagagagtcactgtggaaccaccgccggttcctttcactatggtggatacagcaattgcttgctgttgaagaaacctgctcctcaatgacatcccaggtggatctgttcatcacccaagagatatgcctgctgtcagaatgcttgaatgaccctgcagatgagttcgaagagtcacatgcccaaggagagctttcagcgctctacattctgtggatatcaaagcaagttccggctgtgaatgggaagctgaaagaggggctacattccgtttccattagggggctgaaggacatgctggtaagagcctgccgaccggagaagacgcggctgtggatgaatgtgctcagcctggctaatccatcacaatgacgacatgacatttcttattgacattgagggtgtctgccttgattgtagttgtaacgaaacacatgaattgtattttgtgaccaaacacacacggcatgtggatctctttaagcatttgcctcaggtcctctgtaattgcaaaccagactaaacagggggttgggattgccggcaacccgttacaggcaaataggtagtgtaatgttaagctcagaacaatgttgcttatctccccccacctttgacttcactttggagg

SEQ ID NO: 2225 - DNA, 1397 bp, Pennisetum glaucum
cggcgatctcctccgccacttcgagcgagtcctccactctgatcccctcattgacgaggtggggttcttgcacccgacgcagttcgtctcgctaggccgcggccaagacggcgattctgcgccccaagctccggaattccagcgcaggtacttctggtgcagagaccacaagcttgccatctgctctgaggtcctgcccaagctctaccgcgctgcccgcgatgcgtactccagcgccagaaatgatccgtcacaagcggctcgtctcatgagcctcaccaaggcgctgctcatactttgccccgacatgctcaccgcatggaactccaggaagatggttctgtcggggaaatatgatttcacaaagctcaaggatgagctgcaattgtgtgcactgatcctttcctattcgccgaagaatgagagcacatggagccacaggagatgggtgttgaaacaagttgcagagcaacatcaagatatggcagagcttgtagagaaggaatctgtactagtggaagagatagcagagaggtcaaagatgaactaccgtgcatggaggcaccgatgctggcttattcctcacatgacaagaaaacaggtgctggatgaactgaagaagtcgacaagatggagtgaactacatgttgctgacaactgctgctttcactaccgcaggtccctgcttctcacactactagacaatcacctagagaacggacaggattccctcagttgtgaatcagaaacttacctgctatggaaggaggagctgaggtggaatgagatgctaatcaggcgttaccaagggagagagtccttgtggaaccaccggaggttcctttcgcaatggtggatacaacagttatttgttgttgaagaaacgtgcccatcaacaacatcccaggtggatctgttcatcacccaggagataggccttctgtcagagtgcctgaatgaccctggggacgagttcggggagtcatgcgtccaagcagagctttcagcactctacattttgtggatatcgatgcaagtcccggcagtgaaagggaagctggaagcgaggctgcattccgttccattgcggggttgaaggatgttccggtaagagcctgccgaccggagaagaggcggttgtggatgaatctgcttggcctggctgataaatcacagtaatgacatagcattgcttattgacattgagggtgtctgcatcgattgcagtttgtgacaaaacacaatgtattgcattttgttttaagcaaatggcaaggatacctttttaattaagcgtttgcttcaggtcctctgtaattgccaacaagactataatttatcatgtttatccttgatgatcggtcatggttacctgctttaacattgtttaaataaag

SEQ ID NO: 2226 - DNA, 1656 bp, Panicum virgatum
gcgcagttcggagcgtagttgtgttgggccgaactgggccacatgaaaggcacctagccgctgccgccgtccgccgtccaccgccgccgcacagctccacgagtcgactgccgccggcgcgccgcttgctccaatcctccgagcgggcgttccccgggaccccgccccgacccagcgctttcccttccccgatggaacaagaagacggatcggcagctgctgcggcggagcaacaggcggtgatgaagtggggttcttgcatcccacgcagttcaactcactaggctgcggccaggacggcgattccgcaccccaagctccggagttgcagcacagatacttctggtgccgagaccacaagcttggcatctctgccgagatcctgcccaagctctaccgcgccgcccgcgacgcctactacaactccagaaatgctccactaccagcgacacttctcatgagccacaccaaggcgcttctcatactttgccctgacctgcttaccgcatggaactccaggaagatggttctgtctgagaaatatgatttcacaaagctcaaggatgagctgcaactgtgtgcgctgatcctttcctactcaccaaagaacgagagcacatggagccataggagatgggtgttgaaacaagttgcagagcaacatcaagatatgacagagcttgtagagaaggaatctgtactagtgaaagagatagcagagaggtcaaagatgaactaccgtgcatggaggcatcgctgctggattattccttacatgacaaggaaacaggtgctggatgaactgaagaagtcaacaagatggagtgagctacatgttgctgacaactgctgctttcactaccgcaggtccctgcttcttgcactactagacagtcacctagagaacagagaggattccctcagttgggagtcagaaacctacctgctctggaaggaggagctgaggtggaatgagatgctgatcagacgttaccaagggagagagtcactgtggaaccaccggcggttcctttcacaatggtggatacagcaattgcttgctgttgaaaaaaactgcccctcaatgacatcccaggttgacctgttcatcacccaggagatagacctgctgtcagagtgcctgaatgaccctgtggatgatttcgaggagccacgtatccaagcagagctctcagggctctacattctgtggatatcaaagcaatttccggctgtgaatgggaagctgaaagagaggctgcattccgtttccattatggggctgaaggacgtgctggtaagagcctgccgactggagaagacgcgactgtggatgaatgtgctcggcctggctgatccatcacaatgacgacatgacatttcttattgacattaaggcctacttcctccttcctcatttataaggcaaggtacggtggaacatggcacggtcttccaaacaatactttgaccatttatttgtcatatattatatcacttatgattataaatttataatcattgtaaactatatttgatgacgaatccaatcatataaaatttacattataaaattaatagttaaattattggtcaaagatataaatgtttgaatcttgatatgcgtgtgcgccttataaacgaggaaggagggag

SEQ ID NO: 2227 - DNA, 1769 bp, Panicum virgatum
gcagccgcttgtctccggagccaagacacaaaatcgatgggcaaaagcgggaggaagccgagggagtcgcaccggcagggccgtggccgccgcacgtcgcacttcggcgacgacttgccttcatcagcctacgacgcgccaccgccccaccatgaggactcctctgacgacgacgacgacggcaccaacggagcaacagcggaagacgaacaagaggaagatgccaaagctgacgagaaggaccagtgggcagcggggtccatgccttccaagtttcacctataccagctctccgtgcagtctccaaagggggacatcagctacctacaaaagttcttcctgatgtacgttggcgggcgcgtccctctccacctgcaggaggatttctgtggcacggccctcctcagtactgaatggatccgtactgatgcaagaaggacagcaatcggcttagatttggaccttgagtcacttgagtggtgccttgaaaacaacctaagcaagattggagctgatgggtattcaaggatgttgcttttccatggaaatgttctacaacctaaggaagcacgtcttgtcaagcaaaggttcaatgatcttgtgcaaggccttgatgtaaacagcggcaatggctcttcaggaagtaacaaatgcgagcagttaggtcttgctaattcgaagtgcatagccaattcaaccatgtcagaggcagctttgcctggaagggatattatctgtgcattcaactacagctgctgttgcttgcatagtcgaaaggacttggttttgtatttcaggcatgcatttaacattctctcgaaaagaggtagtatatttgtaatggatgtatatggtggcacatcatctgaacgcaagctgcgtctccaacggaaattccccagcttcacgtatttctgggagcaagaagagtttgatatcacaagtcgccaaacaaggatcagtctccactttcaagctgggaagaagcaaatgctgcggcatgctttcacataccattggcgcctgtggtcgataccagagatcaaagactgcttggaggaagctggattcaagtccatccacgtttggatcagggagatgccaaacacccagtcaagtggaaacgccaaggaatacaatgccaatcgagatgtgaaatatgaagaatcgcagcgtttcaatcaaggagatgcttggaacgcctacgtcgttggagttgcaaacatctagctggctcacgttgccttctgctatgcaaatatgatggaacctggtcgctctcagttccccctgacaattaatgatgtctgaacgctcacgcttttatcatgactcttgcatcgccattgttgcggaagtatgcaggatgtactactatcccatagaatctgtgctcgatctagagcattgcttggattacgttttttttctttttaatttcagaatgaactgttatctcttatcagggtgccaccccttttatcctcctagccagacaacaatgtatgtacatctacacgtacaatctgcaggatgctttgataaatacttttcatgacagctcttttagcccttgctcgatcgggattcagatttgggccattgatagtccaattggcgatccgttatgcgcctttctgccagatggagcttcccgatgcaaacctctcagcctaattggggcatgtctaacaagtgaagtggatatcgtccactcgtctacacttctttctattttcactggcattggtgcggtctaccgtctaccg

SEQ ID NO: 2228 - DNA, 1750 bp, Panicum virgatum
gcggccgcttctccggaggcgggacacaaaatcgatgggcaaaagcgggaagaagccgagggagtcgcaccggcagggccgtggccgccgcacatcgcacttcggtgacgacttgccttcatcagcctacgacgcgccaccgtcccacgacgacgacgacgacggcaccaacgaagcaacagcgaaagacgaacgagaggaagattcgggagctgacgagaagggccagtgggcagcggggtccatgccttccaagtttcacctataccagctctctgtgcagtctccaaaaggggacatcagctacctgctaaagttcttcctgatgtacgttggcgggcgcgtccctctccacctgcaggaggatttctgtggcacggccctcctcagtgctgagtggatccgtactgatgcaagaaggacagcaatcggcttagatttggaccttgagtcacttgagtggtgccttgaaaacaacctaggcaagattggagctgatgggtactcaaggatgttgcttttccatggaaatgttctacaacctaaggaagcacgtcttgtcaagcaaaggttcaatgatcttgtgcaaggccttgatgtaaacagcggcaatggcttttcagaaagtcacagttgcgagcagtctagtcttgctaattcgaagtgcatatccaattcgaccatgtcagaggcagctttgcctggaagggatattatctgtgcattcaactacagctgctgttgcttgcatagtcgaaaggacttggttttgtatttcaggcatgcatttaacgctctctcgaaaagaggtggtatatttgtaatggatgtatatggtggcacatcatctgaacgcaagctacgtctccaacggaaattccctagcttcacgtatttctgggagcaagaagagtttgatatcataagtcgccaaacaaggatcagtctccactttcaagctgggaagaagcaaatgctgcggcatgctttcacataccattggcgcctgtggtcgataccagagatcaaagactgcttggaggaagctggattcaagtccatccacgtttggatcagggagatgccaaacacccagtcaagtggaaacgccaaggaatacaatgccaaccgagatgtgaaatatgaagaatcgcagcgtttcaatcaaggagatgcttggaacgcctacgtcgttggagtggcaaacatctagccggctcacgttgccttctgctacgcaaatatgatggaacctggtcgctctcagtttcccctgacaattaatgatgtctgaacgctcacgcttttatcatgactcttgcgtcgccattgctgcggatgtatgcatgatgtactactatcccatagaatctgtactcgatctagagttttgcttggattacgtttttttttaatttcagaatgaactgttatcacttatcaaggtaccatcccttttatcctcttagccagtcaacaatatatgtacatcctacatgtacaatctgcaggatgctttgataaatacttttcatggcagctcttctagcccttgcttgatcgggattcggatttgggccgttgataatccaattggtgatccgttaggcgcctttctgccagatggagctttccgctacaaacctctcagcctaattgggtcatgtctaacaagtgaagtggatatcgtccactcgtctacacttttttttttgttttcactggcattggagcggtctaccgtctaccg

SEQ ID NO: 2229 - DNA, 1852 bp, Sorghum bicolor
cgcccacagcgagcgtcaatccaatttcttttgcctatcccaaatgccacctgtataagcatacacaaatatactccggagcacttgtattgccttgcctttttcaaaaaagtactcctacgactacgacgaatgtgtggctctttaagcaaacaaaaatatgaacaaggacggggactgttttgcaaaaagtagattctagttctccagtttccaaatagaagtgctgctgtttgtctccagagtgcagacacaaaaaaatcgatgggcaaaagcggaaagaaaccgagggaatcgcaccggcagggccgcggccgccgggcgtcgcacttcggcgacgaggacggcgacgacttaccttcgtcagcctacgacgcgccaccgcgcccaaacgaggactcctctgacgacaacgacgacaccagcgaagcaacagcggaggatgaaccagagagggatgcggaagcgggtgagcaggaccaatggcgagccggatcaatgccttccaagtttcacttataccagctctccgtgcagtcgccaaagggggacatcagctacctgcagaagttcttcctgatgtacgtcggcgggcgcgtccctctccacctgcaggaggatttctgtggcacggccctcctcagcaccgagtggatccgtactgatgcaagaagaacagcaatcggcttagatttggatcttgagtcacttgagtggtgccttgaacacaacctaagcaagattggagttgatggatattcaagaatgttgcttttccatggaaatgttctacaaccaaaggatgcccgtcttgtcaagcaaaagtttagtgatcttgtgcatggtctcaatgtgaacagcgacaatggctcaggaagtaacagttgcgagcagacggatcttgctgactcaaagtgcttagccaatttgaccatgtcagaggcaacttttcctggaagggatattatctgtgcattcaactacagctgctgttgcctgcatagtcgaaaggacttggttttgtatttccggcatgtatgcagtgcgctctcaaaaagaggtggtatatttgtaatggatgtatatggtggcacatcatctgaacgcaaattacgtctccagcggaaattccccagcttcacgtatttctgggagcaagatgagtttgatatcatcagtcgccaaacaaggatcagtctccactttcaagctggaaaaaaacaaatgctgaagcatgctttcacataccattggcgcctatggtcgataccagagatcaaggactgcttggaggaagctgggttcaagtccgttcacatttggatcagggagatgccaaatacccagtcaagtggaaacaccaaggaatataatgccaaccgagacgtgaagtacgaagaatcgcagcgtttcaatcaaggagatgcttggaacgcctacatcgtcggagtagcaaatatctagctggtatgtgctgaattctgctacgaaaatgtgatggtggctcgctggctctcagtttcccctgccagttaatgtttcctgaatgcttacgctttgatcacgacttctgcatcgcgttgctgcgaaagtatgcagggttgttattaccgtaccgtagagaacttgtagtccagaacacggcctcaattatgtttcttttttttttttcaaaatgaaatgttggcaaggtagcatctctttaaatgtatttcctacatgtacaatgtgtaggatatgatgggtgtttcgataaagactcctacctttcaacttccataacaactttgttttaggccttgcttgatatgcgaatgcgattcgagtttgggctattgatcgtccaatcggc

SEQ ID NO: 2230 - DNA, 2146 bp, Oryza sativa
ctcgccccccgctcgctaaacacactagacatttccgatgggtaagagcgggaagaagacggagtcgcaccggcaaggccgaggccgccgtgcctcacgcttccgcggcggcggcggcggcggcgacgaggatggtgacgagttgccttcatctgcctatgatgctccaccgccacaccacgaggactccgacggtgacgacaccgacgaagcagcagccgaggacgaacacgaagggggtgtggatggaggtgaccaggagcagcgggaagtaggttccatgccttccaagttccacctgtaccagctctccgtccagtcgccaaaaggggacattagctacctgcagaagttcttccttatgtacgtcggcgggcgcgtccctctgcacttccaagaggatttctgtggcacggccctcctcagtgctgagtggcttcgtactgatgcaaggcgtacagcagttggcttagatttggaccttgagtcacttgagtggtgtcttgaaaacaacctgagcaagattggagctgatgggtattcaagaatgctacttttccatggaaatgttctacagccaaatgtagctcgcctagtcaagcaaaagatctgtgatgccatgcaagatctgcacgtaaacaatgataatgactctttagcaagtaacatctgtgatcagttggatcctgctagcccaaaatgctcagccaattcaaccatgtcggatttggttttgccggcaagagacattatttgtgcattcaactacagttgctgttgtctccacaggagaaaggacttggttttgtattttaggcatgctttcaatgcactgtcaaaacgaggtggtatatttgtaatggatgtgtatggtggcacatcatctgaacgcaagctacgtctgcagaggaggttccccagcttcacttatttctgggagcaagaagagttcgatatcataagtcaccaaacaaggatcagtctccacttccaagctggaaagaagcaaatgttacggcatgctttcacgtaccattggcgcctgtggtcgataccagaaatcaaagactgcttggaggaagctggatttaaatcaatccatgtctggatcagggagatgccaaatacccaatcaagtggaaatgctaaagaatataatgccaaccgtgatgtgaaatatgaagaattacagcatttcaatcaagcagatgcttggaatgcatatgttgttggagtagcaaatatctagatgattcatgctaccttctttttttagagagaagatgttggaaacctttgcagttttccgttctgatgctatccggtcagtttctctgatgctgcctgccggagtagtatctttttatctaatgcacaagtgcttaacatggattcccttctcgttgaaactagaatgtgtaattgctccactctatgccaggaaactaggaaagttgtatgtcttgggctatgatgtttgttctagatgagatgctagctaacatgtagtatcatcatatctgtaccgatcaaatagagagcagtcaaaccccaaagacaatctactgaagatggtgattcactatttcttgatgcagtcatacaggggttgtatgtccagtcagtttcatgcagcataaccttttcaggtttgcatgccaatggtgttctgtgctgattaacttcctgagccactgagtcccctaagatatgctgtcaaatgtttgattaaactggccgagttaccagatcatttcctctccgcaataatctctgcattgtgaacatctcttctggcagcagatgtcctccacaatagaatctgtgaacctgccatcaacagcatccttcaaatcatccatgcccattgacaattactcgcaaggaacgggggagatctaagaaaattgttagaatagatgtcgaatatactaattctatttggttacagttggacttaaagttgtaataggtggtagggggtagaggtagagtcggactctataacctagcaactctcttaaatagagaggcatggagatgatggtggtgtggccatggacttgtagcggctaggagttatatgggttgaggagcgcccataatcaaaaccccaggacataagcttcggctaaacctcgttaac

SEQ ID NO: 2231 - DNA, 1741 bp, Triticum aestivum
cgagtacgcgggggaaccaagtccctgcactttcatctctccctcgttccaacccctaaacccctcaccgctacgcacgcgacccggcgaccatgggtaagagcgggaagaagacgaaggagtcgcaccggcaaggccgcggccgccgtggctcgcaggtcggcgacgacgacttgccttcatctgcctacgacgcgccgccgcgccgccaggaggactcggacggtgacgattccgacgaagcagcagcggaagacgaacacgacggaggcgcggaagcaggcgaccgccagggccagtggcaagtcggctcgatgccttccaagttccacctgtaccagctctccgtgcagtcgccaaaaggggacatcagctacctgcagaagttctttctgatgtacgtcggcgggcgcgtccctctccacctgcaggaggatttctgtggcaccgccctcctcagtactgagtggcttcgcactgatacgagacgaacagcagtgggcttagactttgaccgtgagtcacttgagtggtgtcttgagaacaacctgagcaagattggagctgatgggtattcgagattgttgctttttgatggaaatgttctgcagccaaatgaatctcgccttgtcaagcaaaagatcagtgatctcgtacaaggtctaaatgttaccagtgacgatggctctactgaaaagaacagctgcgagcagtcagattcttcatttacgaaatgtgaagccaattcgaccatgtcagatgcagttttgcctggaagagacataatttgtgcattcaactacagttgttgttgccttcacaagagaaaggacttggttttgtatttcaggcatgctttcaatgcactttctaaaagaggcggtatatttgtaatggatgtatatggtggcacatcatctgaatgcaagcttcgtctccagaggagattccccagcttcacttatttctgggagcaagaagagtttgatatcataactcgtgaaacaaggatcagcctccactttcaagttggaaagaagcaaatgatacggcatgctttcacgtaccattggcgcctgtggtcgataccagaaatcaaggactgcctggaggaagctggattcaagtccatccacgtatggatcagggagatgccagacaccaaatcaagcggaaacgccaaggagtacactgccgaccgcgacgtgaagtacgaggagctccagcatttcaaccaggcagatgcttggaacgcgtacatagtcggggtagcaaacatctaagatgaaatgatccttgctgcctcctgctacgaaaatgcggtggaaagttgggaacctgacaatttccccttccaacgctggaggagacacgttctgcctaatgtgcggatgctcgcccatcgcattgcaacctgaagtatccggagggtgtttccgatgacagttctaaactagtttctgtaataaaaccatcccttttgatctctcgctagttgcggaagacgatggtcattcggtacgccgaggcttcttgaatctgaagagctatcattctctcgaacgtggaacgtcaagggcttgttgtggagttgcaccaggtggcacttcactgttggcataagctcattggttgcatggctgtgtaggctagtccatttgcttttctgcttttgtaatagggtcttttacatctgtgttcctaactggaacccactactcatatttactcttaattttaa

SEQ ID NO: 2232 - DNA, 1931 bp, Brachypodium distachyon
cagagattgataccatgaagaatatgttttcgagaaatttcattgcaattcttagtcatatgggttactgtgaagttttttgtgtctatgatcctaagcagggtacctgtgatgttttcgactttgaataaagttacagatatgtttttttttttaaaaatatggacgcaatcgcttgataaagaaacgtagggacctatgtgcaaaatatatatcccctcttccaaaactgctaaacccctcgccggtaaacacgctgggacgcaccgatgggtaagagcggaaagaagccgaaggaatcgcaccgacatggccgaggccaccgtgcctcacagttcggcgatgaggacctaccttcgactcactataggcgcgccaccgccccgccccgaggactccgacgatgacgattccaacgaagccgcagcggaaggcgaagacgaaggagacgcagaagcaggcgaccagggccagtggcaagtaggccctatgccttccaagttccacctatatcagctctccgtgcagtcgccaaaaggggacatcagctacctgcagaagttctttctgatgtacgttggcggacgcgtcccgcttcatctgcaggaggatttctgtggcacggccctccttagtactgagtggcttcgcactgatgcaagacgaacagcaattggcttggatttcgaccgtgagtcacttgagtggtgtcttgataacaatatgagcaagattggagctgatggatattcgagaatgttgcttttcgatggaaatgttctgcagccaaatgaatctcgccttgtcaagcaaaagatcagtgatctcatgcaaggtctaaatactaccaatgataatggatctacagaaatctgcgatcagtcagagtctgctattccaaaatgcttagccaattcgaccatggcagatgcagttttgcctggaagagacgttatttgtgctttcaactacagttgctgttgccttcacaggcgaaaggacttggttttgtatttcaggcatgctttcagtgcactttccaaaagaggcggcatatttgtaatggatctatatggcggcacatcatctgaatgcaagcttcgtctccagaggagattccccagcttcacttatttctgggagcaagaagagtttgatatcataactcgtgaaacaaggatcagcctccactttcaagttggaaagaagcagatgttgcggcatgccttcacttaccattggcgcctgtggtcgataccagaaatcaaggactgcttggaggaagctggatttaaatccatccacgtctgggtcagggagatgcctgatacccaatcaagcggaaatgccaaggaatacactgctgaccgagacgtgaagtacgaagagttgcagcatttcaaccagggagatgcttggaacgcctatgtagtgggagtagcgaacatctagatgatgcatgctgcctcctgttacgaaaatatgatggaaacctggtctcagacaatttttccttccaatgcacccagaccagttcgtctgctgctggatgagcatgttttgtctaatgtacgaatgttccctcacgccctttttacatgacattacattgccggaagtattccaaagcatctgctcgattatccagatgatatgtcaacgtgatgccatcccttttggtctctcaccagttgcagactttgtaaccttgtacaaaacggtgttgtcgtgataccatccccctctctcggtctctcctgctccggttcaaagcacttgcagtgtcgaagaagatatagattaactccattgggccttgattagttcaagtttaaatctgaactatgtactgaagtatgatgctttgcccacctttgtaccatcgtccaaaaggagctttctgccgcaacgccttccactcttccagtcct

SEQ ID NO: 2233 - DNA, 1978 bp, Brachypodium distachyon
cagagattgataccatgaagaatatgttttcgagaaatttcattgcaattcttagtcatatgggttactgtgaagttttttgtgtctatgatcctaagcagggtacctgtgatgttttcgactttgaataaagttacagatatgtttttttttttaaaaatatggacgcaatcgcttgataaagaaacgtagggacctatgtgcaaaatatatatcccctcttccaaaactgctaaacccctcgccggtaaacacgctgggacgcaccgatgggtaagagcggaaagaagccgaaggaatcgcaccgacatggccgaggccaccgtgcctcacagttcggcgatgaggacctaccttcgactcactataggcgcgccaccgccccgccccgaggactccgacgatgacgattccaacgaagccgcagcggaaggcgaagacgaaggagacgcagaagcaggcgaccagggccagtggcaagtaggccctatgccttccaagttccacctatatcagctctccgtgcagtcgccaaaaggggacatcagctacctgcagaagttctttctgatgtacgttggcggacgcgtcccgcttcatctgcaggaggatttctgtggcacggccctccttagtactgagtggcttcgcactgatgcaagacgaacagcaattggcttggatttcgaccgtgagtcacttgagtggtgtcttgataacaatatgagcaagattggagctgatggatattcgagaatgttgcttttcgatggaaatgttctgcagccaaatgaatctcgccttgtcaagcaaaagatcagtgatctcatgcaaggtctaaatactaccaatgataatggatctacagaaatctgcgatcagtcagagtctgctattccaaaatgcttagccaattcgaccatggcagatgcagttttgcctggaagagacgttatttgtgctttcaactacagttgctgttgccttcacaggcgaaaggacttggttttgtatttcaggcatgctttcagtgcactttccaaaagaggcggcatatttgtaatggatctatatggcggcacatcatctgaatgcaagcttcgtctccagaggagattccccagcttcacttatttctgggagcaagaagagtttgatatcataactcgtgaaacaaggatcagcctccactttcaagttggaaagaagcagatgttgcggcatgccttcacttaccattggcgcctgtggtcgataccagaaatcaaggactgcttggaggaagctggatttaaatccatccacgtctgggtcagggagatgcctgatacccaatcaagcggaaatgccaaggaatacactgctgaccgagacgtgaagtacgaagagttgcagcatttcaaccagggagatgcttggaacgcctatgtagtgggagtagcgaacatctagatgatgcatgctgcctcctgttacgaaaatatgatggaaacctggtctcagacaatttttccttccaatgcacccagaccagttcgtctgctgctggatgagcatgttttgtctaatgtacgaatgttccctcacgccctttttacatgacattacattgccggaagtattccaaagcatctgctcgattatccagatgatatgtcaacgtgatgccatcccttttggtctctcaccagttgcagactttgtaaccttgtacaaaacggtgttgtcgtgataccatccccctctctcggtctctcctgctccggttcaaagcacttgcagtgtcgaagaagatatagattaactccattgggccttgattagttcaagtttaaatctgaactatgtactgaagtatgatgctttgcccacctttgtaccatcgtccaaaaggagctttctgccgcaacgccttccactcttccagtcctactgggtcgcgtgactcgcgtctacgtatgacgtatctaccatcagc

SEQ ID NO: 2234 - DNA, 1376 bp, Hordeum vulgare
atcacttctgttccgaacccgctaaaccctcaccgctacgcccggaaccggcagccatgggtaagagcggaaagaagacgaaggagtcgcaccggcaaggccgcggccgccgtggctcgcagctcggcgacgacgacttgccgtcgtctgcctacgacgagccgccgcgccgccaggaggactcggacggcgacgattccgacggagcagcagcggaggacgaacacgacggaggcgcggaagcaggcgaccgccagggccagtgccaagtcggctcgacgccttccaagttccacctgtaccagctttccgtgcagtcgccaaaaggggacatcagctacctgcagaagttctttctgatgtatgtaggcggacgcatccctctccacctgcaggaggatttctgtggcacggctctcctcagtactgagtggcttcgcactgatacaaggcgaacagcagtcggcttagactttgaccgtgagtcacttgagtggtgtcttgagaacaacctgagcaagattggagctgatgggtattcgagattgttgctttttgatggaaatgttctgcagccaaatgaatctcgccttgtcaagcaaaaggccagtgatctcgtgcaaggtctaaatcttaccagtgatgatggctctactgaaacaaacagctgtgagcagtcagattcgtcatttacgaaatgtgcagccaattcgaccatgtcagatgcagttttgcctggaagagacataatttgtgcattcaactacagttgttgttgcctccacaagagaaaggaattggttttgtatttcaggcatgctttcaatgcactttctaaaagaggtggtatatttgtaatggatgtatatggcggcacatcatctgaatgcaagcttcgtctccagaggagattccccagctttacttatttctgggagcaagaagagtttgatatcataactcgcgaaacaaggatcagcctccactttcaagttggaaagaagcaaatgatacggcatgctttcacgtaccattggcgcctgtggtcgataccagaaatcaaggattgcctggaggaagctggattcaagtccatccacgtctgggtcagggagatgccagacaccaaatcaagcggaaacgccaaggagtacaccgcggaccgcgacgtgaagtacgaagagctccagcgtttcaaccaggcagatgcttggaacgcgtacgtagtcggggtagcaaacatctagtagatgaaatcgcattgcaacctgaagtatccaaaggatgttttcgatgacagttctgaactactttctgtaataaaagcatccgttttggcccctcgcaattttgcggaaaagtgatggtgattcggc

SEQ ID NO: 2235 - DNA, 1755 bp, Zea mays
cagcctccccacacgcaggctgcatcccatcggtgccagttggaagccaacaaccctgccactgccatgctgcctcactcgcccaccaccctttaataccccaccgctccttgctctcacttcactcacggtcggaatgagcgttcaccgtcacaatcactgaatcacacaagcacgaccacgcacacgcggtaaacacgcgcgcgctcaaacagttcgaaatggcgctcgccgccgccatcatcgtcgtcttcctgcttcctggccttctcctcacggcgatggcggccacgccgtaccctcacggccgcggcgccgacgctctcgtgggcgcgtccaagaagtacgagggcagctccaacctggtggacctccgctaccacatgggccccgtcctctccgccgcgccgctccgcctctacgtgctctggtacggccgatgggaccccgcgcaccaggtccccgtccgcgacttcctcctctccctctccgacacgtccctgccgcgcccctccgtcgccgactggtgggccaccgccgcgctctacgccgaccagaccctcgccaacgtcacctgccgcgtcgacctggccggggaagccgccgacgagtcggcctcgctgggccgctcgctctcccggctcgacatccagcgcgtgctcgcctctgcggtcgccgcgggccggctccctgccgacacccgcggcggcgcctaccttgttctcacggcgcccggcgtcggcgtccaggacttctgccgcgccgtatgcggcttccactacttcaccttcccgtcgctcgtgggccacacgctgccctacgcgtgggtcgggcacagcggcggccgctgcgccgacgtctgcgcgtacccgttcgcgctgtcgtcgtacatggcccggagcggcatggcggcgctgcggccgcccaacggcgacgcgggcgtcgacggcatggtcagcgtcatcgcgcacgagctggccgagctcgccacgaacccgctcgtcaacgcgtggtacgccggggaggaccccacggcgcccaccgagatcgccgacctgtgcgagggggtgtacggtacgggcggcggcggcgggtacgccgggaaggtgtcggtggacgcgcaggggaggagctggaatgtgaatgggaggaaggggaggaaattcttggtgcagtggctgtggagcccagaggctaaggcgtgcgtggggcccaatgccagtgactaggcttattggccactgctagcatgtaactaccatgtagtagtagtttattattctcagctttactttatattatattatatataaaaaactattatatgataattagttgttttagaatctacagagctaatagttaactgctaaatcagttatagaaagttaatggttaactactaaattagttgaagaggtttcaaacaatttcaactaatatctaactaattgttagctagctcaaactagtaaataatttattagctaattgattattagctccagagattttaaacaagaccttagtattacttgggagtggacagccgtaggcaaataccgttcaagatacgcttgcatatgaaactatatctaataatacatcacatacgacaaaatcacggtttttcttttaactactacttctaaacttatataaagtataatcatcctgatatgatatactagaatacgtaaagtaccaaaaagagaaaaatactatagagaatggagaaaacaagatagttactag

SEQ ID NO: 2236 - DNA, 1278 bp, Panicum virgatum
tgccagcccaccctgcctcccgccaccgctagccctccgtccttctttaatgctgctcctctctctgcagtctgcactcacagtcacagactcacagtcgcacagcgggcacgaacaggccgccgaaatggcgctcgccgccgccgccgtcctcttgctgatccctggccttctcctcacggcgatggcggccacgccgtaccctcacggcgacccgctcctcggcgcgtccaagaggtacgagggcagctccgacctggtggacctccgctaccacatgggccccgtcctctccgccgcgccgctccgcctctacgtgctctggtacggccgctgggaccccgcgcaccaggcgcccctccgcgacttcctcctctccctctccgacccgtccccgccgccgccctccgtcgccgcctggtgggccaccgccgcgctctacgccgaccagaccctcgccaacgtcacccgccgcgtcgcgctcgcggccgaggccaccgacgcgtccgcctcgctcggccgctccctctcccgcctcgacatccagcgggtgctcgccgcagccgtcgccgcgggccgcctccccgccgacgcccgcggcggcgcgtacctcgtgctcaccgcgcccggcgtcggcgtccaggacttctgccgcgccgtctgcggcttccactacttcaccttcccctcgctcgtggggcacacgctcccctacgcctgggtcggccacagcggcggccgctgcgccgacgtctgcgcatacccgttcgcgctgccggcctacatgtcccggggcggcatggcggcgctgcgcccgcccaacggcgacgcgggcgtcgacggcatggtcagcgtcatcgcgcacgagctggccgagctcgccaccaacccgctcgtcaacgcatggtacgcaggggaggaccccaccgcgcccaccgagatcgccgacctctgcgagggggtgtacgggacgggcggcggcggcgggtacgccgggagggtggcggtggacgcgcaggggaggagctggaatgtcaacggcaggaacgggaggaagttcttggtgcagtggctgtggagcccagaggccaaagcctgcgtggggcccaatgccagtgactaggctgtgtttagccaacgccgctagcatgtagactagattactactagtggaaaagtagcataatttttgggaatttgtatcgtattttttcggtttattatatgtatgaaagctactttctccgttccaaaaaaaatataaatctgatttctgaa

SEQ ID NO: 2237 - DNA, 1760 bp, Panicum virgatum
tcccctccctgcacagtcacagtcgcacagcgagcacgaccaccgcgcgcgctccaacaggccgacgagatggcgcacgccgccgccgtcctcttgctgatccctggcttccttctccacacggcgatggcggccacgccataccctcacggcggcgacccgctcctcggcgcgtccaagcggtacgagggcagctccgacctggtggacctccgctaccacatgggccccgtcctctccgccgcgccgctccgcctctacgtgctctggtacggccgctgggaccccgcgcaccaggccccgctccgcgacttcctcctctccctctccgacccgtccccgccgccgccctccgtcgccgcctggtgggccaccgccgcgctctacgccgaccagaccctcgccaacgtcacccgccgcgtcgcgctcgcggccgaggccgccgacgcgtccgcctcgctcggccgcgcgctctcccgcctcgacatccagcgggtgctcgcctccgccgtcgccgcgggccggctccccgccgacgcccgcggcggcgcgtacctcgtcctcacggcgcccggcgtcggcgtccaggacttctgccgcgccgtctgcggcttccactacttcaccttcccctcgctcgtggggcacacgctcccctacgcctgggtcggccacagcggcggccgctgcgccgaggtctgcgcgtacccgtttgcgctgccgtcctacatgtcccggggcggcatggcggcgctgcggccccccaacggcgatgccggcgtcgacggcatggtcagcgtcatcgcgcacgagctggccgagctcgccaccaacccgctcgtcaacgcctggtacgcaggggaggaccccaccgcgcccaccgagatcgccgacctctgcgagggggtgtacgggacgggcggcggcggcggctacgccgggagggtggcggtggacgcgcaggggaggagctggaatctcaacggcaggaacgggaggaagttcctggtgcagtggctgtggagcccagaggccaaggcttgcgtggggcccaatgccaatgactaggctgtgtttggccaacgccgctagcatgtatacttgtggtagtggagaaaagttgcattattttaggggatttgtatcgtatttttttcggttattatatgtataaaaaatcaattaacttgattaatcgtatttagggatggtaattttacccacgggtgcgggtacacgacggttgagggtatgtgtatgaaattttaatcgcaggtatgggtatggatataaaatttcacccacgggtaaagcgcgtgtaaaaattattacccacgggtattcgaaataaaaaataatctagtaaatttatattattcacaaattttatatctcattttcttgtgattatatgaactaaatagatggatagtaagattgtgtgaactaatagatgtgaaaatgatattgatatttttacttattatttggagtgaagcgtatgattattgttacattttttagataaaatacatgactagaattgaacgcatgtacttacatacaactacaaaatagatgttgaaaataagaagaaaaaaatggtgcaaaatgatccttttagttctaataatgctttgagttcgctttgatggatgataaattataaatatgcccggcaatacgaccaaatgataggttatttaaattattattaaaatacccgatgggtatctaaaacccgacccgtactcgacgga

SEQ ID NO: 2238 - DNA, 2163 bp, Panicum virgatum
gctgtgcaaaaaatatgaaaccccaacgcaccaccgggcaacggctccttggtcaggtggagcggtcaacgtctcgctcgccgggacactcgccgccctcttaaaaccagcggcaactttcccgtcctcccacacctccctctcctcggcactctagctagtcccacggacagacacccactcagtcctctccaatctccactctccgcccaccaccaagggcaaggaagctaatctcgccgtacacgcatggccgacggggcggcgggcggcggcagggcggaggtcgacacgtcggcgccgttcgagtccgtgcgggaggccgtcgaccgcttcggcggcagcgccgcctggagctccgacctcgtcaggcgcatgttcgcgccctcgaagaaacatgaagactctgaacaagctgcacaaaccatcaacgtacaagagcaggctgcacagctagaaaatgaggttgctgtcaaagagagggagactcttgacgtgttgaaggagctggaatcaaccaagaagatcatagcagacctgaagctgaagatacagaaagaaaccagtgaaacatcccctgatgaagctgtgaagtccgaggaaactgatctggtttctacggcagaacctgaagagcagcaacctgaaaatgttatcgtggatgtggacatggaaggcgtagaagaaaacccgcagcagccttctggcggttcagttttggtggaacttgagcagaccaaagaaagcctgaacagaactacaaatgatctggctgcagtgcgggctgctgttgagttactgcgaaacagcatagcgaaagagaaaatgttacttgaaagaggccgagaaaagctttcctctaacacttccttggtttcttctttggaggatgagttggatcagacagcgcaaaagttggaaactctgaaggatctgcagaagagacgcaaagacccctcggacatttttatcgagattaagaaaatgacctctgaggttcaagagctcaggagcatggcaaatggttcaaaatctgaagcgatgttgttggctgcagaaatcgagcaggcaaaggccagcattagcacagctgagatcaggtgcattgcagccaaaaagatggaagaagcagctagagcagcagaagcccttgcactcgctgagatcaaagctctactgagcagtgaaagttcttttgaaggtgagaactcttctgatggagtgactctctcgatggaggagtatttcatactgtgttccaaagctcttgaaactgatgaaaactccaagaagaaagttggagatgctatgcagcaggtagatatagctaacagttcagagtccgagtcagttaagaggcttgaggatgccaaattagaggttgaggaatgcaagaaagcgctacgagaggccctaaagagggtagaggctgcaaaccatgggaagcttgcagttgaagagatccttcgaaggtggaaatctgagagtggacacagaaagcggtctattggtgggtctccgaagttcaaaaatgcaacccatcaccgtaaagattcgtacagcatggatattgttgataatgtttcagatagatccttcaagcaaactttgtcaattgggcagatactgagtatgaagttaatggggcctgatggatatgacaaaagtgtctgggatgacaagacaagtgagacgccaaatatctcacttggtcagattctgaaccgcagtggtgttttgtgtagagaagatgtggcttctcgcagaagaatttcagcaaagagaaagaaatttgcattgacaggactttctgttctgctggcaaagcaatctaagagcaagaagaagagagaatccttttaaactgatatagattgtcccaaaaagatcattcggggtggtgtggtatttcgtagtattgtactatgtagcagcagttcaatcttgtcgccagtagctaattttcacgctattctatctcgaggtgatgtaccctagtattaaatgtaaccggtagcaatttttgctgctaactagcgtagagttttgacagttctctaccatgcatgctattgagatctatataattggatccaatgtttttacctttctggttgaggcacctagcagatacattttacttggtatatgatggttgtgcaa

SEQ ID NO: 2239 - DNA, 2178 bp, Sorghum bicolor
ctgtgctgcaaaatacgaaaacgcaacggccaacggctccttggtggggcgggcggtcaacgtctctctctcgccgggtcgctcactcgctcgctcttgaaaacccgcagctttcccgtgttcccacatctctcccctctgcctctaggctctagcagtctagccactccactctcctcgcgcaccagtgcagtgcgccaccaagaaactgctcccacagctccccatgagctccgacgccgaatgcgcagcagctcaggccgccgcccccgatgcggcgggcggcggcagggcggagatcgacacgtccgcgccgttcgagtccgtgcgggaggccgtcgacaggttcggcggcagcgccgcctggagctccgacctcgtcaggcgcatgttcgcgccctccaagaaacatgaacactctgaacaagctgcagaggccatcaacgcagaggagcaggctgcacagctagaaaacgagctggctgtcaaagagagggaaactcttgatgtgctcaaggaactggaggcaaccaagaaaatcatagcagacctgaaactcaagatacagaaggaagccactgaaacatcccctgaagaagctgcgaagtctgatgaagctgatcaggtttctgaggcaggacctgaagagcagcagcctgaaaacatcaatgtagatgtggacatggaaggtgcagaggaaaatcattcaggttcagtttcggcagaacttgagcaggcaaaggcaagcctgaacagaactacaggtgatctggctgcagtgcgggctgcagttgagctactgcgaaatagcatagcaaaagaaaaattgttacttgaaagaggccgagaaaagctctcctctaacacttcattggtttcttctctggaggatgagctggatcaggcagcacaaaagatggaaacgctgaaggatctgcagaggagacgaaaagacccctcggacatttttatggagatcaagaaaatgaccactgaggtgcagcagctcaggagcatggcaaatgattcaaaatctgaagctatggtgttggctgcagaaattgagcaggcaaaggccagcattagcacagctgaggtcaggtgcattgcagccagaaagatggaagatgcagctagagcagcagaagcccttgcacttgccgagatcaaagcactactgagcagtgaaagttctttcgaaggtgacactgcttctgacggagtaactctctcgatggaggagtatttcacactgtgttccaaagctcttgaagctgatgaaaactccaggaagaaagcagaagacgccatgctgcaggtagatgtagctaacaattcagagtctgagtcggttaagaggctcgaggatgccaaagtagaggttgaggaatgcaagaaggcactacaagaggccctaaagagggtagaggctgcaaaccatgggaaacttgcggtggaagagattcttcgtagatggaaatctgagagtggacacaaaaagcgatctcttggtggctccccaaaattcaaaaatgtagctcaccgtcgcgaatattcgcacaccacagatatgatttctgatgtttcagatagatcacacaaaccaacattatcaatagggcagatactgagtatgaagttaatgggacctgatgggtatgacaaaagtgtttgggatgacaaagcaagcgagataccagatatctcacttggtcagattctaaacaggagtggtgttttgtgcagagaagatatggctactcgcaaaagaatttcaggaaagaggaagaagtttgcattgactggcctttctgttctcttggcgaagcaatcaaagaacaagaagaagagagaatccttttaaactgatataagttgccccaaaaatatcagtgttgcactttatagtattgtaatatgcagatgtagttcaaccttgtcattagtactagttaactatatcagatgttttatatgaggaatgaggttgttttatatgaggaatgaggtagtacatttagttcatcatgttaaagtaccggtagcaatttttgctgctaattagagtagtgactagcagttctctgctatgtatgctattgagatctacgtaattggatccaagttttacctttctgcgttgaggtacctatatggtctaaaatattacctttttct

SEQ ID NO: 2240 - DNA, 1681 bp, Echinochloa colona
cacgtcggcgccgttcgagtccgtgcgggaggccgtcgaccggttcggcggcagcgccgcctggagctccgacctcgtccggcgcatgttcgcgccctccaagaaacatgaacactctgaacaagctgcacaagccatcaatgtacaagagcaggctgcacatctagaaaatgagctcgccctcaaagagagggagactcttgatgtgttgaaggagctggagtcaaccaagaaaatcatagcagacctgaagctgaagatacagaaagaagccactgaagcatcccctgctgaagctgtaaattccgaggaaactgatcaggtttctgcagcaggacctgatgagcaaccacctgaaaattttaccatgaatgtggacatggaaggcatagaaggaaatccacagcagccttctggttcagttttgctggaacttgagcagaccaaagaaagccttaacagaactacaagtgatctggctgcagtgcgggctgctgttgaattactgagaaataacatagctaaagagaaaatgttacttgaaagaggccgagaaaagctttcctctaacacttccttggtttcttctttggaggatgaactggatcagacagcacaaaagctggaaactctgaaggatctgcagaggagacgcaaagacccctcggacatttttatcgagatcaagaaaatgacttctgaggttcaacagctcaggagcatggcaaatgattcaaaatccgaagctttgttgttggctgcagaaatcgagcaggtaaaggctagcattagcacagctgaagtcaggtgcattgcaaccaaaaagatggaagaagcagctagagcagcagaagcccttgcgcttgctgaaatcaaagctctactgagcagtgacagttcttttgaaggtgacaaggcttctgatggagcgactctctcgatggaggagtatttcacactatgttccaaagctcttgaagccgatgaaaactgcaagaagaaactaggagatgctatgctgcaggtagatatagctaacagttcagagtctgagtcggttaagaggctcgaggatgcaaaagttgaggttgaggaatgcaagaaggcgctacaagaggccctaaagagggtagaggctgcaaaccatgggaagcttgcagttgaagagattcttcaaagatggaaatcggagagccgacacagaaagcggtcaattggtggctctccaaagttcaaaaatgcaacccaccatcgtaaagatttgctcagcatggatattgttgatgatgtatcagatagatccttcaagcaaactttgtcgattgggcagatactgagtatgaagttaatggggcctgatgggtatgacaaaagtgtgtgggacgataaggcaagcgagatgccaaatatctcacttggtcagattctgaaccgcaatggtgttttgtgcagagaagacatggtttctcgcaaaagaatttctggaaagaggaagaaatttgcattgacagggctttctgttctcctggcgaagcaatctaagagcaagaagaagagggagtccctttaaactgatatagattgttgtcccaagaaagatcatttactgtcagtattgtactatgtagcagcagttcaaccgtgtcatcagtagctaattttcatggcattttatctgagg

SEQ ID NO: 2241 - DNA, 2201 bp, Panicum virgatum
ctatgtcaggtggagcggtcaacgtctcgctcgccgggacactcgccgccctcttaaacccagcggcagctttcccgtcctcccacacctcccctctcctcggcactctagctactcctacggacagccactcagtcctctccgctctccacgcaccaccaacgaagctaatctcgccgtgcacgcatggccgacggggcggcgggcggcggcagggcggagatcgacacgtcggcgccgttcgagtccgtgcgggaggccgtcgaccgcttcggcggcagcgccgcctggagctccgacctcgtcaggcgcatgttcgcgccctccaagaaacatgaagactctgaacaagctgcagaaaccatcaacgtacaagagcaggctgcacagctagaaaatgaggttgctgtcaaagagagggagactcttgacgtgttgaaggagctggaatcaactaagaaaatcatagcagacctgacgctgaagatacagaaagaatccactgaaacatcccctgatgaagcagtgaagtccgaggaaactgatcaggtttctatggcagaacctgaagatcagcaacctgaaaatgttgccgtggatgtggacatggaaggcgtagaagaaaacctgcagcagccttctggttcagttttggtggaagaaaacctgaacagaactacaaaagatctggctgcagtaaacccgcagcagccttctgattcagtttttgtggaacttgagcagaccaaagaaaggctgaacagaactacaaatgatctggttgcagtgcgggctgcagttgagttactgcggaacagcatagcaaaagagaaaatgttacttgaaagaggccgagaaaagctttcctctaacaattccttggtttcttctttggaggatgagctggatcagacagcacaaaagttggaaactctgaaggatctgcagaagagacgtaaagacccctcggacatttttatcgagattaagaaaatgacctctgaggttcaagagctcaggagcatggcaaatggttcaaaatctgatgcgatgttgttggctgcagaaatcgagcaggcaaaggccagcattagcactgctgagatcaggtgcattgcagccaaaaagatggaagaagcagctagagcagcagaagcccttgcactcgctgagatcaaagctctacttagcagtgaaagttctttggaaggtgagaactcttctgatgcagtgactctctcgatggaggagtatttcacactgtgttccaaagctcttgaagctgatgaaaactctaagaagaaagtaggagatgctatgcagcaggtagatatagctaacagttctgagtctgagttggttaagaggctcgaggatgccaaattagaggttgaggaatgcaagaaggcactacaagaggccctaaagtgggtagaggctgcaaaccatgggaagcttgcagttgaagagatccttgggagatggaaatctgagagtggacacagaaagcggtctattggtggctctccaaagttcaaaaacgcaacccagcgtcgtaaagattcgtacagcatggatattgttgacgatgtttcagatagatccttcaagcaaactttgtcaattgggcagatactgagtatgaagttaatggggcctgatgggtatgacaaaagtgtctgggatgacaagacgagcgagacgccaaatatctcacttggtcagattctgaaccgcagtggtgttttgtgtagagaagatatggcttctcgcagaagaatttcaggaaagagaaagaaatttgcattgacaggactttctgttctactggcgaagcaatctaagagcaagaagaagagagaatctttttaaactgatgtaaattgccccaaaaagataattcggtgtggtactttgtagtattgtactatgtagtgtagcagctgttcaaccttgtcgccactcgccactagctaattttcatgctattctatccgatgtgatgtattatgtagcagcagttcaaccttgtcgccagtagccaattttcacgctattctatccgtgttgtgccctcttattgaatgtaaccggtagcaatttttgctgctaactagagtagagtttgacagttctctacgctgtatgctactgagatcgatataattggatgcaatgtttttacctttctggttgaggca

SEQ ID NO: 2242 - DNA, 2963 bp, Zea mays
atgtactacgcgggcaaagcaaagcatcggtgtctacctcattattttcggagtccgagtggcgaaacccgccgcagcttccactgggcagtgctccacaggctcatatccgattccgatccctaagacctcagccgctgcggcatccacggccaactcaagcgctggcaactggcaagggcagatgatctgtgtatagcactcgctaccttctcttgatttccccctcaggtcgctgaccaagggtcctgtccgccatggatgcggagcgaagctctgcacgcagcgccacaccttttggtccgccgtccgatcgccaccgctagacgccacgcctgcgttgccttcccggctgaatcgccgattcccttggcggtctagtgcctgcggtcggcgccagacgccggcgaggtagccgcgagacacaggtacgggtgccgaacgggaacggctgctgcccgccgagccgtcgactgcctgcctggagccttgactgcgcaagcgcagctgccgtgtgttgagtgctgagtcgccgactccaccaggtggccagcgattgctttgctgctccaggaaagaagccaaaaaaaaacacgaagaattaaacatcgattgaaagggaaaagacaatgccaagcctgaactgagaggcgcacactggatttcgcatcagttcatgtcgttccttacaccgtcaatttgacgaatcacctcgccacgccgccttgattttgttttgtcctccgcttctggccgggctcagttcagctgtatggtattggtatcgccatgtcaagcgacctctccacacgctcctcgccttcctcctccaccgcgtcgccttccgacgactcgcggcggcaggagcaaggccaggcggcgggtaacgccagcgggagccggcggtggcggtggcgcctcgggctgggcgcggcgtgggcgctggacccgcgggcgaggtgggtccgggactggaaccgcgcctacctcctggcctgcgcggccgggctcatggtcgacccgctcttcctctacgccgtgtccctgagcggcccgctcatgtgcatattcgtcgacggctggctcgccgccgccgtcaccgcgctgcgctgcggggtggacgccatgcacgtgtggaacgtcgccacgcagctccgcaccgccaaggcgccgccgggtaagcgcgtggccggcgacgaggagcagcagcagaccgtcgccgaggccgcgcgcaagctccccgaggacgcggcgtccaggagggggctgttgctggacttcttcgtcatccttcccgtgatgcaggtggtggtgtgggttgcggcgccggcgatgatccgcgcggggctgacgacgccggtgatgacggtgctgctggtgtcgttcctgctggagtacctgcccaagatctaccacgcggcgcgcctgctccggcggatgcagaggcagtctggctacatcttcggcaccatctggtggggcatcgcgctcaacctcatggcctacttcgtcgccgcccatgctgtgggcgcgtgctggtacctgctcggcgtccagcgggccagcaagtgcctgaaagagcagtgcctccaggcggccgggtgcgcgcgcggcagcgcggtggcctgcgcggcgccgctgtactacggcggctccccgtctcccggagtcggcggcggcgacaggctcgcctgggccgggaacgcgcaggcccggggcacgtgcctcgccagcggcgacaactaccagtacggcgcgtacacgtggacggtgatgctggtggcgaacccgagccgggtggagcggatgctgctccccatcttctggggcctcatgacgctcagcacgttcggcaacctggagagcacgacggagtggctggagatcgtgttcaacatcatcaccatcacgggcgggctcgtcctcgtcaccatgctcatcggcaacatcaaggtgttcctgaacgcgaccacgtccaagaagcaggccatgcacacgcggctgcgcggcgtggagtggtggatgaagcgcaagaaactgccgcggagcttccgcggccgggtgcgccagttcgagcgccagcggtgggccgccacgcgcggcgtcgacgagtgccagatcgtgcgcgacctccccgagggcctccgccgggacatcaagtaccacctctgcctcgacctcgtccgccaggtcccattcttccagcacatggacgacctcgtgctcgagaacatctgcgacagggtgaaatccctcatctttcccaagggagaaaccatcgtgagggagggcgacgtggtgcagcggatgctgttcatcgtgcggggccacctgcagtgcagccaggtgctgcggaacggcgcgacgagcagctgcacgctggggcctggcaacttcagcggcgacgagctgctgtcgtggtgcctgcgccgcccgttcctggaacgcctcccgacgtcgtcggcgacgctggtgacgctggagagcaccgaggtgttcggcctggacgccgccgacgtcaagtacgtcacgcagcacttccgctacaccttcaccaacgacaaggtgcgccgcagcgctcgctactactcgcccggctggcgtacctgggcggccgtcgccgttcagctggcctggaggaggtacaagcaccgcaagacgctctcatcgctctccttcatccgcccgcggcgcccgctgtcccgctgctcctcgctcggggaggagaagctccgcctgtacacggccatcctcacctcgcccaagcccaaccaggacgacgacttctagctagcttagctaggccgttccaggccggattctcttctcctcagcgaggagtatatatatcaaacaacatgcatttattagtagtattcattactcgcatgtcgcatgagacacagagccatgaccgtattttgcatccaagttccgatgtggaaagcacgaatttgaggtca

SEQ ID NO: 2243 - DNA, 3646 bp, Sorghum bicolor
cccaaaaaactaagttgaatccaacccaatacacccaacacccaaccaaacacagcctagaaagtccgattttgagtgcctagtcggatgaaatcacctcattcgcggagtggcgaaacacgcttggtaccttccactgctccactccactccacaagctcatatcctcgtcctcctctgctgttttcgcgtccacgggcaacccagctcaggcaagggcagatcatctgcgtatagcgctcgccatctcctgattttcccattgatcccctgaaatcgctgaccgacagtcctgtccgccatggacgccgagagaagctctgcgcgcagcaccaagcctcttgctgtgccgcccgctcgccactgctagacgcgacgacgtctgcgtttgccttcccggttcaactgccggttcccttgacggcctagtgcttgcgatccagcggggcgagacggcgagacgccggcgaggtagccactgtcaatttgacgacacgtggattgagagggagaagacaatgccaaaccaaaattgagagttgtatcgccatcgccatgtcaagcgacctctccgcacgctcgtcggcgctttcctcctccaccgcgtcgccttccgacgactcgcggcggaaggagcaaggacggcatgcgacgaccaacggcagcggcagcggtagcagcagcgggcgccgggggagccactggcggagccagcgcgtgcagtggctcggcggcgccggcgcggcgtgggcggtggacccgcgcgcgaggtgggtccgggactggaaccgcgcctacctcctggcgtgcgcggcggggctgatggtggacccgctcttcctgtacgccgtgtctctgagcggcccgctcatgtgcctcttcgtcgacggctggctcgccgccgccgtcaccgcgctgcgctgcgccgtggacgccatgcacgtgtggaacgtcgccacgcagctccgcctccgcgtcgcgcgcgccggcgccggcgccggcgcgacgccgggtagtaagcgcgtggccagcggcgcgggcgacgaggagcagcagcagcagcagggcgccgaggacgacgacgaggaggccgccgccgaggccgcgcgcaagctccccgaagagtccaggaaagggatgctgcttgacttcttcgtcatccttcccgtgatgcaggtggtggtgtgggtagcggcgccggcgatgatccgcgcggggttgacgacgccggtgatgacggtgatgctggtggcgttcctgctcgagtacctgcccaagatctaccacgcggcgcgcctgctccggcggacgcagcgccagtccggctacatcttcggcaccatctggtggggcatcgcgctcaacctcatggcctacttcgtcgccgcccatgctgtgggggcgtgctggtacctgctcggcgtgcagcgggccagcaagtgtctgaaagagcagtgcctccaggcggcggcggccggcgggtgcgcgcgcagcagcgcggtggcctgcgcggcgccgctgtactacggcggctccccttccacctccggtgtcatcggcagcggcgacaggctcgcctggtcccggaacgcgcaggcccggggcacgtgcctgtccagcggcggcggcggcggcgacaactaccagtacggcgcgtactcgtggacggtgatgctggtggcgaacccgagccgcgtggagcggatgctgctcccgatcttctggggcctcatgacgctcagcacgttcggcaacctggagagcacgacggagtgggtggagatcgtgttcaacatcgtcaccatcacgggcgggctcgtcctcgtcaccatgctcatcggcaacatcaaggtgttcctgaacgcgaccacgtccaagaagcaggccatgcacacgcggctccgcagcgtggagtggtggatgaagcgcaagaacctgccccggagcttccgcgcccgtgtgcgccagttcgagcgccagcggtgggccgccacccgcggcgtcgacgagtgccagatcgtgcgcgacctccccgagggactccgccgggacatcaagtaccacctctgcctcgacctcgtccgccaggtccccttcttccagcacatggacgacctcgtcctcgagaacatctgcgacagggtcaaatccctcatcttccccaagggagaaaccatcgtgagggagggagacgtggtgcagcggatgctgttcatcgtgaggggccacctgcagtgcagccaggtgctgcggaacggggcgacgagcagctgcacgctggggccaggcaacttcagcggcgacgagctgctgtcgtggtgcctgcggcggccgttcctggagcggctcccgacgtcgtcggcaacgctggtgacgctggagagcacggaggtgttcggactggacgccgccgacgtcaagtacgtgacgcagcacttccgctacaccttcaccaacgacaaggtgcgccgcagcgcgcgctactactcgccggggtggcgcacctgggcggccgtcgccgtgcagctggcatggcggaggtacaagcaccgcaagacgctctcgtcgctgtccttcatccgcccgcggcgaccgctgtcccgctgctcgtcgctcggggaggagaagctccgcctctacaccgccatcctcacctcgcccaagcccaaccaggacgacgacttctagttctagctaggccgttccaggccgccggcttcttcgtgacaacgacgacgacgtggatgacctgttactcgcacggcacgagacgcagagacaatatgcacgtatccaatgcaagttccgatggggaaaccacgaaatttcattcctccacagaaattcacttgtatgcaacgccgcaaggagcgtgcgcagccacttttatactttatatttctctcttgtaatatttattatatattactcccttcatcccatattataagtcgtttgacttttttaacaccacttatcttattcaaaaaaaaattatggaaacatagttaaattttaagttatttttgtagaacttttattaataaactaaaccacgacgaaagaagtgatattttgcataaattttcgagtgtcaaaaagttcaaatgtcttatagtttgagatggactgaatatgaaccttattatcttcagtcatgttaatccatatagattagctgcacgtgtaagcttgagtgtcgtcggagaacgttttttttttaatcttaccaaaaaataataaaaattggagctgtttcaaaaacgcttagagatgctctaatatgatttgacaaagcgcctcatgtagtgacactgccgccttagactatttcctaccctaatccaccggtgattctccttcaggccacatgacgaactgcaggaacagacttcgcagaagatgacgcttagaattgaagtgtaccggtcttcctacattgcctcttttaattgctcaacagcaaggcataacttgcaggtccggccaattatagccattaaattgttaagtttccatcatttctagatggtcggcgatgtcaggaagaaacatttgggtgagcttcctctttatttgatgtttcgttggagaaccaatgtccacaataggtgttttacaaccacttgagagaaaagtatggtca

SEQ ID NO: 2244 - DNA, 1570 bp, Sorghum bicolor
gctgctgcttccgcctccgccaactgaactactggagggatgctagcaaccgcaggaggccgcgcggtgttccacctccgcccgcgcccgccatggcgagcccctcctcctcccgccaccacgcacctctcccactcagcgcccgcgaggcgcgccgaccaccatcgcctccccctaggttttttatcaactatggaagtggggatttcatcagtctacttgggtcagcgggcgcactctgcaacatgtagctattctttggatgataggttacagggagagctagatgatatgaatggagaacagagaaagcaagagacggtcggtgcatttcagaaaataccaatggtgatgcctgcaactgatatactaatgtcagcacaaaggaaatctagaaatgtgccaccgactaagggtatagcaaatattgctaagcgtgaaaggaacaaaggtgcgaaacagcttgatgccttaatgaaagaactttctgtaccgttgagaacatacacagaaaacttcccaaagaggagagatttgcatccttatgagaggtctctcattgagttgacctttggggagggttattatgagcaggttctaggacgtgtagatactctgaggaaaaggattacttctgttggaaagcaacatgcttcagtctgtgctaagtcaacaacaaaacgtgaagcagaggagcgcctcactgagggcagaaagaagcttgaagaggctttccagcatgggaagcatgctgttgatgatttagtaaatgtagcaaaggctttgcgttctatgcctgttgttgatctgcatattccaacactatgtctagttggatcacccaatgtggggaagtcatcattagtccgcatattatcatctggaaaacctgaggtctgcagctacccattcacaacaagagggattctaatgggtcacattgtatccaatcacgaacgttttcaggttacggacactccaggactcctgacgaggcatgatgatgacagaaataacatagagagattgacacttgctgtcctttcttatctacctatcgctgtcctgtatgtgcacgatctatctgaagactgtggcacctcagtggccgatcagtacatcacatacaagcatattaaggacagatttggcgatcgcctatggcttgatgttatatccaaatgcgatcttttaggaaagaaagagcccataagctttcacgatgccgatgatgtagcacagtacagaagattggggccagaaggcgccctccgagtatctgtgcagagtgaaatcggcgtcaaagagctaaaggaaagagtgcatgagctactgacctctcagatggctcggatcaaagctagcaaggcggagcatgaaacacaggaaattaggactagtgttgtttactgaagtttgacaatgaacacccgaacatccatgctggaagtttgtataaacattccactaatgtcgatgatggtaacacgtttcatctgttgtcattttacccatctggaaagggttggtcaaatgctagtatgaatatgattgcccattttgtttcccc

SEQ ID NO: 2245 - DNA, 1621 bp, Zea mays
aagcgattattttccgtgggccgttgggtccgtggaacatatccgttgcagaagactacagattacagaagcgctcgctcgctgttgttgctgctgccaactgaagggatgcgagccacggccaccgcaggaggccgtgcggtgttccacctccaacacctccgcccgcgcccgccatggcgagctcttcctcctgctgccaccacgcacctctcccgctccgcgccagcgaggcgagccgaccaccgttgcctccccaaaggtttcttatcaactctagaaccgaggatttcaggagtctctttgtgtcggcgtgctcatgcaacatgtagctattctttggatgacaagttacagggagagctagatgatacacagggagaacagagaaagctagaaacagttggtgcgtttcagaaaataccaatggtgatgcctgcaactgatatactaatgtcagcacaaaggaaatctagaaacgtgccaccaacaaagggtatagcaaatattgctaagcgtgaaaggaacaaaggtgcgaaacagcttgatgccttaatgaaagaactttctgtaccgctgagaacatacacagaaaacttcccaaagaggagagatttgcatccttatgagaggtctctcattgagttgacttttggcgagggttattatgagcaggttctaggacgtgtagatactctcaggaaaaggattacttctgttggaaagcaacatgcttcagtctgtgctaagtcaacaacaaaacgtgaagcagaggagcgcctcactgagggcagaaagaaactcgaagaggctttccagcatgggaagcacgccattgatgatttagtaaatgtagcaaaggctttgcgttctatgcctgttgttgatctacatattccaacactatgtctagttggatcacccaatgtagggaagtcatctttagtccggatattatcatctggaaaacctgaggtctgcagctacccattcacaacaagagggattctaatgggtcacattgtatctaatcaggaacgttttcaggttacggacactccaggactcctgacaaggcatgatgatgacagaaataacatagagcgattgacactagctgtcctttcttatctacctatcgctgtcctgtatgtgcatgatctatccgaagactgtgggacctcagtggccgatcagtacatcacgtacaagcatattaaggacagattcggtgaccgcctatggcttgatgttatttccaaatgcgatcttttgggaaagaaagagcccataagttttcacgatgctgatgaagatgtagcacggtacagaagattggggccagaaggcgccctccaagtatctgtgcagaccgaaatcggcgtcaaacagcttaaggaaagagtgcatgagctgctgacctctcagatggctcggatcaaatctagcaaggcggagcatgaaacacatgaagtagggactagtgttgtttactgaagtttgacaataataaggattcgaatatcatgctgggtgtccgcgtaaacattcaatgtcgatgatggtaacacattccatcagttgtccttttgtccatttggaaagggtggtcaaaattgcc

SEQ ID NO: 2246 - DNA, 1330 bp, Pennisetum glaucum
cgccgcctccccaaaggctttttacatactctggagccgggggtttcggcagtctacttgtgtcggcgagtacactccacagcatgtagtgtttcattggacggccgattacagggagagttagatggtgcaaagggagaagtgcaaaaacatgaaacggttggtgcatttcaaaagataccaatggtgatgcctgcaactgatatacttatgtcagcacaaaggaaatcaagaaatgtgccaccgacaaagggtatagcaaatatcgctaagcgtgaaaggaacaaaggtgcgaaacaacttgatgccttaatgaaagaactttcagtaccactgagaacatacacagaaaacttccctaagaggagagatttgcatccttatgagaggtctctcattgagttgacttttggggagggttattatgagcaggttttaggacgagtcgatgctctcaggaaaaggattacttctgttggaaaggaacatgcttcagtgtgtgctaagtcaacaacaaaacgtgaagcagaggagcggctcactgagggcaaaaagagacttgaagaagttttccagtatggacagtatgccattgacgatttagtaatgtagcaaaggctttgcgttctatgcctgttgttgatctagatataccaacactatgtctagttgggtcacccaatgtagggaagtcatcattagtccgcatattatcatctggaaagcctgaggtctgcagctatccattcacgacaagaggggttctaatgggtcacatagtatccaatcatgagcgttttcaggttacggacactccaggactacttacgaggcatgatgatgacagaaataacatagagagattgacacttgctgtcctgtcttatctaccgatcgctgtcctgtatgttcacgatctatccgaagactgtggaacctcagtggctgatcagtacaccacgtacaagcatataaaagaaaggttcggcgatcgcctatggattgatgttatatccaaatgcgatcttttgggcaagaaagaacctataacctttgacgacactgatgaagaagtggcacagtacagaagattcggtccagaaggcgccctcccagtatctgtgcagagtgaaatcggcatcaaagagctaaaagaaagagtgcatcagcttctgacctcccaaatggctcggatcaaagatgacaaggcggagcatgaaacacaggaagctcgcattagtgttccttcgcggagatagagaatgaatacctgtacgtttatgtttgaagtttgtgtaatttgaactcatgtggaccgtgacggatttca

SEQ ID NO: 2247 - DNA, 2319 bp, Sorghum bicolor
gaatttggtagcatggccataccagcttcatgctagcagcattactgcattagctggctgaacacggacatgtacagggggcctgcccaacgatagtatcacgaaatccaaggtaaatatgttattgtagatatatataaatatagattatgtgctaaaacatgtaagaaagaaaaaaagtaatgaaaaagaaagaagaaaagagatggtacgggctttttatttagcggcccatctaaaaaagcccacgctatcaggctgtgtgcctgagcgccgccatttcttatcttcctcgcagcgccggcgctccatcatctgctccctccccgactcgcgctcggcatgaaggcgacgctccatcttctgctccgtcccccactcgcgcttggcatggaggcgacggaggcggcgctcaggctcgggctctcagcgacggcggggcagtcccagtctcggcggcggcgtcagcggctcctcctcccgcctctcgccagtcgcctcgcgacatcgcctccgtcctcagcacaccggcgggcgaccctgcgttctttatcaactctggaaccggggatttcatcagtctacctgtgtcagcgggcgcactctgcaacatatagctatacgctggatgacaggttacagggagagctagatgatttcaatggagaacagaaaaagcaagagacagtcggtgcgtttcagaaaataccaatggtgatgcctgcaactgatatactaatgtcagcacaaaggaaatctagaaatgtgccaccaacaaagggtatagcaaatatagctaagcgtgaaaggaacaaaggtgcaaaacagcttgatgccttaatgaaagaactttctgtaccgctgagaacatacacagaaaacttcccaaagaggagagatttgcatccttatgagaggtctctcattgagttgacttttggggagggttattatgagcaggttctaggacgtgtggatgctctcaggaaaaggattacctctgttggaaagcaacatgcttcagtctgtgctaagtcaacaacaaagcgtgaagcagaggagcgcctcaccgagggcagaaagaaacttgaagagtctttccagcatgggaagcatgccattgatgatttagtaaatgttgcaaaggctttgcgttctatgcctgttgttgatctacatattccgacactatgtctagttggatcacccaatgtggggaagtcatcattagtccgcatattatcatctggaaaacctgaggtctgcagctacccattcacaacaagagggattttaatgggtcacattgtatccaatcacgaacgttttcaggttacagacactccaggactcctgacgaggcatgatgatgacagaaataacatagagagattgacacttgctgttctttcatatctacctattgctgtactgtatgtgcacgatctatctgaagactgtgggacctcagtggccgatcagtacatcacgtacaagcatattaaggacagattcggtgaccgcctatggcttgatgttatatccaaatgcgatcttttgggaaagaaagagcccataagctttagtgatgctgatgatgatgtagcacagcacagaagattggggccagaaggcgccctccgagtttctgtgcagagcgaaatcggcgtcaaagagctaaaggaaagagtgcatgagctactgacctctcagatggctcggatcaaagctagcaaggcggagcatgaaacacaggaaatagggactagtgtactgtagtttactgaagtttgacaatgagcattcgaacatccatgctggatgtttgtgttaacattccactaatgtcgatgatagtaacgcatttcagccgagccatttcgaacatccactaatttggatgtttgtgtacacattccactaattcgaacacccactattctgttgtcatttttcccatttggaccaagggtgttcaattgttggtatgaatgtgttgcccattttgtttccccctaccgtggccgttatccgttctttagtaggctacaccattcgtcccagaatgatcaccattcttgttttctccactgcagaaagattatcattcttgtttttcaagaaactaatctcgggtttaatcacataaatatgcgagcaatgcatatgctgtgatggttgtggaatcggagacctggttgtccggaggcgtcaacgatgcaggcgacactggttcatcatcctcctcgccgctcctctgttcagcgccgcagcgagaggagccgttctaaatcgatcaaagaaaaacaaaaaaggagc

SEQ ID NO: 2248 - DNA, 1377 bp, Panicum virgatum
aggttttttaccaactgtggaactgggggtttcagcagtctacttgtgtcggcgagtacactccccaacatgtagtgttttagcggaggacagattgcagggggagttagatggtgcaaagggagaagtgagaaaacatgaaactgttggtgcatttcaaaagataccaatggtgatgcctgctactgatatacttatgtcggcacaaaggaaatcaagaaatgtgccacctacaaagggtatagcaaatattgctaagcgtgaaaggaacaaaggtgcgaaacaacttgatgccttaatgaaagaactttcagtaccactgagaacatacactgaaaacttccctaagaggagagatttgcatccttatgagaggtctctcattgagttgacttttggggagggttattatgagcaggttctaggacgagttgatgctctcaggaaaaagattacttctgttggaaagcagcatgcttcagtgtgtgctaagtcaacaacaaaatgtgaagcagaggagcgcctcactgagggaagaaagagacttgaagaagctttccagcatggaaagcatgctattgatgacttagtaaacatagcaaaggctttacgttctatgcctgttgttgatctacatataccgacactatgtctagttggatcacctaatgtggggaagtcatcattagtccgcatattatcatctggaaaacctgaggtctgcagctatccattcacaacaagagggattctgatgggtcacattgtatccaatcatgagcgttttcaggttacggacactccaggactacttacaaggcatgatgatgatagaaataacatagagagactgacacttgctgtcctgtcttatctaccgatcgctgtcctgtatgttcatgatctatcagaagactgtggaacctcagtggctgatcagtacatcacgtacaagcatataaaggaaaggttcggcgatcgcctatggatagatgttatatccaaatgcgaccttttgggcaagaaagcgcccataagctctgacgatgctgatgaagaagtggcacaatacagaagattcggcccagaaggcaccctccgagtatctgtgcagagtgaaatcggcgtcaaagagctaaaagaaagagtgcatcagctactgacctcccaaatggctcggatcaaagctgacaaggcggagcatgaaacacagaaagctcgcattagtgttccttgaagttagagaacgaatacttgcacattcacgttcgatgtttatgtaaattgtccactcataacggatttcaacatgttctgcaaatttggccttttttcaggaaaggaggtcaattgtgttagtatggctcatttatctgt

SEQ ID NO: 2249 - DNA, 1743 bp, Festuca arundinacea
atccgaaaccccgactatcccttcgcggcaaccaaagcgaagagaacgagagatgcgagcagcagcaggcggccgcgccttccagttccacctcctctgcccgcgccggccatggagacctccttcttctcccagcgccgcaaccgcacctctctccaactctactcacgcggggtgcctccaccgacgtcacccctccagaggttttttgccaagtctggagccgggagtttctacagtctacatgtgccgccgggtccattctgcaacatctagtgtttccttagatgacaggtcacaagaaggattaacagatggttcaaatggagatattgtgcacaagagtgagatggttggtgcatttcaaaaaattccgatggtgatgcctgcaactgatatacttatgtcagcgcaaaggaaatcaagaaatgtaccacccacaaagggtataacaaacattgccaagcgtgaacggaacaaaggagcaaaacaacttgatgccttaatgaaagaactttctgtgccactgagaacgtacacggagaactttcctaggaggagagatttgcatccttatgagagatctctaattgagttgacttttggggaggggtattatgaaaaggtacttggacgagtggatgctctcagaaaaaagataaattctgttgggaagcaacatgcttctgtctgtgccaagtcattgacgaagcgtgaagcagaggagcgactctgtgagggccggaaggaacttgaggaagttttccagcgtggtcagcatgcaattgaagatttaataaatgttgcaaaggctttgcgttctatgccagttgttgatccacatataccaacgctttgtcttgttggatcacccaacgtggggaaatcatcattagttcgcatattatcaaccggaaaacccgaggtctgcagctaccctttcacaacaagaggcattctaatgggtcatattgtatccaatcatgaacgttttcaggttactgacactccaggacttcttacgagacatgatgatgacaggaataacatcgagaaattgacactcgctgtcctttcttacttaccaattgctgtcctgtatgttcacgatctatctgaagactgtgggactaaggtggctgatcagtacatcacatacaagcatataaaggaacgattcggtgatcgcctctggatcaacgtcatatccaaatgcgatcttctggacaaggccgtaccctccagctttgactatgatgacgacgaagtaaggagatacagaatgtttggaccagaagacgccatccgagtatctgtgcagagccaaattggcacagaagagctaaaggaaagagtgcatcatctgctaacctctcagatggctcggatcaaagatggcaagagcgaggatgaacttcagggaacagatagcaccgtccgtcggttgacttagaggcacaattgccattttgagtgtttatgtaagaaaacctgcactcgatgctaacggttgatatctctaagcgaccgcaattgtgtaaacggagagcaagggttggtaaggtttgacatcgcttctgcaattttgtaacaggggtacaagtgttggtttggcatcggttacgcataaagctctggattaacttcagtattttttatagagaaaaatcactgctcgcatatgaaaagtctatttttacctgcatatgataagagtcagagtatggcaaaaaaaaaaaaaaa

SEQ ID NO: 2250 - DNA, 1569 bp, Pennisetum glaucum
cggagtcgctgcagcagcagcttgcgtgcgtccgggcgcggggaggacatgagctgcctgggctggttcaagcggaggtcgaggagcgccggcgggtcgtcggggaagcggggggcgtcggcgcctccgtcgggcccggcgaccaccaccacgacgacggtgtccggggtgagcacgagccggtcggactcctcctccggcgcggtgcgtccggtgagcaagtcggcggggtcggccgcctcgtcgcagtcgcaggtgagtatctcctcgctgtacgaggagcggggccacggacagctgcgggtgttcgactacgaggagctccaggccgccacggccgagttcagccgcgcgcagaagctcggcgagggcggcttcggcagcgtctacaagggcttcgtccgcgcggccgacggcaagggggaccgcatccccgtcgccgtcaagaagctcaaccagcgcggcctgcagggacataagcaatggttggcagaagtacagtttcttggtgttctggagcacccaaatcttgtaaagctacttggatattgtgctgttgatagtgaaagagggccacaaagattgttggtctacgagtttatgccgaacaagagcttggaagatcatttgttcaggcgagctaatcctcctctgtcatggaacggaaggcttcaggttatcctgggtgctgcagaaggattggcttaccttcatgaaggggtagaagttcaggtgatctaccgggacttcaagacctcgaacattttactggacaaggacttcagagcaaagctgtcagacttcgggctagccagggagggaccaactggagcaaacactcacgtctcaactgcggtcgtcgggacgcacgggtacgcggcgccagagtacatcgactcggggcacctgacggcgaagagcgacgtgtggagcttcggcgtggtgctgtacgagatcctgacggggcggcggtcgctggaccggaacaggccggcgtccgagcagaagctgctggagtgggtgacccagttcccagcggacagccgcaacttccggatgatcatggaccccaggctccgcggcgagtactcggtgaaggccgcgcgggagatcgctaagctggccgacagctgcctgctcaagaatgccaaggagcggcccaccatgagcgaggtggtcgaggtgctcaggcgtgctgtgcaggcggccgagccggatggcagggcacccggtgctggcgccgtcagggggaagagagccgacgcggccgcgccccccaggagatgattgctacagagtcgtcgccgacaaaggatctgattcgccgagtcaaaattaggcaggaggggagactgagatgctatcatcagacgtgacaggaagcacagcacacaaaagagagttagttttagggtgtatggtgtattggtgcgggtgagtggtgggggcttacaaatactatttgggcacatcattatttagacaacttgtgtacatagaagagacggctttggcgctttgaagttttcctttcccttttcgaaagtgagaattttgaaagaattttgc

SEQ ID NO: 2251 - DNA, 2412 bp, Panicum virgatum
cggcccctgaacgggccgccccaactcccagctcgtcgcgtccggatgtcccctctccccagagccgtcgccatccatgcgtaggtatgacccgtccgcgcgaccacaccgcgtcgccccgcaaccggacgtgacgagccaccagaaaccccccgcacccgcgaggccaggacgcgctgcacaaaagggggccgaggacgcgcgccccgctcgctctcccgcacggcaccaccaccgctactccacaccacaccagctgcgcccccgcgcggacgcgccgcgccccgtgccggggctttcccatcctttccacgctgtcgccgcgcgctctctcctgcgctgctccgtccgaccgtccccccattccggcgttcacaccgcctgctcagcctcgcgtcttacaaagaggcgtgggtgcgcaccctccgattgcccctgagaggcggcacggcggagggagcggcggcggcggtgcgagaagctgctcgtgtgtcgtgtcggcgactcgagggggggggggggacatgagctgcctgggctggttcaagcggaggtcgaggagcgacggggcgtcgtcggggaagcgcggggcgtcggcgtcggcgtcgtccggcccggcgaccgccaccgcgacgaccaccacggtgtcgggggtgagcacgagccggtcggacgactccggcgcggtgcggccggtgagcaagtcggcggggtcggccgcctcgtcgcagtcgcagcggagcatctcgtcgctgtacgaggagcggggccacggccagctgcgggtgttcgactaccaggagctccaggccgccaccgccgacttcggccgcgcgcagaagctcggcgagggcggcttcggcagcgtctacaagggcttcgtccgcgcggccgacggcaggggggaccgcatccccgtcgccgtcaagaagctcaaccagcgcggcctgcagggacataagcagtggttggcagaagtacaatttcttggtgttctggagcacccaaatcttgtaaagttacttggatattgtgctgttgactccgaaagaggggcacaaagattgttggtctatgagtttatgccgaacaagagcttggaagaccacttgttcaggcgagctaatcctcctctatcgtggaacaaaaggcttcaggttatcttgggtgctgcagaaggattggcctacctgcatcagggggtagaagtccaggtaatctaccgggacttcaagacgtcgaacattttactggacaaggacttcagagccaagctgtcagacttcgggctagcccgggaaggaccaactggagcaaacacccacgtctcaactgcggtcgtcgggacgcaagggtacgcggcgccggagtacgtcgactcggggcacctgacggcgaagagcgacgtgttcagcttcggcgtggtgctgtacgagatcctgacggggcggcggtccctggaccgcaacaagccggcggcggagcagaagatgctggagtgggtggcccagttcccgccggacagccgcaacttccggatgatcatggaccccaggctccgcggcgagtactcggccaaggccgcgcgggagatcgccaagctggccgacagctgcctgctcaagaccgccaaggagcggcccaccatgggcgaggtggtcgaggtgctccggcgcgccgtgcaggcggccgagccggatagccggtcggcacccggttccggcgccgtcagggggaagagaggcgacgcggccgcgccgtccaggaggtgattgctatttctatgctgctacggtgtcatcgccggcaacggcaaaggctctggttggcttgaggccatgtttagatgaaacacaaattttttttcgatggaatcttgctaatttgaagtactaaatgaagtctatttacaaaactttttgcacagatgggttgtaaatcacgagaagaatctaatgatactaattaatccatgattaatccataattagcggatggttactgtagcatcattgttgcaaatcatgaattaagtaggctcattagatttgtctcgcaatttacaacccatccatacaaaaagttttataaatatacttcattgagtacttcatgcatgtgtacaaacattcgatgtgattttttttttttgcgtttactagttgtgatctaaacagccctgagactcgaagttggtcatggaagggagactgaaatgcggctgtcgtcagacatgacactgacagcacacacagtgttagttttgggtgtgtgtcggtgagtggcggggggcttacaaatatttttcgggcacattacttggacaacttgtgtacatagagacgattaggcggattggagttttcctttccctttcgaaagtgagattttagaagaattttgcactggctc

SEQ ID NO: 2252 - DNA, 2567 bp, Sorghum bicolor
cttccggtccggcatccgcgcaaaaactgagcgaggaccgcttcgtgcgatatataacttccacgaaaccccctctgagagttggcaacagaagctatcgcgagagagcagcagccaaccggcatcccggaccgagagcacgatacgaatagctccgctcccccgtccccgagcggacaggcacgcccctgacacgtccacgtccaggtccagccgagagccgtccccatcccaacccacccgtcgtccgtccacaccgcgttgccccgcaaccggacgcaacgagccagcagaaaacaccccaccccacaccacccccgcacggccgcggtacagaagcgggccgacgacgcgccctcctccagtcctccctcccgcacggccacggccacccaacccagctgcgcgcgacgcaagtaccgagccgcgggccgtgccccacctttctgcgctgtcgcgcgctctcttccccccccccccccccccccccccctcctcccgacgttcacactctcagccccacgtcgcgtcttacaagaggcgtcgcagccttcgattccccgagaggcggcacggcacggcacgctcttgtaggtaacggcggcgcgagaagctagctgctcgtcttgcggttgcggagctgccgtcatagcagcctgtgccggggtgcgggggacatgagctgcctgggctggttcaagcggcggaggtccaggagcggggggtcgtcgacgtcgacgtcggggaagcgaggggcgtcggcgtcggcgccggtgtcggtgtctggccccgcgaccacgatgaccaccacgacgatggcgtcggcggtgagcacgagccggtccgacgactccggcgcggtgcggccggtgagcaagtcggcgggctcgtcgtcgcaggcgtcgcagcggagcatctcgtcgctgtacgaggagcggggccacggccagctccgggtgttcgactacgaggagctccagggcgccaccgccgagttcagccgcgcgcagaagctcggcgagggcggcttcggcagcgtctacaagggcttcatccgcgccgccgacggcaagggcgaccgcgtccccgtcgccgtcaagaagctcaaccagcgcagcatgcagggacataagcaatggttggcagaagtacagttccttggtgttctggagcacccaaatcttgtaaagctacttggatattgtgctgttgatagcgaaagagggccacaaagattattggtctacgagtttatgcccaataagagcttggaagaccacttgttcaggcgagctaatcctcctctatcgtggaacaaaaggcttcaggttatcttgggagctgctgaaggattggcttacctgcatgaaggggtagaagttcaggtgatctaccgggacttcaaaacgtccaacattttactggacaaggacttcagagcaaagctatcggacttcggcctagccagggagggtccaactggagaaaacactcacgtctcgactgcggtcgtcgggacgcacgggtacgccgcgccggagtacatggaatcggggcacctgacggcgaagagcgacgtgtggagcttcggcgtggtgctgtacgagatcctgacggggcggcggtcgctggaccggaacaagccggcggcggagcagaagctgctggagtgggtggtccagttcccgccggacagccgcaacttccggatgatcatggaccccaggctccgcggggagtactcggtgaaggccgcccgggagatcgccaagctggccgacagctgcctgctcaagaacgccaaggagcggcccaccatgagcgaggtggtcgaggtcctcaggcgggccgtgcaggcgcacgccgagcctgacagccggactcccggcggccccggcgccaaggggaagaaatcatccgacgctgccacaccgtccaggcggtgattggtacgtgtcgtcaccggtgaaggcgctgttgccttgctccgtatttctgaaattggttagtcttattcgtgagttgtgacagcacaaaaggagtgttactcttgaggctacgtataattttttttggacacattactttagacgacttgtacatagagaggagttggcggattgaacttggttcatagctttcgaaagtgagcattttgaaaaattataggatttcagaagtgggcatgtgtgaaaagaaatttgcgctgggtctacgaaaagatctgttttagcataatcgagtgaaatcagacatgagcgcacaaagtttcagaaagcaactgacaataatttcgtcaagcatgtattaacagaaaacataatttatagaaatagcccgcaattttgactattgaatttcaatgggtccttgttaattttctgcttacattaattttcataaattgtctggtcttttatgagaaactccgtcttgtgtttgctattatttgtatggtgtccacctcggtcgttttttttttattcactgcttaagtcaaagattcagattaaacatgcatgaaaaaatgaaggcaaaaggcaaaaattggcagtgcggaacccgtc

SEQ ID NO: 2253 - DNA, 2282 bp, Zea mays
gcagtcgcgaggccccagccaaccggcggcgtgccgagagcagagcatgatacgtccccgttcctgacagacgtagacgctggacctgttgcgtactcggctactcgcgtgcactccagcccagatgagaggcagagccgtccccatccagccgtatgacactgaccccgtccacaccgcgttgccccgcaaccggacgcgacgaaccagcagaaaaccccgtccccggccccccgcacggccgcggtccagaagcgggccctccactacaccccctgctctgctctctctcgcaacagccccacgtcttacaaccgatcccgagactacacggcacgctcgtctcctggcgcggctgtagcctgtagggaacggcgggtgcgggtgacatgagctgcttgggctggttcaagcggaggtcgaggagcggaggatcggcggcgaagcgaggagcgtcggcgccggtgtcggcgtcgggccccgcgaccacaacgacgaccacgacgacggccacgacagcgtcggcggtgagcacgagccggtcggacgactcgggcgcggcgcggccggcgagcaagtcggcggggtcggccggctcgtcgtcgcagtcgcaccggagcatctcctcgctgtacgaggagcggggccacggccagctgcgggtgttcggctacgaggagctccagggcgccacggccgacttcagccgcgcgcagaagctcggcgagggcggcttcggcagcgtctacaagggcttcatccgcggcgccgacggcaagggggaccgcgtccccgtcgccgtcaagaagctcaaccagcgcggtatgcagggacataagcaatggttggcagaagtacagtttcttggtgttctggagcacccaaatctcgtaaagctacttggatattgcgctgttgatagcgaacgaggggcacaaagattgctagtctacgagtttatgcccaataagagcctggaagaccacttgttcaggcgagctaatcctcctatatcatggaacacaaggcttcaggttatcttgggggccgcagaaggattggcttacctgcatgaaggggtggaagttcaggtaatctaccgggacttcaaaacgtccaacgttctattggacaaggacttcagagcaaagctatcagacttcggcctagccagggaggggccaactggagcaaacactcacgtctcgactgcggtcgtcgggacgcacgggtacgctgcgccggagtacatggacacggggcacctgacggcgaagagcgacgtgtggagcttcggcgtggtgctctacgagatcctgacgggacggcggtcgctggaccggaacagaccggcggcggagcagaagctgctggagtgggtggcccagttcccgccggacagccgcaacttccggatgatcatggaccccaggctccgcggcgagtactcggcgaaggccgcccgggagatcgccaagctggccgacagctgcctgctcaagaacgccaaggagcggcccaccatgagcgaggtggtcgaggtcctcaggcgggccgtgcaggcgcacgccgagcctgacggccggactcccggccccggcgccagggggaagaaagccgccgccgccgccgccgccgccgcgccgtccaggcggtgatggctacatgtcgtcaccggtaaaggcgcgctgttgccttatttctgagaccattgtttggtcagtcctagccgtgactcggtgagttgtgattgtgacagcacaaaaggaatgtttatgcttgggtacattcttggacacattgcttagacgacttgtgtacatatagatgagttggcggattgaactttgttagctttcgaaagtgagcattttgaaagaaaaaaaatatataggtctcaaggagtcaaggatttcgaaagtgggcaactgagaagatgttgcgctggctctacaaaaggatcttgttttggcagtatccagtgaaaccagacacgagcgcacaaattttcagaaaccagctggcaagaactccgtcaagcataatttataaaaatagcgcactgttttgattttaatgggttttttgttcattttctacttatataatttttcataagcgttacgtcttgtgttcgttgccattagtatcatcttcaattcgttcgactttttttttaaaaatttattacactgccaagaacctggagactcaagtcaaaggttcagcttaaagatgcgttaaaaatcaagcctaaggggaaattggcagtgctgaacctg

SEQ ID NO: 2254 - DNA, 2424 bp, Zea mays
gccacgatcccgctcctgcagagacgccgctggagctgggcccgtcgcgttcggcaaggaggagagccgtccccatccggccgtgtgaccccacccacccgtgacccgtccacaccgcgttgccccgcaaccggacgcgacgagccagcagaaaacaccccaccccgccccccccgcacggccacccaactcaagtacgagccgcgggccgtgtccacctttctgttcagccttgctgtcttgtcgcgcgctctcttcctctcccgcggccccgccccacagctctgctcccccgtccttccgacgttcacactgccttctcttctcagcccccacgtcgcgtcttacaagaggcatcgcagcctccgattccccgagaggcggcacgtcggcacggcacgctcttctcctagcgcgggtggtgtgggtaaccgcggcgcgagaagctgctcgatcttgcagctcgtgccgggcgccgggggtgtgcggtgcgggtgctgcggacatgagctgcctgtgctggttcaagcggaggtccaggaaagggcgatcgtcgtcgtcggggaagcgaggggcgtcgtcgacggcgacggtgtcggtgtcgggccccgcgaccgcgaccgcgaccacgaccacgacggcgtcggcggagagcacgagccggtcggacgactcgggcgcggtgcggccggtgagcaagtcggcgggctcgtcgcagtcgcagcggagcatctcgtcgctctacgaggagcggggccacggccagctgcgcgtgttcgactacgacgagctccagggcgccacggccgagttcggccgcgcgcagaagctcggcgagggcggcttcggcagcgtctacaagggcttcatccgcgccgccgacggcaagggggaccgcgtccccgtcgccgtcaagaagctcaaccagcgtggcatgcagggacataagcagtggctggcagaagtacagttccttggtgttctggagcacccaaatcttgtaaagctacttggatattgtgctgttgatagcgaaagaggggcacagagattgttggtctacgagttcatgcccaataagagcttggaagaccacttgttcaggcgagctaatcctcctctaccgtggaacagaaggcttcaggttatcttgggagctgcagaaggattggcgtacctgcatgaaggggaagttcaggtgatctaccgggacttcaaaacgtccaacgttttactggacaaggacttcagagcaaagctatcagacttcggcctagccagggaggggccaactggagcaaacactcacgtctcgactgcggtcgtcgggacgcaagggtacgccgcaccggagtacatggacacggggcacctgacgacgaagagcgacgtgtggagcttcggcgtggtgctttacgagatcctgacggggcggcggtcgctggaccggaacaggccggcggcggagcagaagctgctggagtgggtggcccagttcccgccggacagccgcaactttcggatgatcatggaccccaggctccgcggcgagtactcggtgaaggccgcccgggagatcgccaagctggccgacagctgcctgctcaagaacgccaaggagcgccccaccatgagcgaggtggtcgaggtcctcggccgggccgtgcaggcgcacgccgagcctgacagcggggctcccggccccggcgccaaggggaagaagaccgacgctgccacaccgtcccggcggcggcgtgactgactgctacatgtcgtcatcggtaaaggcgcttaccgagtccattggttagtctagtcgtgagctgtgacagcacaaaaggagtgagtgttgtgcttggggccctacatataattttttttggacatacagcattacttagacgtacgtagagacgagctggcggattgaactttgtgtagctttcgaaagtgagcattttgaaaagaaaaaaaagagtagaggtctcaagggtttcgaaagggggcatttcaaaagattttgcgctggctctacaaaaggatctgttttagcatagccgagtgaaatcagagtgtcagacgcgagcgcacagatttttcaggaagcagctggcaagagcttcgtcaagcatgtattaacagaaaacataatttgtataaaaaaatagcgcacaaatttgattgtattggatttcgctgggatcttgttgattgcataaattatttggtcttttacgagcactccgtcttgtgtgtgctattaggccattctcaataaaaattccatgacattaattagtatgccaatttttaataacatgacactgtatttattatgaaatagataaaactagtttcgtcggcgtaaaactatgttaaaccgttttctaagtattggaaattacatgaaactatcatagagca

SEQ ID NO: 2255 - DNA, 1994 bp, Oryza sativa
gaaataaatcttggcgagctttctgattctccctttgctattgctaccttccgcggttcacagttcacactgcctctgcctcctcttcttcgcctacaaaaggattttggaccgcacacggttcgcgtgcgtgcgtgcgtgcttgcttgctgcaagaaatgagctgcttgggttggttcaagaagcggaggtcgtccaagagcaaggaatcgtcggggaggcggggctcgacgacgacgacggtgtcggcggtgagcacgagcaggtcggacgactccggggcggtgaggccggcgagcaagtcgacggggtcgacgtcgtcgcaccggagcatctcgtcgctgtacgaggagcgcggccacggccagctccgggacttcgactacgacgagctccaggccgccaccaacggcttcagccgcgcccagaagctcggcgagggcggcttcggcagcgtctacaagggcttcgtccgctcctcccccgccgacggcaaggccgccgatcgcctcgccgtcgccgtcaagtgcctcaaccagcggggtctccagggacataagcagtggttggcggaagtacagttccttggggttcttgagcacccaaaccttgtaaagcttcttggatattgtgccgttgatggtgaaagggggccacaaagattattggtgtatgagtatatgcctaataagagcctggaagatcacttattcgtccgagcttatcctcctctctcatggaatagaaggcttcaaataatcttgggtgctgcagaaggattagcttatctgcatgaagggcaagttcaggtaatctaccgggacttcaaagcatctaacattttgttggacaaagacttcagagcaaagctgtcggacttcgggctagcaagggagggaccaacaggagcaaacactcacgtctcaacagcggtggttgggacgcacgggtacgcggcgccggactacatagagacggggcacctgacggtgaagagcgacgtgtggagcttcggggtggtgctgtacgagatcctgacggggcggcggacgctggaccgccaccggccgcagggggagcagaagctgctggagtgggtcgcccagttcgcccccgacagccgcaacttccgcatgatcatggatcccaggctccgcggcgagtactccgtcaaggccgcccgcgacatcgccaagctcgccgagtcctgcctcctcaagaacgccaaggagcgccccaccatgtccgaggtcgtcgacgtcctccgccgcgccgtccagtcgcagcccgaccctcctcctccccccgccgccgccgccgccgcctccggcaaggggaagagggtcgacgtcgcgccgcagccggcgaggaggaggtgaggttgcactctgctgctatcatcgatcacggcatgaatgaagaaagaaaagtacagaaagagagacacagagacgagttggtggattcttggcgtttttgttttttgttttcctttctattttttaggcttatttaggatgaggatagtagtatgagaatacatttgatttgattggtagataactactccctccgtcccataatataagggattttgagtttttacttgcaacatttgaccactcgtcttatttaaatttttttaaaattattatttattttttattatatacagtactttaagcataactttttattttttatatttataaaaaaattaaataagacgagtgatcaaacgatacaaacaaaaactcaaaattccttatattataggacggagggattagatttcattgaaagtaggcgtgcttagggcagtgttacgatttcctttcctttttttccccctttcttttgaactcgatgcagcatgaagcccacgggcaccagcagccatgagttgggccgacacgtgggctgtaagcccatagggcttaccaatactgcaggctgcgaaagctagaagtcgagggcccaagctttggtctgtt

SEQ ID NO: 2256 - DNA, 1078 bp, Panicum virgatum
accaccgccgcccacggaatgcagggacccgtttgtaaaccaaatcattgcgaatgaaaagaagcacatgggcttagatgcaaaaggtgcccggctttcctcccggctccctccaccagtccgtccccactccgggcccccaatacaaaacgctcgagagtccgtaaccctaaacccccaaaccctcctcgcctcctccgtccatccatccatccaaatcctcggggcgagcgagcgcggagagagagggattcgcaacgagatggcggcggtggctagggttttccgcgggtcccggttcctcatgtccccggcgccgggcgcggctgcggcggcgggggcgaagaaggcggcggcgccacaggtcaccaaggcggacgcgacggcggcgaaggagaagcgcgggatcttgaagccggtgccggtctccgaggagatgcgcaggttcaccggcggcaagcccgaggtcgcccgctccgaggccgtcaagctcatctgggcccacatcaaggccaacggcctccagaacccggcgaaaaaaacagagatcaactgtgatgccacactcaaaagcttgtttggtgggagggacaagattgggatgctggagatctcgaaactactgaaccctcacttcctgaagaactaacagaagcagcagatggcgccaatgatggtgctttcgtctaagactttattggatggcctcttttgtgatccatgttaagtccagctccccactaggtagttgagccaaagttgtgtcatggtgtcaagacttcagactttgtgttcagcagttgggtttggggtgtgatgcatgtaaaaaggattcccagtgttattgctgctcttgtgatcctgtgagggcaccttcatgcaaattgatgtgggaaatgttagtctgctgatggcacatcttagtcgcatgtttacgcccgccttattgcagttaaatgatttgtgatcaagcattgtggccacagtttgcagttcgttttacatgcatgttaaccctgatgtcagtgaccatgtctcatgtcatcataaaacagagggcctgtgctgatatatcttt

SEQ ID NO: 2257 - DNA, 1598 bp, Panicum virgatum
agttcttaattctgtattcttaatgaggtctgcttgtcctctcttaactgcctttcacccagaattgacatcagattcccgatggcatcgcttcttcttggacatggataaagaatcccagacaaaggccttggccgcgctatcattatcatcatcttcaagagacacagaagacatgccaaagaataagccgcttgatctgcccatttttgagtaacactagaaagaaataaggtcaaaggattgaagataggaagatgaagaaactgaccatatttttaccacttagctggctataaaagaagaaacacctgggcatctgttatgctaagtggaaatgtgtaatctctggtaccaattgtaacgaccaaaataatgacagtgtgtgttgcacgcaattcttcagataaagcaaatgttgttaaaattgtaaccttgctgtgcaaagaagctgctcagttgaatatgtggtattcgcctccattttgtgccacattcattggcgtctcttccttttttcccctggcctcactctcactaaacggctggcaaattgaatgcaaatgtttttgccaaaagaaactgatatcagaacaaataagtgaggtggtgaaatgatcgtgcaagcaattcaaacaggtagacccgtttgtaaaataaaccagtgcggatcaaaagaaacacaaggtcttagatgcaaaaggtgcccggctttcctccctcccacacggcaacacccagtccactccgggccccaaatacaaaaccccccggcccaaaccctcctcgcctcctccgtccatccatccaaatcctcggggcgagcgcgcgcggagagagagggattcccacggcgatggcggcggtagctagggttttccgcgggtccaggttcctcatgtccccggcgccgggcgcggcggcggcagcgggggcgaagaaagcggcggcgccaaaggtcaccaaggccgacgcgacggcggcgaaggagaagcgcgggatcatgaagccggtgccggtctccgaggagctgagcaggttcgccggtggcgcgcccgagctcgcccgctcccaggttgtcaagctcatctgggcccacatcaaggccaacggcctccagaacccggcgaagaaaaaagagatcaactgtgatgccgcactgaaaagcttgtttggtgggagggacaaggttgggatgctggagatcccgaagctactgaaccctcacttcatgaagaactaacagaagcagcagatggcatcaacgatggagctttcatcttaagtctttattggatggctcccagtaggtagttaagccaaagttgtgtgatgacgtcaagaattcatacttgtgttcatctgttgggtttggggcgtgatgcatgtaaaaaggattcccagtgttatcgctactcttgtgatgtgggaaatgtttgtctgctgatgacacatcgtagtcgaatgtttatgcctctcttattgcagtgaaaatgtgaaatgatttgtgatcaaacattgtggccacagtttgctgctccttttacatgcatgttaaccctgatgttattaaccatgttaatgctcatgtcatcata

SEQ ID NO: 2258 - DNA, 895 bp, Pennisetum glaucum
accccacccaaatcaaaacggtcgagagtcctccgtaaccctaaaaccccccaaaaccctggccgcctcctccgtccacccatcgcacccgaatcctcgaggcgagcgcgcgcggagagagaagattcccacggcgatggcggcggtggctaggggtttccgcgggtcccggttcctcatgtcccctgcggccggcgcggcggcggcgggggcgaagaaggcggcggcgcccaaggtcaccaaggcggacgcgacggcggcgaaggagaagcgcgggatcatgaagcccgtcccggtctccgaggagatgagcaggttcgccggcggcgcgaccgagctcgcccgccccgaggccgtcaagctcgtctgggcccacatcaaggctaacgccctccagaaccccacaaagaaaacggagatcaactgtgatgccacgctcaaaagcttgtttggtgggagggatacggttgggatgtttgagatcgggaagctaatgaaccatcacttcctgaagaactaacaaaagcagcagatggagtatgttatagtgctttcgtctaagacttattggatggcctcttttgtgatccaagtcaaagtcctggtcccactaggtagttaagccaaagttgtgtgatggtgtcaagacttaattcagcggttggatttggagtgtgatgcatgtaaaaagaattcccagtgttttggttgctcttctgatcctttgagagcaccgtgtgcacaatgatgtgggaaatgatagtcgctaatggcacatcttctttgtcgtctgtttatgcctatcttgttgcagtgaaatgatttgtgatcaagcattatggtcacttgcgtgccattgcatactatggaaatttacacatttgcagcttgttac

SEQ ID NO: 2259 - DNA, 310 bp, Cenchrus ciliaris
cttcaagcctcgcttgctttcttggttctcccttcgcgagttcgcgttctcccccgcttctccaaactgttgggattcagaagcaagaagagagcatatggggttcgtgctggtcatctccctgcccttcatcttcttctccatcctgctcggcttcggctgctacttcctcggcaagcacaggggcagggaggagatgcgggccggcgtcggcgcgcagatctacggcacgccgctgccgccgcccggcgtcgtcggcgggtcctcaccggcgcatgagccgttccacatgaagaaagaaggggctgag

SEQ ID NO: 2260 - DNA, 419 bp, Echinochloa colona
cccctccccaagcaaagcacaggcaccaccaccacgtctccaacgtttcaaagcatcctttgcttcgcttgctttcttgattctctccaagcagtgggggttcagcagcaagaaagaggatatggggttcgtgctggtgatctccctgcccctcatattcttctccatcctcctcggcttcggctgctactttctcggcaagcacaggggccgggaggagatgcgggccggcgtcggcgcgcagatctacggcacgccgctgccgccgcccggcgtcgtgggcgggtcctcgccggcgcctgagccgttccacatgaagaaagaagggcctgagaacgtttgagtcggatactcggatggtgatgtttctggatttgtttaaatgatagcccattcttttcattcatgttatgttgcgg

SEQ ID NO: 2261 - DNA, 480 bp, Echinochloa colona
catctcccctccccaagcaaagcacaggcaccaccaccacctctccaacgtttcaagcatcctttgcttcgtttgctttcttggttctctccaagcagtcagggttcagcagcaagaaagaggatatggggttcgtgctggtgatctccctgcccctcatcttcttctccatcctcctcggcttcggctgctactttctcggcaagcacaggggccgggaggagatgcgggccggcgtcggcgcgcagatctacggcacgccgctgccgccgcccggcgtcgtgggcgggtcctcgccggcgcctgcgccgttccacatgaagaaagaagggcctgagaacgtttgagtcggatactcggatggtgatgtttctggatttgtttaaatgatagcccattctttaagttcatgttatgttgcggacttgcggtgtaaattgagcaatttggtacctctgtttgctattttgttgagggggg

SEQ ID NO: 2262 - DNA, 943 bp, Panicum virgatum
atggacaattttgtaagcccaacgaagagtgtagaagatgaatcatcaacgaatctcattacgcgtctacatcgtgcagttccctttcggaaagagattcccaaactcttatttggacagatacgatccagaggaaggcgaaaggatcgctgtatgctgaacaatgaaaacatcgccgacacggatatgtataacatagtactccctccaacacctgaagaaaagggcagcacgggctttcgtcatgccattcgaccgttgcccacaagcgccaggccagcccaacggtcggaaggctgtcgccgcagcacactccacaagcttcttccagctgccgccgccttcttccataggattctcctgcagcttccactgtctcctcacctatttaactcactcccacctccatctccattcccaaacaaagcacaggccaccacctcaaagcatcctctgcttcgcttgctttcttgggtcttccaccaggctctctccactgctcctgaaggcaagtcggaattccggagcaagagaggagacatggggttcgtgctggtgatctccctgcccttcatcttcttctccatcctgctcggcttcggctgctacttcctcggcaagcacaggggccaggaggagatgcgggcaggcgtcggcgcgcagatctacggcacgccgctggcgccgcccggcgtcgtgggcggggcctcgccggcgcacgagccgttcgccatgaagaaagaaggggctgagaacgtctgagtgggatgatgtttctggatttgtttaaatgataattcaatcctttcgtcgatgcaatggtgtacattgagcaatttatgcatgtgtttgttactttgttgtgggtgtgatataatgtaatcacagtatgagacaataacagtgtttcgattcattgattgccttgcatgatttgcactta

SEQ ID NO: 2263 - DNA, 788 bp, Eragrostis curvula
tttcttcatagcctcccgcagttcatgtccccctgcgctatttatctggcttccccacctctcctctcaacgcaaagcacaaaaacagcgacatctcctcatccccaaacatccttgctcggctagctttctcggcgctctcgcattgttccctgccttgaagcaggcagcaggaattcaggagcaagaaagaggatggggttcgtgctggtgatatccctgcccttcatcttctcctccatcctgctcggcttcggctgctacttcctcggcaagcacaaaggccgcgaggagatgcgcgccggcgttggcgcgcagatctacggcacgcctctgccgccgcctggtgtcctgggagggacctccccggcggccgaaccgttccacatgaagaaagaaggggctgagaatgtctgagtgggtcatgctctgatatgtctgtgtcctggcgccgcctgacctgcccccccttttcccgcccatatgcggtgtcgccgcggtgtacctttggccacattgctgcgtcctcccccggcgccccccccgcgctcccccctgcccccacccccccctcctccccccacccccccccccccacgccctccaaccgtctgtccaaaaaaaaaaaaaaaaaaaaaaaaaaaaaagtccccgggtttaaacccccggtttaaccccaaggaatttcccgccccccggggggcccaccatagggaaaaccccccaccgggtgggaggcaaacttggaattttcaaaagggcccccaaaaaagttggggaatctgcaa

SEQ ID NO: 2264 - DNA, 545 bp, Panicum virgatum
cccttcccaaaacaaagcacagggcacttcatctcccttcaaagaacactctgctttgcttgtttttcttgttctttcttcacgttctcacctgctcctccagctagtgggaattccggagtaggaagagaggaggaagcatggggttcgtgctggtgatctccctacctttcatcttcttcaccatcctgctcgggttcggctgctacttcctcggcaagcacagggggcgggaggagatgcggtcaggcgtcgctgcccagatctacggcacgccgctgccgccgcccggcgtcgtgggcggggcctcgccggcgcatgagccgttcgccatgaagaaagaaggggctgagaacgtctgagtgggatgatgtttctggatttgtttaaatgataattaattcctttcgtcgatgcaatgtcatggtgtacattgagcaatttatgcatgtgtttgttactttgttgaggggaaagatggtgaagcggtgtgatataatgtaatcacaatatgtggaaaaatcagtgtttctctttgattggta

SEQ ID NO: 2265 - DNA, 593 bp, Saccharum officinarum
caaagcttcgaagcatctctccaactctcctcttgcttctgtcgctccacatcctccctgcgacttcaggcaggagccagacgagaagagaggacatggggttcgtgctggtggtctctctgcccttcatcttcctctccatcctgctcggcttcggctgctacttcctcggcaagcacaggggccgggaggagatgcggaccggcgtcggcgcgcagatctacggcacgccgctgccgccgccgggcgtcgtcggagtctcctcgccgcagcctgagccgttccacgccaagaaacaagggcccgaggccgtgtgattgagattcagactcgacattcgttctagctactactgcatatgtcttggtggtgaactggtgatgttggatttattctttcttctttaatttcgtccaggccgtgttgagggtgtaaatcgagaccgagtctgtgcttgtgtctaaagattgttcattgttatgaggggggaggggtgatggcgtgtggatgttgtgatatgattgcaatcacagtttatatctctgtaagcaagcgaaaaccaaatgcaatgcagtggaatgtcttgtgttcct

SEQ ID NO: 2266 - DNA, 533 bp, Zea mays
atgtcccaaagcaaagcaaagcttcaaagcatctctgcttggattttagcgagcggcaacgacgagcgacccaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacatatatgtcttggtggtgatgttggatttatattctttcttctttaatttcgccctggctgtcttgagagtgtagattgagagtcaaatatgtgcttgtgtaaagatggtgtgtgtggatgttgtgatacgattgcaatcacactttatatcttctgtaatcaagcaaaaaatttctgaaattgtgcttgtgt

SEQ ID NO: 2267 - DNA, 796 bp, Zea mays
aaacaaagcttcaaagcatctctgctgggattttagcgagcggcaacgacgagcgacccaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacttatatgtcttggtggtgatgttggatttatattctttcttctttaatttcgccctggctgtcttgagagtgtagattgagagtcaaatatgtgcttgtgtggatgttgtgatacgattgcaatcacactttatatcttctgtaatcaagcaaaaaccaatgcgttgcagtagaatggcttgtgtgtgtgactcctgcaggctgtatatgtgtttgaagattgcaactgagcatctccacaagatcttttataacatctataaattctttagattcaatttaggatatgtcatagcagatcatctaaaacttgtctctcgtatttcttgaaatgtgctgtcagatgtctgaagttggggaaaaacgtctgaaggagcgttcgataggaagaaaaccaggtttctctcagaatgctgccaagttgcagaaccagaaatcaatggaggcgaccgagtagagcaacaatggg

SEQ ID NO: 2268 - DNA, 502 bp, Zea mays
cacaagcttcttctcttgcaggctgcctccagctgcagcctccttccctaggattcttttgcagcttccattttctccccggctatttaacccacccacccccgcttcgtctcccatgtcccaaagcaaagcaaagcttcaaagcatctctgctaggattttagcgagcggcaacgacgagcgacccaaaaaagcaatcaatagtcaccatatctgctcctctgcgacttgaggcaggacaggaggcacagacgtgcaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcttcctcgccgccgcctgagccgttccacagcaagaaacaatggtccgaggctgtgtgactgagattcagacgtctctcca

SEQ ID NO: 2269 - DNA, 886 bp, Zea mays
catgtcccaaagcaaagcaaaacaaagcttcaaagcatctctgctgggattttagcaagcggcaacgacgagcgacccaaaaaagcaatcaatagtcaccatatctgctcctctcgctccacacccccctgctctgtgacttgaggtaggacaggaggcagaggcgagcaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggctgtgtgactgagattcagacgtctctccatccatccatccattctactactactactactatatgtcttggtggtgatgttggatttatattctttcttctttaatttcgccctggctgtcttgagagtgtagattgagagtcaaatctgtgcttgtgtctaaagatggtgtgtgtgtgtggatgttgtgatacgattgcaatcacactttatatcttctgtaatcatgcaatggcgttgcagtagaatggcttgtgtgtgtgactcctggaggctatatatgtgtttgaagattgcaactgagcatctccacaagatctttcaatttaggataattcaataaagaaatgttatagcaggatcatctaaaacatttctgtcgtatttcttgaaatgtgctatcagatgtctgaagttggggaaatgtctgaaggagcgttcgatagggagaaaaccaccaaaatgctgccaagttccagaaccaggttagccttatttggg

SEQ ID NO: 2270 - DNA, 529 bp, Saccharum officinarum
acccacgcgtccggggacgcgtggggcaaagcttccaaccatctctccaactctcctcttgcttcgtgtcgctccacatcctccctgcgacttcaggcacgagccacacgagaacagaggacatggggttcgtgctggtggtctctctgcccttcatcttcctctccatcctgctcggcttcggctgctacttcctcggcaagcacaggggccgggaggagatgcggaccggcgtctgcgcgcagatctacggcacgccgctgccgccgccgggcgtcgtcggagtctcctcgccgcaacctgagccgttccacgccaagaaacaagggcccgaggccgtgtgatagagactcagactcaacattggttctagctactactgcatatgtcttggtggagaactggggatggctgatttattctttcttcttaaattacgccaagccatgttgagggggttaattgtgaccgaggctgcgcttgggttaaagaatgggcattggttaaagggggaagggggaaggcatct

SEQ ID NO: 2271 - DNA, 532 bp, Saccharum officinarum
aagcacagctttgaagcatccctccactctcctttcgcttctgtcgctccacatcctccctgcgacttcaggcaggagccagacgagaagagaggacatggcgttcgtgctggtggtctctctgcccttcatcttcctctccatcctgctcggcttcggctgctacttcctcggcaagcacaggggccgggaggagatgcggaccggcgtcggcgcgcagatctacggcacgccgctgccgccgccgggcgtcgtcggagtctcctcgccgcagcctgagccgttccacgccaagaaacaaggccccgaggccgtctgattgagattcagactcgacattcgttctagctactactgcatatgtctgggtggcgaggttggattaattctttcttctttaattccgcccagccgtgttgagggtgtaaattgagaccgagtctgtgcttgtcgctaaaagatggtcaattgtaatgatgggggaggggtgatggcctgtggattttttaaatgaatggcaatccacgttata

SEQ ID NO: 2272 - DNA, 971 bp, Sorghum bicolor
cagcccaggctgcagcccaccaacggtcacccgccgctacgctgccatgccagacaagccacactccacaagctgtcaagcttcttctcttccagctacagcccggccgcctccttccctacgattctcctgcagcttccattgtctccgccgcctatttaactcacccccgcctcatctcccctcccaagtcccaaagcagcaaagcttcaaagcatctcttctcctttttgcttctcacgctccacctccacatcctcccctgcgacttcttcaggcagtagtcagacgagaagagaggaggacatggggttcgtgctggtggtctccctgcctttcatcttcctctccatcctgcttggcttcggctgctacttcctcggcaagcacaggggccgggaggagatgcggaccggcgtcggcgcgcagatctacggcacgccgctgccgccgccgggcgtcgtcggagtctcctcgccgccgcctggggctgagccgttccacgccaagaaacaggggcccgaggccgtctgactgagattcagactctcccattcattctagctactgcatacatgtttcttggtggcgatgttggatttattctttcttctttattaatttcgtccaggccgtgtgagggtgtaaattgagagtgaatccgtgcttgtgtctaaagattgttcattgttatgagggcgaggagtgacggtttgtggatgttgtgaacttgtgatatgattgcaatcacagtttatatctgtaagcaagcgaaaaccaaatgcaatgcagtggcatgtcttgtattcctcactgtcctgactcttgcagctgcacgctgtatgtgtttttgaagatcgcagttagttaatgttgagcatctccataagatctcctatatcacatctcctataaattatcttagagaatcaatgttatttttattatgaattgttttacagagtcaatgc

SEQ ID NO: 2273 - DNA, 589 bp, Lolium multiflorum
tccagcccctgccgccttcttccaaacgatccttgcaggatccaagtccctcgctcgtatatataaacccctccccacgcagctcccttttccaaagcaaatcacctcaacaattcccttccaagcattctctgcccagccattccaagcatcctgcccgtttcaaggcatctagggaagaagaagaatggggtttgtgctggtgatctccctgcccttcatattcttcaccatcctgcttggcttcggctgctacttcctcggcaagcacaggggccgcgaggagatgcgcgccggcgttggcgcgcagatctacggcacgcccctgccgccgcccggcgtggccgggagctctccgggaccgtacccgttgacgaaagaggggcctgccaacgtgtgattgatcgagctccttggctgaatcaaaattgtgtcatcttggtgttgctggttggactgtactgtgttcatgtgtacattaagtaatctgttggttgtgttgtgtgtgatgtttgctgggaggtggggatggtgacctggtgtgataacttgtaatcacatttcgtgttcttaactacgtataagaagt

SEQ ID NO: 2274 - DNA, 1361 bp, Secale cereale
tcaggagcaccgcaacaattcgattccaagcatcctccaaccatcctcgtacgtctaggcagctaatcaagaaggaaggggaatggggttcgtgctggtcatctcgctgcccttcattttcttcaccatcctgctcggcttcggctgctacttcctcggcaagcacaagggccgcgaggagatgcgcgccggcgtcggcgcccagatctacggcacgcccctgccgccgcccggtgtggccgggcagtccccggggccgtacccggtcccggtcccgatgaagaaggagggggccgacgccgtctgatcggtcgaccgacctcctcctcctcggctggagcgttgatgttgtttactgggtttgattataccgtctggtgggtgtgtccccgtgtacatggagtaatttgttgctcgtgtcttgtagtatgatgtttactgtgaatgaggaagggatggtgatccgggtgtgataatttgtaatcacagttgccttttctgtgagatgtgcaaatcgatgtactccctccgttcacttttgtaagtcgtttcagacaactgaaaatgaactagtttgcacattgtctgaaaagtcttcaaggtcttataaaagtgaacagagggcgtagttggtttcatcttggtcagaagaagaaaggcctcatctaccctgtgtggccagtccagtcttgtccccaagcaccttgttctctgctcttaatttctaccatcagttaaccatgaaagctgtttctgaatgttgacaatcacagaatatgctagatacaatggcgtggtgtctctgaaccacaatacaatcatttcagcagccaaagtttcacccaaaaatctacaaccagacaagtctcgaccgagaaaactatcctcgaaaatcattcacttgccgttagctactggttttctctttgctacaggactcgttcttccatcaatcttatccggagcagcacaccaacagttagctactatactggtttctctttgctagctacaggaggggcagtacccatacactggtcaattgacagaatacagcctccttccctggtgacctgaggcatcaacttctggcatggcttctcacgctctcaacaagccggacgtactcaaagaaccgagtggagtcaatgcccatttttgcactcatcgtcttcgtcccggcgccttggtacggactgtaattcccgccaatgaccaggtcaaatccaccacactcattcatcatctcctcaagaactctgggtttagcttgtgggtgctaggcagctgtatcaactctccggcctgctcggtttccccccacatctcttgagcattctccggttcaccgcggacccctc

SEQ ID NO: 2275 - DNA, 653 bp, Secale cereale
aacaattcgattccaagcatcctccaaccatcctcgtacgcccaggcagctaagcatcccggagggaggggaatggggttcgtgctggtcatctcgctgcccttcattttcttcaccatcctgctcggtttcggctgctacttcctcggcaagcacaagggccgcgaggagatgcgcgccggcgtcggcgcccagatctacggcacgcccctgccgccgcccggtgtggccgggcagtccccggggccgtacccggtcccggtcccgatgaagaaggagggggccgacgccgtctgatcgctcgaccgacctcctcctcctcggctggagcgttggtgttgtttgtttattgggtttgattataccgtgttaccgtgtacatggagtaatttgttgctcgtgccttgtagtatgatgttttactgttaagaggtggggatggtgaattggtggtccggtgtgataatttgtaatcacagttgtgtttctatgagatgattatacgaatattagtttgtgataatcaaccgttgcttggtttgattgcaattttgctttctcgagcttgcctctgaagctgagtggaattgggtttctgatgtgatggaaggtatcaaaagtcaagcagaaggatgagtatagattcaggagtc

SEQ ID NO: 2276 - DNA, 728 bp, Zea mays
catgtcccaaagcaaagcaaaacaaagcttcaaagcatctctgctgggatttcagcaagcgacaatgacgagcgacccaaaaaagcaatcaatagtcaccatatctgctcctctcgctccacatccccctgctctgcgacttgaggcaggacaggaagcagagacatgcaatggggttcatgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcattgtcggtgcctcctcgccgccgcctgagccgttccacagcaagaaacaatggtccgaggctgtgtgactgagattcagacgtctctccatccatccattctactactactacttatatgtcttggtggtgatgttggatttatattctttcttctttaatttcgccctggctgtcttgagagtgtagattgagagtcaaatctgtgcttgtgtctaaagatggtgtgtgtgtgtggatgttgtgatacgattgcaatcacactttatatcttctgtaatcatgcaatggcgttgcagtagaatggcttgtgtgtgtgactcctgcaggctgtatatgtgtttgaagattgcaactgagcatctccacaagatctttcaatttaggataatacaatagagaaat

SEQ ID NO: 2277 - DNA, 473 bp, Secale cereale
ctaggcagctaagcatcccggtgggaggggaatggggttcgtgctggtcatctccctgcccttcattttcttcaccatcctgctcggcttcggctgctacttcctcggcaagcacaagggccgcgaggagatgcgcgccggcgtcggcgcccagatctacggcacgcccctgccgccgcccggtgtggccgggcagtccccggggccgtacccggtcccgatgaagaaggagggccccgatgccgtctgatcgctcgaccgagctcctcctcgtcgtctggagcgtcggtgctgtttgtttattgggtttgatttatgattataccgcgtggtgtgtccgtgtacatggagtaatttgttgcccgtgccgtgtgtgatgcttactgtgaaggaggaggggatggtgaatccgggtgtgataatttgtaatcacagttgtgtttctataagatgcgcagatcgatgcaatgagg

SEQ ID NO: 2278 - DNA, 494 bp, Secale cereale
tcccggagggaggggaatggggttcgtgctggtcatctccctgcccttcattttcttcaccatcctgctcggcttcggctgctacttcctcggcaagcacaagggccgcgaggagatgcgcgccggcgtcggcgcccagatctacggcacgcccctgccgccgcccggtgtggccgggcagtccccggggccgtacccggtcccgatgaagaaggaggggcccgacgccgtctgatcggtcgaccgagctcctcctcctcggctggagcgtcggtgctgtttgtttattgggtttgatttatgattataccgcgtggtgtgtccgtgtacatggagtaatttgttgcccgtgccgtgtgtgatgcttactgtgaaggaggaggggatggtgaatccgggtgtgataatttgtaatcacagttgtgtttctataagatgcgcagatcgatgcaatgaattagtgtatgaatattagtttgtgataatcaaaagtc

SEQ ID NO: 2279 - DNA, 697 bp, Zea mays
cgctacgctgtcagacagtagccagcacactacacaagcttcttctcttgcaggctccagctgcagcccagccggcctccttcgctaggattcttttgcagcttccattgtctccccggctatttaacccacccacccccgcctcgtctcccatgtcccaaagcaaagcaaagcaaagcaaagcttcaaagcatctctgctgggattttagcaagcggcaacgacgagcgacccaaaaaaagcaatcaatagtcaccatatctgctcctctcgctccacacccccctcctctgcgacttgaggcaggacaggaggcagagacgggcaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccagtgtcgtcggagcctcctcgccgccgcctcagccgttccatagcaagaaagaagtgtacgagtgtgatacccggtttgcaaagaagggaagttggaggttattctttttgttttttttctcattcggttgatgcattttggtaatttggaatttggggaaaatcattcaccagtaggaccgtttaatttgtttggttgagcgcttgcgacggggtcggg

SEQ ID NO: 2280 - DNA, 588 bp, Secale cereale
aacaattcgattccaagcatcctccaaccatcctcgtacgtctaggcagctaatcaagaaggaaggagaatggggttcgtgctggtcatctcgctgcccttcattttcttcaccatcctgctcggcttcggctgctacttcctcggcaagcacaagggccgcgaggagatgcgcgccggcgtcggcgcccagatctacggcacgccgctgccgccgcccggtgtggccgggcagtccccggggccgtacccggtcccggtcccgatgaagaaggaggggcccgacgccgtctgatcggtcgaccgagctcctcctcctcggcggctggagcgtcggtgctgtttgtttattgggttggattgtaccgtgtggtgggtgtgtccccgtgtacatggagtagtttgttgctcgtgccgtgtgtgtgtatggtatttaccgtgatggaggaggaggggatggtgatccggtgaccggtgtgataatctgtaatcacagttgcgtttctatgagatgtgaaaatcgatgtaatgaatatttagtttgcgacaatcaatcgatcgttgctttggtttgcaacgcaaaaaaaaa

SEQ ID NO: 2281 - DNA, 524 bp, Secale cereale
aacaattcgattccaagcatcctccaaccatcctcgtacgcccaggcagctaagcatcccggtgggaggggaatggggttcgtgctggtcatctccttgcccttcattttcttcaccatcctgctcggcttcggctgctacttcctcggcaagcacaagggccgcgaggagatgcgcgccggcgtcggcgcccagatctacggcacgcccctgccgccgcccggtgtggccgggcagtccccggggccgtacccggtcccggtcccgatgaagaaggaggggcccgacgccgtctgatcggtcgaccgagctcctcctcctcggctggagcgttggtgctgtttgtttattgggtttgattataccgtgttaccgtgtacatggagtaatttgttgctcgtgccttgtagtatgatgttttactgttaagaggtggggatgggtgaattggtggtccggtgtgataatttgtaaccacagttgtgtttctatgagatgattatacgaatattagtttgtgataa

SEQ ID NO: 2282 - DNA, 536 bp, Triticum aestivum
ggcctcggattgaaggcatccatccgggagggaggggaatggggttcgtgctggtgatctcgctgcccttcatattcttcaccatcctgctcggcttcggctgctacttcctcggcaagcacaagggccgcgaggagatgcgcgccggcgtcggcgcccagatctacggcacgccgctgccgccgcctggcgtggccgggcagtccccggggccgtacccggtcccggtcccgatgaagaaggagggccccgacgccgtctgatcggtcgagctccctcctcctccttagctggagcgttggtgttgtttgtttactgggtttgattattaccgtgtacatggagtaatttgttgctcgtttcttgtgtggtgtttactgtgaaggaggaagggatgttgatccggtgtgatgatttgtgatcacagttgcgtttctatgagatgtgcaaatcgatgtaatgaatactgtattagtttgtgataatcaaccgttgcttggtatgtatgcaaaatttgctttctcgggcttgagctg

SEQ ID NO: 2283 - DNA, 508 bp, Avena sativa
ctcaacaattcccttcgaagcatcctgcccacccattccttggagctcacctcaacaatccctttccagctcgaagtcttgaaggcatctacgaggaggaaggcaagaatgggcttcgtgcttgtcatctccctgcccttcatattcttcaccatcctgctcggcttcggctgctacttcctcggcaagcacaagggccgcgaggagatgcgcgccggcgtcggcgcgcagatctacggcacgcccctgccgcctcccggcgtggccgggcactctccgggaccatacccgttgacgaaagaggggcctgccaacgtctgatcgatcgagctccttcacccggaaattgtgtgatctcgttgtcgtcgctgggttggattatagtactactgtgttcttgtgtacattgagtattctgttgcttgtgttgtgtatgatgtttgctgggaggatgtaggtgtcgatcttgtgtgataatctgtaatcacagtctgtgttttcaattata

SEQ ID NO: 2284 - DNA, 716 bp, Setaria italica
aacagtacagttcgattcatcaggcaactcgatcaagcaagcatctctgattctctgatcccttttctcgaatccatccttctctgttcttcggggagcccgcgctcagctcgtcggcgagatggcgtacatgcgcgtgacgcaccgcgatgaggagggcaagaaggtgacggagaagatgcccatcccggagacgcgccgcccggacaccgccaagcacttcgagcgcaagctggaggaacagggcttccaccgcctcgagcgccaccccgccaacgcgccccgcggcgtcggcatcggcaccccgccgcccaagtccgggcgcggcggcaagtacacctgggagggccccggcggcctcgtcgaggacgagctcgacccggcgccgcccgccatcgaccccaacgatccgaactacgaggaggaggagggaggaccggctggggatgaggacgacgcggccaaggaggtggtcgtcggggaggtggaggtcgccaaggtcgccgaggaaagggacggcgtcgccagggtcgacgtcgcgccgccgctcctccaggaacagaagcagtagctagttctggttgcttctgaaggctcatccttgtggtgtgggtttgctccttgttgagctaatgagcttggatgtgaactgatgtgttttgttgtacaaatcaatcaataatcgaatgtgaatcaaactcccaactaaagttcaa

SEQ ID NO: 2285 - DNA, 983 bp, Setaria italica
ccgatgtaacaggtgctaaaatttagcacttgctatccaaacacccctcacctgatcacctgtcgtgtcgtgacacgagcatctccaccgctccacgtcacttgcggatatttccagttccatttcccctctagatgtcgccttcagcttcggccaccttccctcaccttctagactcctctgctctcctccacctcagcttactcatccctcgtccactttctctataaatctctgtcggcacatcggccgatcaagcagagaaccaacagtacagttcgattcatcaggcaactcgatcaagcaagcatctctgattctctgatcccttttctcgaatccatccttctctgttcttcggggagcccgcgctcagctcgtcggcgagatggcgtacatgcgcgtgacgcaccgcgatgaggagggcaagaaggtgacggagaagatgcccatcccggagacgcgccgcccggacaccgccaagcacttcgagcgcaagctggaggaacagggcttccaccgcctcgagcgccaccccgccaacgcgccccgcggcgtcggcatcggcaccccgccgcccaagtccgggcgcggcggcaagtacacctgggagggccccggcggcctcgtcgaggacgagctcgacccggcgccgcccgccatcgaccccaacgatccgaactacgaggaggaggagggaggaccggctggggatgaggacgacgcggccaaggaggtggtcgtcggggaggtggaggtcgccaaggtcgccgaggaaagggacggcgtcgccagggtcgacgtcgcgccgccgctcctccaggaacagaagcagtagctagttctggttgcttctgaaggctcatccttgtggtgtgggtttgctccttgttgagctaatgagcttggatgtgaactgatgtgttttgttgtacaaatcaatcaataatcgaatgtgaatcaaactcccaactaaagttcaa

SEQ ID NO: 2286 - DNA, 1086 bp, Panicum virgatum
ccaccgctcccctcgctcctcccacgcccgcctccggctccactataaatctctctcgccgcaatcgtcccaattcattcattcaagccgagagcaacgcccccaattcatcgatcaaacgacgacagctcgaatcgaccatggcgtacatgcgcgtgacgcaccgcgacgaggagggcaagaaggtgacggagaagctgcccgtcccggagacgcgccgcccggacaccgccaagtacttcgagcgcaagctcgaggagcagggcttccaccgcttcgagcgccacccggccaacgcgccccgcggcgtcggcatcggcaccccgccgcccaagtccggccgcggcggcaagtacacctgggagggccccggcggcctcgtcgaggacgagctcgacccggcgccgcccgccatcgaccccaacgaccccaactacgaggacgacgatggagcccaggacgaggtggccaaggaggtggtcgtcggggaggtggaggtcgccaaggtggccgaggagagggacggcgtcgccagggtcgacgtcgcgccgcccctgctccaggaacagcacactcagtagctccagttctactactacaaaggctcttctgagagctcacctgtagcaactcatcctcatccttgttgctgtgttgactgttgagctttggatgtgaactgtgttttatttggtgcactaatcaatcaataatcgaatgtgagaattaaactctgactaactttcaagtccaatcgtgattacttgtaaatccgatctctgtggcgtgatttgtgacctttctcaaattcttgagctctcaactctccttgatcagaaatggcggtctcttcttgttctgaagcagagacggtgatcttttttttttcgagagggagaagagacgtgcagattcagtttgggccggcctactcagcccagcccaccctgaccgtgcgcgacgcgcaggcaaaaacgcacttggcccattaccttacaagtccaaggaaaggcccatatcttctttcaattgggccgcaaccaagcaaaagcccatagctggttgcagcgtgaactgcttactggg

SEQ ID NO: 2287 - DNA, 1356 bp, Panicum virgatum
cccaattcattcaagccgagagcaacgccccaattcagcagacacctcgatcgatcaaacgacgcaactcgaataatcgatccttattctctctcgcagtcgcagagccccagtgcgacgagatcgacgatggcgtacatgcgcgtgacgcaccgcgacgaggagggcaagaaggtgacggagaaactgcccgtcccggaggcgcgccgcccggacaccgccaagtacatcgagcgcaagctcgaggagcagggcttccaccgcttcgagcgccaccccgccaacgcgccccgcggcgtcggcatcggcaccccgccgcccaagtcgggccgcggcggcaagtacacctgggagggccccggcggcctcgtcgaggacgagctcgacccggcgccgcccgccatcgaccccaacgaccccaactacgaggacgacgacggagccgtggacgaggtggccaaggacgtggtcgtcggggaggtggaggtcgccaaggtggccgagggcagggacggcgtcgccagggtcgacgtcgcgccgcccctgctccaggaacagcagcagtagctagctccagtacttctagctggcttctgagacctcacctagcaactcattgcccatcgtcatccactagaaaggccgcgcagcgttgctgcgcgtgacctgctttttaacttttgtgtgtattatatgaaactttgtatattattttgttgatctttttttgaaagaaggggtaagatagtttattagggaggccgaagcgcaattagtgtgttacttaatgtattttcgaaaagatattttaattagtaggcgtattatttttttaagaatgtagtggttgtattaaaatatgatgtattattgtggacgtagcatgagaaactatagaagaatggtgatcgaattgtatgtataatgttgcttttgtagcagtaacgattggaacgtattctagttggtgtaaatttatttaatacgtggaataagaatgtacgtagtttgatgtttttttttcagaattgtaacgtaggtgggatgaatatgctaatttgttattttcgcattatttttgttcggagctcagtgctgcagtttttcgtaggataacttctatagtagaataaatatatggcattggcataaaagggtgttcctgggctgatttgtctatttgatatggtgtaatagtgttgcttttttttggagctattttgtagactatacttttatggtgccttgcggcggatgtgcggtggatcatataaatatttttcctaatgtattgcaaaattactttcaatttgaaagttttctcaattaaaaaatttcatatttagaagtgttgag

SEQ ID NO: 2288 - DNA, 917 bp, Zea mays
atcagaaccgatccttacagagagacacacccagcgcgcgagatatctacatcgatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccccaacgaccccaactacgaggagggaggggcggcggacgaggacgacgaggcggccagggaggtggtcgtcggggaggtggaggtcgctaaggtcgccgagagcagggacggcgtcgccagggtcgacgtcgcgccgggcctgctccaggaccagaagcagtaaaaggactgtcttttctggatacgtctagactctataagactgtgtgtcagtgtgttcgagtttgttccgtgcagagagtgcacgtcaactccgctttaattaatctgcttttgttaatatttctactgatcagtaatatgaaccagtggttgatatttggatggaccttgctctcagcttaacctgtaaagtttctccctgaagagaactcctgcacacagctactgattgggggcacatccctaaagatcttgtggtttctaacaaattctagttggtaaccttaaccttgggacttagttccaacatatcagaagctagctttaggccttatttggaacccatagaattaatagcttagccaatactgttgagccagc

SEQ ID NO: 2289 - DNA, 610 bp, Cenchrus ciliaris
gttagattcagcaaacacaggcagcaacgcatctcccaatctctgatccattcaattccaatccagagagcctgcgctaagctcgtcggcgagatggcgtacatgcgcgtgacgcaccgcgacgaggagggcaagaaggtgacggagaagatgcccctcccggagacgcgccgcccggacacggccaagcacttcgagcgcaagctcgaggaccagggcttccaccgcctcgagcgccaccccgccaacgcgccccgcggcgtcggcatcggcgcgccgccgcccaagtccgggcgcggcggcaagtacacctgggacggcccaggcggcctcgtccaggacgagctcgacgcggcgccggccgccttttttcccaacgaccccccctacgaggaggaggctgaggacaacaaaggggggggaggtggtcgtcggggaggtggaggtcgccaaggtcgccgagggaagggatggcgtcgccagggtcgacgtcgcgccgcccctgctccaggaacagaagcagtagctttcagagtggtgtgggtttggtccctgtaacgagctgatgaacttggatgtgaactgatgtgttttggtgtatacgaatcaa

SEQ ID NO: 2290 - DNA, 803 bp, Pennisetum glaucum
aaccaacggagcacagctcgattcggcacacaaacaagcaggcaactcggtcaagcaagcacagacacctgcgatccattctccgcttccagagcccgcgcgcgctcagctcgaccgtcggcgagggatggcgtacatgcgcgtgacgcaccgcgacgaggagggcaggaaggtgacggagaagatgcccgtcccggagacgcgccgcccggacacggcgaagcactacgagcgcaagctcgaggaccagggcctccaccgcctcgagcgccacccggccaacgcgccccgcggcgtcggcatcggcgccccgccgcccaagtccggccacggcggcaggtacacctgggagggccccggcagcctcgtccaggacgagctcgacccggcgccggccgccatcgaccccaacgacccaaactacgaggacgacggcggggctgtggtggacgacgacgcggccggggaggcgctcgtcggggaggtggaggtcgccaaggtcgccgcggcgaggggtggcgtcgccagggtcgacgtcgcgccgcccctgctccgggaacaggcgcagtagctagttgttgttctggttgcttccgaacagggctcatcctttgtggtggtgtgtgtgggtttggcccttgctgagtgaggctgatgacgagcttttgggtgtgaactcatgtgttttggtgtacaaatcaatcaatcaataatcgaatgtgggctgaactcgaattaaccttttatgtgcaaccgtgtttttttttgcaaattttgttctctgtaacttcaatttcgtgacc

SEQ ID NO: 2291 - DNA, 1694 bp, Sorghum bicolor
gtgtgctctagatgtcgccgtctccttcttccaccttcgctcacgttctagactcctcctccaccgctcacctcccctataaaatctctcaccggccacaccgtcctatatatcctcaccaggcagagaacaagaacaaccagcgcacgcagcacttccactccagcacacacacacacacaccatctcaatctcatcgaatcgatcctcgtccaccgacaatggcggcgtacatgcgggtgacgcaccgggacgaggaaggcaagaaggtgacggagaagatgccggtgccagagacgcggcggccggacacggcgaagcacttcgagcggaagctggaggagcaggggctccaccgcttcgagcggcacccggcgaacgcgccccgcggcgtgggtatcggcacgccgccgcccaagtctgggcgcggcggcaagttcacctgggaaggacccggtggcgtcgtcgacggccagctcgacccggccccgcccgccatcgacgccaatgatcccaactacgtcgcgccggaggaggaggaggaggaggtggctagggaggtggtcgtcggcgaggtggaggtggctaaggtcgctgagagcagggttggtgttgccagagtcgacgtcgcgccggccctgctccaggaccagaaccagtagtcgcttttttttttcctctctttttcctgttgttttctggaagtgtctcgactcggtgtgtgttttgagtttgttgggtgcagatcgtgcaacaccgtaaactctgctttaattaatgtatgtatgtactgatcagtaataaaccagtgtaatagcaagtgtgattatctttgcatcgccatcatcggattagcttgcaccaatttgacatcttgatcgtacctgttgcagtggatttatccgagaacaccgttttatggattatgtttgatttgtcaagaaaattttcaccccaaattcctaatgagaataactcggaccagccggttgctcgcggaacaccacatcatgtcggtgtttctacaattcccagcagaagaggaggatcaagggttgaagctgccttcttcggagtgccctcgggtggttttgtgttccagatgtcctccacgcatcggatgtcttcagttctccagccaatcctagcccaaaactggcgagcgaagtcacaggccgagatgatgatgtgttctttaaagaaacggactcacggagggggcgaaattatgccaaacaaaggtgaaggatggaagcttctgctcacccctgactgaagctttaaagatcgttgccgttgatagcttatgatctcctttctcaaacgcacggactctttcatccactgtctcggtcagtttcacctcctcaagcaacagctccttccagttgttgcagttcattcgccggcctcgggaaatagctatgaagagccgggaaggttgacgttttgcctgatcccttccacaagaaggctctgcatttggggtccaaagcatccttgacgtcgatttgcagagctagagcactcatggcgtatttttgacctgaatcgtgaacaatcacttcccctattatgtgccatacttatgtgactcctttttcttataattaaagttgtttcttagcttagctgggatcggatcaacacactgatattgccattaggaataaatccattatgggattagctta

SEQ ID NO: 2292 - DNA, 2916 bp, Zea mays
ctcactcactcacacagcaaatacccacagtccacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgcttctggccggcgaggaccagttccgcgtcaccttcgactgggaggtggagaagcacggcgtcccgggcgccatcatcgtgaagaacaaccacgcctccgagttcttcctcaagaccatcaccatcgacgacgtccccggccacggccccatcgtcttcgtcgccaactcatgggtgtacccgcagtacaagtaccgctacaaccgcgtcttcttctccaacgacacgtacctccccagccagatgccggcggcgctgaagccttaccgcgacgacgagctccgcaacctgaggggcgacgaccagcagggcccgtaccaggagcacgaccgcgtctaccgctacgacgtctacaacgacctcggcaaccccgacgccaaaaacccgcgccccgtcctcggcggctccaagcaccacccctacccgcgccgcggccgcacgggccggaagccgacgcagacagaccccaacagcgagagcaggctgacgctgaccgacggcgacgtctacgtgccgcgcgacgagcgcttcggccacatcaagaactccgacttctacggctacaccatcaaggcgttcgtcgacggcctggtgcccatcctggaaggctacctcctcggcatcgagttcaactccttcaaggacatcctgcagctgtacgagggcggtatcaagctgcccgacatccccgccctcgaggagttccgcaagcagttcccgctacagatggtcaaggacctcatgcccgccggcggcgactacgtcctcaagctccccatgcccaaaatcatcaaagaggacaagaaagcttggatgagtgacgaggagttcgcaagggagaccctcgccggcgtgaaccccttgatcatcaggcgtctcacggagttccctccgaaaagcacccttgatccgagcaagtacggcgaccagacgagcaccatcacggaggcgcacatcgcggggagcctggagggcctcaccgtgcagcaggcgctggacagcaaccggctctacatcctggaccaccacgaccactacatgccgttcctgatcgaggtcaacagcctgaacgacaacttcatctacgccaccaggacgctcctgttcctgcgcggcgacggcacgctcgcgccggtggccatcgagatgagcctccccgagctccgggacggcatcacggccgcgaagagcacggtgtacacgccggcgccgccgacggccggcgcggaggcgtgggtgtggcgcctggccaaggcctacgtgaacgtgaacgactactgctggcaccagggcatcagccactggctcaacacgcacgcggtgatggagccgttcgtgatcgccaccaaccggcagctcagcgtgacgcaccccgtgcacaggctgctgctgccgcactaccgcgacaccatgaacatcaacgccctcgcgcgccagaagctcatcaacgccggcggcatcttcgagatgaccgtcttcccgcgcaagtacgccatcgagatctcctccaaagtctacggcagctggaacttcaccgagcaggccctccccgacgacctcatcaagcgaggcatggccgttccagatccgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccaattccaggccgtcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtggaggccatgaacaaggacccgcgcttcaagaaccgctacagcgcggcccagttcccctacaccctgctcttccccaacacctccgacaagggcgataacaccggcgtcaccgccaagggcatccccaacagcatttccatctgattcgatcgagtcctggccagcgtttcacccaaaaaagcagagctagcggtgattcccgtatgtcatccgtttcattttttacatgaatgagaagcgtggtaataaaaaggtttgtagttgcgtgcgcgccgtgtattccttggtgtactggtgctggcggtaaccacttattaccagggatccttgtaatttttcctgttggtttcccaataataatgtgaatatattggtcacatgcatggtgtttccaa

SEQ ID NO: 2293 - DNA, 3064 bp, Sorghum bicolor
actcacacacacagtgtacccacagtcctccacagctagtagctagtaagaatcgaagatgttcgggaacattggaaagatcccggtgatcagcgacatcacgggcagcaacaagaatgcgcaccttaagggcaacgtggtgctcatgcgcaaaaccgtcctcggcttcgacgtcaccagcacggccggcgccgtcatcgacggcgtcggcgagttcctcggccgcggcgtcacctgccagctcatcagctccactgtcgtcgacccctacaacgggaaccgcgggaaggttggcgcggaggcgagcctggagcagtggctgctgcaaccgccgccgctgctgtccggcgagaacaagttcggcgtcaccttcgactgggaggtggagaagcacggcgtcccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacacgtacctgcccagccagatgccggcggcgctgaagccctaccgcgacgacgagctccggaacctgaggggcgacgaccagcaggggccataccaggagcacgaccgcgtctaccgctacgacgtctacaacgacctcggcaaccccgacggcgggaacccgcgcccggtcctcggcggctccaaggaccacccctaccctcgccgcggccgcacgggccggaagccgacgctgacagaccccagcagcgagagcaggctgacgctggtcgacggcgacgtctacgtgccgcgcgacgagcggttcggccacatcaagaactccgacttctacggctacaccatcaaggcgttcgccgacggcctggtgcccatcctccaaggctacttcctcggcctcgagttcaactccttcaaggacatcctgcagctgtacgagggcgggatcaagctgcccgacatccccgcgctcgaggagttccgcaagcagttcccccttcagatggtcaaggacctcatgcccgccggcggcgactacgtcctcaaactccccatgccccaaatcatcaaagaggacaagaaagcttggatgagtgacgaggagttcgcaagggagacactcgccggcgtgaaccccctgatcatcaggcgtctgacggagtttcctccgaaaagcacccttgatccgagcaagtacggcgaccagacgagcaccatcaccgaggcgcacatcgcggggagcctggagggcctcaccgtgcaggaggcgctggacagcaaccggctctacatcctggaccaccacgaccactacatgccgttcctgatcgaggtcaacagcctggacgacaacttcatctacgccacccggacactcctgttcctgcgcggcaacggcacgctcgcgccggtggccatcgagatgagcctccccgagctcgtccgggacgtcaccgccgcgaagagcacggtgtacacgccggcgccgccgacggccgccggcgcggaggcgtgggtgtggcgcctggccaaggcctacgtcaacgtgaacgactactgctggcaccagggcgtcagccactggctcaacacgcacgccgtcatggagcccttcgtgatcgccaccaaccggcagctcagcgtgacgcaccccgtccacaggctgctgctgccgcactaccgcgacaccatgaacatcaacgcactcgctcgacagaagctcatcaacgccggcggcatcttcgagatgaccgtcttcccgcgcaagtacgccatcgagatcacctccaaagtctacgccacctggaacttcgccgaccaagccctccccgacgacctcatcaaacgaggcatggccgttccagatccgtcgagcccgtacaaggtgcggctgctgatcgaggactacccgtacgcgtctgacgggctggccgtctggcacgcgatcgagcagtgggtgacggagtacctgggcatctactaccccaacgacggcgtgctgcaggcggacgtggagctgcaggcatggtggaaggaggcgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtactgcgggtaccacccgaaccggccgtcggtgagccggcggccgatgccggtgccaggcaccgacgagtacgcggagctggaggagaacccggagaagttcttcttgcgctccatcaccacgcagttccaggccgtcgtcggcatctcgctgctcgagatcctgtccagccactcctccgacgaggtgtacctcggccagcgcgacaccaaggagtggacgtcggacgccaaggcgcaggaggcgttcaggcggttcggggcgcggctggtcgagatcgagaaacgcgtggaggccatgaacaaggacccacgctacaagaaccgctacagcgaggcccagttcccctacacgctgctcttccccaacacctccgacaagaagggcgacaacgccggcgtcaccgccaagggcatacccaacagcatctccatctgatctctgattcctgaggacagagcatgatgacctgaatgcaggcagggaatagctagcggtgattcccgtacgttatccgtttcattttatccatgaatgagaagcgttgcaataaataaaagattcataattacgtgcgcgacgaacattgtgccatactccttggtgtgctggcgattaccacttatgccttgtttagttctccatcaaaaaaattgagtaaagtccatcagcggtccctaaacttgttcggatgtgtcatcccggtccttaaacttgcaaaatgaccgtttaggtacctaaacttgttcggttgtgtcatcctggtccctaaacttaaaaatctctcatataggtcatcaaacttgttcagttgtgtcatcc

SEQ ID NO: 2294 - DNA, 5116 bp, Setaria italica
ctttagagtgtccacctagtaatcctaggtggcttcaattgaaagcttcaaaatcaattagtaagatttaacgcggtaggacatggaaacgaaaattatacatgtacaccgcgtggcaagcgcggttagcagcctttcaaactatatgtcaaactttgaaaattatacatgcacgaaaaaggaaaaacacttccacgtacacatgggaacatggacttggctgacttcaatgcacgtccccgtgttccaagttccaaccaccaactcgcgtgcgtcgcatggggaaatggcaaagctcagctgctagcctgccatgcaaaaaaaaataaaaaaaaggaaccaggattcgctaatccaattttgcagttcatccttttctgcagtcaactgtactgctctgatccaggccaaactctcgatatatctccacaccagctgatttcgaggtggaagacgagatatatttggaaatcaaaactagccgggcgccgcgctgcaagcgtacgtgcaggtgtgctttgatccgctgttagtatttgcctgtgatcattcatgattgcatcggtctaaaccctggattatattcagcatgtaatcaagacccactcggccatccattatttccgcccagacgatctggagagcttcaagcccggctagcactagaatatgatgtcatgatgcacgaatcttatctcctagtacaacgctttgcatgttttataagcatgcggcgttaggtggagaagacgctgccatgcatatgacccttccaatttctgtagtggacaaatatgccagtgccagacagccacagcttatactttgtactacgattccacatcagctaaattttgaggcacccaatgtacctaaccttgctaaccagcccgtccaatatatgtgctgctcgcattgacatgtccattttggacacacttagcattctttctgttcacccatctattatttgaagcttaggtctccttttgcacttacaacgatggtgaaaaaattattcagtttgtcctggattgccctggaaaatgcgaccattccacacttgcacagcttcctatgtagatcaaggcctaatctgaagaatatacgtttttccaaaaaaaaatgaaaaatggtctctcttgaataacacttactaggacatacactacaagacttgtagttttccccaatggtgtctttgcataagcggccaacagtgatagtacatttgattcactagctaagaaaaatgtgggtaatgagtttgtggagattatattgtaggtagttgcaaaaactgtagggaaagatgtaaaattatactacaaaccctgctggccacttaagaaaaaaaaatactaatagtgctaatactgctggctacttcaaaaaaactattgggaaagatgtagattcttgtagtacgtagaagtacatatgaacgataaagtcactaaatatatagcacaagctaattaagccttcatcttctttaattttgcgcctcttgcatatcatgagagctttatctatggaaaagaacttgcgcaacaaacttactctgtgaacatcatttttagcttacacgagccagtgaataaaatgatcctaggccttgctttggatccatggctaagttggctaggatttaaaatagaatgttgttggtcgagtgtaacagcctgatcgatacaatacaataaaatgatttggtcaccagcagaagatctatcaccatgcaaactagattctctctataataggtctatacatatggcatcacaaatgaagatatacttagttgggaaaattttgtgcaaaggtgccatgatacttcctcgaataaaccagtaaaattctgcacggtacggtgtttactggaggaaaagttggtaactccagtgtcaaatttaggtacacctcaagtttgtaactcaagtgtgaacaaaattatttatagacgtgcgatatgagcccacccctgcgtgcgcgccacatttttggcgcaattctaattctttaaggaaatcataatgtgccatctctgacaattgatcaataattttggagttgaatataattttgagcccatgcagcgcgtgcaacacgaactggcaggtcagtagatgccattatcttatcctaaatggagatttgatctgattatcataaacttcactccatgaattcaggcattcagctcaccctccaactctataagtagcctgcagctacgcaggtctctcacacaacacgaacagcaagcaaagcctgcaactgcaatctgtgctaagcaacgtagtagcaggctagcagctaggcactaggtgaagcgaagatgttcggagggatcatcgggggtctgaccgggaacaagaatggccggctcaacggctcggtggtgctcatgcgcaagagcgtcctcggctttgacgtcaccagcatgggcgccaccgtcatcgacaacatcggcgagttcctcggccgcggcgtcacctgccagctcatcagctccaccgtcgtcgacccaaacaacggcaaccgcggcaaggtgtgcgcggaggcgagcctggagcagtggctgacgtccctgccgtcgctgacgtccagcgagtccaagttcggcgtgacgttcgagtgggaggtggagaagctgggcgtgccgggcgccatcatcgtaaagaacaaccacgcctccgagttcttcctcaagaccatcaccctcgacgacgtccccggccgcggcaccatcgtcttcgtcgccaactcatgggtctacccgcagtccaagtaccgctacagccgcgtcttcttcgccaacgacacgtacctgccgagccagatgccggcggcgctcaagccctaccgcgacgacgagctccggaacctccggggcgacgaccagcagggcccgtaccaggaacacgaccgcgtctaccgctacgacgtctacaacgacctcggcctgcccgactccggcaacccgcgccccaccctcggcggctccggggacctcccctacccgcgtcgctgccgcaccggccgggagcccaccaaatccgaccccagctgcgagagcaggctgacgctggtcgagggcgacatctacgtgccgcgcgacgagcggttcgggcacatcaagaagtcggacttctacggctacgcgatcaaggcgctggtgaacgccgtcgtgcctgccattcgcacctacgtggacctctcgcccggcgagttcgactccttcggggacatcatcaggctctacgagggcggaatcaaactgcccgagatccctgccctcgaggagctgcggaagcagttcccgctccagctcgtcaaggatgtcctccccgtcggcggcgactacctcctcaagctccccatgccgcaaatcattaaagaggacaagacagcttggatgaccgacgaggagtttggacgggagattctcgccggcgtcaaccccatgctcatcagacgtctcaccgaattccctccgagaagcactcttgacccgagcaagtacggcgaccacacgagcaccatcacggcggcgcacatcgagaggaacctcgagggcctcaccgtgcagcaggcgctcgacggcaaccggctctacatcctggatcaccacgacaacttcatgccattcctgctcaaattcaacagcctaaacggcaacttcatctacgcaacgaggaccctactgttcctgcgctccgacggcacgctcgcgccggtggccatcgagctgagcctacccgagcttaaggacggcctgaccaccgcgaagagcacggtgtacacgcccacgtcgacgaccggcgccgaggcgtgggtgtggcacctcgccaaagcctacgccaacgtgaacgactactgctggcaccagctgatcagccactggctcaacacccacgccgtgatggagcccttcgtcatcgccaccaaccggcagctcagcgtggcgcaccccgtgcacaagctgctgctgccccactaccgcgacaccatgaacatcaactccaacgcgcgccagatgctcgtcaacgccggcggcatcttcgagacgactgtcttcccccgcaaatacaccttcgagatgtcctccgtcatctataagaactggaacttcaccgagcaggctctccccgacgacctaatcaagagaggcatggcggtggccgacccatcgagccggtacaaggtgcggcttctgattgaggactacccgtacgcgtccgacgggctggcgatctggcacgccatcgagcagtgggtgacggagtacctggccatctactaccccaacgacggcgtgctccatgccgacgtcgagctgcaggcatggtggaaggaggtgcgtgaggtcgggcacgccgacatcaaggacgcttcctggtggcccaagatgcagacggtggcggagctggccaaagcctgcgccaccatcatctggatcgcgtcggcgctccacgccgccgtcaacttcgggcagtacccatacgcggggtacctcccgaaccggccgtcggttagccggaagccgatgccggtgccaggcacggaggagtacgcggagctggagcgcaacccggagaaggtgttcgtgcgcaccatcacgagccagttccaggccctcgtcggcatctcgctgctggagatcctgtccagccactcctccgacgaggtgtacctgggccagcgcgacacgccggagtggacgtcggatgccaaggcgcaggaggcgttcaagcggttcggagcgcggctcacggagatagagaaacgtgcgatgaccatgaacgccgatccgcggctcaagaaccgcaacggcccggccaagttcccctacactctgctctaccccaacacctccgacaagaagggcgacgccgctggcatcactgccaagggcatccccaatagcatatccatctgagtttaggagccaatgcattcatcatgcatctgtgcatggaagcaggaagctgtgttctctcggtttcatctatgttgtgtaataggcgtggaagccactacaataatacccttcagttcaccaataatgaagttaatgtggccgcttcaaaaaaaaaaaattaagccgctt

SEQ ID NO: 2295 - DNA, 2770 bp, Setaria italica
gctagcagctaggcactaggtgaagcgaagatgttcggagggatcatcgggggtctgaccgggaacaagaatggccggctcaacggctcggtggtgctcatgcgcaagagcgtcctcggctttgacgtcaccagcatgggcgccaccgtcatcgacaacatcggcgagttcctcggccgcggcgtcacctgccagctcatcagctccaccgtcgtcgacccaaacaacggcaaccgcggcaaggtgtgcgcggaggcgagcctggagcagtggctgacgtccctgccgtcgctgacgtccagcgagtccaagttcggcgtgacgttcgagtgggaggtggagaagctgggcgtgccgggcgccatcatcgtaaagaacaaccacgcctccgagttcttcctcaagaccatcaccctcgacgacgtccccggccgcggcaccatcgtcttcgtcgccaactcatgggtctacccgcagtccaagtaccgctacagccgcgtcttcttcgccaacgacacgtacctgccgagccagatgccggcggcgctcaagccctaccgcgacgacgagctccggaacctccggggcgacgaccagcagggcccgtaccaggaacacgaccgcgtctaccgctacgacgtctacaacgacctcggcctgcccgactccggcaacccgcgccccaccctcggcggctccggggacctcccctacccgcgtcgctgccgcaccggccgggagcccaccaaatccgaccccagctgcgagagcaggctgacgctggtcgagggcgacatctacgtgccgcgcgacgagcggttcgggcacatcaagaagtcggacttctacggctacgcgatcaaggcgctggtgaacgccgtcgtgcctgccattcgcacctacgtggacctctcgcccggcgagttcgactccttcggggacatcatcaggctctacgagggcggaatcaaactgcccgagatccctgccctcgaggagctgcggaagcagttcccgctccagctcgtcaaggatgtcctccccgtcggcggcgactacctcctcaagctccccatgccgcaaatcattaaagaggacaagacagcttggatgaccgacgaggagtttggacgggagattctcgccggcgtcaaccccatgctcatcagacgtctcaccgaattccctccgagaagcactcttgacccgagcaagtacggcgaccacacgagcaccatcacggcggcgcacatcgagaggaacctcgagggcctcaccgtgcagcaggcgctcgacggcaaccggctctacatcctggatcaccacgacaacttcatgccattcctgctcaaattcaacagcctaaacggcaacttcatctacgcaacgaggaccctactgttcctgcgctccgacggcacgctcgcgccggtggccatcgagctgagcctacccgagcttaaggacggcctgaccaccgcgaagagcacggtgtacacgcccacgtcgacgaccggcgccgaggcgtgggtgtggcacctcgccaaagcctacgccaacgtgaacgactactgctggcaccagctgatcagccactggctcaacacccacgccgtgatggagcccttcgtcatcgccaccaaccggcagctcagcgtggcgcaccccgtgcacaagctgctgctgccccactaccgcgacaccatgaacatcaactccaacgcgcgccagatgctcgtcaacgccggcggcatcttcgagacgactgtcttcccccgcaaatacaccttcgagatgtcctccgtcatctataagaactggaacttcaccgagcaggctctccccgacgacctaatcaagagaggcatggcggtggccgacccatcgagccggtacaaggtgcggcttctgattgaggactacccgtacgcggcggacgggctggcgatctggcacgccatcgagcagtgggtgaccgagtacctggccatctactaccccaacgacggcgtgctccatgccgacgtcgagctgcaggcatggtggaaggaggtgcgtgaggtcgggcacgccgacatcaaggacgcttcctggtggcccaagatgcagacggtggcggagctggccaaagcctgcgccaccatcatctggatcgcgtcggcgctccacgccgccgtcaacttcgggcagtacccatacgcggggtacctcccgaaccggccgtcggttagccggaagccgatgccggtgccaggcacggaggagtacgcggagctggagcgcaacccggagaaggtgttcgtgcgcaccatcacgagccagttccaggccctcgtcggcatctcgctgctggagatcctgtccagccactcctccgacgaggtgtacctgggccagcgcgacacgccggagtggacgtcggatgccaaggcgcaggaggcgttcaagcggttcggagcgcggctcacggagatagagaaacgtgcgatgaccatgaacgccgatccgcggctcaagaaccgcaacggcccggccaagttcccctacactctgctctaccccaacacctccgacaagaagggcgacgccgctggcatcactgccaagggcatccccaatagcatatccatctgagtttaggagccaatgcattcatcatgcatctgtgcatggaagcaggaagctgtgttctctcggtttcatctatgttgtgtaataggcgtggaagccactacaataatacccttcagttcaccaataatgaagttaa

SEQ ID NO: 2296 - DNA, 2889 bp, Zea mays
accgactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcatcggcgagttcctcggccgcggcgtcacctgccagcttatcagctccaccgtcgtcgaccctaacaacggcaaccgcgggaagttgggcgcggaggcgagcctggagcagtggctgctgaacccgccgccgcttctgtccagcgagaaccagttccgcgtcaccttcgactgggaggtggagaagcagggcatcccgggcgccatcatcgtcaagaacaaccacgcctccgagttcttcctcaagaccatcaccctcaacgacgtccccggccacggcaccatcgtcttcgtcgccaactcatggatctacccgcagtccaagtaccgctacaaccgcgtcttcttctccaacgacacgtacctccccagccagatgccggcggcgctgaagccctaccgcgacgacgagctccggaacctgaggggcgacgaccagcagggcccgtaccaggagcacgaccgcgtctaccgctacgacgtctacaacgacctgggcctgcctgacagcgggaacccgcgccccgtcctcggcggcaccaaggagctcccctacccgcgccgctgccgcaccgggcggaagcccaccaagagcgaccccaacagcgagagcaggctcacgctggtcgacggcgacgtctacgtgccgcgcgacgagcgcttcggccacatcaagaagtcggacttctacggctacgccatcaaggcgctggtgaacgccgtcatcccggcaatccgcacctacgtcgacctgtcgcccggcgagttcgactccttcaaggacatcatgaagctgtacgagggcgggatccagctgcccaaaataccagccctcgaggacctgcggaagcagttcccactcgagctcgtcaaggatgtcctcccggtcggcggcgactacctcctcaagctccccatgccgcagatcatcaaagaggacaagacaggttggatgacagatgaggagtttggacgggagattctcgccggcgtgaaccccatgctcgtcaagcgtctcacggagttccctccgaggagcagtcttgacccgagcaagtacggcgaccacaccagcaccatcagggaggcggacctcgagaacaagctcgagggcctgacggtgcagcaggcgctgcacggcaaccggctctacatcctggaccaccacgacaacttcatgccgttcctggtcagggtgaacagcctggagggcaacttcatctacgccaccaggaccgtgctgttcctgcgcggcgacggcacgctggtgccggtggccatcgagctgagcctgcccgagctccgggacggcctgaccaccgccaagagcaccgtgtacacgcccaagtcgaccaccggcgcggaggcgtgggtgtggcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggtcgggcacgccgacctcaaggacgcgccctggtggcccaagatgcagacggtggccgagctggtcaaggcctgcaccaccatcatctggatcgcgtcggcgctccacgcggccgtcaacttcgggcagtacccgtacgccgggtacctcccgaaccgcccgtccgtcagccggaagccgatgccggcgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccctcgcctcaagaaccgcaacggcccggccgagttcccctacacgctgctctaccccaacacctccgacacgaagggcgacgccgccggcatcaccgccaagggcattccaaacagcatctccatttgagttctgtctgtctgagctgaggacgtacggtcgtcgcactagttgtttgcgtttccccgttccgttccgtgaagtgtggttctcacttgcgcggtattgtgcaaatagccaagtactccttacggaagtcgctacgtgaggactgttgtaataaggctctattcagttcctcaataatgaagttactttgtgttccatct

SEQ ID NO: 2297 - DNA, 3255 bp, Saccharum officinarum
cagctagcaaatacccacaaggccacagctagccactcccaggaactagtagttgcagttagctctgccagtagtagaaccgaagatgttcggaaacatcggaaagatccccatcatcggcgacatcacgggcagcaacaagaatgcgcgcctcaagggcaacgtggtgctcgtgcgcaagaccgtgctcggcttggacgtcaccagcatcgccggctccatcatcgacggcgtcggcgagttcctcggccgcggcgtcacctgccagctcatcagctccaccgtcgtcgacccgaacaatggcaaccgcgggaaggtgggcgcggaggcgagcctggagcagtggctgctgaacccgccgccgcttctgtccggcgacaaccagttccgcgccaccttcgactgggaggtggagaagcagggcattccaggcgccatcatcgtcaagaacaaccacgcgtccgagttcttcctcaagaccatcaccatcgacaacgtccccggccacggcaccatcgtcttcgtcgccaactcatggatctacccgcagtccaagtaccgttacaaccgcgtcttcttcgccaacgacacgtaccttcccagccagatgccggcggcgctgaagccttaccgcgacgacgagctccggaacctgaggggcgacgaccagcagggcccgtaccaggagcacgaccgcgtctaccgctacgacgtctacaacgacctgggcctgcctgacagcggcaacccgcgccccgtcctcggcggcaccacggaactcccctacccgcgccgctgccgcaccgggcggaagcccaccaaaaccgaccccagcagcgagagcaggctgacgctggtcgacggcgacgtctacgtgccgcgcgacgagcgtttcggccacatcaagaagtcggacttctacggctacgcgatcaaggcgctcgtgaacgccgtcatcccggcgatccgcacctacgtcgacctgtcgcccggcgagttcgactccttcaaggacatcatgaagctctacgagggcgggatccagctgcccaaaataccggccctcgaggacctgcggaagcagttcccgctcgagctcgtcaaggatgtcctccccgtcggcggcgactacctcctcaaactccccatgccgcaaatcatcaaagaggacaagacaggttggatgacggatgaggagtttggacgggagattctcgccggcgtcaaccccatgatcgtcaggcgtctcacggagttccctcccagaagtagtcttgacccgagcaagtacggtgaccacacgagcaccgtcacggaggcgcacctcgagaacaagctcgagggcctcaccgtgcagcaggcgctggacggcaaccggctctacatcctggaccaccacgacaacttcatgccgttcctggtcagaatcaacagcctggagggcaacttcatctacgccaccaggacgctgctgttcctgcgcggcgacggcacgctggtgccggtggccatcgagctgagcctgcccgagctccgggacggcctgaccaccgccaagagcaccgtgtacacgcccacgtcgaccaccggcgcggaggcgtgggtgtggcacctcgccaaggcctacgccaacgtgaacgactactgctggcaccagctgatcagccactggctcaacacgcacgccgtgatggagccgttcgtcatcgcgaccaaccggcagctcagcgtgacgcaccccgtgcacaagctgctgctgccgcactaccgcgacaccatgaacatcaactccaacgcgcgccagatgctcgtcaacgccggcggcatcttcgagaccaccgtgttcccgcgccagtacgcgttcgagatgtcagccgtcatctacaagaactggaacttcaccgagcaggctctccctgacgacctaatcaagagaggcatggcgggtgccgacccgtcgagcccgtacaaggtgcggctgctggtggaggactacccgtacgcgtcggacgggctggccgtctggcactccatcgagcagtgggtgacggagtacctggccatctactaccccaacgacggcgtgctgcaggcggacgtggagctgcaggcgtggtggaaggaggcgcgcgaggtcgggcacgccgacctcaaggacgcggcctggtggcccgagatgcagacggtggcggagctcgtcaaggcctgcaccaccatcatctggatcgcgtcggcgctccacgcggccgtcaacttcgggcagtacccgtacgccgggtacctcccgaaccgtccgtccgtcagccggaagccgatgccggtgccgggcagcgacgagtacgcggagctggggaaaaacccggagaaggtgttcgtgcgcaccatcacgagccagttccaggccctcgtcggcatctcgctgctggagatcctgtcgagccactcctccgacgaggtgtacctcggccagcgcgacacgcctgagtggacgtcggacgccaaggcgcaggaggcgttcaggcggttcggcacgcggcttaccgagatcgagagccgcgtgatgaccttgaacgcggacccacggctcaagaaccgcaacgggccggccaagttcccctacacgctgctctaccccaacacctccgacaagaagggcgatgccgccggcatcaccgccaagggcattccaaacagcatctccatctgagttctgactttcgagttctgagcgttttacccgtccgtgaagtgtggtccaaacttgcgcggtattgtgcaaatagccaaatactccttacggaagccgctacagttatgttcgatcgtgtaagacttttataataaggctcccttcagttccccaataataatgaagttaatttgtgttcccctggaaaaatatttacacttaatttttgttgctgttatatgtgtatatgcgattagctagattgattaaactataatgatatctcgttactatactaatttgtgctattatttaacgattttaatactgctaacacttttggtttgtgttcgttattaataaataaatattttcatctttttagttaatatatcgtttttatttaacgtattaattttcttctttctccagggtcatattcttgtcttcatatatcactgcctatctcattttaatttttggtaaaaaactctttttctcttcgttgctaatttcataagtgcaaactatatttcttcaaaatatatactttagacgtgaattat

SEQ ID NO: 2298 - DNA, 2948 bp, Sorghum bicolor
actcacactcatcacacagccaatacccacagctgctagccactcccactccaaggaacaagtagcagtttgcagttagctccgccggtagaaccgaagatgatcggaaagataatcggagacatcacgggcagcaacaagcatgcgcagctcaagggcaacgtggtgctcgtgcgcaagaccgtgctcggcttggacgtcaccagcatcgccggctccctcctcgacggcgttggcgagttcctcggacgcggcgtcacctgccagcttatcagctccaccgtcgtcgaccccaacaatggcaaccgcgggaaggtgggcgcggaggcgagcctggagaagtggctgctgaacccgccgccgcttctgtccggcgagaacaagttccacgtcaccttcgactgggaggtggagaagcagggcattccaggcgccatcatcgtcaagaacaaccacgcctccgagttcttcctcaagaccatcaccctcgacgacgtccccggccacggcaccgtcgtcttcgtcgccaactcatggatctacccgcagtccaagtaccgctacaaccgcgtcttcttctccaacgacacgtacctgcccagccagatgccggcggcgctcaagccttaccgcgacgacgagctccggaacctgaggggcgacgaccagcaaggcccgtacaaggagcatgaccgcgtctaccgctacgacgtctacaacgacctcggcctgcctgacagcggcaacccgcggcccgtcctcggcggcaacaaggagctcccctacccgcgccgctgccgcaccgggcggaaacccaccagaaccgaccccaacagcgagagaaggctgacggtggtcgagggcgacgtctacgtgccgcgcgacgagcgtttcggccacatcaagaagtcggacttctacggctacgcgatcaaggcgctcgtgaacgccgtcatcccggcgatccgcacctacgtcgacctgtcgcccggcgagttcaactccttcaaggacatcatcaagctctacgagggcggcatccagctgcccaaaataccagtccttgaagacctgcggaagcagttcccgctcgagctcgtcaaggacgtcctccccgtcggcggcgactacctcctcaagctccccatgccgcaaatcatcaaagaggacaagacaggttggatgaccgatgaggagtttggacgggagattctcgccggcgtcaaccccatgatcgtcaggcgtctcacggagttccctcccagaagcacccttgaccccagcaagtacggtgaccacacgagcaccatcacggaggcgcacctcgagaacaagctggagggcctcaccgtgcagcaggcgctggaaggcaaccggctctacatcctggaccaccacgacaacttcatgccgttcctgatcaggatcaacaacctggagggcaacttcatctacgccaccaggaccgtgctgttcctgcgcggcgacggcacgctggtgccggtggccatcgagctgagcctgccggagctccgggacggcctgaccaccgccaagagcaccgtgtacacgcccacgtcgaccaccggcgcggaggcctgggtgtggcacctcgccaaggccttcgctaacgtcaccgactactgctggcaccagctggtcagccactggctcaacacgcacgccgtcatggagccgttcatcatcgcgaccaaccggcagctcagcgtgacgcaccccgtccacaagctcctgctgccgcactaccgcgacaccatgaacatcaactccaacgcacgccagatgctcgtcaacgccggcggcctcttcgagacaaccgtcttcccgcgccagtacgcgttcgagatgtccgccgtcatctacaagaactggaacttcaccgagcaggctctccctgacgacctaatcaagaggggcatggcggttgccgatgcatcgagcccgtacaaggtgaagctgctggtggaggactacccatacgcgtcggacgggctggcaatctggcacgcgatcgagcagtgggtgacggagtacctgggcatctactaccccaacgacggcgtgctgcaggcggacgtggagctgcaggcatggtggaaggaggtgcgcgaggtcgggcacgccgacctcaaggacgagccatggtggcccaagatggagacggtggcggagctcgtcaaggcctgcaccaccatcatctggatcgcgtcggcgctccacgccgccgtcaacttcgggcagtacccgtacgccgggtacattcccaaccgtccgtcggtcagccggaagccgatgccggcgccgggcagcgaggagtacgcggagctggggaagaacccggagaaggtgttcgtgcgcaccatcacgagccagttccagacactcgtcggcatctcgctgctggagatcctgtccagccactcctccgacgaggtgtacctcggccagcgcgacacgccggagtggacgtcggacgccaaggcgcaggaggcgttccggcggttcggggcgcggctgaccgagatcgagagccgcgtgatgaccatgaacgccgacccaagtctcaagaaccgcaacgggccggccaagttcccctacacgctgctctaccccaacacctccgacaagaatggcgatgccgccggcatcaccgccaagggcattccaaacagcatctccatctgagttctgagttctgagcgcgaggtccatacggaagccgcagcagttgctctcttcagtcccccaataataaagttattatcatttgtgttccatctatttttctcttaaataacggagtatgtcatcatcagacatgtaaaagaaggttatgtaggagtatttcacaatgtgaaagggggaaatgaactgtattgtctcttgttttttattaaataaaaaatcgggttgtattttgtgtaagc

SEQ ID NO: 2299 - DNA, 2032 bp, Gossypium hirsutum
aattttcccagtgagtcaaactcgaaagccagggttttacactctaatttatcagcctctttctcccccgccgcccatcttttttatttccgtctctttatcttctcatttcttcactgtgtatagagaataagctaaaaagcaaatcaaaccatcttccaccattctttgttgaacatatggctggaggggagcagaaaaagggtggaggggagcagaaaaaggctggcggtggagggaaaaagaaggaagtgaagaaggaaactggtttgggtctctcctttaccaaggatgagaattttggtgaatggtactctgaggttgttgtcaatggtgaaatgattgagtactatgacatttctggatgttatattcttaggccatgggcaatgtcaatatgggagaacatgcaaacgttcttcgatgcggaaatcaagaaaatgaaagtcaagaattgttatttccctctttttgtatctccgggtgttttgcaaaaggagaaggatcacatagagggttttgctcccgaggttgcttgggtgacaaaatctggtgagtctgatttggaggtgccaattgctatccgcccaactagtgagacagttatgtatccctactattctaagtggatcagaggacaccgtgacttgcctttgaagcttaaccagtggtgcaatgttgttcgatgggagtttagcaaccccacaccatttatcaggagtcgtgaatttctatggcaggaagggcatactgccttcgcaaccaaggaagaggcagacactgaggttcttcaaatattggagctataccgacgtatatatgaagaattcttggcaattcctgttacgaaaggcaggaagagtgaactggagaagtttgctggtggactttacacaaccagcgttgaggcatttattccaaacactggccgtggtattcaaggtgcaacctcccattgtttgggccaaaacttcgcaaaaatgtttgagataaactttgaaaatgaaaagggggaaaagtctatggtctggcagaattcctgggcatatagcactcgaacgattggggtaatggtgatggttcacggggataacaaaggcttagtgctgcctccaaaagtagcagctttgcaagttattgtgattcctgtgccttacaaagatgcagatactcaagggatatttgatgcctgtgctgccactgtggcaatcctctctgatgctggtattcgtgctgaagctgatcttagagagaactactcacctggttggaagtactcaaactgggaaatgaaaggtgttcctctaaggattgaaataggacctcgagacttggcaaataatcaggtgcgtgcagttcgccgtgacaatggagaaaagactgatatctctagagtctttttggttgaacaagtaaaaggaatgttggaaaagattcaacagaacctatttgatgtggcaaaacaaaaaagagatgcctgcattgaagttgtaaaaacttgggatgagtttataaaagctctcgggcaaaagaaactgatcttagctccttggtgtgacgaggaggaggtggagaaagatgttaaagctcgaacaaagggtgagatgggagcagctaagtctctatgtaccccatttgaacagcctgaacttccagaaggtactaaatgctttgcttctgggaagcctgcaacaaagtggacctattggggcagaagttactaggtttattcactttttacaaccatctccttttcatggttctttgcctgatgtcaacggttctggtcattggggccattgtaaacagggaaattttcaatttaaaattgttatatgaaactgatgagaagattcagtttttaatcatgttaaaacttctgtggtttttctttttcctttttggcagaattttgctttgctataatagatatactgtgttttatctgatatttattacaatttgcatacttagaatatatggtcattgtacttgggaaatcttgaatgtcatgttctggttgatatggtaa

SEQ ID NO: 2300 - DNA, 1958 bp, Theobroma cacao
tgtgcaaatccagggttttacacactctaccagcacctttctccctctcgcccccgcctatcttctttcttcatttctttatcttttcttcactgtgtcgagggaaggagccaacgcaaccaaggaatccaaaccattctcgttgatgatatggctggacgggagcagaaaaagtctggcggtggagggaaaaagaaggaagtgaagaaggagactggcttgggtctctccttcactaaggatgagaatttcggggaatggtactctgaggttgttgtcaatggtgaaatgattgagtactatgacatttctggctgttatattctgaggccatgggcaatttcaatttgggagaacatgcaaacattctttgatgcagaaatcaagaaaatgaaagtcaagaactgctatttccctctctttgtatctccaggtgttttgcaaaaggagaaggatcacgttgagggttttgctccagaggttgcttgggtgaccaaatctggggagtctgacttggaggtgccaattgcaatccgcccaactagtgagacagttatgtatccctactattctaagtggataagaggccaccgtgacttgcctttgaaacttaaccagtggtgcaatgttgttcgatgggaatttagccatcccacaccatttatcaggagtcgtgaatttctctggcaggaagggcatactgccttttcaacaaaggaagaggcagacacagaggttcttcaaatattggaactgtaccgacgtatatatgaagaattcttggctattcctgttataaaaggcaggaagagtgaattggagaagtttgctggtggactttacacaactagtgttgaggcatttattccaaataccgggcgtggtattcaaggtgcaacgtcccattgtttgggccaaaattttgcaaaaatgtttgagataaactttgaaaatgaaaagggtgagaaggctatggtctggcagaattcctgggcgtatagtacacgaacgattggggtaatggtgatggttcatggggatgacaaaggcttggtgctacctccaaaagtagcagctgtgcaagttattgtgattcctgtgccttacaaggatgcagatactcaaggtatttttgatgcctgtgttgccactgtggcaaccctgacagaagctggtattcttgctgaagctgatcttagagataactactcacctggttggaagtactcagactgggagatgaaaggtgttcccctaaggattgaaatagggcctagagacttggcaaataatcaggtgcgtgcagttcgccgtgacaatggagcaaaaactgatatctctagagtatttttggttgaacaagtaaaaggaatgttggataagattcaacagaacctgtttgacgttgcaaaacaaaagcgagatgcctgtgttgaagttgtaaaaacttgggaagagtttgtaacagctcttggtcagaagaaaatgatcttagctccttggtgtgatgaggaggatgtggagaaagatgtgaaagcacgaacaaagggtgagatgggagcagccaagtctctttgtaccccatttgagcagcctgaactcccagaaggtactaaatgctttgcttctgggaagcctgcaaagaagtggacctattggggcagaagttactaagatcattgtcttttacgaccatctccttcccatggtcctgtggctgatgtcagcagtgctggtgtgtctggaccattctaaacatggccattttcaatttaaaattgttatagaaaactaatgagaagtctcagttttgttatcatattgttaaaacttctgggatttttgtttttggcaagggtgttttgttgaattgtagctttgctgcaattgatctactggtttatcctgtgttattacaaactgttagaatatgattataattacttgaaagtcttgat

SEQ ID NO: 2301 - DNA, 1573 bp, Gossypium hirsutum
aaaccctaaacaaacacctcacactgcttagtctccctcatcgttccattagtcttctcctaaacggcggcatcttcatcttacaattcggcctccctctttcacattctttaagttgaacatatggctggaggggagaagaaaaagtctggcggtggagggaaaaagaaggaagtgaagaaggagactggtttgggtctttccttcaccaaggatgagaattttggggaatggtactctgaggttgttgtcaatggtgaaatgattgagtactatgacatctctggatgttatattcttaggccatgggcaatgtcaatatgggagaacattcaaacgttctttgatgcggaaatcaagaaaatgaaagtcaagaactgctatttccctctttttgtatctccaggtgttttgcaaaaggagaaggatcacatagagggttttgctcccgaggttgcttgggtgacaaaatctggtgagtctgatttggaggtgccaattgccatccgcccaactagtgagacagttatgtatccctactattctaagtggataagaggacaccgtgacttgcctttgaagcttaaccagtggtgcaatgttgttcgatgggagtttagcaatcccacaccatttatcaggagtcgtgaatttctatggcaggaagggcatactgccttcgcaacaaaagaagaggcagacactgaggttcttcaaatattggaactgtaccgacatatatatgaagaattcttggcaattcctgttacgaaaggcaggaagagtgaactggagaagtttgctggtggactttacacaaccagtgttgaggcatttattccaaacactgggcgcggtattcaaggtgcaacctcccattgtttgggccaaaactttgcaaaaatgtttgagataaactttgaaaatgaaaagggaaagtctatggtctggcagaattcctgggcatatagcactcgaacgattggggtaatggtgatggttcatggggataacaaaggcttagtgctgcctccaaaagtttcagctttgcaagttattgtgattcctgtgccttacaaagatgcagatactcaaggtatctttgatgcctgtgctgccaccgtggtaaccctctctgatgctggtattcgtgctgaagctgatcttagagagaactactcacctggttggaagtacttaaactggaaaatgaaaggtgttcccctaaggattgaaaaaggacctcgagacttggcaaataatcaggtgcgtgcggttcgccgtgacaatggagaaaagactgatatctctagagtctttttggttgaacaagtaaaaggaatgttggataagattcaacagaacctattcgatgtggcaaaacaaaaagagatgcctgcattgaagttgtaaaacttgggacgagtttgtaaaagctctcgggcaaaagaaactcatcttagctccttggtgtgatgaggaggaggtggagaaagatgttaaagctcgaacaaagggtgagatgggagcagctaagtctctttgtactccattcgaacagcctgaactccca

SEQ ID NO: 2302 - DNA, 1868 bp, Carica papaya
ctgacgcgaagaagaagaagaagaagaagagatcagttgtttattagaggagtgacgagctgaaaattggaggcagtgaagtggtattttctttaaattaaagaacatatggctggcggtggaggtaaaaagaaggaagtgaagaaagagactggcttagggctttcaaataagaaggatgtgaattttggagaatggtatgctgaggtttgtgtcaatggtgagatgatagagtattacgacatatctggatgttatattctgaggccatgggcaatggcaatttgggataccatgcaaacattctttgatgctgaaatcaagaaaatgaaagtcaagaattgttatttccccctttttgtttcccctggggttttagagaaggagaaggatcacattgaaggatttgctccagaggttgcttgggttaccaaatctgggaaatccgatttggaagtgcctattgctattcgcccaaccagtgaaactgtgatgtatccatattattcaaagtggataaggggacatcgagacttgcctctgaaactaaaccagtggtgcaatgttgtcagatgggagttcagcaaccctacaccatttatcaggagtcgtgagtttctgtggcaggaagggcatactgcttttgccacaaaggaagaggcagatacagaggtgcttgaaatattggaactgtaccgacgtatttatgaagagttcttggctattcctgtcattaaaggcaagaagagtgagatggagaagtttgctggtgggctttacacgacaagtgtcgaggcatttattccaaacacgggtcgtggtgtacaaggtgcaacctcacattgtctgggccaaaactttgcaaagatgtttgaaataaactttgaaaatgagaagggagagaaggccatggtctggcaaaattcttgggcctatagtactcgcacgattggggtcatggtgatggtccatggagatgacaaaggcctggtgttacctcctaaagtagcatctgttcaagttgttgtagtccctgtaccatataaagatgctgatactcaaggaatttttgatgcatgtgctgccactgtagctaccttagatgaggctggtattcgtgctgaggccgacttcagagacaattattctcctggttggaagtactcacactgggaaatgaagggtgttcccttgaggattgaaatagggccaaaagatttggctaacaatcaggtacgtgctgtccgacgtgacaatggagcgaaaactgatattcccaggggtaacttggttgagcaaatagaagaaatgctgggtaagattcagcaaagcctgtttgaaagtgcaaaacaaaaacgagacacatgcgtacaaattgctaaaacttgggatgaatttgtggaggctctaggacagaagaaattaatcttagctccatggtgtgatgaagaggaggtggagaaggatgtgaaaacacgaactaagggtgaaatgggagcagctaagactctttgttctccctttgaccagccagaacttcctgaaggtactaaatgttttgcttccgggaagcctgcgagaaagtggacctactggggaaggagttactagattgttgtggcacccgacgtgcactcctcttgaacatggttattgacacccgatctcgaaatttctgaaattgttactggaatgaaattgatgggacaaacccagattgttcatctttatcatatatggtttttagttttgctactttgtactttcagaaaaaaatgatgatcatcggatatttacttacaatgagctgcaattttatttgtttaagagctctagaaatgaataaaatttttaaagttcttatagtg

SEQ ID NO: 2303 - DNA, 1666 bp, Castanea mollissima
tcacagccctccgtttctttcgttcgcagacctataatagagttttctttctcccgcccccaacccaaaaatccagaaactgactcactctctctccgacagcaggagtaagctgaggaaatggccggtggcgatgcaaaaaagtctaatgcaagtggtggggggaaaaagaaggaggtgaagaaggagactggtttgggactagcgaatcgcaaggatgagaattttggggagtggtattctgaggtagttgtgaatggagaaatgattgagtattatgatatctctggctgttatattctgaggccatgggcaatggctatttgggagataatgcaaaaattttttgatgctgaaataaagaaaatggacatccagaactgctacttcccactttttgtttctcctggcgtattacagaaggagaaggatcatgttgagggttttgctcctgaggttgcatgggtaacaaaatctggggaatctgagttggaagtgcccatagcaattcgcccaacgagtgaaactgtcatgtatccttactattctaaatggattaggggacaccgtgacttgcctttgaaacttaatcaatggtgcaatgttgttcgatgggaattcagccatcctacgccatttatcaggagtcgtgagtttctttggcaggaagggcacactgcttttgcaacaaaagcagaggcagatgcagaggtgctagatattttggaactgtatagacgcatatatgaagagtacttggctattcctgttgtaaagggaaagaagagtgagatggagaagtttgctggtggactttacacaactagtgttgaggcatttgttccaaatactggtcgtggcatacaaggtgcaacttcgcattgtctgggtcaaaattttgctaaaatgtttgagataaactttgaaaatgagaagggagagaagggtatggtctggcagaactcatgggcctatagcactcggacgattggtgttatggtgatggttcatggggacgacagaggcttagtgctgccaccaaaagtagcatctgtccaggttattgtaattcctgtgccttataaagatgctgatactcaggcaatctttgatgcctgttctgccactgtggcctccttgtctgaggcaggtattcgtgctaaggcagactctagagataattactctcctggttggaagtactcacattgggaaatgaaaggcgttcctctaagaattgaaattggtccaaaagacttggcaaatagtcaggtacgtgctgttcgccgtgataattcagcaaaaacagacatccctagggacaagctggttgagcaagtaaaagaaatgctggacaatatccaacaaagcctgtttgatgctgccaaacaaaaacgagatgcttgcattcagactgtaaaaacttgggatgaatttgtggaagcactcggccaaaggaaaatgatcttagcaccttggtgtgatgaggaggaggtggagaaagaagtaaaagcaaggacaaagggtgagatgggagcttgtaagagcctttgttccccatttgaccagccagagctcttagaaggtactaaatgctttgcgtctggaaagcctgcaaaaaaatggacgtactggggaaggagttactagattattgatttttgac

SEQ ID NO: 2304 - DNA, 1902 bp, Castanea mollissima
ccctccgtttctttcgttcgcagacctataatagagttttctttctcccgcccccaacccaaaaatccagaaactgactcactctctctccgacagcaggagtaagctgaggaaatggccggtggcgatgcaaaaaagtctaatgcaagtggtggggggaaaaagaaggaggtgaagaaggagactggtttgggactagcgaatcgcaaggatgagaattttggggagtggtattctgaggtagttgtgaatggagaaatgattgagtattatgatatctctggctgttatattctgaggccatgggcaatggctatttgggagataatgcaaaaattttttgatgctgaaataaagaaaatggacatccagaactgctacttcccactttttgtttctcctggcgtattacagaaggagaaggatcatgttgagggttttgctcctgaggttgcatgggtaacaaaatctggggaatctgagttggaagtgcccatagcaattcgcccaacgagtgaaactgtcatgtatccttactattctaaatggattaggggacaccgtgacttgcctttgaaacttaatcaatggtgcaatgttgttcgatgggaattcagccatcctacgccatttatcaggagtcgtgagtttctttggcaggaagggcacactgcttttgcaacaaaagcagaggcagatgcagaggtgctagatattttggaactgtatagacgcatatatgaagagtacttggctattcctgttgtaaagggaaagaagagtgagatggagaagtttgctggtggactttacacaactagtgttgaggcatttgttccaaatactggtcgtggcatacaaggtgcaacttcgcattgtctgggtcaaaattttgctaaaatgtttgagataaactttgaaaatgagaagggagagaagggtatggtctggcagaactcatgggcctatagcactcggacgattggtgttatggtgatggttcatggggacgacagaggcttagtgctgccaccaaaagtagcatctgtccaggttattgtaattcctgtgccttataaagatgctgatactcaggcaatctttgatgcctgttctgccactgtggcctccttgtctgaggcaggtattcgtgctaaggcagactctagagataattactctcctggttggaagtactcacattgggaaatgaaaggcgttcctctaagaattgaaattggtccaaaagacttggcaaatagtcaggtacgggctgttcgccgtgataattcagcaaaaacagacatccctagggacaagctggttgagcaagtaaaagaaatgctggacaatatccaacaaagcctgtttgatgctgccaaacagaaacgagatgcttgcattcagactgtaaaaacttgggatgaatttgtggaagcactcggccaaaggaaaatgatcttagcaccttggtgtgatgaggaggaggtggagatagaagtaaaagcaaggacaaagggtgagatgggagcatgtaagagcctttgttccccatttgaccagccagagctcttagaaggtactaaatgctttgcatcgggaaagcctgcaaaaaaatggacgtactggggaaggagttactagattattgatttttgacatgatttcttctcctggtgttcctcaatccgtttgagatgttatggaatctgcgattctcaagaattagcgagtaatagtattttctacaaacaaatacaaggacaccattttaaaaagaattaaaaattaatagtccatatgtatggatcttacatgaaaaagtgaaatcatttgctttgctacaagcaaaaggctataatgtttttatattgttgattttttaatgtcttagatatgact

SEQ ID NO: 2305 - DNA, 1854 bp, Citrullus lanatus
tcctgcagaagttaaaaactgaaaacatggccggtcctaagcctggtagctctactactaaccctaaagctggcgggaaaaagaaggaggtgaagaaagagactggtttaggtctcactaataagaaggacgataattttggagagtggtattctgaggtggttgtcagtggagaaatgattgagtattatgatatctctggctgttatatactgaggccgtgggcaatatctgtctgggagactatgcaagtattttttgatgcagaaattaagaaaatgaaaatcaagaactgctattttccactttttgtatctcctggcgtcttacaaagagagaaagatcatatagaaggttttgctcctgaggttgcttgggtgacaaaatctggggagtctgacttggaagtgcccattgcaattcgtcctacaagtgagactgttatgtatccatactattctaagtggatcaggggccaccgtgacttgcctttgaaacttaaccagtggtgcaatgttgtgagatgggagttcagccatcccacaccatttattaggagtcgtgagttcctttggcaggaagggcatactgcttttgctactaaggatgaagcagatacagaggttcttgagatattggaactgtataggcgcatatatgaagaatacctagcgattcctgttatcaagggcaagaagagtgagatggagaagtttgctggtggtctttacaccacaagcgttgaggcatttatcccaaacactggtcgtggaattcaaggtgcgacttcacattgcctgggtcaaaattttgcaaaaatgtttgaaatcaactttgaaaatgaaaagggggagaaagctatggtctggcaaaattcgtgggcctatagtaccagaacgattggtgtgatggttatggttcacggtgatgacaagggattggtgctgcctcccaaagttgcatcagttcaagtcattatagttcctgtaccttacaaagatgcagacactcaaggaatttttgatgcttgttctgccactttggatacattgtccaaagcaggaattcgtgcagaggtagaccttagggataattattctcctggatggaagtactcccactgggagatgaaaggtgttccactcaggattgaaatagggcctaaggacttggcaaacaatcaggtacgtgcagttcgccgtgataattccggaaagaaggacatacctagggcttcgttggttgaacaagtgaaagaattgctagaaagtattcaacaaagcctgtttgatgcagcaaaagaaaaacgagatgcatgcattcaggttattaatacatgggaggagtttactgaagcactcggtcagaagaaaatgatattagctccatggtgtgatgaagaggaggttgagaaggatgtaaaaacaaggactaaaggtgagatgggagcagcaaaaaccttatgttccccgtttgagcagcccgcccttccagaaggtaccaaatgttttgcatctgggaagcctgcaaagaaatggagctattggggccgaagctactaagctatcagctcgtttttatctccttcaaattgcctggatacagaatgtcaagaaatcagctttagagttcttgagttcgggggcattcgattcagtttaatccgagttcatcataatttccaatggtcagtctaaaagcattcactaagcaagtttaactatagaacatttttttaaaaactctgtttgcatacttgggatttatttcaaaatttatgggttttgcctttcaaccttggttttcagttctgttaaactaggccaactcttggagttcctaaattatatattt

SEQ ID NO: 2306 - DNA, 1871 bp, Euonymus alatus
cttacagtttacctgctgaagatatggctggtgatgatgtaaaaaagcccaaggctaaagctagtggtgggggcaaaaagaaggaggtgaagaaagagactggattagggctttcctttaagaaggaggagaactttggagaatggtattcagaggtggttgtcaatgctgaaatgattgagtattatgatatctctggctgttatattttaagaccatggacgatgtcaatatgggagatcatgcaagcctttttcgatgcagaaattaagaaaatgaaaatcaagaactgttacttccctctttttgtatctcctggtgttcttgagaaggagaaggatcacatagaaggttttgctccagaggtagcgtgggtaacaaaatctggtaaatctatcttggaaaaacctattgcaattcgtccaactagtgagactgttatgtatccctactactctaagtggattaggggacaccgtgacttgcctttgaaacttaaccagtggtgcaatgttgttcgatgggagtttagcaatcctacaccatttatcaggagtcgcgagtttctttggcaagaagggcatacggcttttgcaacaaaggaagaggcagacacagaggttctcgaaatattggaactatacaggcgtatatatgaagaattcttggcagttcccgttataaaaggcaagaaaagtgaaatggagaaatttgctggtggactttacacaacaagcgtggaggcgtttattccaaacacaggtcgtggtatacaaggtgcaacttctcattgtttgggccaaaattttgcaaaaatgtttgagattaactttgaaaatgagaagggagagagggccatggtctggcagaattcttgggcatacagtactagaacgataggagtaatggtgatggttcatggggatgacaaaggcttggtgctaccacctaaagtggcctctgttcaagttattgtaattccagtgccttataaagatgctgatactaagggaatatatgatgcatgtgctgcaaccgttgaggtcttgtgtgaagcaggtatccgcgctgagattgactccagagataattattctcctggctggaaatattcgcactgggaaatgaaaggtgttcctttaaggattgaaatcggtcctaaagacttggcaaacaatcaggtgcgtgctgttcgccgtgacaatggagcaaaattagatttaagccgggacagtttggttgaccaagtgaaaactatgcttgacaacattcatgaaagcctgcttgatgctgcaaaaacaaaaagcgggatgcgtgtgtccaagtagtcaaaacttgggatgagtttatggaggctctcagccaaaggaaattgatattggctccatggtgtgatgaggaggaggtggaacaagatgttaaagcccaaacaaagggtgagaagggagcggcaaagaccctctgttccccattcgatcagccagaactcccagaaggtaccaaatgctttgcctcagggaagcctgcaaagaaatggagctactggggaaggagttactagattattacgaggaagttgtctttgcaaattttcttgaatacgcacagtagggaattgttagtgggaagatatatcgatcaacaccccattgaatgatagggtgcaatcgtgggttttatttttccttttctacacgtgattacttattctagcccaacttttcccatccattggagataattatagatttttcatttaccttttcacattgttggggacgggacgggacggaaaaagatgtgtttggttagtcaaaaggtcgagaaaggaaaagttaaaaggtgtatttttgtttgtttgtgagataaaa

SEQ ID NO: 2307 - DNA, 1928 bp, Nicotiana benthamiana
aacatggttatcgactggtagggtgaattcattctgtaactccaatagaggggtgaatctgaattctactcgcaagtcaaacaggataaagagcagtgtctcattttcccttgctctttcctagcggcgacactcttctcctacttcacagagctgcgccgcttccttaatcctcaaaccctcctctctccgacgtcgtttgcgcctctctttgtacccaagtaccctggctattgggagggaacatatttagctgttgtttgaggtgtttgctgctatggctggtaaagattcaaataggggaaaaaagaaagaagtcaagaaagagacaggtcttggtctctcttccaaaaaagatgagaacttcggggagtggtattctgaggttgttgtcagtggtgaaatgattgagtactatgacatttctggctgttatatcttacggccatgggcaatgtccatttgggagatattgcatactttttttgatgctgaaattaagaagatgaagataaagaactcctacttccctctttttgtgtctcctggtgttctacaaaaggaaaaggaccacatagaaggatttgctcctgaggttgcttgggttacaaaatctggagagtctgatcttgaagtgcccattgcaattcgaccaacgagtgaaacggtgatgtatccttatttctctaagtggataaggggacatcgtgacttacccttgagacttaaccagtggtgcaacgttgtgcgatgggagtttagcaacccaaccccctttatcaggagccgtgagtttctttggcaagaaggacacactgcttttgcaactaaggaggaggcagatgcagaggttcttgatatcttggagttgtatagacgtatatacgaagaattcttagccgttccagtgagtaagggaaagaaaagtgagcttgaaaagtttgctggtggactctatacgaccacagtagaagcttttatccctaatactggccgtggtatccaaggtgcaacttcacactgcttaggccagaattttgcaaaaatgtttgagataaactttgaaaacgagaagggagagaaggctatggtctggcagaattcctgggcctatactaccagaacgattggggtgatgatcatggttcatggagatgataaaggcctggtcttacctcctaaagttgcagcaacacaagtaattgttattcctgtgccatacaaggatgctaatactcaagggatctttgacgcctgtgctgccactgtcaaaaacttgaacgaatcaggtattcgtgctgaggcagactacagagacaactactcacctggctggaaatattctcactgggaaatgaaaggggttcctcttaggattgaaataggaccaaaagatcttgcaaataatcaggtacgagctgttcgacgtgacaatggagccaaagctgatattcctgtggccaatatagctgaacaagtaaaaaatgtgctcgcctctatccaacaaaatctatttgatgttgcgaaacaaaagcgggatgcttgtgttcaggttgtaaagacctgggatgaatttgctgaagcattaagccaaaaaaaattgatcttggctccttggtgtgatgaggaggatgtcgagaaagatgtgaaggcacggacaaaaggggagatgggtgcagcgaagactctctgttcaccatttgaccagcctgagctgcctgaaggtacattgtgctttgcctcgggtaaacctgctaagaaatggacatactggggccgcagctattgatgattcatattgatctctattccatttttccgagttgaattgctaattgcaaccatcagtttctttcttaacatgttttgtgctggatagttcacttcgtcttttgtttccccttttttccaatcttaaattgaatttt

SEQ ID NO: 2308 - DNA, 2144 bp, Quercus alba
tctccgacagcgggagtaagctgaggaaatggctggtggcgatgcaaaaaagtctaatgcaagtggtggggggaaaaagaaggaggtgaagaaggagactggtttgggactagcgaatcgcaaggatgagaattttggggagtggtattctgaggtagttgtgaatggagaaatgattgagtattatgatatctctggctgttatattctgaggccatgggcaatggctatctgggagataatgcaaaaattttttgatgctgaaataaagaaaatggacatccagaactgctacttcccactttttgtttctcctggcgtattacagaaggagaaggatcatgttgagggttttgctcctgaggttgcctgggtaacaaaatctggggaatctgagttggaagtgcccatagcaattcgcccaacgagtgaaactgtcatgtatccttactattctaaatggattaggggacaccgtgacttgcctttgaaacttaatcaatggtgcaatgttgttcgatgggaattcagccatcctacgccatttatcaggagtcgtgagtttctttggcaggaagggcacactgcttttgcaacaaaagcagaggcagatgcagaggtgctagatattttggaactgtatagacgcatatatgaagagtacttggctattcctgtcataaagggaaagaagagtgagatggagaagtttgctggtggactttacacaactagtgttgaggcatttgttccaaatactggtcgtggcatacaaggtgcaacttcgcattgtctgggtcaaaattttgctaaaatgtttgagataaactttgaaaatgagaggggagagaagggtatggtctggcagaactcatgggcctatagcactcggacgattggtgttatggtgatggttcatggggacgacagaggcttagtgctgccaccaaaagtagcatctgtccaggttattgtaattcctgttccttataaagatgctgatactcgggcaatctttgatgcctgttctgccactgtggcctccttgtctgaggcaggtattcgtgctaaggcagaccctagagataattactctcctggttggaagtactcacattgggaaatgaaaggcgttcctctaagaattgaaattggtccaaaagacttggcaaatagtcaggtacgtgctgttcgccgtgataattcaacaaaaacagacatccctagggacaagctggttgagcaagtaaaagaaatgctggacgatatccaacaaagcctgtttgttgctgccaaacaaaaacgagatgcttgcattcagactgtaaaaacttgggatgaatttgtggaagcactcagccaaaggaaaatgatcttagcaccttggtgtgatgaggaggaggtggagatagaagtaaaagcaaggacaaagggtgagatgggagcatgtaagagcctttgttccccatttgaccagccagagctcttagaaggtactaaatgctttgcgtctggaaagcctgcaaaaaaatggacgtactggggaaggagttactagattattgatttttgacatgatttcttctcctggtgttcctcaatctgttcgagatgttatggaatctgcgattctcaagaattagctagcaatagtattttctacaaaacaaatacaaggacaccatttaaaaaaaaaaaaaaaattaatagtccatatgtgtggatcttacatgaaaaagtgaaatcatttgctttgctaaaagcaaaaggctacaatgttttttatattgttgattttttaatgtcttagatatgtgactcgttgctttagattgaattctctcttttgagttccaagttggttagtgatatgaatcagtaaccccttttctgaatggtagtcatgggtaaaaaagaaaactggaatgctaatgccggtgcaatgcatgaatgtcacttttcttattctaatgtgcatacaggcattggcaaatgaaatagcccttaagtgaaggtgtgatgttttgatagctggtgattgtgaatgctcatcgtgaacttcaaaaatattttcatcacctattttcctttatgttatatatgtatcgattaaagaaatcctttagctggtgcgtgttgcactt

SEQ ID NO: 2309 - DNA, 2054 bp, Solanum phureja
tgtcgcattttcgttactctttcttagcgttgacactctcttctccttcagtgctgcgccgccgcttcatcctcaaaccctcctcattacgacgtcgttttcgtctctattcatagccaagtatcttggcaatttggagggaacattattagctgtcgtttgaggtgtttgctgccatggctggtaaagatgcagataagggaaaaaagaaagaaggcaagaaagaggtagttcatggaaaaaagaaagaagtcaagaaagagacaggtcttggtctctcttacaagaaagatgagaactttggagagtggtattctgaggtggttgttagtggtgaaatgattgagtactatgacatttctggctgttatatcttacggccatgggcaatgtccatctgggagatattgcagaccttttttgatgctgaaattaagaagatgaagataaagaactcctacttccctctctttgtgtcccctgctgttctacaaaaggaaaaggaccacatagagggatttgctcctgaggttgcttgggttacaaaatctggagactctgatctggaggtgcccattgcgattcgaccaacaagtgaaactgtgatgtatccttatttctcgaagtggattaggggacatcgtgacttgcccttgagacttaaccagtggtgcaacgttgtgcgatgggagtttagcaaccccacccccttcatcaggagccgtgaattcctctggcaagaaggtcacactgcttttgcaactaaggaggaggcagatgaagaggttcttgacatcttggagttgtatagacgtatatatgaagaattcttagctgttccagtaagtaagggaaagaaaagcgagcttgagaagtttgctggaggactttacacgactacagtagaggcttttatccctaatactggtcgtggtatccaaggtgcaacttcacactgtttgggccaaaatttcgcgaagatgtttgagataaattttgaaaatgagaagggagagaaggctatggtctggcagaactcctgggcctatactaccagaacgattggtgtgatgatcatgactcatggagatgataaaggcctggtcttacctcctaaagttgcaacaactcaagtagttgttatccctgtgccatacaaggatgctaatactcaaggaatctatgatgcctgtgctgccactgttaaaagcttgaatgaatcaggtattcgtgctgaggctgacttcagagacaactactcgcctggctggaaatattctcactgggaaatgaagggggtccctcttaggattgaaataggaccaaaagatcttgcaaataaccaggtacgagctgttcgccgtgacaatggagccaaaactgatattcctgtggcaaacttagtcgaacaagtaaaagatgtgctcgattctatccaacaaaatctatttgaaactgcaaaacaaaagcgggaagcttgtgttcaggttgtaaagacctgggatgaatttgcagaagcattgggccaaaagaaattgatattggctccttggtgtgatgaggaggatgttgagaaagaagtaaagacacgcacaaaaggggagatgggtgcagcgaagactctttgttctccatttgaccagcctgagctgcctgaaggtactttgtgctttgcctcgggtaaacccgctaagaagtggacatactggggtcgcagctattgatgattcattttcatctcttttatatttttctgcgttatggtgatatgggaaattgaattccagaacttcaattgtaacatgagtttctttcttaaagactgattgttgttctagttccccagaattttttatttactatctatacagaatgttttgtgcttgataatcattcactttgttagtttcagcctttatttcccccttttttccaatcttatattggattaattttgtagttcacaaatcaaagagatgcttttaaacatttacccctcttctttcttggatcttatgagtactttcaagaaatgatataataccaaattttcc

SEQ ID NO: 2310 - DNA, 2038 bp, Solanum lycopersicum
attgtcgcattttcattgctctttcttagcgttgacactctccttctccttcactgttgcgccgccgcttcatcctcaaaccctcctcagtacgacgccgttttcgtctctcttcatagccaagtatattggcaatttggagggaacattatttgctgtcgtttgaggtgtttgctgccatggctggtaaagatgcagataagggaaaaaagaaagaaggcaagaaagaggtagttcatggaaaaaagaaagaagtcaagaaagagacaggtctcggtctctcttacaagaaagatgagaactttggagagtggtattctgaggtggttgttagtggtgaaatgattgagtactatgacatttctggctgttatatcttaaggccatgggcaatgtccatctgggagatattgcagacctttttcgatgctgaaattaagaagatgaagataaagaactcctacttccctctctttgtgtcccctgctgttctacaaaaggaaaaggaccacatagagggatttgctcctgaggttgcttgggttacaaaatctggagactctgatctggaggtgcccattgcgattcgaccaacaagtgaaactgtgatgtatccttatttctcgaagtggattaggggacatcgtgacttgcccttgagacttaaccagtggtgcaacgttgtgcgatgggagtttagcaaccccacccccttcattaggagccgtgaatttctctggcaagaaggtcacactgcttttgcaactaaggaggaggcagatgaagaggttcttgacatcttggagttgtatagacgtatatatgaggaattcttagctgttccagtaagtaagggaaagaaaagtgagcttgagaagttcgctggaggactctacacgactacagtagaggcttttatccctaatactggccgtggtatccaaggtgcaacttcacactgtttgggccaaaatttcgcaaagatgtttgagataaattttgaaaatgagaagggagaaaaggctatggtctggcagaactcctgggcctatactaccagaacgattggtgtgatgatcatgactcatggagatgataaaggcctggtcttacctcctaaagttgcaacaactcaagtagttgttatccctgtgccatacaaggatgctaatactcaagggatctatgatgcctgtgctgccactgtcaaaagcttgaatgaatctggtattcgtgctgaggctgacttcagagacaactactcgcctggctggaaatattctcactgggaaatgaagggggtccctcttaggattgaaataggaccaaaagatcttgcaaataaccaggtacgagctgttcgccgtgacaatggagccaaaactgatattcctgtggcaaacttagtcgaacaagtaaaagatgtgctcgattctatccaacaaaatctatttgaaactgcaaaacaaaaacgggaagcttgtgttcaggttgtaaagacctgggaggaatttgcagaagcattgggccaaaagaaattgatattggctccttggtgtgatgaggaggatgttgagaaagaagtaaaggcacgcacaaaaggggagatgggtgcagcgaagactctttgttctccatttgaccagcctgagctgcctgaaggtactttgtgctttgcctcgggtaaacccgctaagaagtggacatactggggtcgcagctattgatgattcattttcatctcttttatatttttctgcgttatggtgatatgggaaattgaattccggaacttcaattgtaacatgagtttctttcttaaggactgattgttgttctagttccccagaatttttgatttactatttatacagaacgttttgtgcttgataattcagtttgttagtttcagcctttattttctttccaatcttacattggattaattttgtagttcacaaatcaaagagatgcttttaaacatttacccctcttcttggaagtactttcaagaaatgatataataccaaaattttcc

SEQ ID NO: 2311 - DNA, 1547 bp, Euphorbia peplus
ggtattctgctcgacttgaattagcgaaatggcaggtgggggcaagggcaaaaagaaggaggtcaagaaagagactggattgggcctctctttcaagaaggatgagaacttcggagaatggtattcggaggtggttgtccatggcgagatgattgagtactatgatatttctggctgttatattttaaggccatggtcaatgtcaatttgggaggtcatgcaagcattttttgatgcagagataaaaaagatgaaagttaagaactgttacttccctgtttttgtctcatctactgttttggaaaaggagaaagaccacatcgagggctttgctccagaggtcgcttgggtgacaaaatctgggaaatctgacttggaagttccaattgcaattcggccaactagtgagactgtcatgtatccctactattctaagtggataaggggacaccgtgatttgcctttgaaacttaaccagtggtgcaatgttgttcgttgggagtttagcaatcctactccatttattaggagccgtgagtttctttggcaggaagggcatactgcatttgcgactaaggaagaagctgatgacgaggttcttgaaatattggaactatacagacgcatatatgaagaattcttggccattcctgttttcaagggaaggaaaagtgagatggaaaaatttgctggtggactttacacaaccagtgttgaggcatttattcccaacacgggacgtggtgtacaaggtgcaacttctcattgtctgggccaaaattttgcaaaaatgttcgagattaactttgaaaatgaaaagggcgagaagggtatggtctggcagaactcctgggcatatagcactaggacaattggggtgatggtcatggttcacggagatgacaaaggcttagtgctgcctcctacagttgcatccactcaagttattatcgttcctgtaccctataaagatgctgatatgcaagggatttacgatgcttgttctgcaactgtggatgccttatccaaggcaggcattcgtgcagaggcagatttgagggaaaattactcacctggctggaagtactcccactgggaattgaaaggtgttcccctaaggatcgaaataggaccaaaagatttggcaaataatcaggtacgtgctgttcgtcgtgacaatgcgactaagaaagatttaagcagggataatttggttgaattagtgaagggaactctagatgacattcaaaaaagtatgtttgatgctgctaagcaaaagcgagatgcttgcattcaaactgcaaagacttgggatgaatttaaggaggctttgaatcagaggaaaatgatcttagctccttggtgtgatgaagaggaggtggagaaagatgtgaaagaacggacaaaaggcgaaatgggagcagccaagagtctttgcactccctttgaccagccagagctccctgaaggaactttatgctttgcctctggaaaaccagcaaagaagtggacatattggggcagaagttattagatgattattggtc

SEQ ID NO: 2312 - DNA, 2189 bp, Ricinus communis
cgcaaatacacccgatatgtatcgagtcgagccacctaaccaaatggtgattcggtttccacaaacagagacggacacaatatgaaatgtcaaattcgaaacaagtcagcactagccactagggttttgggcttcatataaagcgcgcccttcgctttgtttcttactgtaacctcttatcgtttctcttttctctctctttttactgctaccaatagagaggagaaagagaacgcacgctatcaaaagaaaatcgattttcaggtattgtggtcaagttgagttggcgaaatggctagtgggggcaaaggaaaaaagaaggaggtgaagaaagagactggattgggactctcctttaaaaaggaagaacaatttggagaatggtattcagatgtggttgtgagtggtgagatgatagagtattatgatatctctggctgttatatcttgaggccatgggcaatgtcaatttgggaggtcatgcaaacattctttgatgcagaaatcaagaaaatgaaaattaagaactgttactttcccctttttgtttcatctagtgtcttagaaaaggagaaggatcacatagagggatttgctccagaggttgcttgggtgacaaaatctgggaaatctgacttggaaattcctatagcgattcgcccaactagtgaaacagttatgtatccctactattctaagtggatcaggggacaccgtgatttgcctttgaaacttaaccagtggtgcaatgtcgtccgttgggaattcagtaatcctactccattcatcaggagccgtgaattcctttggcaggaagggcatactgcttttgcaacaaaggaagaagcagatgaagaggtccttcaaatattggagctgtataggtgtatatatgaagaattcttggccgttccagtcgtgaaaggcaaaaaaagtgagagggagaaatttgctggtggactttacacaaccagtgttgaggcatttattcccaacactggacgtggtattcaaggtgcaacttctcattgtttgggtcaaaactttgcaaaaatgtttgagataaactttgaaaatgagaagggagagaagggtatggtctggcagaactcgtgggcctatagtactcgaacgattggggtgatggtgatggttcatggtgatgacaaaggcttagtgctgccacctaaagtggcatctgttcaagttattgtgattcctgtgccctacaaagatgctgatactcaaggcatttttgatgcttgcactgaaactgtggatgccttgtgcaaggtaggcatccgtgcagagagtgacttcagagacaattactctcctggctggaagtactctcactgggaggtgaaaggtgtacccctaaggattgaaatagggccaaaagatttggcaaataatcaggtacggactgttcgtcgtgataacgcaaccaaaaaagatataagcagagttaatttggttgagcaagtaaaagagatactagatgctattcaacaaagtctttttgatgctgctaagcaaaagcgtgatgcctgcattcaagttgtaagaacttgggatgagttcacagaggctctaagccaaaggaaaatgatcctggctccttggtgtgatgaggaggaggtggaagaagatgtgaaacagcgaaccaaaggtgagatgggagcagccaagagcctttgtactccgtttgagcagccagagctccctgaagggacattgtgctttgcctctggaaagccagcgaggaaatggacatactggggcagaagttactagaatattataattcctttcctcagctacttgatgctttcctatgcaaggccagcaaggaaatggacatatcggagcagggatttattcccatgttcttcaatgtctaatgatcgggaggtgctctaatttttgttttccaaaactgtaattgatactcgagcaaaacgagtgttagatcatttatataatgtcatggatgctatccgttgtttaccaattgtacctggtgtaaaccttaattttatatacaagacttcgaagtgttgatccctgtcttattttaacttgttatttatctactcaacgttcttctgcctctggagttacttctccagagaagtattgtgtgtattttgttcaggatataattatcatttcatcatgctgtaatt

SEQ ID NO: 2313 - DNA, 1842 bp, Panax ginseng
ttgtaactgaatttggaggatatggcttccaatgaggctaagaagaaaccaaatgccaagagtgggggtaaaaagaaggaagtgaagaaagagactggacttggtctttcctacaagaaggatgaaaattttggagagtggtactctgaggtggttgttagtggagaaatgatcgagtactacgacatttctggttgctacattttaaggccatggacaatgtcgatttgggaaaccatgcaagatttttttgataaagaaataaaaaagatgaagatcaagaactgctatttcccacttttcgtatctcctggtgtattgcaaagagagaaggatcacattgaggggtttgctccggaggttgcatgggttacaaaatctggagaatccgacttagaggttcctattgcaatccgtcccacaagtgagactgttatgtatccttattactcaaagtggataagaggacaccgtgacttacctttaaagctgaaccagtggtgcaatgttgttcgatgggagttcagccatccaactccattcattaggagccgagagttcctttggcaagaagggcacacagcatttgcaaccaaggatgaggcagatgcagaggttcttgatatattggaattatatagaagaatatatgaagagtacctggcgataccagttgtgaagggtaaaaagagtgagatggagaagtttgccggtggcctttacacaacaagtgttgaggcctttattcccaacactggtcgaggtatacaaggagctacgtcacattgtttgggtcaaaattttgcaaaaatgtttgagataaattttgaggatgagaagggagagaaaggcatggtttggcaaaattcctgggcatactctactcgtacgattggggtgatggtgatggttcatggggatgacaaaggattagttatgccgcctaaagttgcatcagtccaagtcattgtgattccagtgccttacaaagatgctgacacaaaggccattttagatgcctgttctaatgctgtgaatacgttgagtgaagctggtttacgtgttgaggctgatcttagagaaaactattcacctggttggaagtattcacattgggaaatgaaaggtgttcctttaagaattgaaattgggccaaaagacttggctaataatcaggtacgtgctgttcgccgcgacaatttcaagaaggtggatattcccatggtcaagttggttgagcaagtaaaggacatgttggatgatattcaacgaaatctatttgatttggccaaggaaaaacgagatgcttgtattgagaaggcgaagacatgggatgaatttgttgaagcacttggcaaaaagaagatgatcttagctccttggtgtgatgaagaggaagtagagaaggacgtgaaaacacgaacaaagggtgagatgggagcagccaagacattatgctctccatttgatcagccagacctcccttcagggactctttgctttgcctcaggtaagcctgccaagaaatggacctactggggaaggagctattgatgatcagatgcttatatgttgtccactacaacattgcagtcctttgtgttttgctggctcgggaatttttggctaaagaaactcctgtcccagtaaacatactagctgtgatttttacataccaccgatttttgtctaacaaatcaaatgaaactatgtaacattatacttggaaattgtttatggaggaaaatcattttgtaatttgggacaacatttcttttaacttcaaatacagtttgttgagttggacctgaagattcattgccaactttgttaagtttttac

SEQ ID NO: 2314 - DNA, 1925 bp, Panax ginseng
aagcagtggtatcaacgcagagtacatggggaggcctccaccctgcgaagacttgactatcggcggcgctactaacgatttctctattcccatttttgccttaggaatcaagaattgtaactgaatttggaggatatggcttccaatgaggctaagaagaaaccaaatgccaagagtgggggtaaaaagaaggaagtgaagaaagagactggacttggtctttcctacaagaaggatgaaaattttggagagtggtactctgaggtggttgttagtggagaaatgatcgagtactacgacatttctggttgctacattttaaggccatggacaatgtcgatttgggaaaccatgcaagatttttttgataaagaaataaaaaagatgaagatcaagaactgctatttcccacttttcgtatctcctggtgtattgcaaagagagaaggatcacattgaggggtttgctccggaggttgcatgggttacaaaatctggagaatccgacttagaggttcctattgcaatccgtcccacaagtgagactgttatgtatccttattactcaaagtggataagaggacaccgtgacttacctttaaagctgaaccagtggtgcaatgttgttcgatgggagttcagccatccaactccattcattaggagccgagagttcctttggcaagaagggcacacagcatttgcaaccaaggatgaggcagatgcagaggttcttgatatattggaattatatagaagaatatatgaagagtacctggcgataccagttgtgaagggtaaaaagagtgagatggagaagtttgccggtggcctttacacaacaagtgttgaggcctttattcccaacactggtcgaggtatacaaggagctacatcacattgtttgggtcagaattttgcaaaaatgtttgagataaattttgaggatgacaagggagagaaaggcatggtttggcaaaattcttgggcatactctactcgtacgattggggtgatggtgatggttcatggggatgacaaaggattagttttgccgcctaaagttgcatcagtccatgtcattgtgattccagtgccttacaaagatgctgacacaaaggccattttagatgcctgttctaatgctgtgaatacgttgagtgaagctggtttacgtgttgaggctgatcttagagaaaactattcacctggttggaagtattcacattgggaaatgaaaggtgttcctttaagaattgaaattgggccaaaagacttggctaataatcaggtacgtgctgttcgccgcgacaatttcaagaaggtggatattcccatggtcaagttggttgagcaagtaaaggacatgttggatgatattcaacaaaatctatttgatttggccaaggaaaaacgagatgcttgtattgagaaggcgaagacatgggatgaatttgttgaagcacttggcaaaaagaagatgatcttagctccttggtgtgatgaagaggaagtagagaaggacgtgaaaacacgaacaaagggtgagatgggagcagccaagacattatgctctccatttgatcagccagacctcccttcagggactctttgctttgcctcaggtaagccagccaagaaatggacctactggggaaggagctattgatgatcagatgcttatatgttgtccactacaacattgcagtcctttgtgttttgctgctggggaatttttggctgaagaaactcctgtcccagtaaacatactagctgtgatttttgtctaacaaatcaaatgaaacgatgtaacattatacttagaaattgtttatggagtaaaatcattttgtaatttgggataacatttcttttaacttcaaatacagtttgttgagttggacctgaatattcattgccaacttt

SEQ ID NO: 2315 - DNA, 1952 bp, Amsonia hubrichtii
actgccaattctgcgtttctattccgacagtggctgctagaggcgagtttcctcaatttgcaagaactgaagaagaagaaaaagaaatttccttcttgaaacgtataacttaccaaattcaacgcatttttcttctcagttgctagcatatcttgcagcattgccaagaagttctgtggactcattttttttcccaaggccatacttcaattctgaggaacttcatttggggtttcatattgatttgtttatatggctggtaaagatgcaaaaggttctgctgcaggttcgaacacaagtaagaacacaagtaagaacacaaaggggaaaaagaaagaagttaagaaagagaccggtctaggtctcacccaaaagaaggatgaaaattttggagaatggtattcagaggttgtggttagcggtgaaatgatcgagtactatgacatttctggttgttatattctacggccatgggcaatgtccatatgggagattatgcaagccttctttgatgctgagattaagaaaatgaatatcaagaactgctatttccctttatttgtatcccctggcgtgctgcaaaaggagaaggatcacatagaagggtttgctcctgaggttgcctgggttaccaaatcaggagaatcagatttagaagtacccattgctattcgtccaactagtgaaactgtcatgtatccttattactctaaatggataagaggacaccgtgacttgcctctgagactcaatcagtggtgcaatgttgttagatgggagttcagccatcctactccatttataaggagtcgtgagtttctttggcaagaaggccatactgctttcgctacgaaagaggaggctgatcaagaggtgcttgaaattttggaattgtatagacgcatatatgaagaattcttggctgttcctgtcactaagggaaagaaaagtgagcttgaaaagttcgctggtggcctttatacaactactgttgaggcttttattcccaatactggacgtggtatacaaggtgcaacttcccactgcttgggacagaatttcgcgaaaatgtttgaaataaactttgaagatgagaaaggagaaaagcgtatggtttggcagaactcatgggcttatactacaagaaccattggtgtgatgataatggtccatggggatgacaagggcctggtgctgcctcccaaagttgcagctatccaaattgttgtgatccctgttccttacaaagatgctgatactcaaggaattctggatgcatgtgctgccactgtaaaaaccttaaatgaatcaggttttcgtgctgaagcagatttgagggacaactattcgccaggatggaagtattcgaattgggaaatgaagggtgtccctctaaggattgaaataggaccaagagaccttgctaataagcaggtacgtgctgttcgacgtgacaattcagctaaaattgacattcccatggataatttggttgaccaagtgagaaatttactggataatatccaacaaagtctgtttgatgttgcaaaacaaaagaaagaagcttgcatccaggttgtgaaaacctgggaagaatttgtcgaagcactaggcgaaaagaaattgattttggctccatggtgcgatgaagaggaggtggagaaggatgtcaaagctcggacgaagggcgaaatgggtgcagccaaaaccctatgttctccatttgagcagccagagctgcctgaaggtactttgtgctttgcttcaggcaaaccagccaagaagtggacttactggggccgtagttattaaactcagattagtctcctttgtctatttgttgatgttgtaagtgccaaagggttctgtgatttgagcacttgaaaagaaagcatatacagttcttcttcccatagcaagatttcagaaattaagagaagtatagttttcga

SEQ ID NO: 2316 - DNA, 1896 bp, Fagopyrum esculentum
gacttgtcagaccgtagccgttgctgctttaacgagggtttccatttcgcttcttctcattttcttatcttcctcatccctatttcttctcgccggcgcttactctcttcagattccgaccagatatggcgagtaaggggcaggggaaagggaatgccggcgctaaagctggagggaagaagaaagaggtcaagaaggagactggtcttggtttgacttacaagaaggatgataattttggggagtggtattccgaggtggtcgtcaacgctgagatgatagagtattacgatatttctggatgttacattcttcgcccatggaccatgtctatttgggagatcatgcaaacattttttgacgcagagataaagaagatgaaaatcaagaattgttatttccctctctttgtttccccaggtgtactcgaaaaggagaaggaccatatagaggggtttgctccagaggttgcttgggtgacaaagtcgggagaatctgacttggaagttcctatagctatccgtcccacaagtgagactgtcatgtatccatattactccaagtggattaggggtcaccgtgatttacctttaaggcttaatcagtggtgcaatgttgttcgatgggaattcagcaatcccactccttttatcaggagtagagaatttctttggcaagaaggtcacacagcttttgcaacacaagaagaggcagatgctgaggttcttgacatattggaactctacagacagatttatgaagaatacttagctgttcctgtggtcaaaggaaagaagagtgaactggaaaaatttgccggtggctattacacgaccagtgttgaggcttttatcccgaatacaggacgtggcattcaaggtgcaacttcccattgcttaggtcaaaattttgctaagatgtttgaaataactttgagaatgaaaaacgagagaaggaaatggtatggcagaattcatgggcatacagtactcgaacaattggggtgatggtgatggttcatggtgatgacaaaggcttggtgttgccaccaaaagtagcagctgttcaagttattgtggttcctgtcccatttaaagacgcagatacacaagcaatttttgatgcatgtacttctactgttaacagtttgagtgaagcagggattcgagttgaagctgatcttagagataactattcacctggttggaagtactcaaactgggagatgaaaggtgttcctttgaggattgagattggaccaaaggatttggctaagagtcaggtccgtgttgttcgccgagataattctgacaaggtggatatacctatggctgaactggttgaccaagtaaaagatattctagccaagattcaacagaatctctttgatgttgcaaaagtgaagagagatgcatgcatcaagatcgctaagacttgggaggagtttactgaagcattggcacagaagaaattaatcttggctccttggtgtgacgaggaggaagttgagaaagatgtcaaggcacgaacaaagggtgagattggtgcagcaaagacactgtgtactccatttgagcagcccgagatggaggaaggaacactttgcttcgcttcaggaaagcctgcaaagaaatggacatattggggcagaagttactaacttcccctatcttggtatgaacaataccggttatactagtcaatcagatacctggcttcttctagttactacactgggaagatattagcgacatatctgtcaccattttcttagcttgaagagaatttgttggtttcatttgtcccattctgggaacaaaacagttttttctacacatactactagtatcctcatattttcgttcgatcaatgaatttgcgagtcacccagtgcct

SEQ ID NO: 2317 - DNA, 2008 bp, Brassica rapa
tagcgtagattatatatcggtcagtaacgaagtgagtcaaaaggtttgcaagttgtaacgttgctctctccttatctccgccgtcttcagcttcttcctcctcctctttcgctaactatcaaagaagaagaaaaggttgaaatggctggtccaagtgggaagaaggagaaggttgacaaggcgggtcccagtggcggcaagaagaagaaggacgttaagaaggaaacgggtctcggactaagcgtcaagaaagatgagaacttcggtgaatggtactctgaggtttgcaagcacgagatgattgagtactacgatatctctggatgttatatccttaggccttggtctatggctatttgggagattatgcaaactttctttgatgcggaaatcaagaaaatgaaggtgaagaattgctacttccctctctttgtatctcctggtgtcctcgagaaggagaaggaccacattgagggtttcgctcctgaggttgcttgggttacaaaatcgggcaaatctgacttggaagtccctattgcaattcgtccgactagtgagacagtcatgtacccttactacagcaagtggataagagggcaccgcgacttgcctttgaagcttaaccagtggtgcaatgttgttagatgggagttcagcaaccctaccccatttatccggagccgtgagttcctttggcaggaagggcacactgctttcgccacaaaagaggaagcagataaagaggtccttgaaattttggagctttaccgtcgcatatatgaagagtatctcgcagtcccagttgtgaaaggtatgaagagtgaaaatgaaaagtttgctgggggactttacactacaagtgtggaggctttcattccaaacacgggacgtggtgtacaaggtgcaacatctcactgtttgggacaaaactttgcgaagatgtttgagatcaactttgagaatgagaaaggagagactgaaatggtgtggcagaattcttgggcctacagtaccaggacgattggagtcatgattatgactcatggagatgacaaaggcctgatacttcctcctaaagtagcatctgtgcaagttgttgtgatccctgtgccttacaaagatgctaatacacaaggaattttcgatgcttgtaccgctactgtagctgctttgagtgaagccggtatccgtgcggaagaagatctaagggacaactactctcctggttggaagtattcaaactgggaaatgaagggtgtccctttgagaattgagattggaccccgtgatctcgaaaacaaccaggtcagaactgtgagaagggacaacggagttaaggaagatatcccaagagggagcttggtggagcatgtgaaggaactgctggagaagatccaggcaaacatgtatgaagtggccaagcaaaagagggaagcttgcgttgaagaaattaagacttgggacgagtttatcgtagcactcaacaaaaagaagctcatcttagctccctggtgtgatgaagaggaagtggagagagatgtcaaggcacgaactaagggtgaaactggagcagctaaaaccctctgctctccatttgaacagccagagctccctgaaggcactctctgctttgcatctggaaagcctgcaaagaaatggacctattggggcaggagttactaagtgttcaccatgttttggttcagttcatgaaatttactttgtgaagaccatctcaagttcattgtgctgtgatttgatattttgactgaaagctattttagtttcataactgtgattgcactatgaactacaaaaacgatgttttcttaattcaaaagaactgtttgagaaaggaaaaactagctctgaaatcaactgcttgtgggaatttagttgcagttggggctcaaggtatgtacgattctaggtggtacttgttccttaggtgttagctaataagccttggagtctcaggtgcaatgtggtatatactatgttctgttcg

SEQ ID NO: 2318 - DNA, 2082 bp, Eucalyptus grandis
acgaacataagcctctggtttagggttttggcaaaggctcccatttttaactgccaacttcttagctttcttggatcttatcaccttcgcttcgaccgggaaacgataaacacgccctgtcaagacaccatccagtcagaggtatggctggtggtgaatcgaagaagcccaaagcaaatgcaggtgccgggggaaaaaagaaggaggtgaagaaggagacaggtttaggtctctccaacaagaaggatgagaactttggagagtggtattcagaggttgttgtgagtggcgagatgattgaatactatgatatatctggctgttatatcttgaggccttgggcaatggctatttgggagatcatgcaagaattttttgatgcagagatcaagaaaatgaaaattaaaaactgctatttccctctttttgtctctcctggtgttttacaaagggagaaggaccacatagagggttttgctccagaggttgcttgggtgactaaatcaggggaatctgatttggaagtgcctattgcgatccggccaactagtgagactgtcatgtacccatactattcaaaatggataagaggacacagagacctgcctttgagactcaatcagtggtgcaatgttgtccgatgggagttcagccatcctactccatttatcaggagtcgcgagtttctttggcaggaaggtcatactgcttttgcaacgaaagaagaggcagatgcagaggttcttgatatattggaactctacagacgtatatatgaagaatatttagctgtcccagtcataaagggaaagaaaagtgagctggaaaagtttgctggtggttattacacgacgactgttgaggcgttcattcctgacactggtcgtggtatacaaggagcaacttcgcattgcctggggcagaattttgccaaaatgtttgagattaattttgagaatgaaaagggggagaaggccatggtttggcagaattcttgggcctatactacaagaacgattggagtgatgattatggtacatggtgatgacaaggggttggtcctccctcctaaagtgtcgtctgtgcaagtgattgttgttcctgttccatacaaggatgccgatactcaaggaatatttgatgcctgtactgccacagcgaataccttgtgtgaggctgggatccgggctgaggtagacttaagagataactattcacctggttggaagtactcacattgggaaatgaaaggagtacccctgaggattgaaattggtccaaaggactttgcaaagaaccaagtacgtgccgttcgccgtgacaattccacaaaaagtgatataccacaagccagcttggttgagcaagttgagaaaattctagatgacatacagcaaagcctgttcgacgctgcaaaacaaaagcgagaggcttgcattcagattgtgaagacttgggatgaattcattgatgcactaggcaaaaagaaaatgattctagccccttggtgtgatgaggaggaggtagagaaagatgtgaaagcacggacaaagggcgaaatgggggccgtcaagacactttgttccccatttgatcagcctgaacttcctgaaggaactatgtgctttgcgtcgggaaagcctgccaaaaaatggtcctactggggcagaagttactagtccttgtcgatcagctagttttggtatctcaaacatgtctcagaattgttcgtctttgcaaggaagtgatttaagtctttcttcctcattaccaggtttaaatgatagccttataggaatactcatttgttaatcagaagtgcaacatcagtttttcctctagtcacaggctgcttgactactcatttttccaggttgataatgtctttggaaagtggccttcatgtactccaacattttaaacttaattactctagtgtacacttacaagcattgagagatgcggttctgttttctattttcaatgaacattctgttgtaattctaattgaacattttgttatttgcaacgcggttgcactgattcacgactattcgccatggttttgcttgtcgattcata

SEQ ID NO: 2319 - DNA, 2083 bp, Glycine max
aatttcttcggttacattgagagtgagtagccgaaggaagctgcagagtggagtaaaaaaaaagagcagtgtaagaaattagaaagggcgaaaggcgcactttatctgaaagcaaaaaccctacctagggtcaaccgtgacgccacaatcgccttcggcatctttgcaacgggatcaggtgctcctcgtccttcacgatggcgggaactgaagccaaaaaaactgaatccaaaaaacctgccgctaagcaatccggtgcgaagaagaaggaggtgaagaaggaaactggcttaggtctcacgcatcggaaggcggagaacttcggagagtggtattccgaggtggttgttaatgcggaaatgattgagtactatgatatttccggttgctatattctgaggccttggtcaatggcaatatgggagatcatgcaagagtttttcgatccagaaataaagaaaatgaaaatcaagaactgctacttcccattgtttgtatctcctggagttctgcaaaaggagaaggaccacgttgagggttttgctcctgaggttgcttgggtgacaaagtctggggaatccgaattagaaattcctatagctattcgtcctactagtgaaacagtgatgtatccctactactctaagtggataaggggacatcgtgacttgcctttgaaacttaatcagtggtgcaatgttgtaagatgggagttcagcaaccccactccattcatcaggagtcgcgagtttctttggcaagaagggcacactgcttttgcaacaaaggatgaagcagatgcagaggttcttgagattctggaattatataggcgtatatacgaagagtatttggcagttcctgtcataaagggtaagaaaagtgagcttgagaagtttgctggtggactctacactaccagtgttgaggcatttattccaaacactggtcgtggtatccaaggtgcaacttctcattgtttgggccaaaattttgctaaaatgtttgagataaactttgaaaatgaaaagggagagaaagcaatggtctggcagaattcatgggcctatagtactcgaactattggggtcatggtgatggttcatggtgatgacaagggattggtactacctcctaaagtagcatcagtacaagttattgtgattcctgtgccttacaaagatgccgatactcaaggaatctttgatgcctgttctgcaactgtgaatacattgaatgaagcaggtattcgcgctgagtcagattctagagataattattctcctggatggaagtattccaactgggaaatgaaaggggttcctctaagaattgaaattgggccaaaggatttagcaaataagcaggttcgcgctgttcgacgtgataatggtgcaaagatagacattgctagtgctgatttggttgtggaaataaaaaagttgctcgatactattcaacagaacctgtttgatgttgcaaaacaaaaacgagatgaatgcattcagatcatacacacttgggatgaatttgtgcaagctttgaaccaaagaaaaatgatcttagctccttggtgtgacgaggaggaggttgaggctgatgtcaaagcgaggacaaagggtgagatgggagcagctaagactctttgcagtccctttgatcagccagaactcccagaaggcaccaagtgctttgcatcaggaaagcctgcaacaaagtggacatactggggaagaagttactaggctactggctgttgattgtggtattttctggaattaatttggtatttaatggtaccttgtacgaatttgtggatcacacagatattagttttcttctcttgggaatatttttcaactgatagttttactttgatttttatatggtgcaatatttattttggattaaaagatgagtattacatttgttgccgtccaattattgttggggagcgtattggactcttggttgtgatgatccaaaatttcggataaaatttcactcaattgaacgacatcattactggaagtgaaaattgattgtacaatcaaatgtagtttgtatataatataatatggag

SEQ ID NO: 2320 - DNA, 1780 bp, Brassica napus
gtaacgttgctctctccttatctccgccgtcttcagcttcttcctcctcctctttcgctaactatcaaagaagaagaaaaggttgaaatggctggtccaagtgggaagaaggagaaggttgacaaggcgggtcccagtggcggcggcggcggcaagaagaagaaggacgttaagaaggaaacgggtctcggactgagcgtcaagaaagatgagaacttcggtgaatggtactctgaggtttgcaagcacgagatgattgagtactacgatatctctggatgttatatccttaggccttggtctatggctatttgggagattatgcaaactttctttgatgcggaaatcaagaaaatgaaggtgaagaattgctacttccctctctttgtatctcctggtgtccttgagaaggagaaggaccacattgagggtttcgctcctgaggttgcttgggttacaaaatcgggcaaatctgacttggaagtccctattgcaattcgtccgactagtgagacagtcatgtacccttactacagcaagtggataagaggccaccgtgacttgcctttgaagcttaaccagtggtgcaatgttgttagatgggagttcagcaaccctaccccatttatccggagccgtgagttcctttggcaggaagggcacactgctttcgccacaaaagaggaagcagataaagaggtccttgaaattttggagctttaccgtcgcatatatgaagagtatctcgcagtcccagttgtgaaaggtatgaagagtgaaaatgaaaagtttgctgggggactttacactacaagtgtggaggctttcattccaaacacgggacgtggtgtacaaggtgcaacatctcactgtttgggacaaaactttgcgaagatgtttgagatcaactttgagaatgagaaaggagagactgaaatggtgtggcagaattcttgggcctacagtaccaggacgattggagtcatgattatgactcatggagatgacaaaggcctgatacttcctcctaaagtagcatctgtgcaagttgttgtgatccctgtgccttacaaagatgctaatacacaaggaattttcgatgcttgtaccgctactgtagctgctttgagtgaagccggtatccgtgcggaagaagatctaagggacaactactctcctggttggaagtattcaaactgggaaatgaagggtgtccctttgagaattgagattggaccccgtgatctcgaaaacaaccaggtcagaactgtgagaagggacaacggagttaaggaagatatcccaagagggagcttggtggagcatgtgaaggaactgctggagaagatccaggcaaacatgtatgaagtggccaagcaaaagagggaagcttgcgttgaagaaattaagacttgggacgagtttatcgtagcactcaacaaaaagaagctcatcttagctccctggtgtgatgaagaggaagtggagagagatgtcaaggcacgaactaagggtgaaactggagcagctaaaaccctctgctctccatttgaacagccagagctccctgaaggcactctctgctttgcatctggaaagcctgcaaagaaatggacctattggggcaggagttactaagtgttcaccatgttttggttcagttcatgaaatttactttgtgaagaccatctcaagttcattgtgctgtgatttgatattttgactgaaagctattttagtttcataactgtgattgcactatgaactacaaaaacgatgt

SEQ ID NO: 2321 - DNA, 1943 bp, Tropaeolum majus
agggattcctaatatcattttgcttttgtaaaaaacctcaagcttctttcaatctaccgccgcatttgagctccgtttagaactaagttgataatatggctggcggtgggaagaaaaagaaggaagtgaagaaagagactggtcttgggctcaccaataagaaggatgtaaatttcggggagtggtatgcggaggtttgtgtcaatggtgagatgattgagtactatgatatatctggatgctatattctgaggccatggtccatgtcaatctgggaaaacatgcaaacattctttgatgcagaaatcaagaaaatgaaaatcaagaactgttatttccctctctttgtgtccccggtgttttagagaaagagaaggaccacgtagaagggtttgctccggaggtagcttgggttacaaaatcagggaaatctgagttagaagtgcctattgctattcgtccaactagtgagacagtgatgtatccctactattctaagtggataaggggacatcgtgatttgcctttgaaactaaaccagtggtgcaatgttgttagatgggagttcagcaatcccacaccattcataaggagtcgtgagtttctctggcaggaagggcatactgcttttgcaacgaaggaagaggcagatgcagaggtccttgacgttttggaactttaccgacgtatttatgaagaatttttggctattcctgtttttaaaggcaagaagagtgagatggaaaagtttgctggtggactttacactacaagtgtcgaggcttttattccccacactggtcgtggtattcaaggtgcaacctcacattgtttaggtcaaaactttgcaaaaatgtttgagataaactttgaaaacgagaagggagagaaggctatggtttggcagaattcttgggcgtacagtacacgaacgattggggttatgataatggttcatggagatgacaagggattggtgctgcctcctaaagtcgcatctctgcaagtcattgtcattccagtgccctttaaagatgctaatactcaagggatctttgatgcatgtgctgctaccgtggctactttgtctgaggctggcatccgtgctgagtctgatttaagagacaactactcacctggttggaagtactcgcattgggaaatgaagggtgttcctcttagaattgaaataggcccaaaagatttggcaaataaccaggtccgtattgttcgtcgtgacaatggggcaaaaagtgatatagctcaggctaacttggttgaacaagtaaaagaagtgttggataagattcagcaaagcatgtttgacgctgccgtagaaaaacgagatgcttgcattttggttgcgaaaacctgggatgaattcatggagggtcttgcccaaaagaaaatgatcttagctccgtggtgtgatgaagaggaagtggagaaagatgtgaaggcacgtacaaagggtgatgtcggagcagctaaaacactttgttctccctttgatcagccagaacttcctgaaggtactctatgttttgcatcaggcaagccagccaagaaatggacctactggggaagaagttattaaacttaccatccaattctctctctccgctatcgatttagaaccaagattaaattttattaagaagtttgttaaattcgaatctgatttcttggtatacaaactttaaccgagtttcaatatatcgacacttaaggataagtaagttatatttgtgtacgataacgctttcctttccggttttgaagaatgtgacgagtttacatttatgcagttgcgatgggcgaagtattcatgagaataacatattatttttattccgaatttctctaataactttatgtttgtggggaaacgatgagatgaaatcaaaagggaagaagtgtgtgttgctcgtttatatcaaact

SEQ ID NO: 2322 - DNA, 2608 bp, Eucalyptus grandis
gcacataagtcagcgtgcatctaccgacgtgctccggacaggcggcccgcggatctgatcctggccgaacgtggttggatcggacgggaatcacagcactgcactctcccttttgacttcctcccttaaatccgctcgtttccagttagggttttctcgcctgtgccggcttgccctcgcgtccgctggtttccgccgccggagctctctttccgccgtcgccgccgcccccgccccctcgcgcgaccttatcgactcgtcagcgaagacaaaaagatcagggggatggccagtggagagccgaagaagtccaataaacccaatgccggcgcggggaagaagaaggaggtgaagaaggagacggggctgggtctctccaataagaaggatgagaacttcggggaatggtattccgaggttgttgtcagcggcgaaatgatagagtactatgatatctctggctgttacattctaaggccatgggcgatggcgatctgggagattatgcaagagttctttgatgctgaaataaagaagatgaaaattaagaactgttatttccctcttttcgtatctcctggggttctgcaacgcgaaaaggaacatatagagggttttgctccagaggttgcttgggtgacaaaatctgggcaatctgatttggaagtgcccattgcaatccgaccaacaagtgagacagtgatgtatccttacttttctaagtggataaggggacacagagacttgcctttgagacttaatcagtggtgcaatgttgttagatgggagtttagcaatcctacaccctttatcaggagtcgtgagtttctttggcaggaaggacatacagcttttgctacaaaagaagaagcagatgcagaggttcttgatatactggaactatatagacgtatatatgaagagtacttagctgttccagtaataaagggcaagaagagtgagttggagaagtttgctggtggtttttatacaactactgtagaggcatttgttcctaacactgggcgtggaattcaaggggcaacatcacactgtttgggtcagaattttgcaaaaatgttcgaaatattctttgagaatgaaaagagagagaaagccatggtctggcagaactcgtgggcctataccactagaacgattggggtcatggtgatggttcatggggatgataaggggttggttctccctcccaaagtggcatcagttcaagttatcattgtacctgttccatataaagatgctaatactcaaggtatttttgatgcctgcacagccactgttaataccttgtgtgaagcaggtattcgtgcagaggcagacctcagagataactattcgcctggttggaagtactcacattgggaaatgaaaggtgttcctcttagaattgaaattggaccaaaggacttggcaaataatcaggtccgagctgttcggcgtgataattctgctaaaaaagatataccgagggctgacttagttgagcaggtgaaagaattgttggccaacattcaacagagcctgtttgatgctgcaaaacaaaaacgagatgcttgcattcaagttgtgaaaacatgggatgaatttgtggaagcactgggccaaaagaagatggttttggctccttggtgtgatgaggaagaggtggagaaagaagtaaaagcacggacgaagggtgagatgggagcatgtaagacactttgttccccatttgaagagcccgagcttcctgaaggtactatatgctttgcttctggaaagccagcaaaaaggtggagctactggggcaggagttactagttctaccgtcggtccttcctccacatgaagatcggatcggccccagcttggagcaagctcagtcaaattcagaccagtaatcttatggcagtgctgatttatttattgacatcgactcgagccacccaagttttctgaatcatagtttggcgttttcctttttttcaatacacaggtgatgtttggaaaatgctttgaaacatggagcaataccacccaaaaaaaaataaaaaattgatatttagtaacactcttgtgcactgagttagaattacaaaagattgcgtgctgctaggattatttatttatttatagttaagacagacggttttcttatgtttgttcgtgctcacgggcggaccgtggttcactggtcaagtgcaataaaggccgacggttcttgtggaagtctacatgggatcggccgtgatttatcctaatcttatggacccgggactaggacgaggatacatcctggtctttcactgccgtccgatgagcggccgatcctcgttggaagctagggacgaacttcgatttagatctcatggtacaggcgcatgtttccacctagtgtccctcaacgccacatgaaccggggtaggacgatttttttgggtcgaagaggtagacgatttgtttgtattctttttttctcttttttggtcaaatgtggacgatttggctagtgggtacgatgtggcgtttatatattaatgctgtagtatcatatctttttgaaactggtgtatttattctaattaattttcgtgtcataaaaattctc

SEQ ID NO: 2323 - DNA, 1710 bp, Nicotiana benthamiana
agaaggaaaaaagaaagaagtcaagaaagagacaggtcttggtctctcttacaaaaaggatgaaaattttggagagtggtattctgaggttgtcgttagtggtgaaatgatcgagtactacgacatatctggctgttatattctacggccatgggcaatgtctatctgggagatattgcaggcattttttgatgctgaaattaagaaaatgaagataaagaactcttactttcctctatttgtgtcccctggtgttctacaaaaggaaaaggaccacatagagggatttgctcctgaggttgcttgggttactaaatctggtgaatctgatttggaagtacccattgcaattcgaccaactagtgaaacagtgatgtatccatacttctctaagtggataaggggacatcgtgacttgcccttgagactcaaccagtggtgcaatgttgtacgatgggagtttagcaaccctacccccttcatcaggagtcgcgagtttctctggcaagaaggacacactgcttttgcaacaaaggaggaagcagatacagaggttcttgatattttggaattgtatagacgtatatatgaagaatttttagctgttccagtcagtaagggaaagaaaagtgagctcgagaagtttgccggtggactctacacgactacagttgaggcatttatccctaatactggccgtggtatccaaggtgcaacttcacactgtttgggccagaattttgcaaaaatgtttgagataaattttgaaaatgagaagggagagaaggctatggtctggcagaactcatgggcctatactactagaacaatcggtgttatgatcatggttcatggggatgacaaaggcctggtcttacctcctaaagtagcatcaattcaagtaattgttattcctgtgccatacaaggatgcaaatactcaagggatctttgatgcctgtgctgctaccgttgagaagttgaatgaatcaggtattcgtgctgaggcagacttcagagataactattcacctggctggaaatattctcattgggaaatgaagggggttcctcttaggattgaaataggaccaaaagaccttgcaaataaccaggtacgagctgttcgacgtgacaacggagccaaagcagatattcccatggataatcttgctgaacaacttgaagttcttctcgccactatccaacaaaatctatttgatgttgcaaaacaaaagagagatgcctgcgttcagattgtaagaacttgggatgaatttacggtagcactgggccaaaagaaattagtcttggctccttggtgtgatgaggaggatgttgagaaagatgtcaaggcacgcacgaaaggggagatgggtgcggcaaagactctttgctctccatttgaccagcctgagctgcctgaaggtacactgtgtttcgcatcgggtaaacctgctaagaagtggacatattggggccgcagttattgatgttccattttgaagcttttcaacctttctcccttttttaatttgagagtaaaattcatatttgacaattatacaaggaagtcacattcttaaagaaatgattttgatttaagttgcaagatttggtcaagttactaaacagattttgatcctaacttctgtgcaatgttcgtacattattgtcccgtggataactcagccattttgatgttctacta

SEQ ID NO: 2324 - DNA, 1788 bp, Quercus alba
tctctgacagcaggagtaagctgaggaaatggctggtggcgatgcaaaaaagtctaatgcaagtggtggggggaaaaagaaggaggtgaagaaggagactggtttgggactagcgaatcgcaaggatgagaattttggggagtggtattctgaggtagttgtgaatggagaaatgattgaatattatgatatctctggctgttatattctgaggccatgggcaatggctatctgggagataatgcaaaaattttttgatgctgaaataaagaaaatggacatccagaactgctacttcccactttttgtttctcctggcgtattacagaaggagaaggatcatgttgagggttttgctcctgaggtcgcatgggtaacaaaatctggggaatctgagttggaagtgcccatagcaattcgcccaacgagtgaaactgtcatgtatccttactattctaaatggattaggggacaccgtgacttgcctttgaaacttaatcaatggtgcaatgttgttcgatgggaattcagtcatcctacgccatttatcaggagtcgtgagtttctctggcaggaagggcacactgcttttgcaacaaaagcagaggcagatgcagaggtgctagatattttggaactgtatagacgcatatatgaagagtacttggctattcctgtcgtaaagggaaagaagagtgagatggagaagtttgctggtggactttacacaactagtgttgaggcatttgttccaaatactggtcgtggcatacaaggtgcaacttcgcattgtctgggtcaaaattttgctaaaatgtttgagataaactttgaaaatgagaagggagagaagggtatggtctggcagaactcatgggcctatagcactcggacgattggtgttatggtgatggttcatggggatgacagaggcttagtgctgccaccaaaagtagcatctgtccaggttattgtaattcctgtgccttataaagatgctgatactcaggcaatctttgatgcctgttctgccactgtggcctccttgtctgaggcaggtattcgtgctaaggcagactctagagataattactctcctggttggaagtactcacattgggaaatgaaaggcgttcctctaagaattgaaattggtccaaaagacttggcaaatagtcaggtacgtgctgttcgccgtgataattcagcaaaaacagacatccctagggacaagctggttgagcaagtaaaagaaatgctggacaatatccaacaaagcctgtttgatgctgccaaacaaaaacgagatgcttgcattcagactgtaaaaacttgggatgaatttgtggaagcactcggccaaaggaaaatgatcttagcaccttggtgtgatgaggaggaggtggagatagaagtaaaagcaaggacaaagggtgagatgggagcatgtaagagcctttgttccccatttgaccagccagagctcttagaaggtactaaatgctttgcatcgggaaagcctgcaaaaagatggacgtactggggaagagttactagattattgatttttacatgatttcttctcctggtgttcctcaatccgttcaagatgttatggaatctgcgattctcaagaattagcgagtaatagtattttctacaaacaaatacaaggacaccattttaaaaggaattaaaaattaatagtccataatgtgtggatcttacatgaaaaagtgaaatcaatttgctttgctaacaagcaaaaggctacaagtttttacattg

SEQ ID NO: 2325 - DNA, 2122 bp, Cajanus cajan
agagtaacggaagacagcacagtgaagagtgaagagtaaaaacgcaaagaaaatagtgagggcggaggggcactttatctgaaagcgaaaaccctagggtcaaccgtaacgccacaatcgctctcgcgcgtttcgctcgccttcgacatctttgcagcgggatcaggtgctcctcgttcgcgatggcgggaagtgaggccaaaaaacctgtcgccaagcaatccggcgggaagaagaaggaggtgaagaaggagactggcttaggtctcacgcatcggaaggcggagaacttcggagagtggtattctgaggttgttgttaatgcggaaatgattgagtactatgatatatctggttgctatattctgaggccttggtcaatggcaatatgggagataatgcaagagtttttcgacccagaaataaagaaaatgaaaatcaagaactgctacttccctttgtttgtgtctcctggagttttgcaaaaggagaaggaccacgttgagggatttgctcctgaggttgcttgggtgacaaaatctggggaatctgaattagaaattcctattgctattcgtccaactagtgaaactgtcatgtatccctactactccaagtggataaggggacatcgtgatttgccactgaagcttaatcagtggtgcaatgttgttagatgggagttcagcaatcccacaccattcatcaggagccgcgagtttctttggcaagaagggcacactgcttttgcaacaaaggaagaagcagatgcagaggttcttgatattctggaattatataggcgtatatatgaagagtatttggctgttccagtcattaagggtaagaaaagtgagatggagaagtttgctggtggactttacactacaagtgttgaggcatttattcccaacaccggtcgtggtatacaaggtgcaacttctcattgtctgggccaaaattttgctaaaatgtttgagataaactttgaaaatgataagggagagaaagcaatggtgtggcagaactcatgggcctatagtactcgaactattggggtcatggtgatggttcatggtgatgacaagggtttggtactgcctcctaaagtagcatcagtacaagtcattgtgattcctgtgccttacaaagatgctgatactcaaggaatctttgatgctgtttctgcaactgtgaatacattgtctgaagcaggtattcgtgccgattcagattttagagataattattctcctggatggaagtattctcactgggaaatgaaaggcgttcctctgagaattgaaattggtccaaaggatttagcaaataagcaggttcgtgctgttcgacgtgataatggagcaaagatagacattgctagtgcggagttggttgtggaaataaaaaagttgctcggtgatattcaacaaaacttgtttgatgttgcaaaacaaaaacgagatgaatgcattcaggtcatacacacctgggatgaatttgtgcaagctttgaaccaaagaaaaatgatcttagctccttggtgtgatgaagaggaggtggaggctgatgtcaaagcaaggacaaagggtgagatgggagcagctaagaccctttgcagcccctttgatcagccagaactcctggaaggcaccaagtgctttgcgtcaggaaagcctgcaacaaagtggacatactggggcagaagttactagactactagctgttgattgtggtagtttttgagttagtttggtatttaatggtgccttgtacgaatttgtggaccacacagattaattttttcttttcttgggtatctttttcaactgataattttacttttatttttatatgggtacaatatttattttggtttagaagatgagtattacatttgttgccgtccaagttttgttgagagcatactggactcttggttgggatgatccaattatttagcataaaattaccctcaattaaacatgacatcatttacttcaggcttagtttggaagatatgaaatggtatggaacattgattgaacgatccaaatgtagtttgtacttatataatatgacggaggaagaaagtctagcgagtgttgaacttttaatgaga

SEQ ID NO: 2326 - DNA, 2212 bp, Glycine max
aaggaagctcttctcaaaaaagaaaacgaaggaagctgcacagtggagtaaaaaaaaactgtgtaagaaattagaaagggcgaacggcgcactttatctgaaagcgaaaaccctagggtcaaccgtgacgccacaatcgctcttgcgcgtttcaatcgccttcgacttctttgcaacgggatcaggtgctcgtccttcacgatggcgggaactgaagcaaaaaaaactgaatccaaaaaacctgccgctaagcaatccggtgggaagaagaaggaggtgaagaaggagactggcttaggtctcacgcatcggaaggcggagaacttcggagagtggtattccgaggttgttgttaatgccgaaatgattgaatactatgatatttccggttgctatattctgaggccttggtcaatggcaatatgggagatcatgcaagagtttttcgatccagaaataaagaaaatgaaaatcaagaactgctacttcccattgtttgtgtctcctggagttctgcaaaaggagaaggaccacgttgagggttttgctcctgaggttgcttgggtgacaaagtctggggaatctgaattagaaattcctattgctattcgtcctactagtgaaactgtcatgtatccctactactctaagtggataaggggacatcgtgacttgcctttgaaacttaatcagtggtgcaatgttgtcagatgggagttcagcaaccccactccattcatcaggagtcgtgagtttctttggcaagaagggcacactgcttttgcttcaaaggaggaagcagatgcagaggttcttgagattctggaattatataggcgtatatacgaagagtatttggcagttcctgtcataaagggtaagaaaagtgagcttgagaagtttgctggtggactctacactactagtgttgaggcatttattccaaacactggtcgtggtatacaaggtgcaacttctcattgtttgggccaaaattttgctaaaatgtttgagataaactttgaaaatgaaaagggagagagagcaatggtctggcagaattcatgggcctatagtactcgaactatcggtgtcatggtgatggttcatggtgatgacaagggattggtactacctcctaaagtagcatcagtacaagtcattgtgattcctgtgccttacaaagatgccgatactcaaggaatctttgatgcctgttctgcaactgtgaatacattgaatgaagcaggtattcgcgctgagtcagattctagagataattattctcctggatggaagtattctaattgggaaatgaaaggtgttcctctaagaattgaaattgggccaaaggatttagcaaataagcaggttcgtgctgttcgacgtgataatggagcaaagatagacattgctagtgctgatttggttgtggaaataaaaaagttgcttgatactattcaacagaacctgtttgatgttgcaaaacaaaaacgagatgaatgcattcagatcatacacacttgggatgaatttgtgcaagctttgaaccaaagaaaaatgatctttgctccttggtgtgacgaggaggaggtggaggctgatgtcaaagccaggacaaagggtgagatgggagcagctaagactctttgcagcccctttgatcagccagaactcccagaaggcaccaagtgctttgcatcaggaaagcccgcaacaaagtggacatactggggcagaagttactagactactggctgttgattgtggtattttctggatttaatttggtatttaatgatgccttgtacgaatttgtggatcacacaaacattagttttcttttcttgggaatctttttcaactgatagttttactttgatttttatatggtgcaatatttattttggattaaattaaaagatgagtatcatacatttgttgtccaattattgttgggagcgtattggactcttggttgtgatccaaatatttagcataaaattacactcaattgaacacgacatcatttactgcaggcttagatggatcggggattacgaaatggaagggaaaattgattgtacaatcaatataatataatacggacttaagcaggaagaaagtctagcgaatgttgagcttttaaatgaattttatcaacacttctatactaaaaaacaatatttacaatacatgcatgtgaatgtgt

SEQ ID NO: 2327 - DNA, 1962 bp, Manihot esculenta
agggttttgatcttactaaacagaggcacaacactctctttctccgtctctgaagctgtacctccgttcctcttatcgtctggattctccttatcctccctcttttctcttttgcctctgagaggggaagacgaagagaagctacctcaaaatccaatcagactgtgttgtgcccaatttgagttggtgaaatggctggtgggggtaaaaggaaggaggtgaagaaagagactgggttaggactctcctttaagaaggaagagaactttggagagtggtactctgaggtggtcgtcaatggtgagatgatcgagtactatgacatttctggctgttatattttgagaccatggtcaatgtcaatttgggagatcatgcaagctttctttgatgctgaaatcaagaaaatgaaaatcaagaactgttacttccctctttttgtttcatccagtgtattggaaaaggagaaggaccacatagagggctttgctccagaggttgcatgggtgacaaaatctggaaaatctgaccttgaaattcctatagctattcgtccaactagtgagacagttatgtacccctacttctctaagtggataaggggacaccgtgacttgcctttgaaacttaaccagtggtgcaatgttgttcgttgggaatttagcaatcctactccatttatcaggagccgagagttcctttggcaggaagggcatactgcatttgcaacaaaggcagaagcagatgaggaggcatgaaactaattacttaattcctgtccttcaaatattggaactatatagacgtatttatgaagaattcttggctattcctgttgtaaaaggcaggaaaagtgagatggagaaatttgctggtggactctacaccactagtgttgaggcatttattccaaacactgggcgtggcatacaaggtgccacttctcactgtttagggcaaaattttgcaaaaatgtttgagataaactttgaaaatgagaagggagagaagggtatggtctggcagaattcttgggcttatagcactagaacgattggggtgatggtgatggttcatggagatgataaaggcttggtgctaccacctaaagtggcatctgttcaagttattgtggtcccggtgccatacaaagacgctaatactcaaggaatctttgatgcctgcactgaaactgtggatactttatgtaaagcaggtattcgtgcagaagctgattttagagacaattattcacctggttggaaatactctcactgggaaatgaaaggtgttcccttaaggattgaaataggtccaaaagacttggcaaataatcaggtgcgtgctgttcgtcgtgacaatgcagcaaaagaagatataagcagggtcaatctggttgagcaagtaaaacgtatactggatgatattcatcaaagtctgtttgatgctgctaaacaaaagcgagatgcttgcattcaagtagtaaaaacttgggatgaattcaaggaggctctcagccaaaggaaaatgatcttagctccttggtgtgatgaggaggaggtggagcaagatgtgaaagaacgaacacgaggtgagatgggagcagccaagagcctttgtacaccatttgaccagccagaactccctgaaggtactaaatgctttgcctctggaaagcctgcgaagaaatggacctactggggcagaagttactagattattatcccctagtttttgaatttttaaaaaatgattgagacatgctaaattttggtttttggaactagtaattgatacctcacttgttgcttttttttttcttcttgaaatgttgtgcaaaatgtaccttgctatgatgaagcggttgtcggattattttatgtactgtcgtggttgatatccttcatccgcgccgttatatctggtgcaaatcttaatttttatgaacggcacttttataac

SEQ ID NO: 2328 - DNA, 1974 bp, Euonymus alatus
ctgcttacacaggcgacgtttaggtttcggatctccatttctcctctctttctcttgcttctctaccagttcacctgcggaagatatggccggtgatgatgcaaaaaagcctatggctaaagctagtggtagcggcaaaaagaacaaggtgaagaaagagcctggattagggctttcctttaagaaggaggagaactttggagaatggtattcagaggtggttgtcaatgctgaaatgattgagtattatgatatctctggctgttatattttaagaccatggtcgatgtcaatatgggagatcatgcaagcctttttcgacgcagagattaagaaaatgaaaatcaagaactgttactttccacttttgtatctagtgatgttcttgagaaggagaaggatcacatagaaggttttgctccagaggtagcgtgggtaacaaaatctggtaaatctatcttggaaaaacctattgcaattcgtccaactagtgagactgttatgtatccctactactctaagtggattaggggacaccgtgacttgcctttgaaacttaaccagtggtgcaatgttgttcgatgggagtttagcaatcctacaccatttatcaggagtcgcgagtttctttggcaagaagggcatacggcttttgcaacaaaggaagaggcggacacagaggttctcgaaatattggaactatacaggcgtatatatgaagaattcttggcagttcccgttataaaaggcaagaaaagtgaaatggagaaatttgctggtggactttacacaacaagcgtggaggcgtttattccaaacacaggtcgtggtatacaaggtgcaacttctcattgtttgggccagaattttgcaaaaatgtttgagattaactttgaaaatgagaagggagagagggccatggtctggcagaattcttgggcatacagtactagaacgataggagtaatggtgatggttcatggggatgacaaaggcttggtgctaccacctaaagtggcctctgttcaagttattgtaattccagtgccttataaagatgctgatactaagggaatatatgatgcatgtgctgcaaccgttgagatcttgtgtgaagcaggtatccgcgctgagattgactccagagataattattctcctggctggaaatattcgcactgggaaatgaaaggtgttcctttaaggattgaaatcggtcctaaagacttggcaaacaatcaggtgcgtgctgttcgtcgtgacaatggagcaaaattagatttaagccgggacagtttggttgaccaagtgaaaactatgcttgacaacattcatgaaagcctgcttgatgctgcaaaacaaaagcgggatgcttgtgtccaagtagtcaaaacttgggatgagtttatggaggctctcagccaaaggaaattgatattggctccatggtgtgatgaggaggaggtggaacaagatgttaaaacccaaacaaagggtgagaagggagcggcaaagaccctttgttccccatttgatcagccagaactcccagaaggtaccaaatgctttgcctcagggaagcctgcaaagaaatggagctactggggaaggagttactagattattacgaggatgtagtctttgcaaattttcttgaatacgcacactagggaattgtaagtgggaagatatatcgatcaacaccccattgaaagatagggtgcaatcgtgggttttatttttccttttctacacgtgattacttattctggcccgacttttcccatccattggagataattatagatttttcatttaccttttcacattgttggggaggggaggggacgggacgggacgggaaatttgagcagcagaaaaatatgtttggttagtcaaaaggtagagaaggaaaagttaaaaggtgtatttttatttgtttgtgagataaaaagacaattattattttattct

SEQ ID NO: 2329 - DNA, 1843 bp, Vigna unguiculata
gtagcgccacaatcgctctcgcgcgtttcgttcgccttcggcatctttgcaacaggatcaggtgctcctccttcaccatggcggggactgaagccaaaaaaccttcggctaagcaatccggtgggaagaagaaggaggtgaagaaggagaccggcttaggtctcacgcatcggaaggcggagaacttcggagagtggtattctgaggttgttgttaatgctgaaatgattgaatactatgatatatctggttgctatattttgaggccttggtcaatggcaatatgggagatcatgcaagaatttttcgatccggaaataaagaaaatgaaaatcaagaactgctacttccctttgtttgtgtctcctggagttttgcaaaaggagaaggatcacgttgagggttttgcccctgaggttgcttgggtaacaaagtctggggaatctgaattagaaattcctattgctattcgtccaactagtgaaactgtcatgtatccctactactctaagtggataaggggacatcgtgacttacctttgaaacttaatcagtggtgtaatgttgttagatgggagttcagcaatcccacaccattcatcaggagtcgtgagtttctttggcaagaagggcacactgcttttgcaacaaaggaggaggctgatgcagaggttcttgacattctggaattatataggcgtatatatgaagagtatttggcagttcctgtcataaagggtaagaaaagtgagcttgagaagtttgctggtgggctttacactaccagtgttgaggcatttattccaaacactggccgtggtatacaaggtgcaacttctcattgtctgggccaaaactttgctaaaatgtttgagataaactttgaaaatgaaaagggagagaaagcaatggtgtggcagaactcatgggcctatagtactcgaactattggggtcatggtgatggttcatggtgatgacaagggattggtactgcctcctaaagtagcatcagtacaagtcattgtgattcctgtgccttacaaagatgctaatactcaaggaatctttgatgcctgttctgaaactgtgaatacattgtctgaagctggtattcgtgctgagtcggattttagagataattattccccgggatggaagtattctcactgggaaatgaaaggtgttcctctaagaattgaaattgggccaaaagatttagcaaataagcaggttcgtgcggttcgacgtgataatggagcaaagatagacatcgctagtgctgatttggctgttgaaataaaaaagttgcttgataatattcagcagaacttgtttgaggttgcaaaacaaaaacgagatgaatgcattcaaatcatacacacttgggatgattttgtgcaagctttgaaccaaagaaaaatgatcttagctccatggtgtgatgaggaggaggtggaggcggatgtcaaagcaagaacaaagggtgagatgggagcagccaaaactctttgcagcccctttgatcagccagaactcccagaaggcaccaagtgctttgcgtctggaaagcctgcaacaaagtggacatactggggcagaagttactagcctactggctctttcgtggtattatatgaagctagtttatcatttaatggttccttgtactgatttgtggatcacacaattagttttgttttcttggttatcttttcaacagatagttttactttgatttttatatggcacaatatttattttggtttaaagaatgagtgttacttttgttgtcgttcaattattattgggggcatattgggctcttcgttgggatgactcaa

SEQ ID NO: 2330 - DNA, 1584 bp, Nicotiana benthamiana
ttgatttgtctaatgcatcttttttgtctttcttcaaaaggaaaaaagaaagaagtcaagaaagagataggtcttggtcagggaaaaaagaaagaagtcaagaaagagacaggtctcggtctctcttacaaaaaggatgataattttggagagtggtattctgaggttgtcgttagtggtgaaatgatcgagtactacgacatatctggctgttatattctacggccatgggcaatgtctatctgggagatattgcaggcgttttttgatgctgaaattaagaaaatgaagataaagaactcttactttcctctgtttgtgtcccctggtgttctacaaaaggaaaaggaccacatagagggatttgctcctgaggttgcttgggttactaaatctggtgaatctgatttggaagtacccattgcaattcgaccaactagtgaaacagtgatgtatccatacttctctaagtggataaggggacatcgtgacttgcccttgagactcaaccagtggtgcaatgttgtacgatgggagtttagcaatcctacccccttcatcaggagtcgtgagtttctctggcaagaaggacacactgcttttgcaacaaaggaggaagcagatacagaggttcttgatatcttggaattgtatagacgtatatatgaagaatttttagccgttccggtcagtaagggaaagaaaagtgagcttgagaagtttgccggtggactctacacgactacagttgaggcttttatccctaatactggtcgtggtatccaaggtgcaacttcacactgtttgggccagaattttgcaaaaatgtttgagataaattttgaaaatgagaagggagagaaggctatggtctggcagaactcatgggcctatactactagaacaatcggtgttatgatcatggttcatggggatgacaaaggcctggtcttacctcctaaagtagcatcaactcaagtaattgttattcctgtaccatacaaggatgcaaatactcaagggatctttgatgcctgtgctgctactgttgagaagttgaatgaatcaggtgttcgtgctgaggcagacttcagagataactattcacctggctggaaatattctcattgggaaatgaagggggttcctcttaggattgaaataggaccaaaagaccttgcaaataaccaggtacgagctgttcgacgtgacaatggagccaaaacagatattcccatggataatcttgtcgaacaactaaaagatctgcttgccactatccaagaaaatctatttgatgttgcaaaacaaaagagagatgcgtgcgtccagattgtaagaacttgggatgaatttacggtagcactgggccaaaagaaattggtcttggctccttggtgtgatgaggaggatgttgagaaagatgtcaaggcacgcacaaaaggggagatgggtgcagcaaagactctttgctctccttttgaccagcctgagctgcctgaaggtacactgtgcttcgcatcgggtaaacctgctaagaagtggacatactggggccgcagctattaatgtacttgcctgata

SEQ ID NO: 2331 - DNA, 1836 bp, Lippia dulcis
aagtgaaagcgaaaaggagactgttgcacacggaaagaagaaggaagtgaaaaaagagactggcctgggtctctcctataagaaagatgaaaactttggagaatggtactccgaggtggttgttaatggggaaatgattgaatattatgacatatctggctgttatattctgcgaccttgggcgatgtcaatttgggagatcatgcaaaccttttttgatgctgaaatcaagaaaatgaagattaaaaactgctactttcctttgtttgtatcctctggtgtcttacaaaaggagaaggaccatatcgagggatttgctcctgaggttgcatgggttacaaagtcaggggaatctgagttggagatgcccatcgcaatccgtccaactagcgaaactgttatgtatccgtatttttccaagtggattagaggtcaccgtgacttgcctctgagacttaaccaatggtgcaatgttgttcgatgggaattcagcaatcccactccatttatcaggagtcgtgaatttctttggcaagaaggacatactgcttttgcaaccaaagaggaagcagatacggaggtgcttgatattttggaactctatagacgcatatacgaagaattcttggccgttccagtttttaaggggaaaaagagcgagcacgagaagtttgctggtggactctatacaacaactgttgaggccttcgtcccaaacactggacgtggtgtacaaggtgcaacttcccactgtctgggtcaaaattttgcaaaaatgtttgagattaacttcgagaatgagaaaggggaaaaggccatggtgtggcagaactcctgggcatatactactagaacgataggggtgatgataatggtacatggggatgataaaggcttggtactgcctcctaaagttgcatctgtccaagtaattgtaattcctgtgccgtataaggatgcaaacactcaggggatctttgatgcatgtgcagccactgtgaaatccttgaatgaggctggcattcgtgccgaggctgattttagagataactactcacctggatggaagtattctcattgggaattgaaaggtgtcccgcttagaattgaaattggacccaaagacttagcaaataatcaggtacgtgctgtacgccgggataatgcagctaaaattgatattcccatggctgatttggttgaaaaagtgaacgacatgctaaacaacatccaacaaagcctcttggatgttgccaagcaaaaacgagatgcctgcattcaagttgtccatacctgggaagaattcacggaagcacttggccaaaagaagatgattctggcaccatggtgcgatgaagaggaggtggagaaggacgtaaagacccgcactaagggagaaatgggtgcagctaaatcactgtgctctccatttgatcagcccgcacttccagaaggtaccctgtgcttcgcatctggaaaacccgccaaaaagtggacttactggggaaggagttactgatcattccttatgctacccaaaacatcatcttgccgtcattccatgtttccctcgaggccgatacggtcgtttgtgttttcgtgattttgaaagatcttgaaagtgtaaccatagttttttttgtttttcgtatttttggcaaaagaagattaccagaaaaccataattgttcaactttagatggactaaacatatagttccattttcatttaaagctaggacacatcttacgttttgttattgaactctaatgagaaaaatatgtacttttttatttgacattttaaatgatggtagttaaatttgtgctaaaaaag

SEQ ID NO: 2332 - DNA, 1712 bp, Tripterygium wilfordii
ggaggtaaagaaagagactgggttagggctttccttcaagaaggaggagaactttggagaatggtattcagaggtggttgtcaatgctgaaatgattgagtattatgatatctctggctgttatattttaagaccatggacgatgtcaatatgggagatcatgcaagcctttttcgattcggaaattaagaaaatgaaaatcaagaactgttacttccctctttttgtatctcctggcgttcttgagaaggagaaggatcacatagaaggttttgctccagaggtagcatgggtgacgaaatctggtaaatctgacttggaagtgcctattgcaattcgtccaactagtgagactgttatgtatccgtactactctaagtggattaggggacaccgtgacttgcctttgaaacttaaccagtggtgcaatgttgttcgatgggagtttagtaatcctacaccatttatcaggagtcgtgagtttctttggcaagaagggcatactgcttttgcaacaaaggaagaggcagacacggaggtcctcgaaatattggaactatacaggcgtatatatgaagagttcttggcggttcctgttataaaaggcaaaaaaagtgaaatggagaaatttgctggtggactttacacaacaagtgtcgaggcgtttattccaaacacaggtcgtggtatacaaggtgcaacttctcattgtctgggccaaaatttcgcaaaaatgtttgagattaactttgaaaatgagaagggagagaagtccatggtctggcagaattcttgggcatatagtactcgaacgataggggtaatggtgatggttcatggggatgacaaaggcttggtgctaccacctaaagtggcctctgttcaagttattgtaattccagtgccttataaagatgctgatactaagggaatcttcgatgcatgtgctgcaactgctgaaaccttgtgtgaagcaggtatccgcgctgagactgacttcagagataattattctcctggctggaaatattcgcattgggaaatgaaaggggttcctttaaggattgaaataggtcctaaagacttggcaaacaatcaggtacgcgctgttcgccgtgacagtggagcaaaattagatataagccgggacagtttggttgaccaagtgaaaactatgcttgacaacattcatcaaagcctgtttgatgctgctacacaaaagcgggatgcctgtgtccaagtggtcaaaacttgggatgaatttaaggaggctctcagccaaaggaaattgatattagctccttggtgcgatgaggaggaggtggaacaagatgttaaagctcgaacaaagggtgagattggagcggcaaagaccctctgttccccatttgatcagccagaactcccagaaggtaccaaatgctttgcctcagggaagcctgcgaagaaatggacctactggggaaggagttactagattatgaggaggtaatctttgcaaagttgcttgaatacgcacaatagggaattgcaagtgagaagatatctctattactgcaatgaatggtggggtgcactcatgggttttctttaccggaaaagattgagttactacattttgtccttttctacacatgattacttattgttggtcccaactgttgctcacccagcctttgccatcacattggagataattatagatttttcat

SEQ ID NO: 2333 - DNA, 2038 bp, Brassica oleracea
agacgtggctatatatgattggaagtagatcagtaacgaagcgagtcaaaaggtttgcaacttgtaacgttttccctcgattcgttgctctctccttatctccgccgtcttcagctcaccggcgaatcgaaagaagaaaaggttgaaatggctggtccaagtgggaagaaggagaaggtcgacaaggcgggtcccagtggcggcggcggcaagaagaagaaggacgtcaagaaggaaacgggtctcggactgagcgtcaagaaagacgagaacttcggtgaatggtactctgaggtttgcaagcacgagatgattgagtactacgatatctctggatgttacatccttaggccatggtcaatggctatttgggagattatgcatactttctttgatgcggaaatcaagaaaatgaaggtgaagaattgctacttccctctctttgtatctcctggtgtcctcgagaaggagaaggaccacattgagggtttcgctcctgaggttgcttgggttacaaaatcgggcaaatctgacttggaagtcccgatcgcaattcgtcctaccagtgagacagtcatgtacccttactacagcaagtggataagagggcaccgtgacttgcctttgaagcttaaccagtggtgcaatgttgttagatgggagttcagcaaccctaccccatttatccggagccgtgagttcctttggcaggaagggcacactgctttcgccacaaaagaggaagcagataaagaggtccttgaaattttggagctttaccgtcgcatatatgaagagtatctcgcagtcccagttgtgaaaggtatgaagagtgaaaatgaaaagtttgctgggggactttacactacaagtgtggaggctttcattccaaacacgggtcgtggtgtacaaggtgcaacttctcattgtttgggacaaaattttgcgaagatgtttgagatcaactttgagaatgagaaaggagagactgagatggtgtggcagaattcttgggcctacagtaccaggacgattggagtcatgattatgactcatggagatgacaaaggcctgatacttcctcctaaagtagcatctgtgcaagttgttgtgatccctgtgccttacaaagatgctaatacacaaggaattttcgatgcttgtaccgctactgtagctgctttgagtgaagccggtatccgtgccgaagaagatttaagggacaactactctcctggttggaagtattcaaactgggaaatgaagggtgtccctttgagaattgagattggaccccgtgatctggaaaacgaccaggtcagaactgtgagacgggacaatggagttaaggaagatatcccaagaggtagcttagtggaacatgtgaaggaactgcttgagaagatccaggcaaacatgtatgaagtggcgaagcaaaagagggaagcctgtgttgaagaaattaagacttgggacgagtttatcgtagcactcaacaaaaagaaactcatcttagctccctggtgtgatgaagaggaagtggagagagatgtcaaggcacgaactaagggtgaaactggagcagctaaaaccctctgctctccatttgaacagccagagctccctgaaggcactctctgctttgcatctggaaagcctgcaaagaaatggacctattggggcaggagttactaagtgttcaccatgttttggttcagttcatgaaatttactttgtgaagaccatctcaagttcattgtgctgtgatttgatattttgactgaaagctattttagtttcataactgtgattgcactatgaactacaaaaacgatgtttttttaattcaaaagaactgtttgagaaaggaaaaaatagctctgaaatccactgcttgtgggaatttagttgaagaagttggggctcaaggtatgtacaattctaggtggctaataagccttggagtctcaggtgcaatgtgatatatactatgttctgttctataagctaagctttttcctgctataataattcacca

SEQ ID NO: 2334 - DNA, 1757 bp, Brassica napus
gttgctctctccttatctccgccgtcttcagctcaccggcgaatcgaaagaagaaaaaggttgaaatggctggtccaagtgggaagaaggagaaggtcgacaaggcgggtcccagtggcggcggcggcaagaagaagaaggacgtcaagaaggaaacgggtctcggactgagcgtcaagaaagacgagaacttcggtgaatggtactctgaggtttgcaagcacgagatgattgagtactacgatatctctggatgttacatccttaggccatggtcaatggctatttgggagattatgcatactttctttgatgcggaaatcaagaaaatgaaggtgaagaattgctacttccctctctttgtatctcctggtgttctcgagaaggagaaggaccacattgagggtttcgctcctgaggttgcttgggttacaaaatcgggcaaatctgacttggaagtcccgatcgcaattcgtcctaccagtgagacagtgatgtacccttactacagcaagtggataagagggcaccgtgacttgcctttgaagcttaaccagtggtgcaatgttgttagatgggagttcagcaaccctaccccttttatccggagccgtgagttcctttggcaggaagggcacactgctttcgccacaaaagaggaagcagataaagaggtccttgaaattttggagctttaccgtcgcatatatgaagagtatctcgcagtcccagttgtgaaaggtatgaagagtgaaaatgaaaagtttgctgggggactttacactacaagtgtggaggctttcattccaaacacgggtcgtggtgtacaaggtgcaacttctcattgtttgggacaaaattttgcgaagatgtttgagatcaactttgagaatgagaagggagagactgagatggtgtggcagaattcttgggcctacagtaccaggacgattggagtaatgattatgactcatggagatgacaaaggcctgatacttcctcctaaagtagcatctgtgcaagttgttgtgatccctgtgccttacaaagatgctaatacacaaggaattttcgatgcttgtaccgctactgtagctgctttgagtgaagccggtatccgtgccgaagaagatttaagggacaactactctcctggttggaagtattcaaactgggaaatgaagggtgtccctttgagaattgagattggaccccgtgatctggaaaacgaccaggtcagaactgtgagacgggacaatggagttaaggaagatatcccaagaggtagcttagtggaacatgtgaaggaactgcttgagaagatccaggcaaacatgtatgaagtggccaagcaaaagagggaagcctgtgttgaagaaattaagacttgggacgagtttatcgtagcactcaacaaaaagaagctcatcttagctccctggtgtgatgaagaggaagtggagagagatgtcaaggcacgtactaaaggtgaaactggagcagctaaaaccctctgctctccatttgaacagccagagctccctgaaggcactctctgctttgcatctggaaagcctgcgaagaaatggacctattggggcaggagttactaagtgttgttcaccaagtttttgttcagttcatgaaatttactttgtgaagactatctcaagttcattgtgctgtgatttgatattttgactgaaagctattttagtttcattactgtgattgcactatgaactaccaaaacgatg

SEQ ID NO: 2335 - DNA, 1997 bp, Citrus clementina
gaaagctcagcggcaaagaacagaacaaaaagcagcacacgctcgccgcaccccacgcagttaccaccgtttgatttagtttagaaaatggctggtggtcaggagaaaaagcctatagctaaagcaaagcctaaagctgatgcgggcggtggaggtaagaagaaggagttgaagaaagaaactggcttaggtctctcctacaagaaagatgataactttggtgaatggtattcagaggtagttgtcaatggtgaaatgattgaatactatgatatttctggttgttatatcatgaggccttgggcaatttcaatttgggagaccatgcagaaattctttgatgcagaaatcaaaaaaatgaaaattcagaattgttactttcctctcttcgtatcccccactgttttacaaaaggagaaggatcacattgagggatttgctccagaggttgcgtgggtgacaaaatcaggcgaatctgatttagaggttcctattgcaattcgcccaactagtgaaactgtgatgtatccctacttttcgaagtggataagggggcatcgtgacttgccattgaaacttaaccagtggtgcaatgttgtccgttgggaattcagcaatcctaccccatttatcaggagtcgtgaatttctctggcaggaagggcatactgcttttgcaaccaagtcagaagcagatgatgaggtccttcagatattggaactctacaggcgtatttatgaagaattcttggctgttcctgttataaagggcaaaaagagtgaactagaaaagtttgcaggtgggctttacacaacaactgtcgaggcatttatcccaaacactggtcgtggtatacaaggtgcaacctcacattgcttggggcaaaatttttcaaaaatgtttgagataatctttgaaaatgagaagggagagaaggctatggcctggcagaattcctgggcctatactactcgaacaattggggtcatggtgatggttcatggggatgacaagggcttgatgctgccacccaaagttgcatctgtgcaagtaattgtcattcctgtgccttacaaagatgctgatactcaaggaatttttgatgcatgcactgcaactgttgaaaaattgtgtgaggcaggtattcgtgctaattctgactttagagacaactactcacctggatggaagtactcacactgggaaatgaaaggtgtcccccttaggattgaaataggaccaaaagacttggcaaatgatcaggtacgtgctgttcgccgtgacaacggagcaaaaattgatctgcctaggggctccttggtcgagagagtaaaagaacttcttgaggaggttcaagaaagcttgtttgttgctgcaaaacaaagacgagatgcttgcattcaaattgtaaaaacttgggatgaatttgtggaggctcttggccaaaggaaaatgatcttggctccatggtgtgatgaggaggaggtggagaaagatgtgaaagcacgtaccaagggtgagatgggagcagctaagaccctttgttccccattggagcagccggaagtccctgaaggcactctatgttttgcttctgggaagcctgcaaagaagtggacctattggggcaggagttactagattttgactctcggaaagctgacataacattttaatctatactagtttgaggtgtgtctgatttctttagtgttggagcatctggattgaactgcagaagttgcaataggataactttttattttcactgggattgatcattgatgagacactcacattcagttttgttttcttagattgtattttttttcattatgtggctttcatttgaataattgttctagccatgagcaaacgggtgactccatgattgtgggattttgccactatcatgtcatatgccaaattcctccccaccactggtatcctttcagctcaattttgttgttgaattatactttttgttgatttcatgt

SEQ ID NO: 2336 - DNA, 1876 bp, Vitis vinifera
gtaaggttaaacatcaatagagaaaacgagttcctcagtgttttccctcccctgtctctgcctccgccgccaggactaagttaaggagatggctagtggtgagggaaaaaagtctggtgagggaaaaaaggctaatgccaatgcaaagggtggtgggaaaaagaaggaggtgaagaaagagactggtttaggcctttcctataagaaggaggagaactttggggaatggtattctgaggtttgcgtcaatggtgaaatgattgagtactatgatatatcaggctgttacattctgaggccatggactatggcagtctgggagacgatgcaaactttctttgatgcggagattaagaagatgaaaatcaagaattgctacttccctctctttgtatcacctggtgttttacaaaaggagaaggatcacattgagggtttcgctccagaggtcgcttgggtaacaaaatctggacaatcagatttggaagtgcctattgctattcgtccaacaagtgagactgtcatgtatccctattattctaagtggataaggggacaccgggacttgcctttgagacttaaccaatggtgcaacgttgttcggtgggagttcagccatcctaccccatttataaggagtcgggaatttctttggcaggaggggcatactgcttttgctacaaaggaagaggcagataaagaggtccttgaaatattggaactgtatagacgtatatatgaagagtacttggcgattcctgttataaagggtaagaagagtgagatggagaagtttgctggtggattttacacaacaagtgttgaggcctttattccaaacactggtcgtggtatacagggtgcaacttcacattgtttaggtcaaaattttgcaaaaatgtttgatataacctttgaaaatgagaagggagaaaaggctatggtctggcagaattcctgggcctacagtaccagaacgattggggtgatggtaatggttcatggggatgacaaaggcttagtgatgccacctaaagtagcatctgtccaaattattgtggttcctgtgccttttaaagatgctgatactcaagcaatctttgatgcctgtgatgccactgtgaataccttgaatgaagcaggttttcgtgccgaggcagatcttagagataactattcaccaggttggaagtattcacattgggaaatgaagggtgttcctcttagaattgagattgggccaaaagacttagctaacaagcaggcgcgtgctgttcgccgtgacaattcagctaaaatcgatattcctattgtcaatttggttgaacaagtaaaagacatgctggataatattcaacaaaacctgtttgatgttgcaaaacaaaaacgagatgcttgtattaagactgtgagaacatgggacgaattcatagaagcgcttggccagaagaaaatgatccttgctccttggtgtgatgagatggaagtggaaaaagatgtgaaagcaaggacaaagggcgagacaggagcagctaaaactctttgtgctccttttgatcagccagaccttgaaggtgttaattgctttgtgacaggaaagcctgcaaagaagtggagttactggggcaggagctactagattacaagattctgtttatcaatcagtctcttttccacacagaatttctgaatttgtggaaaaatttggctagggtgattaatcatttctttagagaagcttaagacttaataggatgctctcaattttgcttaaaaaaattggtaaatcatgatttgtgggttttaccagtgtaatgtgttataattgattggctacttcatttccttatttatactattgacattgataatgata

SEQ ID NO: 2337 - DNA, 1822 bp, Vinca minor
ctctccaactctcttccgtttcttctcccactgaaggctgctaaaaggatatttcttttgggcttcatatagttttgtttgaatggctggtaaagaagcaaaaggtgctgggaaagaagcaaaaggttctggtgcgggttcgaacacgaagggaaaagaaagaagtgaaaaagagactggtcttggtcttaccttcaagaaagatgaaaattttggagaatggtactctgaggttgtcgttagtggtgaaatgatcgagtattatgacatttctggctgttatattctacgtccatgggcaatgtccatatgggagatcatgcaaggattctttgatgccgagatcaagaaaatgaatatcaagaactgttatttccctctgtttgtatcccctggtgtgctgcaaaaggagaaggatcacatagaagggtttgctcctgaggttgcctgggttaccaaatcaggagaatccgatctagaagttcctattgctattcggccaactagtgaaactgtcatgtatccttattattctaaatgggtaagaggacaccgtgacttgcctctgagactcaatcagtggtgcaatgttgtcagatgggagttcagcaatcctactccattcatcaggagtcgcgagtttctttggcaagaaggccatacagctttcgctacgaaagaggaggccgacaaagaggtgcttgatattttggaattgtatagacgcatatatgaagaattcctggctgttcctgtcactaagggaaagaaaagcgagcgtgaaaagtttgccggtggcctttatacaactaccgttgaggcttttattccaaacactggccgcggtgtacaaggtgcaacttcccactgcttggggcagaactttgctaaaatgtttgaaataaactttgaagatgagaaaggagagaagcgtatggtttggcagaactcatgggcttatactaccagaactattggcgtaatgataatgacccatggggatgataaaggtctggtgctgcctccaaaagttgcagcggtccaagttgttgtgatccctgttccttacaaggatgctgatactcaagcaattcttgatgcctgtgctgccactgtaaaaaccctgaatgaatcaggttttcgagcagaagcggacttgagggacaactattctccaggatggaagtattcaaattgggaaatgaagggtgtccctctaaggattgaaatagggccaagagaccttgctaataagcaggtacgtgttgttcgacgtgacaacgcagccaaaattgacattccaatggataatttggttgaacaagtgaaaaatctattggataccatccaacaaaatctgtatgatgttgcaaagcaaaagaaagaagcctgcattcaggttgtgaaaacctgggaagagtttgtggaagcactggcacaaaagaaattgattttggctccatggtgcgatgaagaggaggtggaggaagatgtcaagaatcggacaaagggtgaaatgggtgcagtcaaaaccctgtgttctccatttgagcagccagagctgcctgaaggtacgttgtgctttgctactggaaaaccagccaagaagtggacttactggggtcgaagctattaaagttcttatttttcgccttttggcctagtttggtgttctaagtgttgaatttctaacattgttttgacagagatttgtgacttttgattactttgggaaagaagtttatcagattgttcttcccgtagcaatatgatatatcagaattaaatataaatatagctttcaattttctacaaaaaaaaa

SEQ ID NO: 2338 - DNA, 1928 bp, Citrus clementina
  Sequence also found in Organisms: Citrus sinensis
aaaaagacaaaaatgagtttacttgcgcacgtctaggcggctagggattaataacttttacgtgaaagaagaaaacgccaccagtcgaataatacgtcagatcggattaattttaggttatggctggtggtggggagaaaaagtccaaagctaatgcgaccggtggagggaagaagaaagaggtgaagaaggaaactggtttaggtctttcctacaagaaagatgaaaactttggggagtggtattcagaggtagttgtcaatggtgaaatgattgaatactatgatatctctggttgttacatcataaggccttgggcaatgtcaatttgggagaccatgcagaaattctttgatgcagaaatcaaaaaaatgaaaattcagaattgctactttcctctttttgtatcccctactgttttacagaaggaaaaggatcacattgagggttttgctcctgaggttgcttgggtgacgaaatcaggggaatctgatttggaggttcctattgctatccgcccaactagtgaaactgtgatgtatccatactattctaagtggataaggggacaccgtgacttgcctttgaaacttaaccagtggtgcaatgttgttcgatgggagttcagcaatcccaccccatttatcaggagtcgtgaatttctctggcaggaagggcatactgcttttgcaactaaatcagaagcagatgatgaggtccttcagatactggaactctacagacgtatttatgaagaattcttggctgttcctgttataaagggtaagaagagtgagctagaaaagtttgctggtgggctttacacaacgaccgttgaggcatttattccgaacactggtcgtggtatacaaggtgcaacttctcattgtttgggccaaaacttttcaaaaatgtttgagataatttttgaaaatgagaagggagagaaggctatggcctggcagaattcttgggcctacactacccgaacaattggggttatggtgatggtccatggggatgacaaaggcttggtgctgccacctagagttgcatctgtgcaagtgattgttgttcctgtgccttacaaagatgctgatactcaaggaatttttgatgcctgcactgcaactgtagaaacattgtgtgaggcaggtatttgtgctaatatggactcaagagacaactactcacctggatggaagtactcacactgggaaatgaaaggtgttccccttaggattgaaataggaccaaaagacttggcaaaaaatcaggtacgtgctgttcgccgtgacaatggagcaaaagttgatctgcctaggagctctttggttgagcgaataaaagaacttcttgatgagattcaagaaagcttgtttgttgctgcaaaacaaagacgggatgcctgcattcaaattgtaaaaacttgggatgaatttgtggaggctcttggccaaagaaaaatgatcttagctccatggtgtgatgaggaggaggtggagaaagatgtgaaagcacgaaccaagggtgagatgggagcagctaagaccctttgttccccgttggaacagccagaaatccctgaaggtactctctgctttgcctctgggaagcctgcaaagaggtggagttactggggcaggagttattagattctgaagcttaccatacatttcctctatattccttggatcatgtgtttgattctgaaacgaaccgcagagaattgcagcaataggatagattttctttatataatttgtattggaaagttgggagacgcactcagttttccgtttacttcaatttttatgttattttcaatttctcgccttaatttgaaggtttttcgagccacgaatcaaatggttcttttactacgaaatttgtgcttggatcttgatgtgagattttaacttgaactg

SEQ ID NO: 2339 - DNA, 3597 bp, Mimulus guttatus
cagtacgttagggtgacaacgaaagaaacaacgaacctctatttcttctctgccccatttcctccgtgacggcggccgccgttgcgtcggaaattgctaaccgtcgagattcgaaagtgaggaagggttattgtgatcggtaatagttctgcttctcaccgttttgagttttaagagattcgtcaccatggctggtaaagatgctaaaagtaatgctgccaagggaaagaagaaggaagtgaaaaaggagacaggcctaggtctttcttataagaaagatgaaaattttggagaatggtattcggaggttgttgttaacggggaaatgatcgagtactatgatatatctggctgttacattctgcgcccttgggcaatgtctatttgggagatcatgcaaacattctttgatgctgaaatcaagaaaatgaaaattaagaactgttacttccctttgtttgtatcatccggtgtccttcaaaaagaaaaggaccatatagagggttttgctcctgaggttgcatgggttacgaagtcgggagaatctgaactggagatgcccattgcaattcggccaactagtgaaactgtcatgtatccatatttttccaagtggattaggggacatcgagacttgccacttagacttaatcagtggtgtaatgttgttagatgggaattcagcaatcccactccattcatcaggagtagagagtttctttggcaggaaggacatactgcttttgcaaccaaggaggaggcagataccgaggtgctggatatcctagaactttatagacgtatatatgaagagttcttggcggttcctgttatcaagggcaaaaaaagtgagcatgagaagtttgctggtggactttacaccactaccgttgaggcttttgtcccaaacactgggcgtggtgtgcaaggtgcaacttcacattgcctgggccaaaattttgcaaaaatgtttgagataaattttgagaacgagaaaggagaaaaggctatggtctggcagaattcctgggcttataccaccagaacgataggggtgatgataatggtccatggagatgacaaaggcttggtgctacctcccaaagtagcatctgttcaagtaattgttatccctgttccctataaggatgcagacacaaaagggatcttcgacgcatgcgcagccactgtgaaatccttaaacgaatcaggcattcgtgcggaggctgattttagagataactattcaccaggatggaagtattcacattgggaaatgaaaggtgttcctcttaggatagaaattgggccgaaagactacgcaaataatcaggtccgtgcagttaggcgtgacaatgcaacaaaacacgatattcccatggctgatgtggtcgaacgagtgaaagacatgcttgataacatccagcaaagcctctttgatgccgccaaggaaaaacgagatgtatgtattgaggttgtacatacatgggaagaatttgcagaagcacttggacagaagaagatgattctggccccatggtgtgatgaagaggaggtggagagggatgtgaagacacgtacgaagggggaaatgggtgcagccaagtcattgtgttctccatttcaacagcctgaactccctgaaggtaccttgtgcttcgcgtcgggaaaaccagcgaagaagtggacatactggggaaggagttattgatcaccaatatttatatacaggtattcgatatcttgaaaaatggttgctttctagaaaaaaagaagaagttatatgacgaagctacttaaggcgcaatttgttctttgttgaattcaattgttttaatagtcggtctagttttcgttttattcaaaagtacaccaccaattgacaatacctgagaagtttaattcgaattgtcgaggcataggaattgtccacatgccgagactttgcattggaattttacgcatagccattcggggcatagttgagaaatcgacatcgtttgttagcattgttggttagcaattttattcgttaataataatgtggtcgatgggacattatttcattgagacagaaagttaataatcgataattgtatgaagaacacaatcaaatacattgaactgcaataataatattatacaactctttctacccgaatgagaaacacgctttttttttattttctaatctctatccaatgaatcagctattaaatctaaaaatatctaaaaaatctacaagtatgaaaatctgctctgagctgcatggcgaaatctctctcttcacatctagttcgacatctttaccttacaaaatttccccactgaagaacctcgacatttccgaactcccttctctatcgttgccaccagttaaataaatatcgagctatgacaaacataaaaataaagctaccggaacgaagaaattgaatagaagtataacatttttcgcggaaaacgaataactcattcgcggaagaaaaccctgcaacccaatattatacactggggtaccgtccggataatacaacccgtagttcctctcggaagcgggccccggcttcaaatcctcgttaaatagcgcaaaaaagaacacatcgatcggcaccgatggcttcgctggagtcccctcgttcaacgctattctgttaatcaaattcccgttgtacaactgagcgttttctggtgtggcccccacttcattcacatcccccttcgaaggccaccccgtttccgaaaccttaacctgtatatcggtgtgccccaacaatcgaatcgccgaataaaccgcatcgatctgcgcgtacaacatattatcgtaatgcaaattcgtaacagggtcgatcgagccagcattcggccgaaagagcacgtaatcgagcgacacctctcccggattgtctttatacgcgaaaaacgggtacgcatttataaggaagggcgatttcgtccttgcatgaaattcaagaatgggttgaatatacggcaccaaatcctggcggaaggttccggaagaaggcggaaacgagttgctcaagactccgtacgagtgagcggtcgtgacgtaaattttatcacttaaaccgagattcacgagggccccactaacggtctccattgcagggaggaggttcgatattagttgggagtcgttgccggttaatatttcgttcccgacggttatgcagttgattttggtgcgggagatgtagggttggacgtgggtttggatccaggcttgggcgagggacggatcggtcatctgctgtaggtgctcgttgcctagtccgatcacgaattcgaccggcgacgaggcgaatgctgacaggacgatggggtcggcgtcgtagagcttgactcgggttatgttgagggagttgaggaggtggaccacgcgcgacggggccgggaggttatttgcgatttggccgtagtttatccccactccttggctgcgtgccgtgctaactaatgaatctgaaaaaacgaagaggaggaggaggagaagaagaagccgccgccgtggagtggccattgtaattagcgatttgctaactctgttaaaaaatctctcagccacaggcggtgctg

SEQ ID NO: 2340 - DNA, 1842 bp, Eutrema halophilum
aaaggtttacaagttgtaacgttttcccttgaattcgctctcttcttatctttgctgtgtttgtctccgccgtcttcagctcaccggcgaattgaaagaaaagatttaaaatggctggtccaagtggaaagaaagacaaggctgagaaggctggtcccagtggaaaaaagaagaaggaggtcaagaaggaaacaggtctcggactcagcgttaagaaagatgagaatttcggggagtggtattctgaggtctgtaaacacgagatgattgaatactacgatatttctggatgttatatccttaggccatggtcaatggccatttgggagatcatgcaaagtttctttgatgcggaaatcaagaaaatgaaggtcaagaattgctatttcccattgttcgtatctcctggtgtcttggagaaggagaaggatcacatcgagggattcgccccagaggttgcttgggttacaaagtcgggtaaatctgacttggaagtcccaattgctatccgtccaactagtgagacggttatgtacccgtacttcagcaagtggataagggggcaccgggacttgccgttgaagctgaaccagtggtgcaatgtggttagatgggagttcagcaaccctactccatttatccggagccgtgaattcctctggcaggaagggcatactgctttcgccacgaaagaagaagcagatgaagaggtccttcaaatattggagctttaccgtcgcatatatgaagagtatctcgcagtcccagttgtgaaaggtatgaagagtgaaaatgagaagtttgctgggggactttacactacaagtgtagaggctttcattccaaacactggtcgtggtgtacaaggtgcaacctctcattgtttaggacaaaattttgcaaagatgtttgagatcaactatgagaatgagaaaggagagacagcaatggtgtggcagaattcttgggcctacagtaccaggacgattggagtgatgattatgactcatggagatgacaaaggcctgatactccctcctaaagtcgcatccgtgcaagttgttgtgatccctgtgccctacaaagatgccaatacccaaggaatctttgatgcttgtactgctactgtctctaccttgtgtgaagccggtatccgtgcggaagaagatctaagggacaactactctcctggatggaagtattcaaactgggaaatgaagggtgttccattgagaattgagattgggcccagagatctggaaaatgatcaggtcagaactgtaagacgggacaatggagttaaggaagatatcccaagaggtagcttaggcaaacacgttcaggaactgcttgagaagatccagcaaaacatgtatgaagtagcgaagcaaaagagggaggcatgtgttgaagaaattaagacttgggatgagtttatagaagctctcaacaaaaagaaactcatattagctccctggtgcgatgaagaggaagtggagagggatgttaaggcacgtactaaaggtgaaactggagcagctaaaaccctttgttctccatttgaacagccagaactccctgaaggcactctctgctttgcttcaggaaagcctgcgaagaaatggacctattggggcaggagttactaaaagtgttcatcatcttttggttcaattcatgaaatttacttttgtcttgtgctttgatttgatattttgaccaaatttgagttttttatttaaaactgtgattacactatggacgataaacatatgtttcgaaggttcaaacgaactgttggtgttggaaaaagaaaaagaaaacagacgatcaatttaacaa

SEQ ID NO: 2341 - DNA, 2187 bp, Phaseolus vulgaris
actgaaacaaagtacgttacactgagtagtcgaaggtgcacagtgaagagtaaaaaaataggagtgtaagaaattaaagagggcggaaggggcacagctgaacactttatctgaaagtgaaaaccctagagtcaaccgtagcgccacaatcgctctcgcgcgtttcgttcgccttcggcatctttgcaacgggatcaggtgctcgtccttcaccatggcggggactgaagccaaaaagccttcggctaagcaatccggtgcgaagaagaaggaggtgaagaaggagactggcttgggtctcacgcatcggaaggcggacaacttcggagagtggtattccgaggttgttgttaatgcggaaatgattgaatactatgatatatctggttgctatattctgaggccttggtcaatggcaatatgggagatcatgcaagagtttttcgatccggaaataaagaaaatgaaaatcaagaactgctacttccctttgtttgtgtctcctggagttttgcaaaaggagaaggatcacgttgagggttttgctcccgaggttgcttgggtaacaaagtccggggaatctgaattagaaattcctattgctattcgtccaaccagtgaaactgtcatgtatccctactactctaagtggataaggggacatcgtgacttgcctttgaaacttaatcagtggtgtaatgttgttagatgggagttcagcaatcccacaccattcatcaggagtcgtgagtttctttggcaagaagggcacactgcttttgcaacaaaggaggaagcagatgcagaggttcttgacattctggaattatatagacgtatatatgaggagtatttggcagttcctgtcataaagggtaagaaaagtgagcttgagaagtttgctggtgggctttacactaccagtgttgaggcatttattccgaacactggtcgcggtatacaaggtgcaacttctcattgtcttggccaaaactttgctaaaatgtttgagatcaactttgaaaatgataagggagagaaagcaatggtctggcagaactcatgggcctatagtactcgaactattggcgtcatggtgatggttcatggtgatgacaagggattggtactgcctcctaaagtcgcatcagtacaagtcattgtgattcctgtgccttacaaagatgctaatactcaaggaatctatgatgcctgttctgcaactgtgaatgcattgtctgaagcaggtattcgttctgagtcggattttagagataattattctccggggtggaagtattctcactgggaaatgaaaggtgttcctctaagaattgaaattggaccaaaggatttagcgaataagcaggttcgcgctgttcgacgtgataatggagcaaagatagacattgctagtgctgatttggctgttgaaatacaaaagttgcttgataatattcaacagaatctgtttgatgttgcgaaacaaaaacgagatgaatgcattgaggtcatacacacttgggatgaatttgtgcaagctttgaaccaaagaaaaatgatcttagctccatggtgtgatgaggaggaggtggaggctgatgtcaaagcaagaactaagggtgagatgggagcctctaagactctttgcagcccctttgatcagccagaactccctgaaggcactaagtgctttgcatctggaaagcctgcaacaaagtggacatactggggcagaagttactagtctacgggctgttgattgtggtattatatggagctagtttgtcatttactggtcccttgtgtactaatttgtggatcacacaaatattagttttgttttcttggtatctttttcaacgaatagttttactttgatttttatatggtacaatatttattttgctttaaagaatgagtattgcttttgttgtcgttcaattatattgaggggcatattagactcttggttattatttaggcataaaatgagacactcaattatacaaattagttgctgcaggtttagatggatggtgggaagatatgaaaatgggacggaaaattggttgaacagtttgtataatgaagaagtaatgaatatgtgcgtgcatgtgaatgtgtattatgcctaactaattgaattattaagttatatgaagtagtgagccggaattgactatt

SEQ ID NO: 2342 - DNA, 2333 bp, Populus trichocarpa
taaagtcgatttttttcaacgctatctagggttttactttaagacagagagagagctcttttgtgttatcccccactgcacttgcttttgttctctcctgctgtggatacacaacaacgccaccaccagcgtcaacccgattcgtgtaatttttaagctgtgaaaaatggctggtggtaaaaagaaggaggttaagaaagagactgggttaggtctctctttcaaaaaggaagagaattttggggaatggtactcagaggtggttgtgaatggggagatgattgaatattatgacatttctggttgctatattctgaggccatgggcaatgtcaatatgggagattatgcaagtattctttgatgcagaaatcaagaaaatgaaaattaagaattgctacttccctctttttgtttcatctagtgttctggaaaaggaaaaggatcacattgagggctttgctccagaggttgcttgggtgacaaagtcaggaaaatctgacttggagattcctattgccatccgtccaactagtgagactgttatgtatccctatttttctaagtggatcaggggacaccgtgacctgcctctgaaactcaaccaatggtgcaatgttgttcgttgggagttcagcaatcctacaccatttatcaggagccgggagttcctctggcaggaagggcacactgcttttgcaacaaagcaagaagcagatgaagaggtccttcaaatattggaactgtacagacgcatatatgaagaattcttggctattcctattataaagggcaagaaaagtgagatggagaagtttgctggtggactttacacaactagcgttgaggcatttattcccaacactggacgtggtatccaaggtgcaacttctcattgtctgggccaaaattttgcaaaaatgtttgaaataaacttcgaaaatgagaagggggagaagggaatggcctggcagaactcttgggcctatagtactcgaacgattggagttatggtgatggttcatggtgatgacaaaggcttggttctgccacctaaagtgtcatctgtccaagttattgtcgttcctgtgcctttcaaagatgctaatactcaaggaatctttgatgcatgtgctgcaactgtggatactttgtgtgaagcaggtattcgtgctgaggctgattacagagagaattactcacctggttggaaatactctcactgggaaatgaaaggtgttcctctgaggattgaaattgggcccaaagatttggcaaataatcaggtacgtgcagttcgccgtgacaatgcagcaaaagtggatatcagttgtgacaatttggcggagaaagtaaaggatatgctggatgatattcaaaagagcatgttcgatgctgctaaacaaaagcgagatgcttgcattcaagttgcgaaaacttgggatgaattcaaggaagctctcagtcaaaggaaaatgatcttagctccttggtgtgatgaggaggaggtggaaaaggatgtgaaagatcgaacaagaggtgaaatgggagcagccaagagtctttgttccccatttgaccagcccgagctccctgaaggtactacatgctttgcttctggaaagcctgcaaaaaagtggacctactggggcaggagttactagattatcaggtcttggtgcaatcttccttctcaattttcaaattgtttgaatttcaggtgcttatgtacttcagttggagcacatactaaactaatttgtcagcagaacataggaaatgaggggaatatactaagttttgtttcttgaaattgtaatcgatttctgactttgattccacttgaaatgttgggttgcgaagttcaaatcagacacaacaaataggttgccacataatatatacaatctttttaatgattcatcgggttcttttgtggaccaagtttgccagtgttttaacttctttcactggtgtttttatttcacttttcagcaacagaaaagatgcatctttttaaaggttatattagtgattggagaggttgtggtggctaaacaaaatgtgtttggtcaaaatacctcaggcgaggggaatagacatttgaagagggtagcttttggtttaaaaaaagggttcggagctaaaaggctagacaacttcactgtcaaagccagacatgctcgcattgtttaaatcttgttttagattccaacttccctctcgcaaagagtgttcaagaaggaaaaggaagagagggcacgtctctttatgatcaaaacgtcagtttatcaatagtctttccggaaatgtgggcttgatttttctgtgcgc

SEQ ID NO: 2343 - DNA, 2155 bp, Populus trichocarpa
gaagacgtgaattgtgtttcataacccctaaaactcatatttccagatacgaaacgcctagcttatctgttcacttcttaattccaattgcgtcagactgttagttcttttatttgtatttttgggattctgttttcaatttcggtaaaggtttattgttaggattgggtgaaatgcatgcgaatttactgtttgtcatttctgtttttgttgtctgattttttttggttaatagtatttgatcaggtgtagtttttaagctgtgaaaatggctgatggtaaaaagaaggaggtcaagaaagagactgggttaggtctcactttcaaaaaggaagagaattttggggaatggtattcagaggtggttgtgaatggggagatgattgaatattatgatatttctggttgttatattctgaggccatggtcaatgtcaatatgggagactatgcaagcattctttgatgtggaaatcaagaaaatgaaaatcaagaattgctacttccctctttttgtatcatctagtgttttgcaaaaggagaaggatcacattgagggctttgctccagaggttgcttgggtgacaaaagcaggaaaatctgacttggaggttcctgttgctattcgaccaactagtgagactgttatgtatccctatttttctaagtggatcaggggacaccgtgacctgcctttgaaactcaaccagtggtgtaatgttgttcgatgggagttcagcaatcctacaccatttatcaggagccgtgagttcctttggcaagaaggacacactgctttcgcatcaaagcaagaagcagatgaagaggtgcttcaaatattggaactgtaccaacgcatatatgaagaattcttggctattcctgttataaagggcaagaaaagtgagatggaaaagtttgctggtggactttacacaactagtgttgaggcatttattcccaacactggacgtggtatccaaggtgcaacttctcattgtttgggccaaaattttgcaaagatgtttgaaataaactttgaaaatgagaagggagagaagggaatggcctggcagaactcttgggcctatagtactcggacgattggagttatggtgatggttcatggagatgacaaaggcttggttctgccacctaaagtggcatctgtccaagttattgttgttcctgtgccttacaaagatgctgatactcaaggaatctttgatgcctgtgctgcaactgtggatactttgtgtgaagcaggtattcgtgctgaggctgactttagagagaattactcacctggttggaagtattctcactgggaaatgaaaggtgttcctctaaggattgaaatagggcccaaagatttggcaaataatcaggtacgtgcagttcgccgtgacaatgcagcaaaagtggatatcagtcgtgacagtttgatggagaaagtaaaagatatgttggatgatattcaacagaggttgtttgatgctgctaaacaaaagcgagatgcttgcattcaagttgtgaaaacttggggtgaattcaaggaagctctcagtcaaaggaaaatgatcttagctccttggtgtgatgaggaggaggtggaaagggacgtgaaagaacgaacaagaggtgaaatgggagcagccaagagtctttgttccccatttgaccagcctgagctccctgaaggtaccgcatgctttgcttctggaaagccagcaaagaaatggacctactggggcaggagttactagatcatcaggtccctgtgcaatcttcaattttcatatagttcgaatatcaggtgcttatgtacttcagtttgggcacacatttaagtaatttggcagcagaacaacaggaaatgaagctaacatactaggttttgttgtaatccatttccgacatcgattattctacttgaaatgttgggttgcaacgcttaaatctgctacaataataggttgccagataatttatacaatcttgttcttgttgatggtatcgttgggctccttggtggacctagtttgccagtgttttgaactgcttctttcacttcgttttcatttaacttcctaacagctgaaggatacattttcgaaggctggaccgtagctatacttgcagctcaactgtggtta

SEQ ID NO: 2344 - DNA, 1851 bp, Arachis hypogaea
gaaagaagaaaacctagtagccgctgaaagcgaaaaccctaaagagactcacgccacaaaatcgctctcgcgcgctttgtccccctccggcggcatctcggcaatcggttctcgtcgttcaggatggcggggagtgaagcgaaaaactctggctcaaagcaatctggtgcgaagaagaaggaggtgaagaaagagactggattaggactcacgaatcgcaaggctgataacttcggagagtggtattccgaggtggttgttaattccgaaatgattgagtactatgacatttctggctgctacattctgaggccttgggcaatggcaatatgggagatcatgcaaggattcttcgatcctgaaataaagaagatgaaaatcaagaattgctacttccctttgtttgtgtctcccggagttttggaaaaggagaaggagcacgttgagggatttgcaccagaggttgcttgggtgacaaagtctggaaaaaccgacttagaaattcccattgccattcgtccaactagtgaaactgtcatgtatccatactactccaagtggattaggggacaccgtgacttgcctctgaaacttaatcagtggtgtaatgttgttagatgggagttcagcaaccccacaccattcatcaggagtcgagagttcctttggcaggaaggacatactgcttttgcaactaaggaagaggcagatgctgaggttcttgagatattggaattatataggcgcatatatgaagagtttttagccattcctgtcattaagggtaagaaaagtgagatggagaagtttgctggtggactttacactaccagtgttgaggcatttattccaaacactggacgtggagtacaaggtgctacttctcattgtcttggccaaaattttgctaagatgttcgagataaactttgaaaatgaaaagggagaaaaagcaatggtctggcaaaactcatgggcctatagtactcgaactattggggtgatggtgatggttcacggtgatgacaagggactagtgctgcctcctaaagtggcctcagtccaagttattgtgattccggtgccttacaaagatgctaatactcaaggaatctttgatgcctgtactgcaactgtaaatacattgtgtgaagcaggtattcgtgctgagtcagattttagagacaactattctcctggatggaagtattcacactgggaaatgaaaggtgttcctcttagaattgaaattgggccaaaggatttagcaaataagcaggctagagctgttcgacgtgataatggagcaaaaatagacattgcaaatgacaatttggttgatgaagttaagaagttacttgacactgttcaacagaacctttttgatgttgcaaaacaaaaacgagatgaatgcattgaggttgtacatacttgggatgaatttgtacaagctttgaaccaaagaaaaatgatattagctccttggtgtgacgaggaggcggtggaagctgatgttaaagcaaggacaaagggtgagatgggagcagctaagacactttgtagtccttttgatcagccagaactcccagaaggtaccaagtgctttgcctcagaaaaacctgctaagaaatggtcatattggggcagaagttactagatgactagtttgtgatactttttttttatatggatgggtgttaatggtgccctgtctggatttgttgagcacacaccagttttagtttttccaattggttattttctttttcagctgtcggttgttcgatgattttgtactacatattacttaaaaaactgcagttaattgaacatggcatcatttacttgactc

SEQ ID NO: 2345 - DNA, 1787 bp, Brassica oleracea
gctaaagtgagtcaaaaaaggtttgcaagttgtaacgttttccctcgattcgttgctctctccttatctccgccgtcttcagctcaccggcgaatcgaaagaagaaaaggttgaaatggctggtccaagtgggaagaaggagaaggtcgacaaggcgggtcccagtggcggcggcggcaagaagaagaaggacgtcaagaaggaaacgggtctcggactgagcgtcaagaaagacgagaacttcggtgaatggtactctgaggtttgcaagcacgagatgattgagtactacgatatctctggatgttacatccttaggccatggtcaatggctatttgggagattatgcatactttctttgatgcggaaatcaagaaaatgaaggtgaagaattgctacttccctctctttgtatctcctggtgttctcgagaaggagaaggaccacattgagggtttcgctcctgaggttgcttgggttacaaaatcgggcaaatctgacttggaagtcccgatcgcaattcgtcctaccagtgagacagtgatgtacccttactacagcaagtggataagagggcaccgtgacttgcctttgaagcttaaccagtggtgcaatgttgttagatgggagttcagcaaccctaccccttttatccggagccgtgagttcctttggcaggaagggcacactgctttcgccacaaaagaggaagcagataaagaggtccttgaaattttggagctttaccgtcgcatatatgaagagtatctcgcagtcccagttgtgaaaggtatgaagagtgaaaatgaaaagtttgctgggggactttacactacaagtgtggaggctttcattccaaacacgggtcgtggtgtacaaggtgcaacttctcattgtttgggacaaaattttgcgaagatgtttgagatcacctttgagaatgagaagggagagactgagatggtgtggcagaattcttgggcctacagtaccaggacgattggagtaatgattatgactcatggagatgacaaaggcctgatacttcctcctaaagtagcatctgtgcaagttgttgtgatccctgtgccttacaaagatgctaatacacaaggaattttcgatgcttgtaccgctactgtagctgccttgagtgaagccggtatccgtgccgaagaagatttaagggacaactactctcctggatggaagtattcaaactgggaaatgaagggtgtcccattgagaattgagattggaccccgagatcttgaaaatgatcaggtcagaacggtgagacgggacaacggagttaaggaggatatcccaagaggtagcttagtcgaacatgttaaggaactgcttgagaagattcagcaaaacatgtatgaagtggcaaggcaaaagagggaagcatgtgtgcaagaaattaggacttgggatgagtttatcagtgcactcaaccaaaagaacctcatcttagctccctggtgcgacgaagaggaagtggagagagatgtcaaggcacgcactaaaggtgaaactggagcagctaaaactctctgttctccatttgaacagccagaactccctgaaggcactctctgctttgcatctggaaagcctgcgaagaaatggacctattggggcaggagttactaagtgttcctcatgtttttgttcaatgtcttgtaaagactcaagtgctttgatttgatgatatttttgactcaaaagttatttcagtttttttcttaactggaactataaagtgatgttttgtttc

SEQ ID NO: 2346 - DNA, 2541 bp, Cicer arietinum
tcttatttttttaattgaattttaaaattatgacatagtaaaatagacaaatattgattattatttgaaaatgagaaatttggatttgtagcgtaaacacgaacgtatgaaatgttacggtaggtattaatgatgctgatgacaaaaaaaatggaatttactttaagagaggtaagtgaagagtaaagaaggagtatagagaaaagagaaaaccctagtagagatatacttacaacagacaagagtctaacataacgccacaatcgctctcgcgcgcttcattctccctcgccttctttccaacaacaggttcaggtgctcctcctcgttgacaatggcggggaccgaatccaaaaaacaatctgctgaaaaaaaaccaaaatctggtgccaaaccacaacaatctggtggtaagaagaaggaggtcaagaaagaaactggattaggtctcactaatcggaaggctgaaaactttggagagtggtattctgaggttgttgttaatggggaaatgattgagtactatgatatttctggttgctatatcctcagaccttggtcaatgtcaatttgggagattttgcaagcgttttttgacccagaaataaagaaaatgaagatcaagaactgctacttccctgtgtttgtttcacctggtgttctggaaaaggagaaggaccatgttgagggttttgctccagaggttgcttgggtgacaaaatctgggaactctgatttagagattcctatcgctattcgtccaactagtgaaactgtcatgtatccctactactctaagtggattaggggacaccgtgacttgcccttgaaacttaatcagtggtgcaatgttgttagatgggagttcagcaatcccacaccgttcatcaggagtcgtgagtttctttggcaagaaggacacactgcttttgcaacaaaggaggaagcagatacagaggttcttgaaatattggaattatataggcgtatatatgaagagtatttggcagttccagtcataaagggtaagaaaagtgagcttgagaagtttgcgggtggactttacactaccagtgttgaggcattcattccaaacactggtcgtggcatacaaggtgcaacttctcattgtttgggacagaattttgctaaaatgtttgagataaactatgaaaatgagaagggagagaaagcaatggtctggcagaactcatgggcctatagtactcgaactattggtgtgatggtgatggttcatggtgatgacaagggattggtgctgcctcctaaagtagcatcagttcaagttattgtgattcctgtgccttacaaagatgctgatactcaaggaatctttgatgcctgttctgcaacagtgagtatgttgtgtgaagcaggaatccgtgctgagtcagattcaagagataactattctcctggatggaagtattctcagtgggaaatgaaaggtgttcctctaaggattgaaattgggccaaaggatttagcaaataagcaggttcgtgctgttcgacgtgatactggagcaaagatagacattgctaatgctggcttggtcgaggaaataaaaaagctgctcgatagtattcaacagaatctgtttgacgttgcaacacaaaaacgagatgaatgtattcagatcatacatacatgggatgagtttgtacaagctttgaatcaaaaaaagatgatattagccccttggtgtgatgagaaggatgttgaagtagatgtcaaagcaaggacaaagggtgagatgggagcagcaaagactctttgtagtccctttgatcagccagaactcccagaaggcacaacgtgttttgcgtcaggtaagcctgcaaagaaatggtcatactggggaagaagttactagatcttgattctggtattttttgaagcttgttcaacatgtctgaatttgtggattatgcaaatattagttttcttctgcttggataactaatttttcaattgatagtttttacttcgattttatacagtacaatttttattcaactttaaagaagagtacactgggttttgcatgctactgcttcattgattactacgtcactcatcactgtctattttctttttggcgattgaccactgcctttttaggtggattgaaacccaatagaatgaaatattaattgaacaatccgatcctggttttgcatatatttgcaaaagacgtgttattgatacaagttagcaatttacttcagacgtgttattggtagaaacctgttaaaattcgatgtgtcaagttgtaaatatagtcaagttagtgaacattaaaatatgatttttaactggtatcaaattattttactttgacattatgtctaaatctatttcaaaagttgaaggtatctaataataatattgtgttactttttaggctttaataatattgtagtgcgctgcaatattgaatactcgggtgagataaattaaaaggattattgtatatttttacatagtttttatcacattactgagacttgcgatgct

SEQ ID NO: 2347 - DNA, 1720 bp, Eschscholzia californica
tctaaaactttctatcctctagggttggatttggcggcctccacctatcaataagaggttaggcaccttgagatggctaatgacaaggctacgaaatccagtgccaacccgaagagtggaggcaaaaagaaagaagtgaaaaaggagactggacttggtctctcccacaaaaaagatgaaaattttggagaatggtactccgaggttgttgtcagtggtgagatgatcgaatactacgatatctctggctgttatattctgaggccatggtcaatgtctatttgggaaattatgcaagtcttctttgatgctgaaattaagaaaatgaaaatcaagaactgttacttccctgttttcgtgtccccaggtgttttacaaagggagaaggatcatattgaaggttttgctccagaggttgcatgggttacaaagtctggagacactgacttagaagttccaattgcaatccgtcctacaagtgagaccgtcatgtacccctactattcaaaatggattaggggacatcgtgacttacctttgaggcttaaccagtggtgcaatgttgtacggtgggagttcagcaaccctactcccttcatcaggagtcgtgaatttctctggcaagaaggccatacagcttttgcaacgaaggcagaagcagataaagaggttcttgaaatattggagctgtaccgaaggatttatgaagaatttttggctatcccagttgtgaaggggaagaaaagtgagaacgaaaagttcgctggtggcctttatacaacaagtgttgaggcttttattccaaacactggtcgtgggatacaaggtgcaacctcacattgtcttggtcaaaactttgcaaaaatgtttgagataaactttgagaatgagaagggagaaaaaggaatggtttggcagaattcgtgggcatacagcactcgaacgattggggtgatggtaatggttcatggagatgacaaaggcttagtgttgccacccaaagtagcatctgttcaagtcattgtgattcctgtaccatacaaagatgctgatatgcaagcaatctttgatgcctgctcctctacagtggacaagttgaacgaagctggttttcgtgcggaggcagatctaagagacaattactcacctggctggaagtattctcattgggaattaaagggtgttcctttgaggattgagatagggccgaaggatatggctaataatcaggtacgtgttgttcgtcgtgacaatggatcaaaagtggacataccaaatgcgaacttagttgaccagattaaagatgtattggacgatatccaacaaagccttttcaatgctgcaaagctaaaacgagatgctagtgttacaatcgcaaaaacatgggaagaatttataactgctcttaatgagaagaaaatgatcttagctccttggtgtgacgaagaggaagttgagaaagacgtgaaagcacgtactaagggcgaaacaggggctgccaaaaccctttgcactcctttcgatcagcctgaacttccagaggggactctatgctttgcatcgggaaagcctgcgacgaaatggacatattggggtagaagctactaaacaaactgttgcctgttaccaaaccatgagtggcttgattgctcataggactctgcttaatttctacaatttttctttttctgaaaccggaggaagcctaggttttgtaaga

SEQ ID NO: 2348 - DNA, 1811 bp, Flaveria ramosissima
gaacattcactctctcatcgacagctttcaatcgattccccttcaactccgaactgcttcgccgccggcgttgaccggaaaccaccgcaaaagctcggacggcggagggttactgtttgttcttccggtgtctgaacttatcgtacttctgcaattcactgtaatttgactgaaatctgaagaaatggctagtggaaagggagataaggctgctaaggccgataaatctgctgctgttgccaaatcgagtaagggaaggaagaaggagactggtctaggtcttactaatactaaagatggcaacttcggggaatggtattctgaggtcgttacaaatggtgaaatgatagaatattatgaaatatcgggctgttacatccttcgtccatggacaatggctatttgggagataatgcaaaacttctttgatccagaaattaagaagatgaagattaaaacttgctatttcccgctctttgtgtccaataatgttctacagaaagagaaggatcacatagagggttttgctcctgaggttgcttgggtcacaagatcaggtgactcagatttggaggttccaattgccattcgtccaactagtgaaactgtcatgtatccgtatttttctaagtggatcaggggacaccgtgatttgcccttaaaacttaaccagtggtgcaatgttgttcgatgggagtttagtaatcctactccatttatcaggagccgtgagtttctttggcaagagggacacactgcccatgcaacaaaggaggaggcagataccgaggttcttgaaatccttgaattgtatagacgtttgtatgaggagtacttggctgtccctgttgtgaaagggaaaaagagtgagttagagaagtttgctggtgggctctatactactagtgttgaggcctttattccaaatactggtcggggtgtacaaggtgcaacttcacattgcttgggccagaattttgctaaaatgtttgagattaactttgaagatgaaaaaggagaaaaggctatggtctggcagaattcctgggcgtatagtaccagaacgattggggtgatggtgatggttcatggtgatgataaaggcctggtgttgccccctaaagttgcagcagtacaagttattgtgattcacgtgccttacaaagatgcagatgttaaggaaataatgaatgcatgttctgccactgttaagactttatgtgatttaggcattcgggccgaggctgaccttagagagaattattcacctggttggaagtattctcactgggaaatgaaaggtgttcccttgaggattgaaataggaccaaaggatctcgctaataaccaggtgcgtgctgttcgtcgtgacaatggagaaaaagctgatattccaatggcagatttggttgataaagtaaagggtatgctggataatatccagcaaaatatgtttgatgttgctaagcaaaaacgagatgcttgtattcaagttacaaaaacttgggatgaatttattgaagcgttaggtcaaaagaaattgatcttggctccatggtgtgatgaagaggaagtcgagaaggaggtgaaagcgaagacaaaaggggagacaggggctgctaaaacactttgttctccatttgaccagccagaactgcctgaaggcacattatgctttgcatcagggaaacctgcaaaaaaatggacctactggggacgaagctattaacattattcacgatttcattttcttgtttttacaataccatgtcaaatgtttgagtaatttttatgtagtttaaccatttgct

SEQ ID NO: 2349 - DNA, 1913 bp, Chenopodium quinoa
aagaaagtgtaagaagaatgtggggggctatctagtaaacccaaatacactaatcaaatataatcaagtcaacaacttttaatgtctgctgccggtttcgcttgcacctttattagcgcagcatcatcttcgctcacccgcccttgttatctcacttcctctcgcattctctccttcttctctttctctctcctctcgccgccattaccgccgcacaggtgctttaatcgtagtagaagattgtttgctatggctggtgattccaaggctaaaactgctgatcctaaggctaaaaatgttgggaagaagaagaaggaggtgaagaaagagactggattagggttaactaataagaaggatgagaattttggggagtggtattctgaggttgttgtgaattctgagatgattgagtattatgatatttctgggtgttacattctcaggccgtggactatggcgatttgggaggctatgcaagaattttttgatgcggaaatcaagaagatgaagataaagaattgctacttcccactatttgtctcacctggtgttttggagaaggaaaaagatcacatcgaaggttttgcccccgaggttgcatgggtaacaaagtctgggcaatctgacttggaggtgcctattgctattcgtccaaccagtgagactgttatgtacccttactattcaaagtggatcaggggacaccgtgacttacctctaagactgaatcagtggtgtaatgttgtccgttgggaattcagcaatccaactccttttatcaggagtcgtgaatttctctggcaagaaggccatacagcatttgctacacaggaagaggcagatgctgaggttcttgatatattggaactctaccggcgaatatatgaagagtttttggctgttccagtggtcaagggcaagaaaagtgaaatggagaagtttgcaggtggatattacacaacaagtgttgaggcatttataccaaacactggacgtggtgttcaaggtgcaacttcacattgtcttggtcaaaattttgcaaagatgtttgaaattacttatgaaaatgagaaaggagagaaggcaatggtctggcagaactcatgggcatacagtaccagaacgataggggtaatggtcatgacacatggtgatgacaaaggcttagttttgccacctaaagtagcagctgtccaagtcattgtggtacctgtacctttcaaagacgccgacacacaaggaattttcgatgcttgtgcttctactgtcaaaattctgagtgaagcaggcattcgggctgaatgtgatcttagggataactattctccaggctggaagtattcacactgggaaatgaaaggtgttcctttgaggcttgagattggaccaaaggatttggccaatagtcagactcgtgctgttcgacgtgacaattcggccaagaaggatataccaatggcagatttggttgatcaggtgaaagaattgctggatacaattcaacaaaacttgtttgatgttgcaaaggaaaagagagatgcatgtgttaaagaagttaggacatgggatgagtttgttgaagcattggcacagaagaaactgattttagctccttggtgtgatgaagaggaagttgagaaggatgtcaaagctcgaacaaaaggagagataggagctgctaagactttatgctcaccatttgatcagccagcgctagaagaaggcaccctttgctttgcttctggaaagccggccaagaaatggacatattggggcagaagctactagcactactatctttgttattctcctgttttttggccatctctcgtacttttgtctaattctccaaatactctatatattttttacacaggtgtttcatggtttcttattctaccataagcggt

SEQ ID NO: 2350 - DNA, 1693 bp, Vinca minor
aagggaaaaagaaagaagtgaaaaaagagactggtcttggtcttacttacaagaaagatgaaaattttggagaatggtactctgaggttgtcgttagtggtgaaatgattgagtactatgacatttctggctgttatattctacgaccatgggcaatgtccatttgggagatcatgcaaggcttctttgatgccgaaatcaagaaaatgaacatcaagaattgttatttccctctgtttgtgtcacctggtgtgctgcagaaggagaaggatcacatagaagggtttgctcctgaggttgcctgggttacgaaatcaggagaatcagatttagaagtgcccattgctattcggccaactagtgaaactgtcatgtatccttattattctaaatgggtaagaggacaccgtgacttgcctctgagactcaaccagtggtgcaatgttgttagatgggagttcagcaatcctactccatttataaggagtcgcgagtttctttggcaagaaggccatacagctttcgctacgaaagaggaggctgacatagaggtacttgatattctggaattgtatagacgcatatacgaagaattcctggctgttcccgtcactaagggaaagaaaagcgagcgcgaaaagtttgctggtggcctttatacaactactgttgaggcttttattccaaacactggccgcggtatacaaggtgcaacttcccactgcttgggacagaacttcgctaaaatgtttgaaataaactttgaagatgagaaaggagagaagcgtatggtttggcagaactcgtgggcttatactaccagaactattggcgtgatgataatgacccatggggatgataaaggtctagtgctgcctccaaaagttgcatctgtccaagttgttgtgattcctgttccttacaaggatgctgatactcaagggattctggatgcatgttctgccactgtaaaaaccttgaatgaatcaggttttcgtgctgaagcagacttgagggacaactattctccaggatggaagtattcaaattgggaaatgaagggtgtccctctaaggattgaaataggaccaagagaccttgctaataagcaggtacgtgctgttcgacgtgacaattcagctaaaattgacattccaatggataatttggtcgaacaagtgaaaaatctactggataccatccaacaaaatctgtatgatgtagcaaagcaaaagaaagaagcctgcattcaggttgtgaaaacctgggaagagtttatcgaagcactagcacaaaagaaattgattttagctccatggtgcgatgaagaggaagtggaggaagatgtcaaaaatcggacaaagggtgaagccggtgcagtcaaaaccctgtgttctccatttgagcagcctgaactgcctgaaggtactttgtgctttgctactggaaaaccagccaagaagtggacttactggggtcgaagttattaacgtttttgtttttcgccttttgtccagtttggtgttgcgagtgtcgaattttctaaccttgttttgacagagttttgtgttttgagtaccatagcaacaagatatatcagaatatatagtagaagctttcgattatctagaaacatcatcttttatatcagaagagagaatggaattatctctggatatttttgtgatctgca

SEQ ID NO: 2351 - DNA, 2109 bp, Orobanche aegyptiaca
taaaaatcgagaattccacgacctaaatctctgttatctctcgcttccccccctcacagtacgtggcggcggcggcacgacggcattgctgcgagagaacgcgattttctgattggtcgtgtattctgaatttgttatatttatcgccatggacgggaaagatgccaacagctccgattccaagggagagaagaaagaagtgaaagaagtgaaaaacgatggaaagaaggaagtgaaaaacgatggaaagaagaaggaagtaaaaaacgatggaaagaaagaagtgaaaaacgatggaaagaagaaagaagtgaaagaagtgaaaaaagatggaaagaagaaagaagtgaaaaaagaaactggactaggtctttcttataagaaagatgaaaactttggagaatggtactctgaggtcgttgttactggagagatgattgaatactatgacatatctggctgttacattctgcgaccatgggcaatgtcaatttgggaggtcatgcaaaccttctttgatgctgaaatcaagaaactgaaaattaagaactgctactttcccctgtttgtatcctctgatgtcctacaaaaggagaaggaccatattgaggggtttgctcctgaggttgcttgggtgacaaagtcgggagaatctgtgttggagaagcccattgcaattcgtccaactagtgaaactgtcatgtacccatatttttccaagtggattagggggcaccgagacttgcctttgagacttaaccagtggtgtaatgttgttagatgggaattcagcaatccgactccatttataaggagccgcgagtttctttggcaagaaggacatactgcttttgaaaccaaagaggaggcagatactgaggtgcttgaaattttggaactctacagacgcatatatgaagaatttttggctgttccagttattaagggcaaaaagagcgagcatgagaagtttgctggtggactttatacgactaccgtggaggcttttgttccaaacaccggacgtggtgtgcaaggtgcaacttcgcactgcctgggtcaaaattttgcaaaaatgtttgagattaattttgagaatcagaaaggtgaaagggctctggtttggcagaattcctgggcatatactaccagaacgataggggtgatgataatggttcatggtgatgataaaggcttggtgctgcctcctaaagttgcctctctacaagtaattgtaatccctgtgccttacaaggatgccaatactcaggggatctttgatgcatgtgcagcaaccgtcgagtctttgaccgaagcaggaatccttgccgaggctgattttagagaaaactattcacctggatggaaatattctaattgggaattgaaaggagttcctctcaggattgaaatagggcccaaggacttggccaataatcaggtccgtgctgtccgccgtgataattcagctaaaatcgatattcccatggctgatttggttgaaaaagtgaaagacatgcttaatgatatccaacaaagcatgtttgatgttgccaagcaaaaacgagatgcctgcatccaaatagtacatacctgggatgaatttgtggaagcacttggccaaaagaagatgattctggccccatggtgtgatgaggaggaagtcgagaaggatgtgaagcccgcacgaaaggagacatgggtgcagctaagtctctatgttctccatttgatcagcctgtcatcccagaaggtacgttgtgctttgcgtcgggaaagcctgccaaaaagtggacctactggggaaggagttactgatcattgttttcagttcattacttaaatctttactattttctgttgtcttgcttcaatagtggtaaggccacttgggtatagtgatatttaaaagttttgggaatatagcatacggttttgttttatggaatgctttttgcagaaggaaaaattgtcaggagcgtatttgtcttttaattcttgtattgatgacatatttagagtttgttcaacgatggagactattttttggttgctgtgtactctaattgcatgaatttattgtgttaactaattttagaccaataattg

SEQ ID NO: 2352 - DNA, 2021 bp, Brassica oleracea
tttaaaatcgagaataagggtagagatagatgaccctaacacgtggcgagatataagtgggtgtagttcagtgagaaagctcgctaaaagtgagtcaaaagggtttacaagttgtaaccgtttctctcaattcgctcgttgttgtttgcctccgccgtcttcagctcatcggcgatttgaaagaagaaagggttggaatggctggtccaagtgggaagaaagagaaggttgacaaggctggtccaagtggtggtggaaagaagaagaaggacgttaagaaggagacaggtcttggtctcagcgttaagaaagatgagaactttggggaatggtactctgaggtttgtaaacacgagatgattgagtactacgatatctctggatgttacatccttaggccatggtcaatggccatttgggagattatgcaaactttctttgatgcggaaatcaagaaaatgaaggtgaagaattgctacttccctctctttgtatctcctggtgtcctcgagaaggagaaggaccacatcgagggtttcgctccagaggttgcttgggttacaaaatcgggcaaatctgacttggaagtcccaatagccattcgtccaaccagtgagacagtgatgtacccttactacagcaagtggattaggggccaccgtgacttgcctttgaagctcaaccagtggtgcaatgttgttagatgggagttcagcaaccctaccccatttatccggagccgtgaattcctatggcaggaagggcacactgctttcgccacaaaagaagaagccgatgaagaggtccttcaaattttggagctttaccgtcgcatatatgaagagtatctcgcagtcccagttgtgaaaggtatgaagagtgaaaatgagaagtttgctgggggactttacactacaagtgtagaggctttcattccaaacacgggtcgtggtgtacaaggtgcaacctctcattgtttgggacaaaactttgcgaagatgtttgagatcaggtatgaggatgaggaaggaaagagagaaatggtgtggcagaattcttgggcctacagtaccaggacgattggagtaatgattatgactcatggagatgacaaaggcctgatacttcctcctaaagtcgcatctgtgcaagtcgttgtgatccctgtgccatacaaagatgctaatacccaaggaatctttgatgcttgtactgctactgtatccgccttgagtgaagctggtatccgtgctgaagaagatttaagggacaactactctcctggatggaagtattcaaactgggaaatgaagggtgtcccattgagaattgagattggaccccgagatcttgaaaatgatcaggtcagaacggtgagacgggacaacggagttaaggaggatatcccaagaggtagcttagtcgaacatgttaaggaactgcttgagaagattcagcaaaacatgtatgaagtggcaaggcaaaagagggaagcatgtgtgcaagaaattaggacttgggatgagtttatcagtgctctcaaccaaaagaaacttatcttagctccctggtgcgatgaagaggaagtggagagagatgtcaaggcacgtactaaaggtgaaactggagcagctaaaaccctgtgttctccatttgaacagccagaactccctgaaggcactctctgctttgcatctggaaagcctgcgaagaaatggacctattggggcaggagttactaagtgttcctcatgtttttgttcaatgtcttgtaaagactcaagtgctttgatttgatgatatttttgactcaaaagttatttcagtttttttcttaactggaactataaagtgatgttttgtttcaaaagaactgttagaaggagaaaaaatgagatcaccagtgaatttgagattgggtcttgtgggttactatggttctgaggttataccgttctagtgatcaggtcattagacccctgaatctagtcttcatgaatcgttttcattgcctaaattgg

SEQ ID NO: 2353 - DNA, 1851 bp, Brassica rapa
aaagtgagtcaaagggtttacaagctgtaaccgtttccctctcgattcgctcgttattgttcgcctccgccttcttcagctcatcggcgatttgaaagaagaaagggttgaaatggctggtgcaagtgggaagaaagagaaggttgacaaggctggtccaagtggtggtggaaagaagaagaaggacgttaagaaggagacaggtcttggtctcagcgttaagaaagatgagaactttggggaatggtactctgaggtttgtaaacacgagatgattgagtactacgatatctctggatgttacatccttaggccatggtcaatggctatttgggagattatgcaaactttctttgatgcggaaatcaagaaaatgaaggtcaagaattgctacttccctctctttgtatcccctggtgtcctcgagaaggagaaggaccacatcgagggtttcgctccagaggttgcttgggttacaaaatcgggcaaatctgacttggaagtcccaatagccattcgtccaaccagtgagacagtgatgtacccttactacagcaagtggataaggggccaccgtgacttgcctttgaagcttaaccagtggtgcaatgttgttagatgggagttcagcaaccctaccccttttatccggagccgtgaatttctgtggcaggaagggcacactgctttcgccaccaaagaagaagctgatgaagaggtccttcaaattttggagctttaccgtcgcatatatgaagagtatctcgcagtcccagttgtgaaaggtatgaagagtgaaaatgagaagtttgctgggggactttacactacaagtgtagaggctttcattccaaacactggtcgtggtgttcaaggtgcaacctctcattgtttgggacaaaactttgcgaagatgtttgagatcaggtatgaggatgaggaaggaaagagagaaatggtgtggcagaattcttgggcctacagtaccaggacgattggagtaatgattatgactcacggagatgacaaaggcctgatacttcctcctaaagtcgcatctgtgcaagtcgttgtgatccctgtgccatacaaagatgctaatacccaaggaatctttgatgcttgtactgctactgtatccgccttgagtgaagctggtatccgtgctgaagaagatttaagggacaactactctcctggatggaagtattcaaactgggaaatgaagggtgttccattgagaattgagattggacccagagatctggaaaatgatcaggtcagaactgtgagacgggacaacggagttaaggaagatatcccaagaggtagcttagtggaacatgttaaggaactgcttgagaagatccagcaaaacatgtatgaagtggcgaagcaaaagagggaagcatgtgtgcaagaaattaggacttgggatgagtttatcagtgctctcaacctaaagaaacttatcttagctccctggtgcgatgaagaggaagtggagagagatgtcaaggcgcgtactaaaggtgaaactggagcagctaaaaccttgtgttctccatttgaacagccagaactccctgaaggcactctctgctttgcatctggaaagcctgcgaagaaatggacctattggggcaggagttactaagtgttcaatttttcttgtaaagactcatgttcactgtgctttgatttgctgatattttttactccaagttatttcagttttttttttctcaactgtttcattgaattaagaactataaagtgatcttttgtttcaaaagaactgttagaaaaaggagaaaaatatgagatcaccagttgaggttgagaaaccag

SEQ ID NO: 2354 - DNA, 1871 bp, Brassica napus
aaccgtttctctcaattcgctcgttgttgtttgcctccgccgtcttcagctcatcggcgatttgaaagaagaaagggttggaatggctggtccaagtgggaagaaagagaaggttgacaaggctggtcccagtggcggcggcaagaagaagaaggacgttaagaaggagacaggtctcggcctcagcgttaagaaagatgagaactttggggaatggtactctgaggtttgtaaacacgagatgattgagtactacgatatctctggatgttacatccttaggccatggtcaatggccatttgggagattatgcaaactttctttgatgcggaaatcaagaaaatgaaggtgaagaattgctacttccctctctttgtatctcctggtgtcctcgagaaggagaaggaccacatcgagggtttcgctccagaggttgcttgggttacaaaatcgggcaaatctgacttggaagtccccattgcaattcgtccaaccagtgagacagtgatgtacccttactacagcaagtggattaggggccaccgtgacttgcctttgaagctcaaccagtggtgcaatgttgttagatgggagttcagcaaccctaccccatttatccggagccgtgaattcctatggcaggaagggcacactgctttcgccacaaaagaagaagccgatgaagaggtccttcaaattttggagctttaccgtcgcatatatgaagagtatctcgcagtcccagttgtgaaaggtatgaagagtgaaaatgagaagtttgctgggggactttacactacaagtgtagaggctttcattccaaacacgggtcgtggtgtacaaggtgcaacctctcattgtttgggacaaaactttgcgaagatgtttgagatcaggtatgaggatgaggaaggaaagagagaaatggtgtggcagaattcttgggcctacagtaccaggacgattggagtaatgattatgactcacggagatgacaaaggcctgatacttcctcctaaagtcgcatctgtgcaagtcgttgtgatccctgtgccatacaaagatgctaatacacaaggaatctttgatgcttgtactgctactgtatccgccttgagtgaagctggtatccgtgctgaagaagatttaagggacaactactctcctggatggaagtattcaaactgggaaatgaagggtgtcccattgagaattgagattggaccccgagatcttgaaaatgatcaggtcagaacggtgagacgggacaacggagttaaggaggatatcccaagaggtagcttagtcgaacatgttaaggaactgcttgagaagattcagcaaaacatgtatgaagtggcaaggcaaaagagggaagcatgtgtgcaagaaattaggacttgggatgagtttatcagtgcactcaaccaaaagaaacttatcttagctccctggtgcgacgaagaggaagtggagagagatgtcaaggcacgcactaaaggtgaaactggagcagctaaaactctctgttctccatttgaacagccagaactccctgaaggcactctctgctttgcatctggaaagcctgcgaagaaatggacctattggggcaggagttactaagtgttcctcatgtttttgttcaatgtcttgtaaagactcaagtgctttgatttgatgatatttttgactcaaaagttatttcagtttttttcttaactggaactataaagtgatgttttgtttcaaaagtaactgttagaaggagaaaaaatgagatcaccagtgaatttgagattgggtcttgtgggttactatggttctgaggttataccgttatagtgatcaggtcattagaaccctgaat

SEQ ID NO: 2355 - DNA, 1653 bp, Brassica napus
atcggcgatttgaaagaagaaagggttgaaatggctggtccaagtgggaagaaagagaaggttgacaaggcaggtccaagtggtggtggaaagaagaagaaggacgttaagaaggagacaggtcttggtctcagcgttaagaaagatgagaactttggggaatggtactctgaggtttgtaaacacgagatgattgagtactacgatatctctggatgttacatccttaggccatggtcaatggctatttgggagattatgcaaactttctttgatgcggaaatcaagaaaatgaaggtgaagaattgctacttccctctctttgtatctcctggtgtcctcgagaaggagaaggaccacatcgagggtttcgctccagaggttgcttgggttacaaaatcgggcaaatctgacttggaagtcccaatagccattcgtccaaccagtgagacagtgatgtacccttactacagcaagtggataagagggcaccgtgacttgcctttaaagcttaaccagtggtgcaatgttgttagatgggagttcagcaaccctaccccttttatccggagccgagaatttctgtggcaggaagggcacactgctttcgccaccaaagaagaagcagatgaagaggtccttcaaattttggagctttaccgtcgcatatatgaagagtatcttgcagtcccagttgtgaaaggtatgaagagtgaaaatgagaagtttgctgggggactttacactacaagtgtagaggctttcattccaaacactggtcgtggtgttcaaggtgccacctctcattgtttgggacaaaactttgcgaagatgtttgagatcacgtatgaggatgaggaaggaaagagagaaatggtgtggcagaattcttgggcctacagtaccaggacgattggagtaatgattatgactcatggagatgacaaaggcctgatacttcctcctaaagtcgcatctgtgcaagtcgttgtgatccctgtgccatacaaagatgctaatacccaaggaatctttgatgcttgtactgctactgtatccgccttgagtgaagctggtatccgtgctgaagaagatataagggacaactactctcctggatggaagtattcaaactgggaaatgaagggtgttccattgagaattgagattggacccagagatctggaaaatgatcaggtcagaactgtgagacgggacaacggagttaaggaagatatcccaagaggtagcttagtggaacatgttaaggaactgcttgagaagatccagcaaaacatgtatgaagtggcgaagcaaaagagggaagcatgtgtgcaagaaattaggacttgggatgagtttatcagtgctctcaaccaaaagaaactcatcttagctccctggtgcgatgaagaggaagtggagagagatgtcaaggcgcgtactaaaggtgaaactggagcagctaaaaccctgtgttctccatttgaacagccagaactccctgaaggcactctctgctttgcatctggaaagcctgcgaagaaatggacctattggggcaggagttactaagtgttcaatttgtcttgtaaagactcatgttcactgtgctttgatttgatgatatttttacttttctagttttttctt

SEQ ID NO: 2356 - DNA, 1897 bp, Actinidia deliciosa
tctctctaggtcaaaagcggcacagcattcttcatctttgtttcctccaaggcaaagcccacaaacacagcccgacgctcctctccgtctctttgtgtatgcagcgtacctagcttcggagagccagagccaggattcgccagattggtggcattatggctgggggtgaggccaagaaagctagtacaaatgcaaacaatagaaaaaagaaggaagtgaaaaaagagactggtctaggtctctcttctaagaaggatgaaaactttggggagtggtattctgagatcgttgtcagtggcgagcttattgaatattatgacatatctggctgttatatcttgcgcccatggacaatgtctatttgggagatcatgcaagccttctttgatgcagaaattaagaagatgaagatcaagaactgctatttccctctttttgtatccccaggtgttttacaaaaggagaaggatcacatagagggttttgcacctgaggttgcttgggtcacaaaatcaggtcaatctgatttggatgtgcctattgcaattcggcctacaagtgaaactgtcatgtatccctacttttctaagtggataagaggacaccgtgacttacctttgaaacttaaccaatggtgcaatgttgttcgatgggagttcagcaatccaactccatttatcaggagtcgtgagtttctttggcaggaggggcatacagcatttgctgcaaaggaggaggcagataaagaggttcttgaaatattggaactgtatagacgaatatatgaagactatttggctattcctgttataaagggcaagaaaagcgaacatgagaagtttgctggtggactttatacgactagcgtcgaggcttttattccacacactggtcgtggcattcaaggtgcaacgtcacattgtttgggtcaaaattttgcaaaaatgtttgagatagacttcgaaaatgataaaggtgaaaaggcaatggtctggcaaaattcatgggcatacagtactagaacgattggagtgatggtgatggttcatggggatgataaaggcttggtgctgccaccaaaaatagcagctgtccaagttattgtgattcccgttccttacaaagatgctgatactaaagggatctttgatgcctgtgatgatactgtgaaagccttgaatgaatcaggtttccgtgctgaagcagacttcagggataactattcacccggttggaagtattcgcattgggaaatgaaaggtgttcctcttaggattgaaataggaccaaaagatcttgccaatgatcaagtacgtgccgttcgccgtgacaattcagctaaacgtgatattccgagggcccgtttggttgaacaagtaaaagatatgctcgatgatattcagcaaagtctgtttgatgctgcaaaacaaaaccgagatgcctgtgttcaggttgcaagaacgtgggatgaattcatggaagcattgaaccaaaaaaaaatgatcttagctccttggtgtgacgaagaggaggtcgagaaagacgtaaaagcacgcacaaaaggcgagataggagcagctaagacactttgttctccatttgaccagcctgcactggatgaaggtactttgtgctttgcctccgggaaacctgccaagaagtggacctactggggacgaagttattgatattatgaattctgcttttctaagaagcttctctggtggttggttagctcagctggatgaaccaatatttctcttccaattatggtgttactgatttggacgctcgtgtttttgtacttgagaattgtcttgttaaatctacaacaaatcccaaatctttttgtttcctcagcatcgtagtgaatggggagcaaagtgacatgtatttt

SEQ ID NO: 2357 - DNA, 1954 bp, Olea europaea
cgtaataatacaggcagcagcggcgtcataacggaagatttacacttacaggttacacgaagaagagcggctatagcctctccttcttcactgcgcgcgcatttgactgcaattgcggctgaaagaagaagcttttccgattgatttgtcctgtgctgggagattgtatagattaatcacctcatggctggtaaagataaagaggccaatagttccaacagtaagggaaaaaagaaggaagtgaagaaagagactggtcttggtctctctgtcaagaaagatgacaactttggagagtggtattctgaggttgtcgttaatggtgaaatgattgagtactatgacatatctggttgttacattttgcggccatgggcgatgtctatttgggagatcatgcaaaccttctttgatgctgaaattaagaaaatgaaaataaaaactgctacttccccttttgtatcccctggtgttctgcaaaaggagaaggatcatatagaggggtttgctcctgaggttgcatgggttacaaaatcaggagaatccgagctggaagtgcccattgccattcgaccaactagtgaaactgttatgtatccttatttttccaagtggattaggggacaccgtgatttgcctctgagacttaaccaatggtgcaatgttgttcgatgggagtttagcaatcctactccatttatcaggagtagagaattcctttggcaggaagggcatactgcgtttgcaacaaaggaggaggcagataccgaggtccttgagattctggaattgtatagacgtatttatgaagaattcttggctgttcccgttattaagggcaagaaaagtgagcatgagaagtttgctggtggactttacaccaccactgttgaggcttttattccgaacactgggcgtgctatacaaggtgcaacttcacactgtttgggtcaaaattttgcaaaaatgtttgagataaattttgaaaatgataaaggagaaaaggctatggtctggcagaattcttgggcttatactacaagaacaataggggtaatgattatggttcatggggatgataaaggcttggtgctgcctcctaagatagcttctgtccaagtaatcgtaatacccgtaccctataaggatgccaacactcaaggaatctttgatgcatgtgcagccaccgtaaagaccttggatgaatctggcatccgtgccgaggtggattctcgagataactattcacctggctggaagtattcacattgggaaatgaaaggcgttcctcttaggattgaaattggccccaaggacttggctaataatcaggtgcgtgttgtcagacgtgataattcggccaaaattgatattcccatggccagtttggtggaacaagtgaacgacttgctcaacgacatccagaaaaatctatttgaagttgcaaaacaaaaaagagatgcctgcattcacactgtaaatacatgggaagaatttgcagaagcactgaaccaaaagaaaatgattctggctccatggtgcgatgaggaggaagtggagaaggatgtaaaagcacggacaaaaggagaattgggtgcagccaagtccctatgttctccatttgaccagccagaactcccagaaggtaagttgtgctttgcctcaggaaaacctgccagaaagtggacctactggggccggagttattgaagactggttttatttatgtatcaccaccccgtaggccgtaccttaaatagtgctataattgataaccttggggttaaatgatttgaaacgcccttctaaaacagatagtgtttaagcttcacagaaaatttaccatatacttgatggaattgcggttttacttttttcttcacgttttgccttgataaaaaatgattgtaatggctatgaatgctgctttggtgcattatagtgatatttctca

SEQ ID NO: 2358 - DNA, 1786 bp, Chenopodium quinoa
cttcttctctttctctctcctctcgccgccattaccgccgcacaggtgctttaatcgtagtagaagattgtttgctatggctggtgattccaaggctaaaactgctgatcctaaggccaaaaatgctgggaagaagaagaaggaggtgaaaaaggagactggattagggttaactaataaaaaggatgagaattttggggagtggtattctgaggttgttgtgaattctgagatgattgagtattatgatatttctgggtgttacattctgaggccgtggactatggcgatttgggaggctatgcaagaattttttgatgcggaaatcaagaagatgaagataaagaattgctacttcccactatttgtctcacctggtgttttggagaaggaaaaagatcacattgaaggttttgcccccgaggttgcatgggtaacaaagtctgggcaatctgacttggaggtgcctattgctattcgtccaaccagtgagactgttatgtacccttattattcaaagtggatcaggggacaccgtgacttacctctaagactgaatcagtggtgtaacgttgtccgttgggaattcagcaatccaactccttttatcaggagtcgtgaatttctctggcaagaaggccatacagcatttgcaacacaggaagaggcagatgctgaggttcttgatatattggaactctaccgacgaatatatgaagagtttttggctgttccagtggtcaagggcaagaaaagtgaaatggagaagtttgcaggtggatattacacaacaagtgttgaggcatttatacctaacactggacgtggtgttcaaggtgcaacttcacattgtcttggtcaaaattttgcaaagatgtttgaaattacttatgaaaatgagaaaggagagaaggcaatggtctggcagaactcatgggcatacagtaccagaacgataggggtaatggtcatgacacatggtgatgataaaggcttagttttgccacctaaagtagcagctgtccaagtcattgtggtacctgtacctttcaaagacgccgacacgcaaggaattttcgatgcttgtgcttctactgtcaaaattctgagtgaagcaggcattcgggctgagtgtgatcttagggataactattctccaggctggaagtattcacactgggaaatgaaaggtgttcctttgaggcttgagattggaccaaaggatttggccaacagtcagactcgtgctgttcgacgtgacaattcagccaagaaggatataccaatggcagatttggtcgatcaggtgaaagaattgctggatacaattcaacaaaatttgtttgatgttgcaaaggaaaagagagatgcatgtgttaaagaagttaggacatgggatgagtttgttgaagcgttggcacagaagaaactgattttagctccttggtgtgatgaagaggaagttgagaaggatgtcaaagctcgaacaaaaggagagataggagctgctaagactttatgctcaccatttgatcagccagcgctggaagaaggtaccctttgctttgcttctggaaagcctgccaagaaatggtcatattggggcagaagctactagcactactatctttgttattctcctgttttttggccatctctcgtacttttgtctatttctccaaatactctattttttacacaggtgtttcatggtttcttattctaccataagcggtagttcgttgttccacacttcgtataacatgtcaaatctcacaatgaaaca

SEQ ID NO: 2359 - DNA, 1730 bp, Flaveria ramosissima
ttcaatcgacagctttcaatcgattccccttcaactccgaactgcttcgccgccggcgttgaccggagaccaccgcaaaagctcggacggcggagggttactgtttgttcttccggtgctgaacttaaagcatttctgcaattcactgtaatttgactgaaagctgaagaaatggctagtggaaagggagataaggctgccaaggccgataaatctactgctgttgccaaatcgagtaagggaaggaagaaggagactggtctaggtcttactaatacgaaagatggcaacttcggggaatggtattctgaggtcgttacaaatggtgaaatgatagaatattatgaaatatctggctgttacatccttcggccatggacaatggctatttgggagataatgcaaaacttctttgatccagaaattaagaagatgaagattaaaacttgctatttcccactctttgtgtcgaataatgttctacagaaagagaaggatcacatagagggttttgctcccgaggttgcttgggtcacaagatcaggtgactctgatttggaggttcctattgccattcgtccaactagtgaaactgtcatgtatccatatttttctaagtggattaggggacaccgtgatttgcccttaaaacttaatcagtggtgcaatgttgttcgatgggagttcagtaatcctaccccatttatcaggagccgtgagtttctttggcaagagggacacactgcccatgcaacaaaggaagaggcagataccgaggttcttgaaatccttgaattgtatagacgcttgtatgaggagtacttggctgtccctgttgtgaaagggaaaaagagtgagttagaaaagtttgctggtgggctctatactactagtgttgaggcctttattccaaatactggtcggggtgtacaaggtgcaacttcacattgcttgggccagaattttgctaaaatgtttgagattaactttgaagatgaaaagggagagaaggctatggtctggcagaattcttgggcgtatagtaccagaacgattggggtgatggtgatggttcatggtgatgataaaggtctggtgttgccccctaaagttgcagcagtgcaagttattgtgattcatgtgccttacaaagatgcagatgttaaggaaataatgaatgcatgctctgccactgttaagagtttatgtgatttaggcattcgggctgaggcagaccttagagagaattattcacctggttggaagtattctcactgggaaatgaaaggtgttcccctgaggattgaaataggaccaaaggatctcgctaataaccaggtgcgtgctgttcgtcgtgacaatggagaaaaagttgatattccaatggctgatttggccgacaaagtaaagggtatgctggataatatccagcaaaacatgtttgatgttgccaagcaaaaacgagatgcttgtattcaagttacaaaaacttgggatgaatttattgaagcattaggtcaaaagaaattgatcttggctccatggtgtgatgaagaggaagtcgagaaggaggtgaaagcaaagacaaaaggggagacaggggctgctaaaacactttgttctccatttgaccagccagaactgcctgaaggtacattatgctttgcatcagggaaacctgcaaaaaaatggacctactggggaagaagctattaacattattcacgatt

SEQ ID NO: 2360 - DNA, 1956 bp, Mimulus guttatus
agagaacgaaaggattcaacgcctaaaacctctttcattatctatcgcttcctctcacagtgcgttacggcggcggcggcgcatcgacgatttctgagaaaggaagtcgtattctgatactgttcgtcaccgagtgttgaagacttatagccatggccagtaaaggtgccaacaaccctgctgccaaggggaagaagaagaaggaagtgaaaaaggagaccggtctgggtctctcctataagaaggatgagaacttcggagaatggtactctgaggttgttgttaatggggaaatgattgaatactatgacatatctggctgttacattctgcgaccatgggcaatgtcaatttgggaggtcatgcaaaccttctttgatgctgaaatcaagaaaatgaaaataaaaaactgctacttcccactgtttgtatcctctagcgtcctacaaaaggagaaggatcatattgaggggtttgcacctgaggttgcatgggttacaaaatcgggagactcagagctggagatgcccattgcgatccgtccaactagtgagacagttatgtatccatacttttccaagtggattagggggcaccgcgacttgcctttgagacttaaccagtggtgtaatgtcgttagatgggaattcagcaatcccactccattcatcaggagtcgtgagtttctttggcaggaaggacatactgcctttgcaaccaaggaggaggcagatactgaggtgctagatgttttggaactctatagacgcatatatgaagaattcttggctgttccggttattaagggcaaaaagagtgagcacgagaaatttgctggtggactttatacaactaccgtcgaggcttttgtcccaaacactggtcgcggtgtccaaggtgcaacttcgcactgtctgggtcaaaacttcgcaaaaatgtttgaaattaatttcgagaatgagaaaggagaaaagtctatggtctggcagaattcctgggcatataccaccagaacgataggagtgatgataatggttcacggtgatgacaagggtttagtgctgcctcctaaagtagcatcactccaagtagtcgtaatcccagttccctataaagatgcaaacactcaggggattttcgatgcatgtgccgacgttataaaatcattggaagaggcaggaattcgtgccgaggctgattatagagataattattcacctggatggaagtattcccattgggagatgaaaggtgttcctcttaggatcgaaataggacccaaagacttagcaaataatcaggttcgtgtggtgcgacgtgacaattcagctaaaagtgatattccgatggctgatttggttaaaggagtaacagacatgctcgataacatccagcagagtctctttgatgctgccactcaaaaacgagacgcatgcatccatactgtgcatacatgggaagagtttgcagaggcacttggtcaaaagaagatgattctcgccccttggtgtgacgaggaggaagtggagaaggatgtgaaaacccgaaccaagggagaaatgggtgcagctaagtcactgtgtactccgttcgatcagcctgcactcccagaaggtacattgtgcttcgcctcgggaaagcctgctaaaaagtggacctactggggaaggagttactagtcatatttgttttctaatttatactttcaaatcttaccattgtgttttgggtttattgatttttggacaccttggtatattgcatgtttttgctgttatagattttgtctgaaacttaatcttcgttcactccttggattgatttcttatatagagattgatttttcatatgttgggattttttttttaatttttattattactattattattattattaattttttaatgaagtttaagtttgttatcaaatacgatcttaaataatagtttgcaa

SEQ ID NO: 2361 - DNA, 1959 bp, Allium cepa
ggggaggtcaaccctcattccgcccgcttacgtatacagggtttatgctagcccctctagtctcctcctttgatatcagatccgccgcacttccctttctagtatcattcgttgttttcttcttctgccgccgctccacaatcaaaaattttcaattagtttgcaaaagagcgagatggcttcaaagaatgcaaaaaagaggaagtgaagaaggagactggtcttggtttgacatacaagaaggatgagaattttggtgaatggtattcagaggtcgtggttaatggtgaaatgattgagtattacgacatctctggctgctatattcttaggccatggacaatgtcaatttgggaaaccatgcaagagttctttgatgctgagatcaagaagttgaaggtgaagaattgttatttccctctgtttgttacggaaactgttctgcaaaaagagaaggatcatatagagggttttgctccagaggttgcatgggttacaaaatcagggcagagtgaaatggaaatcccaattgcaattcgtcccacgagtgaaacagttatgtatccatatttttcaaagtggataaggggacacagggagttaccgctaaagcttaaccaatggtgcaatgttgtaagatgggaattcagcaatcctactcctttcataaggagccgggaatttctttggcaagaaggacacacagcttttgctactaaagaagaagctgataaagaggttcttgatatactggagctataccgaaggatatatgaagagtatttagccattccagttgtgaagggaaagaaaagtgaactagaaaaatttgctggtgggctttacacaacaagcgttgaggcatttataccaaacacgggacgtggaatacaaggtgccacctcacattgtcttggccaaaattttgcaaagatgtttcatatcaatttcgagaacgagaagggtgaaaaagctatggtgtggcagaattcctgggcatatagcacccgaactattggagtgatggtgatggtccatggagacaataaaggcttggtgctacctccaaaggtagcatcagtacaagttatcgtaatccctgtaccatataaagatgccaatacacaagcaatatttgatgcttgcaaatcaacagtcgcaacgttaagtattgctggttttagggctgaagaagatttaagagataattactcacccggctggaaatactcaaactgggaaatgaaaggcgttcccttgagaatagaaattggtccaaaggatttagccaataatcaggtacgagttgttcgtcgtgataatggcaataagcaggatatacctatggaacacttagcggagaaagtaaaagaaattctgattgatattcaacaaagtctgtttaatgcagccaaggaaaaaagggatgcatgtgtaaagatcattagtacctgggatgaatttgtgactgcactcaatgataaaaaactgattttggctccttggtgcgatgaagaggaagtggagaaggatgtgaaagcacggactaaaggtgatcttggagcagcaaagaccttatgcactccatttgagcagcccaggctccctgaaggaaccaaatgctttgcttccggaaagcctgcaacgaagtggacttactggggtcgtagctattgagtgatataccccatatcttcagtgctttgaagttgtttttcgtggttgccaaccattttgattttcagttgattgcaattgagatagacttcttatttatattaaacgacaattcttgaaaaaagatatgcttcaaaaaaaaattatcacatcatattcgaagttttcttctgttgaactgttctgaatttgttgactgaatgttgaaactttgtcaacgtatgtgtagaggaagaaggggttgtattattttctaatgtcaatttcaaaagaaaagtaaga

SEQ ID NO: 2362 - DNA, 1826 bp, Helianthus annuus
tctcatttcgcttcgattccgaactgtttcaccgccggcgttgaccggaaaccacaacaaaacttcaccggcggaggattccgtttagttttctcgcatctaaactcaccgtactccttcagttcactagaatttagttgaaagctgaaaatatggctggaaaaggagataagcctgctaaagcagataaatctgctgctgttgcgaaatctagcaagggaaggaagaaggagactggtctaggtcttactaataccaaagatggaaactttggggaatggtattctgaggttgttacaaacggtgaaatgatcgaatattatgaaatatccggatgttacatcctccgcccatggacaatggccatttgggagataatgcaaaacttctttgatccagaaattaagaagatgaacattaaaacatgctatttccccctttttgtgtccaataatgttctacaaaaagagaaggatcacatagagggttttgctcccgaggttgcgtgggtcacaagatccggtgactctgatttggaggttcctattgccattcgcccaactagtgaaactgtcatgtatccctatttttctaagtggatcaggggacaccgtgatttgcccttaagacttaatcagtggtgcaatgttgttcgatgggagttcagtaatcctactccatttatcaggagtcgtgagtttctttggcaagaaggacacactgcttttgcaacaaaagaggaggcagacactgaggttctggaaatccttgaattgtatagacgtctgtatgaggaatacttggctgtccctgttgtgaaagggagaaagagtgagttggagaagtttgctggcgggctctatactactagtgttgaggcctttattccaaatactggtcgaggtgtacaaggtgcaacctcacattgcttgggccagaatttcgctaaaatgttcgagattaacttcgaagatgaaaaaggagaaaaggctatggtctggcagaactcctgggcatatagtaccagaacgattggggtgatggtgatggttcatggtgatgataaaggcctggtgttgccccctaaagttgcagcagtacaagttatcgtcgtgcacgtgccttacaaagatgcagatgttaaggaaataataaacgcatgttctgccactgtgaagactttatgtgatgctggtatccgtgctgaagcagaccttagagagaattactcgcctggttggaagtattctcattgggaaatgaaaggtgttcccctgaggattgaaataggtccaaaggaccttgctaataatcaggcgcgtgctgttcgtcgtgacaatggtgcaaaagtagacattccgatggcagatttggtcgattcagtaaagggaatgctggatactatccagcaaaacatgtttgatgttgctaaggaaaaacgagatgcttgtattcaagttacaaaaacatgggatgaatttattgaagcgttaggtcaaaagaaattgatcttggctccatggtgtgatgaagaggaagttgagaaggaggtgaaagcaaagacgaaaggggagacgggtgctgctaagacactttgttctccattggagcagccagaactgcctgaaggcacattatgctttgcatcagggaaaccagcaaagaaatggacgtactggggacgaagttattagaaatttgattctcgtgttttctgttactatactgaactgtgaggattttttttaaagtttaaccatttcctacgattgtgtttcgaaatcaaaacaatggttcacaatgtttaatgtttgactttgatattg

SEQ ID NO: 2363 - DNA, 1901 bp, Lotus japonicus
cgaaaaccctagtctctcgcagcgccacaatcgctctcgcgcgttccactcaccttcgccggcttctctgcaaccggatctcgtgttcatcgttcacaatggcggggactgaagccaaaaccaagaaatctgattcgaaaccccaaaagcagcagcagcaacaaggtggtgggaagaagaaggaggtgaagaaagagactgggttagggcttacgcataagaaggctgaaaacttcggagaatggtattccgaggttgttgttaattcggaaatgattgagtattatgatatttctggttgctatattctgaggccttggtccatggccatatgggagataatgcaagctttttttgatccagaaattaagaaaatgaagatcaagaactgctacttccctttgtttgtgtctcctggagttttgcaaaaggagaaggaccatgttgagggatttgctccagaggttgcttgggtgactaagtctggggaatctgagttagaaattcctattgctattcgcccaactagtgaaaccgttatgtacccctactactccaagtggattagggggcatcgtgacttgccactgaaactcaatcagtggtgcaatgttgttagatgggagttcagcaaccccacaccattcatcaggagtcgtgagtttctttggcaggaaggacacactgcttttgcaaccaaggaggaagcagatgcagaggttcttgagatattagaattatataggcgtatatatgaagagtatttggcagttcctgtcataaagggtaagaaaagtgcgcttgagaagtttgctggtggactttacactaccagtgttgaggcatttattccaaacacaggtcgtggtgtacaaggagcaacttctcattgtctgggccaaaattttgctgaaatgtttgagattaactttgaaaatgagaagggagaaaaagcaatggcctggcaaaactcatgggcctatagtactcgaacgattggggtgatggttatggttcatggtgatgacaagggattagtgcttcctcctaaagtagcatcagttcaagtcatagtgattcccgtgcctttcaaagatgctaatactcaaggaatctatgatgcttgtgctgcaactgtgaatacattatgcgaagcaggtattcgtgctgagtcagatactagagataactattctcccggatggaagtattctcactgggaaatgaaaggcgttcctctaagaattgaaattgggccaaaggatttggcaaataagcaggttcgtgctgttcgtcgtgataatggagcaaagatagacattgctaatgcagatttggttgaggaattaaagaagttgctggataatattcagcagaatctttttgatgttgccaaacaaaaacgagatgaatgtattcagatcatacatacatgggatgagtttatacaagctttgaatgaaaaaaatatgatcttagcaccttggtgtgatgaggaggaggtggaagcagatgtcaaagcaaggacaaggggcgagacgggagcagctaagaccctttgtagtccctttgatcagccagaactcccagaaggcaccaaatgctttgcatcaggaaagcctgcgacaaagtggtcatactggggcagaagttactagatcttggttgtggtattttctggagctagtttgatatttaaccttgtctgatttgtgggttacataaatattagctttcttttgcttgagtacatttttgttttactttgattttatacgttacaatagaattcaggtttgaagatgaatattacatctgttgccatctaattatcgttgggagcatattggttcaatacttgcattgagaacagtggttgcgtatgaacattgaatttattc

SEQ ID NO: 2364 - DNA, 1820 bp, Cannabis sativa
atgttggcttttacaggaggaaagaaaaaggaagttaagaaggagactggacttggacttacccacaagaaggatgagaactttggagagtggtactctgaggtagttgtcaatggagaaatgatcgagtactatgacatatcggggtgttatattctcaggccttggactatggcaatatgggagatcatgcaggcatttttcgatggtgaaataaagaaaatgaaaataaagaactgctatttcccacttttcgtatctcctactgtcttgcaaaaggagaaggatcatattgagggttttgcacctgaggttgcgtgggtgactaaatctggagagtctgatttggaggtgccaattgcaattcgtccaactagtgagacggtaatgtatccctattattcaaaatggataaggggacaccgagaccttcctttgagacttaaccagtggtgtaatgttgttcgatgggagttcagcaatcccacgcctttcatcaggagtcgggagtttctttggcaagaagggcatactgcttttgcaacaaaacccgaagcagatgaagaggttcttgagattttggagttgtacagacgcatctacgaagaattcttggctattcctgttgtgaagggcaagaagagtgagatggagaaattcgccggtggactttacaccacaagtgttgaggctttcgttccaaacactggtcgtggtgtacaaggtgcaacttcacattgccttggtcaaaatttcgccaaaatgtttgagattaactttgaaaatgagaagggagagaaggctatggtctggcagaactcgtgggcctatagtactcgaacgattggagtaatggtgatggttcatggggacgacaaaggtttggtgttgccaccgaaagttgcatccgtccaagttattgtagttcccgtgccatataaagatgccgatactcaagggatttatgatgcttgtactgctactgtgaatagcttgaacgaagttggtattcgtgctgaagccgacttccgagacaattactctcctggctggaagtactctcattgggaaatgaagggtgttcctcttaggattgaaataggaccaaaagacttggcaaacagtcaggtacgctgtgtccgccgtgacaatgcatcgaaaaaagatattccaatggcaaacttggtagagggagtaaaagaacttctggacaacattcaacagagcctattcgatgctgcaaaagtaaaacgagatgcgtgtgttcaaattgttaagacttgggaagagtttgtcgatgcactcgccaaaaggaaattgatcttagctccttggtgtgacgaagaggaagtagaaaaggatgtgaaaacaaagacaaagggtgatatgggagcagccaaaactttatgctcaccgttcgaacagccagagctcccagaaggtactttgtgcttcgcctcggggaagccggcgaagaagtggacctattggggaaggagttactaagattatagcatttgtttggtatttttgaatgtagctgagcttgttgtattggagtgtgatttgttataggaaaagaggtacttattgacctgaaaaaattgaacaaatcccactactttcaattttcaatctaatttataatttgcttacatttgttcattttacaaaattacataaaagaatgttttgaaggatttgatttgattttcttttattatatagttggatttgtctttccctatgcttagcatatggatatgcatgccttaagtaaattaataactacattacttgcttaatggattgacatgggt

SEQ ID NO: 2365 - DNA, 1710 bp, Catharanthus roseus
gagactggtcttggtctcacccacaagaaggatgaaaattttggagaatggtactctgaggttgttgttagtggtgaaatgattgagtactatgacatttctggctgttatattctacgaccatgggcaatgtctatatgggagatcatgcaagccttctttgattctgagattaagaaaatgaacatcaagaactgttattttcctctgtttgtatcccctgctgtgctgcaaaaggagaaggatcacatagaagggtttgcacctgaggttgcctgggttaccaaatcaggagaatcagatctagaagtgcctattgctattcggccaactagtgaaacggtcatgtatccttattactctaaatggataagaggacaccgtgacttgcctctgagactgaaccagtggtgcaatgttgttagatgggagttcagccatcctactccatttataaggagtcgcgagtttctttggcaagaaggccatactgcttttgctacaaaggaagaggctgatcaagaggtgcttgacattctggaactgtatagacgcatatacgaagaattcctggcggttcctgtcactaagggaaagaaaagtgagcttgaaaagtttgctggtggcctttatacaactactgtcgaggcctttattccaaacactggccgtggtatacaaggtgcaacttctcactgcctgggacagaactttgctaaaatgtttgaaataaactttgaaaatgataaaggagaaaagggtatggtttggcaaaactcctgggcttacactacgagaactatcggtgtgatgattatgacccatggggatgataaaggtctggtgctgccaccaaaagttgcagctatccaagttgttgttatccctgttccttttaaggatgctgatactcaaggaattctcgacgcatgttctgccactgtaaagaccttgaatgaatcaggttttcgtgcagaagcagacttgagggacaactattctcccggatggaagtactcaaattgggaaatgaagggtgtccctctaaggattgaaataggtccaagagaccttgctaataagcaggtacgtgctgttcgacgtgacaatggagctaaaattgacattccaatggataatttggttgaagaagtcaaaaatttactggacaacatccaacaaaatctgtttgatgttgcaaagcaaaagaaagatgcctgcattcaggttgtgaaaacctgggaagagtttgttgaagcactaggacaaaagaaattgattttagctccatggtgtgatgaagaggaggtggagaaagatgttaaaactcggacaaagggtgaaatgggtgcagccaaaaccttatgttctccatttgtgcagccagagctgcctgaaggtactttgtgctttgcttcaggcaaaccagccaagaaatggacttactggggtcggagttattaacttttatcatttgccaatttctattttattgatgttgtaagtgccaaatttgatatcttgttctactgaggtacgtgattttcagcacttggaaagagaaatgacatctaattattcttcagcaattgaatagaaaatatagttttcagtttcctgcagaaaagatctgttggttttatgatagaattgaactatatatggatatatattttgtgatctcaaaatgctattttaccgctagcaata

SEQ ID NO: 2366 - DNA, 1922 bp, Centaurea maculosa
tctccttcgatcctaatttctgcgacggacggcggcggttgaccggaaaagaagcaaggattccgacgccggaggagaggttcttgcttgtttttctggttagtgaacggattctgaccatttgtgcttagccttcaagcaagaacttatctccattctgcaattactagaaatcagcttaaagtcaaagccatggctggtggaaagggagacaagcctgataatggcaagaaacctgctgctgttgccaaatctagtaagggaaggaaaaaggagacaggtcttggtcttacaaatactaaagacggcaactttggggaatggtattctgaggttgttacaaatggtgaaatgatagaatattatgaaatatctggctgttacattctccgcccatggacaatgtccatttgggagataatgcaaacattctttgatgcagaaattaagaagatgaagattaaaacttgctattttccactttttgtatccaacaacgttctacaaaaggagaaggatcacatagagggttttgctccagaggttgcttgggtcacaagatcaggtgactctgaattggaagtccctattgctattcgcccaaccagtgaaactgtcatgtatccctatttctctaagtggatcaggggacaccgtgacttgcctttaaaacttaatcaatggtgcaatgttgtccgctgggagttcagtaatcctaccccatttatcaggagccgtgagtttctttggcaagaaggacacactgcctttgcaacaaaggaggaggcagacactgaggttcttgaagttcttgaactgtataggcgtctatatgaggagtacttggctgtacctgttgtgaaagggaaaaagagtgagatggagaagtttgccggtggactttatactactagtgtcgaggccttcattccaaatactggacgtggtgttcaaggtgcaacttcacattgcttgggccagaattttgctaagatgtttgagattaactttgaagatgagaagggagaaaaggctatggtctggcagaattcctgggcatacagtactagaacgattggggtgatggtgatgactcatggggatgatagaggcctggtcttaccccccaaagttgcagcaattcaagttattgtgattcatgtgccttacaaagatgcagatattaaggaaatattaaatgcatgttcagccaccgtaaaagctttatgtgattcaggtattcgtgctgaagctgaccttagagagaactattcacctggttggaagtattctcattgggaaatgaaaggtgttcccttgaggattgagatcggaccaaaagatcttgccaataagcaggtgcgtgctgttcgtcgtgataatgccgcaaagatcgatattcctatggacggtttggttgataaagtaaagggtatgctggatgatattcagcaaagcatgtttgatgttgctaagcaaaaacgagatgcctgtgttcaagttgcaaaaacttgggatgaattcattgaagcattaggccaaaagaaattgatcttggctccatggtgtgatgaagaggaagttgagaaggatgtgaaaacaaagacaaaaggggagacaggagctgctaagaccctttgttctccatttgaacagcctgaactgcctgaaggtacattgtgctttgcatcagggaaacctgcaaagaaatggacgtactggggacggagctattgacatcatttacggtttgatttggtgtttccatttaccattgaagagttatatttgagttgaattgtgtttgggagttgaaacagttgttcatactgatagatttttcttaccttgtacgtggaaattacatgtttggaactcgtatatgcttatattatccgaggagaacgagccttttaaactgc

SEQ ID NO: 2367 - DNA, 1920 bp, Centaurea maculosa
ggcgggggacaccgatgcatttcgtttcatctccttcgatccgaattgctgcgacggacggcggcggttgaccggaaagcagcaacaaggattccgacgacggaggagagtcttttttctggttagtgaacagcttctgatcatttgtgcttagcctcaagcaacaacttatctcctttctgcaattactagaaatcagcttaaagtcaaagctatggctggtggaaagggagacaagcctgataatggcaagaaatctgctgctgttgccaaatctagtaagggaaggaaaaaggagacgggtcttggtcttacaaacactaaagatggcaactttggggaatggtattctgaggttgttacaaatggtgaaatgatagaatattatgaaatatctggctgttacattctccgcccatggacaatgtccatttgggagataatgcaaaccttctttgatgcagaaattaagaagatgaagattaaaacttgctattttccactttttgtatccaataacgttctacaaaaggagaaggatcacatagagggttttgctccagaggttgcttgggtcacaagatcaggtgactctgaattggaagtccctattgccattcgcccaaccagtgaaactgtcatgtatccctatttttctaagtggatcaggggacaccgtgacttgcctttaaaacttaatcaatggtgcaatgttgtccgttgggagttcagtaatcctaccccatttatcaggagccgtgagtttctttggcaagaaggacacactgcctttgcaacaaaggaggaggcagacactgaggttctcgaagttcttgaactgtatagacgtctatatgaggagtacttggctgtacctgttgtgaaagggaaaaaaagtgagatggagaagtttgccggtggactttatactactagtgtcgaggccttcattccaaatactggtcgtggtgttcaaggtgcaacttcacattgcttgggccagaattttgctaagatgtttgagattaactttgaagatgagaagggagaaaaggctatggtctggcagaattcttgggcatacagtactagaacgattggggtgatggtgatgactcatggggatgatagaggcctggtcttaccccccaaagttgcagcaattcaagttattgtgattcatgtgccttacaaagatgcagatattaaggaaatattaaatgcatgttcagccaccgtaaaagctttatgtgattcaggtattcgtgccgaagcagaccttagagagaactattcacctggttggaagtattctcattgggaaatgaaaggtgttcccttgaggattgagatcggaccaaaagacctggccaataaccaggtgcgtactgttcgtcgtgacaatgcagcaaaaattgatattcctatggacggtttggttgataaagtaaagggtatgctggatgatattcagcaaagcatgttcgatgttgctaagcaaaaacgagatgcctgtgttcaagttgcaaaaacttgggatgaattcattgaagcattaggccaaaagaaattgatcttggctccatggtgcgatgaagaggaagttgagaaggatgtgaaaacaaagacaaaaggggagacaggagctgctaagaccctttgttctccatttgaacagcctgaactgcctgaaggtacattgtgctttgcatcagggaaacctgcgaagaaatggacgtactggggacggagttattgacatgatttacggtttgatttcctgttttcatttaccattgaagagttatatttgagttgaattgtgtttgggagttgaaacagttgttcatactgatagatcttttttacattgtacgtggaaaatacatactttgaactcgcatatgctatattatccga

SEQ ID NO: 2368 - DNA, 1922 bp, Centaurea maculosa
ccttcgatcctaatttctgcgacggacggcggcggttgaccggaaaaccagcaaggattcgtacgccggaggtgaggttcttgctgtttttctggttagtgaacggattctgaccatttgtgcttagccttcaagcaagaacttatctccattctgcaattactagaaatcagcttaaagtcaaagccatggctggtggaaagggagacaagcctgataatggcaagaaatctgctgctgttgccaaatctagtaagggaaggaaaaaagagacgggtcttggtctgacaaacactaaagacggcaactttggggaatggtattctgaggttgttacaaatggtgaaatgatagaatattatgaaatatctggctgttacattctccgcccatggacaatgtccatttgggagataatgcaaaccttctttgatgcagaaattaagaagatgaagattaaaacttgctattttccactttttgtatccaacaacgttctacaaaaggagaaggatcatatagagggttttgctccagaggttgcttgggtcacaagatcaggtgactctgaattggaagtcccaattgccattcgcccaactagtgaaaccgtcatgtatccctatttctctaagtggatcaggggacatcgtgacttgcctctaaaacttaatcaatggtgcaatgttgtccgctgggagttcagtaatcccaccccatttatcaggagccgtgagtttctttggcaagaaggacacactgcctttgcaacaaaggaggaggccgacactgaggttctcgaagttcttgaactgtataggcgtctatatgaggagtacttggctgtacctgttgtgaaagggaagaaaagtgagatggagaagtttgccggtggactttatactaccagtgttgaggccttcattccaaatactggtcgtggtgttcaaggtgctacttcacattgcttgggccagaattttgctaagatgtttgagattaactttgaagacgagaagggagaaaaggctatggtctggcagaattcctgggcatacagtactagaacgattggggtgatggtgatgactcatggggatgatagaggcctggtcttaccccccaaagttgcagcaattcaagttattgtgattcatgtgccttacaaagatgcagatattaaggaaatattaaatgcatgttcagccaccgtaaaagctttatgtgattcaggtatccgtgctgaagcagaccttagagagaactattcacctggttggaagtattctcattgggaaatgaaaggtgttcccttgaggattgagatcggaccaaaagatctggctaataagcaggtgcgtgctgttcgtcgtgataatgctgcaaagatcgatattcctatggacggtttggttgataaagtaaagggtatgctggatgatattcagcaaagcatgtttgatgttgctaagcaaaaacgagatgcctgtgttcaagttgcaaaaacttgggatgaattcattgaagcattaggccaaaagaaattgatcttggctccatggtgcgatgaagaggaagttgagaaggatgtgaaaacaaagacaaaaggagagacaggagctgctaagaccctttgttctccatttgaacagcctgaactgcctgaaggtacgttgtgctttgcatcaggaaaacctgcaaagaaatggacgtactggggacggagctattgacatcatttacggtttgatttggtgttttcatttaccattgaagcgttatatttgagttgaattgtgtttgggagttgaaacagttgttcatactgatagaatttttttaccttgtacgtggaacttacatgtttggaattcgtatatgcttatatcatccgaggagaacgagccttttaaactgttata

SEQ ID NO: 2369 - DNA, 2027 bp, Lupinus angustifolius
cttcttaaaacctagccgccgaattcgattcgctgttcagtaaactcaaaatcgctttcgcacgcttatttcatcttcgtcatctctgcaatcgttccttcgcaatggcagggaatgaagtcaaaaccaaaaatccttcctcaaagcaaaaatctggcggtggtggtggtaagaagaaggaggtgaagaaggaaactggtttaggactcacgaataagaaggctgagaacttcggagagtggtattctgaggttgtggttaattctgaaatgattgagtattatgatatttctggatgctatattctgaggccttgggcgatgtcaatatgggagaacatgcaagcattttttgatccagaaattaagaaattgaaaatcaagaactgttatttccctttgtttgtgtctcctggagttttggaaaaggagaaggagcacgttgagggatttgctccagaggttgcttgggtgacaaagtctgggcaaaccgatttagaagttcccatcgccattcgtccaactagtgaaactgtcatgtatccctacttctctaagtggataaggggacatcgtgacttgccattgaaacttaatcagtggtgcaatgttgttagatgggagttcagcaatccaacaccattcatcaggagtcgtgagtttctttggcaagaaggacacactgcttttgcaaaaaaggaggaagctgatcaagaggttcttgatattttggagttatataggcgtatttatgaagagtatttagcgattcctgtcataaagggtaagaaaagtgaacttgagaagtttgctggtggactttacactaccagtgttgaggcatttattccaaacactggtcgtggtgtacaaggtgcaacttctcattgcttaggccaaaatttttctaaaatgtttaatatagaatttgaagatgagaatcgtgagaaggcaagggtctggcagaactcatgggcctatagcacacgaactattggggtgatggtgatggttcatggcgatgacaagggattggtgctgcctcctaaagtagcatctgtccaagtcattgtgattcccgtgccttacaaagatgctgatactcaaggaattttggatgcctgttctgctactgttaatacattagttgaagcaggtattcgtgccgagtcagatttaagagataactattctcctggttggaagtattcacactgggaaatgaaaggtgttcccctaaggattgaaattgggccaaaggatttagcaaatcagcaggtccgtgctgtacgacgtgataatggagcaaagatagacattaaaagtgctgattcggttgtggaaataaaaaagttgctcgatcatattcaacaaaacctttttgaagttgcaaaacaaaaacgtgatgaatgcattcaggtcatacatacatgggatgagtttgttcaagctttgagccaaagaaaaatgatcttagctccttggtgtgatgaggaggaggtggaggtagatgtgaaagcaaggacaaagggtgagaccggagcagctaagactctttgtagcccctttgaacagcccgaactcccagaaggtaccaagtgctttgcatcaggaaagcctgcaaagaagtggtcatactggggcagaagttactagaccttatcagtattgatggtgctaatctggaattgttgaacacaaatattacttttcatttgcttggatcttgtttttcaactatttctacttcgattctgtatgctacatttttcttggattgaaaaatgataaaccataaaaatacttttaaatatatttgcatttggatttctattcttcttcctccctgtatataaatgtcccacttcctgttgaattagatctgaaggaaatactggcccctaaaaaattttgtgtatcaatttgttcccttgaatattgagaatcgaaaattgtcccaaaaatatcaaatgtgagttaaattagtcatttatatgactgataatagaaattattgactcacatttc

SEQ ID NO: 2370 - DNA, 1807 bp, Chrysanthemum coronarium
tatccatccacaacaaacatattctctcattattaactggatccacccaccatcattttgaagggcggacggcgttgaccggataaagaaaagaaaagaaaagaaatggctggtggtggtggtaaaggtaaaggaggagataagccaactaaatcagctaagggaaggaagaaggagactggtttaggtcttaccaatactaaggacggtaactttggcgagtggtattctgaggttgttacaaatggcgaaatgatagaatactatgaaatatctggctgttacatccttcgtccatggacaatggccatttgggagacgatgcagaacttctttgatccagaaattaagaagatgaatattaaaacatgttacttcccactttttgtgtctaatacggttttacaaaaggagaaggatcacatcgagggttttgcccctgaggttgcgtgggtcacgagatcaggtagctccgatttggaagttcctattgctattcgcccaacaagtgagactgtcatgtatccctatttttctaagtggatcaggggacaccgtgacttgcccttaagactaaatcaatggtgcaatgttgttcgctgggagttcagtaatccaaccccctttatcaggagtcgtgagtttctttggcaagagggacacactgcctttgcaaccaaggaggaggctgacactgaggttctggaaatacttgaactgtatagacgtctttatgaggattacttggccgtccctgttgtgaaagggaaaaagagtgagctggagaagtttgctggtgggctatataccactagtgtggaggcctttattccaaacactggtcgtggtgtacaaggtgcaacttcacattgcttaggccagaattttgctaaaatgtttgagattaacttcgaagacgaaaagggagaaaaggctatggtgtggcagaactcatgggcttacagcacccgcactattggtgtgatggttatggttcatggtgatgataaaggcctggtgttgcctcctaaaatctcagcagtacaagttattgtgattcatgtgccttttaaagatgcagatgtcaaagaaattatgaatgcttgttcagcgactgtgaaaacattatgtgatttaggtattcgtgccgaggcagaccttcgagagaattattcgcctggttggaaatactcacattgggaaatgaagggtgttcccttgaggattgaaataggaccaaaggatctagctaataaccaggtccgagctgttcgtcgtgacaatgggtcaaaaatcgatcttccagtggcagatttgggtgataaagttaagggcatgttagatgatattcagcaaagcatgtttgatgttgctaaacaaaaacgagatgcatgcattcaagttaccaaaacttgggatgagttcattgaagcattaggccaaaagaaattgatcttggctccatggtgtgatgaagaggaagtcgagaaggatgtgaaagctaagaccaaaggggaggtgggagctgctaagacactttgttctccatttgaacagcctgaactgcctgaaggaacgctatgctttgcatcgggaaagcctgctaagaaatggacgtactggggacgaagctattaagctcactgtcatttggtgattttgttgttttcgttttaccatactaaaaccctcgatggatgtagggtttaaccttttgctatattagctgtcttttgtgtttaaaaatcgaaacaatggttcatatcacgagagttttgatcttctgtgaaaaataactggtttagtt

SEQ ID NO: 2371 - DNA, 2004 bp, Allium cepa
tagttacggggttacggcctagttacgggggatacagggtttatactagcccctctagtctcctcctttgatatcagatccgccgcacttccctttctagtatcattcgttgttttcttcttctgccgccgctccacaatcaaaaattttcaattagtttgcaaaagagcgagatggcttcaaagaatgcaaaaaagaaggaagtgaagaaggagactggtcttggtttgacatacaagaaggatgagaattttggtgaatggtattcagaggtcgtggttaatggtgaaatgattgagtattacgacatctctggctgctatattcttaggccatggacaatgtcaatttgggaaaccatgcaagagttctttgatgctgagatcaagaagttgaaggtgaagaattgttatttccctctgtttgttacggaaactgttctgcaaaaagagaaggatcatatagagggttttgctccagaggttgcatgggttacaaaatcagggcagagtgaaatggaaatcccaattgcaattcgtcccacgagtgaaacagttatgtatccatatttttcaaagtggataaggggacacagggagttaccgctaaagcttaaccaatggtgcaatgttgtaagatgggaattcagcaatcctactcctttcataaggagccgggaatttctttggcaagaaggacacacagcttttgctactaaagaagaagctgataaagaggttcttgatatactggagctataccgaaggatatatgaagagtatttagccattccagttgtgaagggaaagaaaagtgaactagaaaaatttgctggtgggctttacacaacaagcgttgaggcatttataccaaacacgggacgtggaatacaaggtgccacctcacattgtcttggccaaaattttgcaaagatgtttcatattaattttgagaacgagaagggtgaaaaagctatggtgtggcagaactcctgggcatatagcacccggactatcggagtgatggtgatggtccatggagacaacaaaggcttggtgctacctccgaaggtagcatcagtacaagtgatcgtaatccctgtaccatataaagatgccaatacacaagcaatatttaatgcttgcaagtcaacagtcgcaacgttatgtagtgctggttttagggctgaagaagatttaagagataattactcacccggctggaaatactcaaactgggaaatgaaaggcgttcccttgagaatagaaattggtccaaaggatttagccaatagtcaggtacgagttgttcgtcgtgataatggcagtaagcaggatataccgatggaaaacttagcggagaaagtaaaagagattctgattgatattcaacaaagtctgtttaatgcagcaaaagagaaaagggatgcatgcgtaaagatcattagtacctgggatgaatttgtaactgcactcaatgataaaaaactgattttggctccttggtgcgatgaagaggaagtggagaaggatgtgaaagcacggactaaaggtgatcttggagcagcaaagaccttatgcactccatttgagcagcccaggctccctgaaggaaccaaatgctttgcttccggaaagcctgcaacgaagtggacttactggggtcgtagctattgagtgatataccccatatcttcagtgctttgaaattgttttttggttgccaaccattttgaattttcagttgattactagctatgccgagatagacttttatttatattaaacgacataattcttgaaaaaaggacatgtttcagaaaaaatgatcacgtcttattcaaagttttcttgtggtgaacagttctgaatttgttgactgaatgttgaaacttgtcaacgtatatgtagagcaagagccataaccagtacaaatatttgagtttaaagcccagttatgatcaccttgacaaagatattttacaagtttcataaaaacacacac

SEQ ID NO: 2372 - DNA, 1935 bp, Beta vulgaris
agaacaatttccgccatggctggtgatgcgaaggttaaagctggtgatacgaaagctaaacctaaaactggtggtaagaagaaggaggtgaagaaagagactggtttagggttaacttataagaaggctgagaattttggggagtggtattctgaggttgttgtcaatgctgagatgatcgagtattacgatatctccgggtgttacattctgaggccatggactatgtccatttgggagtctatgcatgaattttttgatgccgaaatcaaaacgatgaacatcaagaactgctatttccctctgtttgtctcacctggtgtattggagaacgagaaggaccatattgacggttttgccccacaggttgcatgggtcacaaactctggacaatctgacttggaagtacctattgctattcgtcccactagtgagactgtcatgtatccatactactcaaagtggatcacgggacaccgtgacttgcctttaagacttaatcagtggtgcaatgttgtccgctgggaattcagcaaccctactccttttatcaggagtcgtgaatttctctggcaagaaggccatacagcttttgcaacacaggaagaggcagatgctgaggttctagatatattggaactgtaccggcgaatatatgaagaatttttggctgttccagttttcaagggaaagaagagtgaaatggagaagtttgctggtggatactacactacaagtgttgaggcttttattccaaacactgggcgtggtgtacaaggtgcaacctcacactgcttagggcaaaattttgcaaagatgtttgagataacatacgaaaatgagaaaggagagaaggcaatggtttggcagaactcatgggcgtacagtaccagaacgataggggtcatggtgatgacacatggcgatgacaaaggcctagttctgccaccaaaagtagcagctgtccaaatcattgtggtgcctgtccctttcaaagatgcagatatgcaaggaatttatgatgcttgtacttccactgtcaagatattgaatgaagcaggtcttcgggctgagacagatcttagggataactattctcctggctggaagtactcacactgggagatgaaaggtgttcctttgagacttgagattggaccaaaggatttggccaatagtcaggctcgtgctgttcgacgtgacaatacggaaaagaaggatatcccaatggctaatttggtcgatcaggtgaaagagttgctggacacaattcaacagaacatgtttgatgttgcaaagcagaagagagatgagtgcatcaaagtagttaggacgtgggatgagtttattgaagctttgggccagaagaaactgatcttggctccttggtgtgatgaagaggaagttgagaaggatgtcaaagctcgaacaaaaggtgagatgggggctgcgaagactttgtgctcaccgtttgaccagccagagttggaagaaggtaccctttgctttgcttctggaaaaccagctaagaagtggacatattggggcagaagctactaaatgtctgcgttatgattttccagttttctgacatgaaagatagcagtcactcgaactactgtgtactactccaaatactccttcatattgccaggttcccggtgttcttattcttaccaagagtggtagctcattttccaggacttgttagattgtatcgattcttcttgacttgaatttgagttggagaaaaaggatatctttgtacaattcaatcccccttttgatactaattacttctgacatcgttacattttatagttttgttgtttcaagttttaccttggcttcatggaaatcaattttaggcgtcttccacgggaacaaaatagttttagagaccccttatcaaatcgccagccttatcaaattgcc

SEQ ID NO: 2373 - DNA, 1689 bp, Cirsium arvense
ctcccactctctccgtttctcagcctccgccggcgcaactccggccacttctcagtttccgactctcacactcactctatcaattttctatcattcagctgaaagtcaaagaaatggctggtggaaagggagacaaggctgagaatggcaagaaatctgctgctgttgccaaatctagcaagggaaggaaaaaggagacaggtcttggtcttacaaatactaaagacggcaactttggggaatggtattctgaggttgttacaaatggtgaaatgatagaatactatgaaatatcaggttgttacattctccgcccatggacaatgtccatttgggagataatgcaaaccttctttgatgcagaaattaagaagatgaagattaaaacttgctattttcctctttttgtgtccaataacgttctacaaaaggagaaggatcacatcgagggttttgctcctgaggttgcgtgggtgacgagatcaggtgactctgatttggaagtccctattgccattcggccaactagtgaaaccgtcatgtatccctatttttctaagtggatcagggggacaccgtgacttgcctctaaaacttaatcaatggtgcaatgttgtccgatggggagtttagtaatcctactccatttatcaggagccgtgaatttctttggcaagaagggcacactgcctttgcaacaaaggaggaggcagacactgaggtcctcgaagtccttgaactgtataggcgtttatacgaggagtacttggcggtacctgttgtgaaagggaaaaaaagtgagatggagaagtttgccggtggactttatactactagtgttgaggcgtttattccaaataccggtcgtggtgttcaaggcgcgacttcacattgcttgggccagaatttcgctaagatgtttgagattaactttgaagacgagaagggagaaaaggctatggtttggcagaattcgtgggcatacagtactagaacgattggggtgatggtgatgactcatggggacgataaaggcctggtcttacccccaaaagttgcagaaatacaagttattgtgattcatgtgccttacaaagatgcagatattaaggaaatactaaatgcatgttcagccaccgtaaaagctttatgtgattcaggtattcgtgccgaagcggaccttcgagagaattattcacctggttggaagtattctcattgggaaatgaaaggtgttcccttgaggattgagataggaccaaaagacctggccaataaacaggcacgtgctgttcgtcgtgacaatggagcaaaaattgatattcctatggacggtttggctgataaagttaagcttatgctggatgatattcagcaaaacatgtttgatgtagctaagcaaaaacgagatgcttgtgttcaagttgtgcaaacttgggatgaattcattaaagcattaagccaaaagaaattgatcttggctccatggtgcgatgaagaggaagtcgagaaggatgtgaaaacgaagacaaaaggggagactggagctgctaagacactttgttcaccatttgaccaacctgaactgcctcaaggtacgttgtgctttgcctccgggaaacctgcaaagaaatggacgtactggggacggagttattaacgtcatccacggtttgatttcttgttttc

SEQ ID NO: 2374 - DNA, 1719 bp, Flaveria ramosissima
gggttactgtttgttcttccggtgtctgaacttaaagcatctctgcagttcactgtaatttgactgaaagctgaagaaatggctagtggaaagggagataaggctgctaaggccgataaatctactgctgctgccaaatcgagtaagggaaggaagaaggagactggtctaggtcttactaatactaaagatggcaacttcggggaatggtattctgaggtcgttacaaatggtgaaatgatagaatattatgaaatatctggctgttacatcctcggccatggacaatggctattgggagataatgcaaaacttctttgataccaagaaattaagaagatgaagattaaaacttgtcttatttcccgtcttctttgtagtccaataatgttctacagaaagagaaggatcacatagagggttttgctcctgaggttgcttgggtcacaagatcaggtgactctgatttggaggttcctattgccattcgtccaactagtgaaactgtcatgtatccgtatttttccaagtggatcaggggacaccgtgatttgcccttaaaacttaaccagtggtgcaatgttgttcgatgggagttcagtaatcctaccccatttatcaggagccgtgagtttctttggcaagagggacacactgcccatgcaacaaaggaggaggcagacaccgaggttcttgaaatccttgaattgtatagatgtttgtatgaggagtacttggctgtccctgttgtgaaagggaaaaagagtgagttagaaaagtttgctggtgggctctatacaactagtgttgaggcctttattccaaatactggtcggggtgtacaaggtgcaacttcacattgcttgggccagaattttgctaaaatgtttgagattaactttgaagatgaaaaaggagaaaaggctatggtctggcagaattcctgggcgtatagtaccagaacgattggggtgatggtgatggttcatggtgatgataaaggcctggtgttgccccctaaagttgcagcagtacaagttattgtgattcatgtgccttacaaagatgcagatgttaaggaaataatgaatgcatgctctgccactgttaagactttatgtgatttaggcattcgggccgaggcagaccttagagagaattattcacctggttggaagtattctcactgggaaatgaaaggtgttcctctgagaattgaaataggaccaaaggatctcgctaataaccaggtgcgtgccgttcgtcgtgacaatggagaaaaagttgatattccaatgtctgatttggtcgacaaagtaaagggtatgctggataatatccagcaaaacatgtttgatgttgccaagcaaaaacgagatgcttgtattcaagttacaaaaacttgggatgaatttattgaagcattaggtcaaaagaaattgatcttggctccatggtgtgatgaagaggaagtcgagaaggaggtgaaagcaaagacaaaaaggggagacaggggctgctaaaacactttgttctccatttgaccagccagaactgcctgaaggtacattatgcttcgcatcaggaaaacctgcaaaaaaatggacctactggggacgaagttattaacattattcacgatttcattttcttgttttccgataccatatcaaatgttggagaatttttatgagtttaaccatttgctacgattgtgtt

SEQ ID NO: 2375 - DNA, 1977 bp, Echinacea purpurea
cggccggggggagtaaattagggttttgaagttttgacacacagttgaatataaaaccaaaccagcccccttttcgacagcttgcattcacctccgattcgactccaacttgcttcgtcgccggcgttgaccggaaaatcagcacaaaagttccgacgacggaggattccgctgaaagctgaagatatggctggaaaaggagacaaacctgctaaggctgataaatctgctgctggtgctaaatccagtaagggaaggaagaaggagactggtctaggtcttaccaatactaaagatggcaacttcggggaatggtattctgaggttgttacaaatggtgaaatgatcgaatactatgaaatatccggctgctacatcctccgaccatggacaatggccatttgggagataatgcaaaacttctttgatccggaaattaagaagatgaatataaaaacttgctacttcccgcttttcgtgtccaataatgttctacaaaaagagaaggatcacatagagggttttgctcctgaggttgcctgggtcacacgatcaggtgactctgatttggaggttccaattgccattcgcccgactagtgaaactgtcatgtatccctatttttccaagtggatcaggggacaccgtgatttgcccctaagacttaatcagtggtgcaatgttgttcgatgggagttcagtaatcctactccatttatcaggagtcgtgagtttctttggcaagaaggacatactgcttttgcaacaaaagaggaggcagacactgaggttcttgaaatccttgaattgtatagacgtctgtatgaggagtacttggctgtccctgttgtgaaggggaaaaagagtgagctggagaagtttgctggtgggctctatactactagtgtcgaggctttcattccaaatactggtcgaggtgtacaaggtgcaacctcacattgcttgggccagaactttgctaaaatgtttgagattaactttgaagatgaaaagggagaaaaggctatggtctggcagaattcctgggcatatagtaccagaacgattggggtgatggtgatggttcatggtgatgataaaggcctggtgttgccccctaaagttgcagcagtacaagttatcgtggttcacgtgccttacaaagatgcagatattaaggaaataatcaatgcatgttccgccactgtaaagactttatgtgatgctggtattcgtgctgaagctgaccttagagagaattattcacctggttggaagtattctcattgggaaatgaaaggtgttcccttgaggattgagataggaccgaaggaccttgctaatagccaggtgcgtgctgttcgccgtgacaatggtgaaaaagtcgatcttccaatggcagatttggtcgataaggtaaagggtatgcttgataatatccagcaaagcatgtttgatgccgctaagcaaaaacgagatgcttgtattcaaattacaaaaacatgggatgaatttattgaagcattaggccaaaagaaactgatcctggctccatggtgtgatgaagaggaagtcgagaaggaggtgaaagcaaagacaaaaggggagacaggggctgcgaagacactatgttctccacttaaacagccagaactgcctgaaggcacattatgctttgcatcagggaaacttgcgaaaaaatggacgtactggggtcgaagttattaaatatctgattctcgtgttttctgctactatactgaactcttgaggttttctttttcaggtttaaccatttgctacgattgtgtttcgaaaccaaaacagaggttcatactgttacattttgatttgataatgttggtcttaattgtgatatatatggttataaagatacaagtttttcggctaattgtaaaacacaaaaataagaaaaaatatctcgtggaaatgaaataataaacgttgtcaatgtca

SEQ ID NO: 2376 - DNA, 1961 bp, Lactuca sativa
gtgaggtgcaattttagggtttggataacagtctggacataaagcctccctctatagctttcgtttccctcgatacaaattgctgcgacgccggcggttgaccggaaaacagctaccagatttcggacgggggagagttcctgcttctacttgtttgttaacggctttcgatcattcttgattttcgccacaaaaagtcaaaagatatggctggaggaaagggagacaagcctgctaatgccaacaaatctaatgcaaacaaatctaatgcagctgcgcagtctagtaagggaaggaagaaggagactggtctaggccttaccaataccaaagatggaaactttggggaatggtattctgaggttgttacaaatggtgaaatgatagaatactatgaaatctctggctgttatatcctccgcccatggacaatgtccatttgggagataatgcaaacatactttgatgcagaaattaaaaagatgaagattaaaacttgctactttccactttttgtatctaataccgttctacaaaaggagaaggatcacatagaggggtttgctcctgaggttgcatgggtgacaagatctggggactctgaattagaagttccaattgcaattcgccctactagtgaaactgtgatgtatccctacttttctaaatggataagaggacaccgtgatttacctctgaaacttaatcaatggtgtaatgtagttcgttgggagtttagtaatcccactccttttatcaggagtcgtgagtttctttggcaagaaggacacactgcttttgcaacaaaggaagaagcagacactgaggttcttgagattcttgaactatacagacgtctatatgaggagtatttagctgtccctgttgtgaaagggaagaaaagtgaaatggagaagtttgctggtggactttacaccacaagtgttgaggcattcattccaaacacaggacgtggtgtacaaggtgcaacctcccactgtttaggacaaaattttgcaaaaatgtttgagattaactttgaggatgaaaagggggaaaaagctatggtgtggcaaaactcatgggcttacagtacacgcacgataggggtgatggtgatggttcatggtgatgataaaggcctggtgttgcctcctaaagttgcagctgttcaagttattgtagtcaatgtgccttataaagatgcagacactgaaaaaataaaagatgcatgtttggacactgtgaaaactctaagtgatttaggtattcgtgctgaagctgatttgagagaaaactattcccctggttggaagtattctcattgggaaatgaaaggtgttcctttaaggattgaaattggacctagagatgtcaccaataaacaggtgcgtgttgttaggcgcgacaatggagaaaaaattgatattccaatggcggatttggtgaaagtgaaggagttgttggatgatgttcaacaaagcatgtttaatgttgctaaacaaaaacgtgatgcgtgtgttgaagtgacaaaaacatgggatgagtttattaaagctttaggtcaaaagaaattgattttggctccatggtgtgatgaagaggaagtggagaaggatgtgaaaacaaagacaaaaggagagacaggagcggctaagacactttgctctccatttgaacagcctgaactgcccgaaggtaccttgtgctttgcatctgggaaacctgccaagaaatggacatattggggccgaagctattaacaaaatttaaaatttggttttgtggtttatgtttactatatggaaagctttgaggagttaatcgtgtttttttttaagtgtttgaaatattggaacaattgttagtactgtttttggaagaaaaaaaaacatgtttggtacacactactggctaattaacttgatgactttaatatagttaacataacgataattttg

SEQ ID NO: 2377 - DNA, 1969 bp, Prunus mume
ctactactaagtcttccagtctgctgtcttctttctttctttattctcacaagaggaggctaaggagcgagaagaagagagaagccaaaactgcgagccgcaaacgcgaccaacaagattcaattttggttgaaaacatccaaacatggccgatgccggtgctaagaagtctaacaccaataccaagggtggagggaaaaagaaggaggtgaagaaagaaactggcctgggtctttccaagaagaaggatgagaattttggagagtggtattctgaggttgttgttcatagtgagatgattgaatactatgatatctctggttgttatattttaaggccatggacgatgtcaatatgggagacgatgcaagcattcttcgatgcagaaataaagaaaatgaaggtgaaaaatacctatttccctttgtttgtctccccgggtgttctggaaaaagagaaggatcatgtagagggttttgctccagaggttgcttgggtcacaaagtctggaaaatctgaattggaagtgccaatagcaatacgtccaacaagtgagactgttatgtatccttatttctctaagtggatcaggggacaccgtgacttacctttgaagctaaatcaatggtgtaatgttgttcgatgggagttcagcaatcctactccatttatcaggagtcgggagtttctttggcaagaaggccatacagcttttgcaacacaggcagaggcagatgaagaggttcttgagatattggaattatacaaaaggatatatgaggaatatttggcaattccagttgtgaagggaaagaagagtgagcttgagaaatttgctggcggcctttacactacaagtgtggaggcttttattccaaatactggccgcggtgtacaaggtgctacctcgcattgtttgggtcaaaattttgctaaaatgtttggcatagagtttgaaaatgagaagggtggaaaggccatggtttggcaaaactcttgggcatatagcactcgaacgattggagtgatggtgatggttcacggagatgacaaaggcttggtattgccacctaaagtggcagctacccaggttattgtggttccagtgccttacaaggatactaatacaaaagaaatgtttgaagcttgcttgagaactgtggataccttgaccgaagcaggatttcgtgttgaggcagatttaagagacaactatggtccaggttggaagtattcacattgggaaatgaaaggtgttcctctaaggattgaaattggaccaagggatttggaaaaaaaacaagtacgcctggcccgccgtgacaattcagataaactggacattcctgtgagcaatttggttgagcaagtaaaaaatatcttagatagaattcaggaaaatctgtttgatgtggcaaaacaaaagcgagatgcttctatcagggttgcaaagacatgggatgaatttatggaagctctaaaccaaaagaaaatgatcttggctccttggtgtgacgaaatggaagtagaggaggatgtgaaaaaacgaacgaagggtgaaattggagcagccaagtcactctgcaccccattcgagcagcctgaacttcctgaagggacactttgctttgcctccggaaagccagcaaagaagtggacttactggggcaggagttactagacaacatttccaaatcatgctgttaattaccacccattattttgctgatgttttcacatttcctatttggcttaagagagaaattttgaattactcaaaaattgtttgccagggcgttacttctgtagttcacatataatacaatacttatgataaattaatattgtagacatgattgtttattaatatcttaaatgaatttgggtggtacgtggagatattaatgaaaaggctgaaattaatatatgaaaatagtatgtgttttattcggcaaattacaactcaaaa

SEQ ID NO: 2378 - DNA, 1710 bp, Flaveria ramosissima
ctgctaaggccgataaatctactgctgctgccaaatcgagtaagggaaggaagaaggagactggtctaggtcttactaatactaaagatggcaacttcggggaatggtattctgaggtcgttacaaatggtgaaatgatagaatattatgaaatatctggctgttacatccttcggccatggacaatggctatttgggagataatgcaaaacttctttgatccagaaattaagaagatgaagattaaaacttgctatttcccgctctttgtgtccaataatgttctacagaaagagaaggatcacatagagggttttgctcctgaggttgcttgggtcacaagatcaggggactctgatttggaggttcctattgccattcgtccaactagtgaaactgtcatgtatccgtatttttctaagtggatcaggggacaccgtgatttgcccttaaaacttaaccagtggtgcaatgttgttcgatgggagttcagtaatcctaccccatttatcaggagccgtgagtttctttggcaagagggacacactgcccatgcaacaaaggaggaggcagataccgaggttcttgaaatccttgaattgtatagacgtttgtatgaggagtacttggctgtccctgttgtgaaagggaaaaagagtgagttagaaaagtttgctggtgggctctatactactagtgttgaggcctttattccaaatactggtcggggtgtacaaggtgcaacttcacattgcttgggccagaattttgctaaaatgtttgagattaactttgaagatgaaaaaggagagaaggctatggtctggcagaattcctgggcgtatagtaccagaacgattggggtgatggtgatggttcatggtgatgataaaggtctggtgttgccccctaaagttgcagcagtacaagttattgtgattcatgtgccttacaaagatgcagatgttaaggaaataatgaatgcatgctctgccactgttaagactttatgtgatttaggcattcgggccgaggcagaccttagagagaattattcacctggttggaagtattctcactgggaaatgaaaggtgttcccctgaggattgaaataggaccaaaggatctcgctaataaccaggtgcgtgctgttcgtcgtgacaatggagaaaaagtggatattccaatggctgatttggtcgacaaagtaaagggtatgctggataatatccagcaaaacatgtttgatgttgctaagcaaaaacgagatgcttgtattcaagttacaaaaacttgggatgaatttattgaagcattaggtcaaaagaaattgatcttggctccatggtgtgatgaagaggaagtcgagaaggaggtgaaaacgaagacaaaaggggagacaggggctgctaaaacactttgttctccatttgaccagccagaactgcctgaaggtacattatgcttcgcatcaggaaaaccagacaaaaaatggacctactgggacgaagttattaacattattcacgatttcattttcttgttttcgataccatatcaagtgttggagaattttatgagtttaaccatttgctacgatttgtgttttgtgtttttgaaaccccgtaaactaacgggtttcattaggattcgtttgtattatttatactctaatcttgacttaaaatatgtatttatatgaattaaag

SEQ ID NO: 2379 - DNA, 2424 bp, Ricinus communis
gtaaaacggaccgcaaatacacccgatatgtatcgagtcgagccacctaaccaaatggtgattcggtttccacaaacagagacggacacaatatgaaatgtcaaattcgaaacaagtcagcactagccactagggttttgggcttcatataaagcgcgcccttcgctttgtttcttactgtaacctcttatcgtttctcttttctctctctttttactgctaccaatagagaggagaaagagaacgcacgctatcaaaagaaaatcgattttcaggtattgtggtcaagttgagttggcgaaatggctagtgggggcaaaggaaaaaagaaggaggtgaagaaagagactggattgggactctcctttaaaaaggaagaacaatttggagaatggtattcagatgtggttgtgagtggtgagatgatagagtattatgatatctctggctgttatatcttgaggccatgggcaatgtcaatttgggaggtcatgcaaacattctttgatgcagaaatcaagaaaatgaaaattaagaactgttactttcccctttttgtttcatctagtgtcttagaaaaggagaaggatcacatagagggatttgctccagaggttgcttgggtgacaaaatctgggaaatctgacttggaaattcctatagcgattcgcccaactagtgaaacagttatgtatccctactattctaagtggatcaggggacaccgtgatttgcctttgaaacttaaccagtggtgcaatgtcgtccgttgggaattcagtaatcctactccattcatcaggagccgtgaattcctttggcaggaagggcatactgcttttgcaacaaaggaagaagcagatgaagaggtccttcaaatattggagctgtataggtgtatatatgaagaattcttggccgttccagtcgtgaaaggcaaaaaaagtgagagggagaaatttgctggtggactttacacaaccagtgttgaggcatttattcccaacactggacgtggtattcaaggtgcaacttctcattgtttgggtcaaaactttgcaaaaatgtttgagataaactttgaaaatgagaagggagagaagggtatggtctggcagaactcgtgggcctatagtactcgaacgattggggtgatggtgatggttcatggtgatgacaaaggcttagtgctgccacctaaagtggcatctgttcaagttattgtgattcctgtgccctacaaagatgctgatactcaaggcatttttgatgcttgcactgaaactgtggatgccttgtgcaaggtaggcatccgtgcagagagtgacttcagagacaattactctcctggctggaagtactctcactgggaggtgaaaggtgtacccctaaggattgaaatagggccaaaagatttggcaaataatcaggtacggactgttcgtcgtgataacgcaaccaaaaaagatataagcagagttaatttggttgagcaagtaaaagagatactagatgctattcaacaaagtctttttgatgctgctaagcaaaagcgtgatgcctgcattcaagttgtaagaacttgggatgagttcacagaggctctaagccaaaggaaaatgatcctggctccttggtgtgatgaggaggaggtggaagaagatgtgaaacagcgaaccaaaggtgagatgggagcagccaagagcctttgtactccgtttgagcagccagagctccctgaaggtaccagtctgtggtgtcttttaagggacattgtgctttgcctctggaaagccagcgaggaaatggacatactggggcagaagttactagaatattataattcctttcctcagctacttgatgctttcctatgcaaggccagcaaggaaatggacatatcggagcagggatttattcccatgttcttcaatgtctaatgatcgggaggtgctctaatttttgttttccaaaactgtaattgatactcgagcaaaacgagtgttagatcatttatataatgtcatggatgctatccgttgtttaccaattgtacctggtgtaaaccttaattttatatacaagacttcgaagtgttgatccctgtcttattttaacttgttatttatctactcaacgttcttctgcctctggagttacttctccagagaagtattgtgtgtattttgttcaggatataattatcatttcatcatgctgtaattttcttttctttacctattcctttttgcccttttttttttttttttttttaaattttctaattatttccattgttttccagaagtctgtcatgatcatctattgcaatgaaataatattgctatatttgatcaatgaaaactcaacaaataatagaacaaataaaaattgcatccatcaatgcaggttttttatttattg

SEQ ID NO: 2380 - DNA, 1754 bp, Cucumis sativus
gtgtttgctaattctttgttgcttattgggcaggtggcaaaaagaaagaggtgaagaaagagactggtttaggtctcaccaataagaaagatgataactttggagagtggtattctgaggtggttgtgagtggagaaatgatcgagtattatgatatctctggctgctatatactaaggccgtgggcaatatctatttgggagactatgcaagtattttttgatgcagaaattaagcaaatgaaaatcaagaactgttattttccactttttgtatctcctggcgttttacaaagagagaaagatcatattgaaggttttgctcctgaggttgcttgggtgacaaaatctggggagtctgacttggaagtgcccattgcgattcgccctacaagtgagactgttatgtatccatactattctaagtggatcaggggccaccgtgacttgcctttgaaacttaaccagtggtgcaatgttgtgagatgggagttcagccatcccacaccatttattaggcaattactcgtgcttgtgcttatttttttgagtcgtgagttcctttggcaggaagggcatactgcttttgctactaaggatgaagcagatacagaggttcttgagatattggaattgtatagaaggatatatgaagaatacttggcgattcctgttatcaagggcaagaagagtgagatggagaagtttgctggcggtctttacaccacaagtgttgaggcatttatcccaaacactggccgtggtattcagggtgctacttcacattgtttgggtcaaaattttgcaaaattgtttgaaatcaactttgaaaatgaaaagggggagaaagctatggtctggcaaaattcgtgggcctatagtactagaacgattggtgtgatggttatggttcatggggatgacaaaggattggtgctgcctcctaaagttgcgtcggttcaagttattatagtccctgtaccttacaaagatgcagacactcaaggaatttttgatgcttgttctgccactttggatacattgacagcagcagggattcgtgcggaggtagactctagggataactattctcctggatggaagtactctcactgggaaatgaaaggtgttccactcaggattgaaataggacctaaggacttggcaaacaatcaggtgcgtgctgttcgccgtgataattcgggaaaaaaagacatacctagggattcattggtagaacaagtgaaagaattgctagaaagtattcaacaaagtctgtttgatgcagcaaaagtaaaacgagatacatgcattcaagttattaatacatgggaggagtttactgaagccctcggtcagaagaaaatgatattggctccatggtgtgatgaagaggaggttgagaaggatgtgaaaacaaggacaaagggtgagatgggagcagctaaaaccttatgttccccattcgaccagcctgcacttccagaaggtaccaaatgctttgcttctggaaaacctgcaaagaaatggagctattggggccgaagctactaagctatcagcttgtgtttatctccctatgttgcgattggatacatcgagaagtcagcatttgggagttagtgaatagaggggcattcgattcagttaattctgagttcatcagtacttccaataggaggctctcttacacgatgaagaaaaaagcattcagttagcaagagttaactataaaacactttactttggttgcat

SEQ ID NO: 2381 - DNA, 1862 bp, Amaranthus tuberculatus
cctcctcctccttctctctcctatcgccgtcgtcttcttccagccgcctttttaatcgcactgtcacatcatcattttccatggctggtgaaggcaattccaagcccaaatctggtggtaagaagaaggaggttaagaaagagactgggttagggttaactcataaaaaggatgacaattttggggaatggtactctgaggttgttgttaatgctgagatgatagagtattatgacatttctggatgttacattttgaggccttggactatggctatttgggaggctatgcaagaattttttgatgctgaaatcaagaaaatgaagataaagaactgctacttccctctgtttgtatcacccggtgtgctgcagaaggagaaagaccacattgagggttttgccccagaggttgcatgggtgaccaagtctggacaatctgagttggaagtgccaattgctatccgtcccacaagtgagactgttatgtatccatactattcaaagtggatcaggggacatcgtgacttgcccttaagactgaatcagtggtgtaatgttgtccgttgggaattcagcaatcctactcctttcatccggagtcgtgaatttctctggcaagaaggtcatactgctttcgcgacacaggaagaagcagatgccgaggttctcgacatattggaactctacaggaaaatatatgaagaatttttggctgttccagtgatcaagggcaaaaaaagtgaaatggagaagtttgctggtggatactacacaactagtgttgaggcttttattcccaacactggacgtggagtacaaggtgcaacttcacactgtttaggtcaaaattttgcaaagatgtttgaaatcacttatgaaaatgagaaaggagagaaagcaatggtgtggcagaactcatgggcgtacagtactagaacgattggggtcatggtgatgacacatggtgatgacaaaggcctagttttgcctccaaaagttggcgctgttcaagtaatagtggtgcctgtccctttcaaagatgcagatacacagggcatttttgatgcatgttcttctactgtaaatattttgagtgaagcaggtattcgggctgaggcagatcttagggataattattctccaggttggaagtactcacactgggagatgaaaggtgttcctttgaggcttgagattggaccaaaggatttagccaacagtcaggttcgtgcagttcgacgtgacaattcggccaagaaggatcttccaatggctaatttggttgatcaggtcaaagaattactggatgcaattcagaagaacttgtttgatcttgctaaggagaaaagagatgcgtgcgttcaaaaagttaggacgtgggatgagtttgttgaggctttggccaagaagaaactgatttttgctccttggtgcgacgaagaggaagtcgagaaagatgtcaaagctcgaacaaaaggtgagatgggagctgctaagacattgtgttcaccatttgaccagccagagatggaagaaggtaccctttgctttgcttccggaaagccagctaagaagtggacgtattggggcagaagctactaaaccgaatctgcaaatgtattttctcgtgccctcaaaacgatgccattatttacacaacctactgtgcatttcttaagatgctatcatattatagattgggttttggtgtttttgtttttcgatccatcagaattggttgatttatagagctcttttgcgcggcaaggatatgtttgtacaatacatttttatttttagtcgaggtggatcaacgctttgaaatgtgagatccgttctcttaacttttatttttgtcgg

SEQ ID NO: 2382 - DNA, 1821 bp, Ambrosia trifida
tcatcgacagctacaatcccattacacttcgccgttgaccggaaaccaccacaaatcttcaccggcggtttgttatttcggtctctgaacttaacgacgttgaaaggtgaagatatggctggaaaaggagataagcctgctaagcaagataaatcagctgctgcttctaaatccagcaagggaaggaagaaggagactggtctaggtcttactaataccaaagatggaaacttcggagaatggtattctgaggttgttacaaatggtgaaatgatcgaatattatgaaatatccggctgttacatcctccgcccatggacaatggccatttgggagacaatgcaaaacttctttgatccagaaattaagaagatgaacattaaaacatgctatttccccctttttgtgtccaataatgttctacaaaaagagaaggatcacatagagggttttgctcctgaggttgcttgggtcacaagatcaggtgactctgatttggaggttcctattgccattcgtccaactagtgaaacagtcatgtatccctatttttctaagtggatcaggggacaccgtgatttgcctttaagacttaatcagtggtgcaatgttgttcgatgggagttcagtaatcctactccatttatcaggagccgtgagtttctttggcaagaaggacacactgcttttgcaacaagagaggaggcagacactgaggttcttgatatccttgaattgtatagacgtctgtatgaggagtacttggctgtccctgttgtgaaagggagaaagagtgagttggagaagtttgctggcgggctctatactactagtgttgaggcctttattccaaatactggtcgaggtgtacaaggtgcaacctcacattgcttgggccagaattttgctaaaatgtttgagattaactttgaagatgaaaaaggagaaaaggctatggtctggcagaattcctgggcctatagtaccagaacgattggggtgatggtgatggttcatggtgatgataaaggcctggtgttgccccctaaagtttcagcagtgcaagttattgtggtgcacgtgccttacaaagatgcagacgttaaggaaattatcaatgcatgttctgccactgtgaagactctatgtgaggctggtatccgtgctgaagcagaccttagagagaattactcgcctggctggaaatactctcattgggaaatgaaaggtgttcccctgaggatcgagataggaccaaaggaccttgctaataaccaggtgcgtgctgttcgtcgtgacaatggtgcaaaagtcgacattccaatggcaggtttggtcgattcaataaatggtatgttggatactatccaacaaagcatgtttgatgttgctaagcaaaaacgggatgcttgtattcaagttacaaaaacgtgggatgaatttattgaagcactaggtcaaaagaaattgattttggctccatggtgtgatgaagaggaagtcgagaaggaggtgaaagcaaagacaaaaggggagaccggggctgctaagacgctctgctctccattggagcagccagaactgcctgaaggtacattatgcttcgcatccgggaaaccagcgaaaacgtggacgtactgggggcgaagctattagatatttgagtctcatgttttatgttactatactgaactgtgatgtttattttcaagttttaaccatttgctacgattgtgtttcgaaacagaaacaatggttcacaatgtttaaatttttgacttccatgttgatcttaaattgtgatttatatggttataaaga

SEQ ID NO: 2383 - DNA, 1602 bp, Citrullus lanatus
gtcattgtgctccatcctcaatcttctcctcgcatttcatcactgtccgcgcctcctcgcagccgcctgttcatcggaatcgcagagatccatccattaagctaagaactgaaaaccatggctggtcctaagcctggtagctctgctactaatccaaaaactggcggcaaaaagaaggaggtgaagaaagagactggtttaggtctcactaataagaaggacgataactttggagagtggtattctgaggtggttgtcagtggagaaatgatcgagtattatgatatctctggctgctatatactaaggccgtgggcaatatctatctgggagactatgcaagtattttttgatgcagaaattaagaaaatgaaaatcaagaactgctattttccactttttgtatctcctggcgtcttacaaagagagaaagatcatatcgaaggttttgctcctgaggttgcttgggtgacaaaatctggggagtctgacttggaagtgcccattgcaattcgccctacaagtgagactgttatgtatccatactattctaagtggatcaggggccaccgtgacttgcctttgaaacttaaccagtggtgcaatgttgtgagatgggagttcagccatcccacaccatttattaggagccgtgagttcctttggcaggaagggcatactgcttttgctactaaggatgaagcagatacagaggttcttgagattttggaactctatagacgcatatatgaagaatacctggctattcctgttatcaagggaaagaagagtgagatggagaagtttgccggtggtctttacaccacaagtgttgaggcatttatcccaaacactggtcgtggaatccagggtgcgacttcacattgtttgggtcaaaattttgcaaaaatgtttgaaatcaactttgaaaatgaaaagggggagaaagctatggtctggcaaaattcttgggcctatagtactagaacgattggtgtgatggttatggttcatggggatgacaaaggattggtgctgcctcctaaagttgcttcggttcaagttattatagttccggtaccttacaaagatgcagacactcaaggaatttttgatgcttgttctgccactttggatacattgtccgaagcaggcattcgtgcagaggtagactctagggataattattctcctggatggaagtactctcactgggaaatgaaaggtgttccactcaggattgaaatagggcctaaggacttggcaaacaatcaggtgcgtgctgttcggcgtgataattcgggaaaaaaggacatacctagggactcattggttgaacaagtgaaagaattgctagaaagtattcaacaaagcctgtttgatgcggcaaaagagaaacgagatacatgcattcaagttattaatacatgggaggagtttaccgaagccctcagtcagaagaaaatgatactagctccgtggtgtgatgaagaggaggttgagaaggacgtgaaaacaaggaccaagggtgagatgggagcagctaaaaccttgtgttccccattcgagcagcccgcacttccagaaggtactaaatttctg

SEQ ID NO: 2384 - DNA, 1620 bp, Amaranthus tuberculatus
cttctcgtattgccgtcgtctttgctcagaactacattttccatggctggcgaagggaaagctaaatctggtggtaagaagaaggaagtcaagaaagagactggtttaggattgactcacaaaaaggatgataattttggggagtggtattctgaggttgttgtcaatgctgagatgatagaatattacgatatctctggctgttacattttgaggccttggactatggctatttgggaggctatgcaagaattttttgatgctgaaatcaagaaaatgaagataaagaactgctacttccctctgtttgtatcacccggtgtgctgcagaaggagaaagaccacattgagggttttgccccagaggttgcatgggtgaccaagtctggacaatctgagttggaagtgccaattgctatccgtcccacaagtgagactgttatgtatccatactattcaaagtggatcaggggacatcgtgacttgcccttaagactgaatcagtggtgtaatgttgtccgttgggaattcagcaatcctactcctttcatccggagtcgtgaatttctctggcaagaaggtcatactgctttcgcgacacaagaagaagcagatgccgaggttctcgacatattggaactctacaggaaaatatatgaagaatatttggctgttccagtgatcaagggcaagaaaagtgaaatggagaagtttgctggtggatactacacaactagtgttgaggcttttattcccaacactggacgtggagtacaaggtgcaacctcacactgtttaggtcaaaattttgcaaagatgttcgaaatcacttatgaaaatgagaaaggagagaaagcaatggtgtggcagaactcatgggcgtacagtactagaacgattggggtcatggtgatgacacatggtgatgacaaaggcctagtttgcctccaaaagttgcagctgttcaagtcatagtggtgcctgtccctttcaaagatgcaaatacacaaggaatctttgatgcatgttctaatactgtaaaagtattgagtgaagcaggtattcgggctgaagcagatcttagggataactattctccaggttggaagtactcacactgggagatgaaaggtgttcctttgaggcttgagattggaccaaaggatttagccaacagtcaggttcgtgctgttcgacgtgacaattcggccaagaaggatcttccaatgtctaatttggttgatcaggtcaaagaattactggatgcaattcagaagaacttgtttgatctcgctaaagagaaaagagatgcatgcgttcaaaaagttaggacgtgggatgagtttgttgaggctttggccaagaagaaactgatttttgctccttggtgcgatgaagaggaagtcgagaaagatgtcaaagctcgaacaaaaggtgagatgggagctgctaagacattgtgctccccgtttgaccagccagagatggaagaaggtaccctttgctttgcctctggaaagccagctaaaaagtggacgtattggggaagaagctactaaaacgaatctgcaaatgtattttctcgtgccctcaaaacgatgccattatttacacaaccta

SEQ ID NO: 2385 - DNA, 1945 bp, Chrysanthemum coronarium
caaaggtgtaacttaaattagggttttatatttcccctaaatctgtttgacgactgcctcttggttatatccagccaccctccattcattcattactggatccatcatcatcatcatcttggttaaaagaacaacaggtgaaaggaaagaaatggctggtggtaaaggagataagcctgctgctactaaatctgctaagggaagaaagaaggagactggtctaggtcttactaatactaaggacggtaactttggagaatggtattctgaggtggttacaaatggggagatgattgaatactatgaaatatctggctgttacattctccgtccatggacaatggccatttgggagacaatgcaaaacttctttgatccagaaattaagaagatgaatatcaaaacatgttacttcccactttttgtgtccaatacggttctacaaaaggagaaggatcacatagagggttttgcccctgaggttgcttgggtcacgagatcaggtagctccgatttggaagttcctattgccattcgcccaaccagtgaaactgtcatgtatccctacttttctaagtggatcaggggacaccgtgacttgcccttaagactaaatcaatggtgcaatgttgttcgctgggagttcagtaatcctactccctttatcaggagtcgtgagtttctttggcaagaaggacacactgcctttgcaacaaaggaggaggctgacactgaggttcttgaaatacttgaactgtatagacgtctttacgaggagtacttggccgtccctgttgtgaaagggaaaaagagtgagctggagaagtttgctggtgggctatatactactagtgtggaggcctttattccaaatactggtcgtggtgtacaaggtgcaacttcacattgcttgggccagaattttgctaagatgtttgagattaacttcgaagatgagaagggagaaaaggctatggtgtggcagaactcatgggcttatagtacaagaaccattggtgtgatggttatggttcatggcgatgataaaggcctggtgttgcctcctaaaatctcagcagtacaagttattgtgattcacgtgccttttaaagatgcagatgtcaaagaaataatgaatgcctgttccgcgactgtgaaaacgttatgtgatttaggtattcgtgccgaggcagaccttcgagagaattattcgcctggttggaagtattctcattgggaaatgaagggtgttcccttgaggattgaaataggaccaaaggatctagctaataaccaggttcgcgctgttcgtcgggacaatggatcaaaggtcgatcttcctatggcagatttgggtgagaaagttaagggtatgttggatgatattcagcaaagcatgtttgatgttgctaaacaaaaacgagatgcatgtattcaagttaccaaaacttgggatgagttcattgaagcattaggccaaaagaaattgatcttggctccatggtgtgatgaagaggaagtcgagaaggatgtgaaagctaagacaaaaggggaggtcggagctgctaagacactttgttctccatttgaccagcctgaactgcctgaaggaacgttatgctttgcatcgggaaaacctgctaagaaatggacgtactggggacgaagctattaaccacactatcattgggttgattttttgttgtttttcatttaccatactaaatccttgatgaatacagggtttaaccctttgctatattagctgtcttgtgtgtttgaaaatcgaaacaatggttcatatcgctattcatatgatttgaaaaattgtaggcgtaagccagaaaatatgaactgtactggaggtgaaaacatgatgcttgatgactggtgcttaggtgtcttttctccattttcttttagtatcatgataaatcaaatatag

SEQ ID NO: 2386 - DNA, 2792 bp, Aristolochia fimbriata
cggttgcgtcccagcagtcggaactcaatcctatatctcattctgcaagccgttgacaaaggttgccattgagtagtcttcagacatatccccgatcgccgccgagtgaagctcgaagctctgcctgtactcagccactgaggctgtttgccggcgtgattgccaacagttgctgcgccactaactactggtgccacgataaagctacgtcctccatacaaacagcggcggatgcaaccctttcagatccggtgatcccattggcggcggaataacgttccgctcagaaaagccaccccgacagatcttcccctctgtgcactggaagttctagtctccggattggttcacacgcgaggagtcctgcagatatggcaaatgacggtactggttcactgaagtccttgaaaatatctggtaacacatcaaaagctgccaagaagaaagaggttaaaaaggagagtggccttggtctgacaaacaagaaagatgaaaatttcggagaatggtactctgaggttgttgtgaatgcggaaatgattgaatactatgatatttcgggttgttacattctaaggccttggagcattggtatttgggaaattttgcatgacttcttcgacccagagataaagaagatggaaatagaaaattgttactttcctctatttgtttctccaggtgttctacagagagagaaagatcacatagagggatttgctccagaggtggcctgggttacaaaatctggtagtactgatttggaagttcctattgcaatccgtccaacgagcgagactgtgatgtatccatattactctaagtggataaggggccaccgcgacttgcctttgaaactcaatcagtggtgcaatgttgtccgttgggaattcagtcatcctaccccttttatcaggagccgtgagtttctatggcaagaaggccatactgcttttgcatcaaaggaagaagcagatgaagaggttcttcaaatcttggaactttatagaagggtatatgaagaataccttgctgttcctgttataaaggggaagaaaagtgaacttgagaagtttgctggtggactatacactacaagtgttgaggcattcattcctaacacaggccgtggtatacaaggggctacctctcattgtcttggtcaaaactttgcaaagatgtttgaaatcaacttcgaagatgagaaaggagaaaagcgtatggcgtggcagaattcctgggcttacagtactcgcactataggtgttatggtaatggttcatggagatgataaaggcttggttcttccacctaaagtggcctctgttcaagttattgtcattccggtgccttacaaggatgctaatacacaaggcatatttgatgcatgctcagcaactgtgaagacactcagtgaagctggattccgtgttaaaaaggatgtaagggataattactcacctggctggaagtattctcattgggaaatgaaaggtgttcctttgagaattgaaattggaccaaaggatttggcaaataatcaggtccatgttgctcgccgtgataatggtgctaaaacggacataccaatgagtaagttggttgatgaggtggcaaatatcttatctaacattcagcaaagcatgtttgatgctgcaaagcagaagagagatgcttgtgttgtggtcataaagacgtgggatgaatttatgacagcactgaataagaagaaactgatccttgctccttggtgtgatgaagaggaagttgaaaaggatgttaaagctcgaacaaaaggcgaaatgggtgcagctaagacactgtgcaccccatttgatcagccagagcttcctgaagggacactttgctttgcttcaggaaagcctgctaagaaatggacatattggggtcgaagttactaagaatttcagtgttttgcttggactatacatcatcacaaagtcgattattttgattggtcaatatacagttttggacctgcatcatttttgggaaaatcagagagcagtttctttttcttctatgtttgaaaaatggtatctcagattatatttagttaagattttgataacttgcacctgtagtgaaatccagttaagtctttagtatcttttgaaccaaattgacaaagtgcatagcatcacgagtcattatgattacacatcaatttgtgctttggctgataatgcttcttattcgaacaattgtcttgtttttgtattaattatcacgaccaaatttttggtacttcattgctgttttcaatatatagttgtctattatgctgtaaagcgggagagcagaaaggttgaacttttactggacctcatttcctgtcccaagttgtatattagggctttgtaaccagattttgtatctgacttggactaatcaaaatcttgattgggtgggctgtgtcaggttggattgaccttgcccgagtcagagtctcagagggatgtaccattacagaagcgggcaatggtaactgaagaggtaaagcccatccgttgtgtttatcttttcatagcattcgctcaagaggagattgcttggcaaatcagaaggggagaaccaggaggggagaagttgatcaaaagagtgtcattgggtatatttgtttatggtaagaaacatggtgtagcactgggactaggaaccttcagatttcttcctaatacaagtttggtcgacccactggacaaagacgaaatccttccgcgttggaggggacttgaaccagtacgactcataataaggaatctgaattg

SEQ ID NO: 2387 - DNA, 1691 bp, Solanum phureja
agggaaaaatgaaagaagtcaagaaagagacaggtcttggtctctcttacaaaaaggatgaaaattttggagagtggtattctgaggttgtcgttagtggtgaaatgatcgagtactatgacatatctggctgttatattctacggccatggtcaatgtctatctgggagatattgcatggttttttcgatgccgaaattaagaaaatgaagataaagaactcctactttcctctgtttgtgtcccctgctgttcttcaaaaggaaaaggaccacatagagggatttgcacctgaggttgcttgggttacaaaatctggtgattctgatttggaagtacccattgcgattcgacccactagtgaaacagtaatgtatccttatttctctaagtggataaggggacatcgtgacttgcccttgagactcaaccaatggtgcaatgtcgtgcgatgggagtttagcaaccccacccccttcatcaggagtcgtgaatttctctggcaagaaggacacactgcttttgcaacaaaggaggaatcggatgcagaggttctagaaatcttggaattgtatagacgtatatatgaagaacttttagctgttccggtcagtaagggaaagaaaagtgagcttgagaagttcgctggtggactatatacgactacagttgaggcttttatccctaatactggccgtggtatccaaggcgcaacttctcattgtttagggcagaattttgcaagaattttcgagataaattttgaaaatgaaaagggagagaaggctatggtctggcagaactcatggggcttttctacaagaacaattggtgttatgatcatggttcatggggatgacaaaggtctggtcttacctcctaaagtagcatcaactcaagtagttgttattcctgttccatacaaggatgcaaatactcaagggatctatgatgcttgtgctgctaccgttagagaaatgaatgaatcaggtattcgtgctgaggcagacttcagagacaactattcacctggctggaaatattctcattgggaaatgaagggggttcctcttaggattgaaataggaccaaaagactttgcaaataaccaggtacgagctgttcgacgtgacaacggagccaaaaccgatattcccatggccaatcttgccgaacaagtaaaagatttgcttgccactatccaacaaaatctattcgatgttgccaagcaaaagagagatgcatgtgttcagattgtaagaacctgggatgaatttactgtagcactgggccaaaagaaattggtcttggctccttggtgtgatgaggaggacgttgagaaagatgtcaaggcacgcacaaagggcgagatgggttcagtaaagacactttgctccccatttgatcagcctgagctgcctgaaggtacattgtgcttcgcgtcgggtaaacctgctaagaagtggacatactggggccgtagctattgatgatctgttccataactcaggttacctagtgattcataaggaccctcacagtacactttgctctaaggtcactctttagaattaaattcagttatatacatcttcatcatgacgattataacttctatgaatttcattaaatcattaaactcaaatacatcactatattcggatctctgaattaaataaataaaggaagta

SEQ ID NO: 2388 - DNA, 1744 bp, Solanum lycopersicum
gccctccatcgaaacagttcttttctgcattttatcttccctaaatccaactacttccattatttgggagcttttagctgtttcttagggaaaaaatgaaagaagtcaaaaaagagacaggtcttggtctctcttacaaaaaggatgaaaattttggagagtggtattctgaggttgtcgttagtggtgaaatgatcgagtactacgacatatctggctgttatattctacggccatggtcaatgtctatctgggagatattgcaaggttttttcaatgctgaaattaagaaaatgaagataaagaactcctactttcctctgtttgtgtcccctgctgttcttcaaaaggaaaaggaccacatagagggatttgctcccgaggttgcttgggttacaaaatctggtgattctgatttggaagtacctattgcgattcgacccactagtgaaacagtaatgtatccttatttctctaagtggataaggggacatcgtgacttgcccttgagactcaaccaatggtgcaatatcgtgcgatgggagtttagcaaccccacccccttcatcaggagtcgtgaatttctctggcaagaaggacacactgcttttgcaagaaaggaggaatcagatgcagaggttctagaaatcttggaattgtatagacgtatatatgaagatcttttagctgttccagtcagcaagggaaagaaaagtgagcttgagaagttcgctggtggactatatacaactacagttgaggcttttatccctaatactggccgtggtatccaaggtgcaacttctcattgtttagggcagaattttgcaagaattttcgagataaattttgaaaatgaaaagggagagaaggctatggtctggcagaactcatggggctttagtacaagaacaattggtgttatgatcatggttcacggggatgacaaaggcctggtcttacctcctaaagtagcatcaactcaagtagttgttattcccgtcacatacaaggatgcaaatactcaagggatctatgatgcttgtgctgctaccgttagagagatgaatgaatcaggtattcgtgctgaggcagacttcagagaaaactattcacctggctggaaatattctcattgggaaatgaagggggttcctcttaggattgaaataggaccaaaagaccttgcaaataaccaggtacgagctgttcgacgtgacaacggagacaaaacagatattcccatggccaatcttgctgaacaagtaaaagatatgcttgccactatccaacaaaatctattcgatgttgccaagcaaaagagagatgcatgtattcagattgtaagaacctgggatgaatttacggtagcactgggccaaaagaaattgatcttggctccttggtgtgatgaggaggacgttgagaaagatgtcaaggcacgcacaaagggcgagatgggtgcagcaaagacactttgctccccatttgaccagcctgagctgcctgaaggtacattgtgcttcgcgtcgggtaaacctgctaagaagtggacatattggggccatagctattgatgatctgttccataactcaggttacctagtgattcataaggacccttcacagtacaatttgctgtaagatcactctttagaataaaattcagttatatatacatcttcatcctgacgattataacttttatgaaattcattaaattatccagaagatcattatacta

SEQ ID NO: 2389 - DNA, 2548 bp, Medicago truncatula
ttctctccattcatttatgtcaagcacaaggaacatgaagacactcaaaagaatcagctaaatgaatctgatgaagaatccttaaataacgaaacgagaagcattttcttgaaacaaccaaagtcggaaacaccgacgaccgtggcggagacgaaacaggtcaaaaatgtcggcgacgctggacacggtggcggctgtgcaccaagaaccatggtcgcctcttgtcatcggaaccaccccatacttaactgccgaggtttttctcagtgcagacgattttatttttcctcgacagttaactgcagaggggctagtagctagagaatacacagagagtctcctcgcacgctccatcgctctcgcacgctccattctgtctcgccttctttccaactcaacaaggatcaggtgctcgtcatccttcacaatggcggggaccgatgacaacataacacaacaacaatccgctgcaaaaccccaaaaacaaccaaaacaaccaaaacaaccaaaaccacaacaatcaggtggtggaaagaagaaggaagtgaagaaagaaactggattaggtttaaccaataagaaggctgaaaacttcggagaatggtattccgaggttgttgtgaatggggaaatgattgagtactatgatatttctggttgctatattctcagaccttggtcaatggctatttgggagattatgcaagcgttttttgatccagaaataaagaaaatgaagatcaagaactgctacttccctctgtttgtttctaacactgttctggaaaaggagaaggaccatatcgagggtttcgctccagaggttgcttgggtgaccaaatctggagaatctgatttagagattcctattgctattcgtccaactagtgaaactgttatgtatccttactactctaagtggataaggggacatcgtgacttgcctttgaagcttaatcagtggtgcaatgttgttagatgggagttcagcaatcccacaccattcatcaggagtcgtgagtttctttggcaagaaggacacactgcttttgcaacaaaggaggaagcagatacagaggtgcttgagattttggaattatatcggcgtatctatgaagagtatttggcagttcctgtcgtaaagggtaagaaaagtgagcttgagaagtttgctgggggactttacactaccagtgttgaggcatttattccaaacactggtcgtggtatacaaggtgcaacttctcattgtttgggacaaaattttgctaaaatgtttgagataaactatgaaaatgagaagggagagaaagcaatggtctggcagaactcgtgggcctatagtactcgaactattggggtgatggtgatggttcatggtgatgacaagggattggtgctgccacctaaagtagcatcagttcaagtcattgtgattcctgtgccttacaaagatgctgatactcaaggaatctttgatgcctgtaccgcaactgtgaatatgttgttggaagcaggaattcgtgctgagtcagatgccagagacaactattctcctggatggaaatattctcagtgggaaatgaaaggtgttcctctaaggattgaaatcgggcccaaggatttagcaaataagcaggtccgtgctgttcgtcgtgatagcggagcaaagatcgacattggtaatgatgatttggttgtggaaataaagaagttgctcgataatattcaacagaatttgtttgatgtcgcaaaacacaaacgagatgcatgtattcagatcatacatacatgggatgagtttgtagcagctttgaatgaaaaaaagatgatcttagctccttggtgtgatgaggaggaggtggaaaaagatgtcaaagcaaggacaaagggtgagacaggagctgcaaagacactttgtagtccctttgatcagccagaactccccgaaggcaccgtgtgctttgcgtcaggcaagcctgcaaagaagtggtcatactggggcaaaagttactagatcttgattgtggtattttctgaagctagttcaccatttaatggtgccttgactgaatttgtggatcatgcaaatattagtttcttgtgcttgagtaacacacttatttttcaattgatagttttactttgattttatacggtacaatattttatttattcagctttaaagaagagtattgcatcttttcctgtccaaatattgttggcagtatagcgactgatctactgaatattatgccttttgaccacagcttgtttatgtcgattgaaagccaatggaatggaaattgaacaatccaatcctctggtttgcaccaaatgttacaaaagagatactgttattttttttggggacacaaaagtgttgtgctaaaatttattgagtggtactatatagtacggaatgttaattgtacgaaaattcacggaaatgtgtatttgagacacaacacttgcaatacacgggctgattaggggcagaattaaattttattaaaaaattatactaaaatagtctgcatgaatacat

SEQ ID NO: 2390 - DNA, 1800 bp, Cichorium intybus
catactgataactttctttttccctcgatccaaattgctgcgacgccggcggttgaccggaaaacagcaacaagaattcggggagaggttcctgcttcttctttccaagcaatcgtgcttcgccacaattgaaagtcaaaagacatggctggtggaaagggagaaaaatctgctaatgccaagaaatccgcagatgcgaagtctagtaagggaaggaagaaggagactggtctaggtcttactaatactaaagatggaaactttggagaatggtattctgaggttgttacaaatggtgaaatgattgaatactatgaaatatctggctgttacatccttcgtccatggacaatgtccatttgggagataatgcaatcatactttgatgcagaaatcaagaagatgaagatcaaaacttgctacttcccactttttgtatccaacactgttcttcaaaaggagaaggatcacatcgagggttttgctcctgaggttgcttgggtgacaagatcaggtgattctgatttagaagttcctattgctattcgtccaacaagtgaaaccgtcatgtatccttatttttctaagtggataaggggacaccgtgacttgcccttgaaacttaatcaatggtgtaatgttgttagatgggaattcagtaatcctactccttttatcaggagccgtgagtttctttggcaagaaggacacactgcatttgcaacaaaggaggaagcagacaccgaggttcttgaaattcttgagctatacagacgtctgtatgaagagtacttagctgtccctgttgtgaaagggaagaaaagtgagatggaaaaatttgctggtggtctttacaccacaagtgtcgaggcattcatcccaaatactggccgtggtgtacaaggtgcaacttcacattgtttgggacaaaattttgccaaaatgtttgaaattaactttgaagatgaaaaaggagaaaaatctatggtgtggcaaaattcatgggcatacagtactagaacgataggggtgatggtgatggtgcatggtgatgataagggcttagtgttaccccctaaagttgcagcagtacaagttattatagtgaatgtaccattcaaagaagcagatactgacaaaataaaaaatgcatgtttggaaactgtaaaaactttatgtgatttaggtattcgtgctgaagctgatttaagagaaaattattcgcctggttggaaatattctcattgggaaatgaaaggtgttcctttgaggattgaaattggaccaagagatgtggccaataatcaggtggtggttgcgcgccgtgacaatggagaaaaagtcagtgttcccatggcggatttggtcaaagtcaaggatttgttggatgatgttcaacaaaatatgtttaatgttgctaaacaaaaaagggatgcgtgtgttgaagttataaaaacttgggatgaatttattaaagcgttagggcaaaagaaattgattttggctccatggtgtgatgaagaggaagtggagaaggaagtgaaaacaaagacaaaaggagagacaggagcggctaagacactttgttctccatttgaccagcccgaactgcccgaaggtacattgtgctttgcgtcggggaaacctgccaagaaatggacgtattggggacgaagctattaacaaaatttaaaatttggctttattgtttatgttttacttatattgaagcctttgaggaattatggtgttttactgtttggatattggaacgaatgttgatatactgttttttatctt

SEQ ID NO: 2391 - DNA, 1716 bp, Ambrosia trifida
taacgcagccacctctcatcatcgacagctacaatcccattacacttcgacgttgaccggaaaccaccacaaatcttcaccgacggtttgttatttcggtctctgaacttaacgacgttgaaaggtgaagatatggctggaaaaggagataagcctgctaagcaagataaatcagctgctgcttctaaatccagcaagggaaggaagaaggagactggtctaggtcttactaataccaaagacggaaacttcggagaatggtattctgaggttgttacaaatggtgaaatgatcgaatattatgaaatatccggctgttacatcctccgcccatggacaatggccatttgggagacaatgcaaaacttctttgatccagaaattaagaagatgaacattaaaacatgctattccccctttttgtgtccaataatgttctacaaaaagagaaggatcacatagagggttttgctcctgaggttgcttgggtcacaagatcaggtgactctgatttggaggttcctattgccattcgtccaactagtgaaactgtcatgtatccctatttttctaagtggatcaggggacaccgtgatttgcccttaagacttaatcagtggtgcaatgttgttcgatgggagttcagtaatcctactccatttatcaggagccgtgagtttctttggcaagaaggacacactgcatttgcaacacaagaggaggcagacactgaggttcttgagatccttgaattgtatagacgtctgtatgaagaatacttggctgttcctgttgtgaaagggagaaagagtgagttggagaagtttgctggcgggctctatactactagtgttgaggcctttattccaaataccggtcgaggtgtacaaggtgcaacctcacattgcttgggccagaactttgctaaaatgtttgagattaactttgaagatgaaaaaggagaaaaggctatggtctggcagaattcctgggcctatagtaccagaacgattggggtgatggtgatggttcatggtgatgataaaggcctggtgttgccccctaaagtttcagcagtgcaagtcattgtggtgcacgtgccttacaaagatgcagacgttaaggaaattatcaatgcatgttctgccactgtgaagactctatgtgaggctggtatccgtgctgaagcagaccttagagagaattattcgcctggctggaaatactctcattgggaaatgaaaggtgttcccctgaggatcgagattggaccaaaggaccttgctaataaccaggtgcgtgctgttcgtcgtgacaatggtgcaaaacttgacattccaatggcagacttggctgcttcagtaaagggtatgctggatactatccagcaaagcatgtttgatgttgctaagcaaaaacgggatgcttgcattcaagttacaaaaacatgggatgaatttattgaagcactaggtcaaaagaaattgattttggctccatggtgtgatgaagaggaagtcgagaaggaggtgaaagcaaaacaaaaggggagacgggggctgctaagacgctctgctctccattggtgcagccagaactccctcaaggtacattatgctttgcatccgggaaaccagacaaaaaagtggacgtactgggggcgaagttattagatatttgatgctcatgttttatggtactatactgaactgtgat

SEQ ID NO: 2392 - DNA, 1592 bp, Arnica chamissonis
tctcgacagcgcttccaccgcgaattgctcaccgccggcgttgactggaaagcagcacgaagctatggccggcgcaaagggagataagcctgctaaggccaataaatctgcttctgttgccaaatccagtaagggaaggaagaaggaaactggtctaggtcttacaaatactaaagatggcaattttggggaatggtattctgaggttgtgacaaatggtgaaatgatagaatattatgaaatatctggctgctacatcctccggccatggacaatggccatttgggagataatgcaaaatttctttgatccagaaattaagaagatgaagattaaaacttgctatttcccgctttttgtgtccaacaatgtgctacaaaaagagaaggatcacatagagggttttgctcctgaggttgcttgggtcacaagatcaggtgactctgatttggaggttcctattgccattcgtccaactagtgaaactgtcatgtatccctatttttctaagtggatcaggggacaccgtgatctgccattaaaacttaatcagtggtgcaatgttgttcgatgggagttcagtaatcctactccatttatcaggagccgtgagtttctttggcaagaagggcacactgcctttgcaacaaaagaggaggcagacactgaggttcttgaaattcttgaattgtatagacgtttgtatgaggagtacttggctgtccctgttgtgaaagggaagaagagtgagatggagaagtttgctggtgggctctatactaccagtgttgaggcctttattccacaaactggtcgaggtgtacaaggtgctacttcacattgcttgggccagaattttgctaaaatgtttgagattaactttgaagatgaaaaaggtgaaaaggctatggtctggcagaattcctgggcatatagcaccagaacgattggggtgatggtgatggttcatggtgacgataaaggcttggtgctgccccctaaagtttcagcagtacaagttattgtaattcatgtgccttacaaagatgcagatgttaaggaaataataaatgcatgttctgccactgtgaagaccctatgcgatttaggtatccgtgctgaagcagaccttagagagaattattcacctggttggaagtattctcattgggaaatgaaaggtgttcccctgaggattgaaataggaccaaaggaccttgctaataaccaggtgcgtgctgttcgtcgtgacaatggagaaaaaattgatattcctatggaagatttggttgataaagtaaagggtatgctggataatatccagcaaagcatgtttgatgttgctaagcaaaagcgagatgcttgtattcaagttacaaaaacatgggatgaatttatcgaagcattaggtcaaaagaaactgatcttggctccatggtgtgatgaagaggaagtcgagaaggaggtgaaaacgaagacaaaaggggagacgggggctgctaaaacactttgttctccatttgatcagccagaaatgcctgaaggcacattatgctttgcatcagggaaacctgcaaaaaaatggacgtact

SEQ ID NO: 2393 - DNA, 1902 bp, Silene vulgaris
tttaagctaagagctgctggattctttgtttgaccagcaacccttgtgcacctctcttcaaaaccccaatactccattaaaaaccttccaatcttcttccgattttcaccgttctctgtaatggcaagcaccggtgaaggcaaaggcaaaggcaaatcaacttcaaagtctggtgggaagaagaaggaggtgaagaaggaaaccgggttaggcttatctttcaagaaagatgagaactttggagaatggtactctgaggtggttgtgaatggtgagatgatcgagtattatgacatttctggatgctacatcttgaggccaacctcaatgtctatttgggatattttgaaagatttttttgatgacaaaatcaagaaaatgaagataaagaattgctattttccactatttgtatcccctggagtattggagaaggaaaaagatcacatcgaggggtttgcccctgaggttgcatgggttacaaagagtggaaaatctgatctagaagttccaattgccatacgacccaccagtgagactgtcatgtacccatacttctccaagtggattaggggacaccgtgatctgcccttgagacttaaccaatggtgtaatgttgtccgctgggagttcagcaatcctactccattcatcaggagtcgtgaatttctttggcaagagggtcatacagcttttgcaacacaggcagaggcagatgctgaggttcttcaaatattagaactctacaggcaggtatatgaagattatttggctgttcccgttgtcaagggaaagaaaagtgaattggagaagtttgccgggggttactatactaccagtgttgaggcttttattccacatactggacgtggtgtacaaggtgcaacttctcattgtttgggtcaaaatttcgcaaagatgtttgatataacttttgaaaacgaaaagggagaaaaggcaatggtttggcagaactcgtgggcatatagtactcgaacgataggggtgatggtgatgacacacggtgatgacaagggattggtcttgcccccgaaggtggcagaattgcaaatcatagtggtgcctgttcctttcaaagacgcagacatgcaaggaatctatgatgcttgtacttctacagtcaacactttgattgatgctggtttccgagccgaggcagatcttcgggacaattattctccaggttggaagtactcacagtgggagatgaaaggtgtgcctttgagaattgaaattggcccaaaggatttggctaagagtcaggttcgtgttgtccgacgtgacaactctgccaaggtggatatacccatggctgatttggtggatcaggtgaaagaagtgctggatcaaattcaacaaaatttgtttgaagtggctaaacaaaagagagatgcatgcatccaagtaattaagacctgggaggaatttgccgatgccttagctcacaagaaattaattttagctccctggtgtgatgaggaggcagttgagaaagatgtaaaagcgcgaaccaagggtgaaatgggagcagcgaagactctatgtaccccgtttgaccagccagagatggaggaaggaaccgtttgctttgcttcgggaaaacccgctaagaagtggacttattggggaaggagttactaatccattaccaatttaccatcatatgtgagggttaaggccagaagttctggtactagtgaaagaccatctcacaagctgttctcttcccatagacttcgatttgtgttttagttaaattcatgatctctattgaagcaaaattgaaaatttcaattagctttcgtagttatctttttcgcttgaacaagttttgtgcaagatagtcgtatgctaagatggatataataccatactattaag

SEQ ID NO: 2394 - DNA, 1736 bp, Arabidopsis lyrata
aagaagaaggttgaaaatggctggtcccagtgaaaagaaagaaaaggttaaaaaagaaaaggttgtgaaagaaaaggttgcaaaggcttcttctattggacagaagaaaaaggacgtcaagaaggaaacgggtcttggactcagcgttaagaaagatgagaatttcggggattggtattctgaggtttgtaaacaagatatgattgagtactatgatatctctggatgttatattcttaggccatggtccatggccatttgggagattatgcaaattttctttgatgcggaaatcaagaaaatgaaggtcaagaattgctatttccctctgtttgtatctcctgctgtcttagagaaggagaaggaccacattgagggattcgctccagaggttgcttgggttacaaagtcaggtaaatctgacttggaaatcccaattgctattcgtccaaccagtgagactgtgatgtacccttactacagcaagtggataagggggcaccgtgacttgcctttgaagcttaaccagtggtgcaatgttgttagatgggagttcagcaaccctaccccatttatccggagccgtgagttcctttggcaggaaggtcacactgcattcgccacgaaagcagaagcagatgaagaggtccttcaaattttggagctttaccgtcgcatatatgaagaatatcttgcagttccagttgtgaaaggtatgaagagtgaaaatgagaagtttgctgggggactttacactacaagtgtagaggccttcattccaaacactggtcgtggtgtacaaggtgcaacctctcactgtttgggtcaaaactttgcgaagatgtttgagatcaactatgagaatgagaaagcagagacagcaatggtgtggcagaattcttgggcctacagtaccaggacgattggagtgatgattatgactcatggagatgacaaaggcctggtactccctcctaaagtcgcatctgtgcaagttgttgtgatccccgtgccctacaaagatgctaatacccaaggaatttatgatgcttgtactgctactgcatctgccttgtgtgaagccggtatccgtgctgaagaagatttaagggacaactactctcctggatggaagtattcagactgggaaatgaagggtgttccattgaggattgagattggtcccagagacctggaaaatgatcaggtcagaactgtgagacgtgacaacggagttaaggaagatatcccaagaggtagcttagtcgaaaatgttaaggaactgcttgagaagatccagcaaaacatgtatgaagttgcgaagcaaaagagggaagcatgtgttcaagaggtaaagacttgggatgagtttatcaaagcacttaacgaaaagaaactcatcttagctccctggtgtgacgaagaggaagtggagagagatgttaaggcacgtactaaaggtgaaactggagcagctaaaaccctttgttctccatttgatcagccagaactccctgaaggcactctctgctttgcttcaggaaagcctgccaagaaatggacctattggggcaggagttactaagtgttcatcatgttttgattcaattcatgaaaatttacttttgtcttgtaaagactctctcaagtgcattgtgctttgatctgatattttgaccaatttgagttattttgactgtgattacgctaagaattataaagagttgtcttcttca

SEQ ID NO: 2395 - DNA, 1659 bp, Eschscholzia californica
gtgaaaaaggagactggacttggtctctcgcacaaaaaagatgtaaattttggtagaatggtactccgaggttgttgttagtggtgagatgatcgaatactacgatatctctggctgttatattctgaggccatggtcaatgtctatttgggaaattatgcaagtcttctttgatgctgaaattaagaaaatgaaaatcaagaactgttacttccctgttttcgtgtccccaggtgttttacaaagggagaaggatcatattgaaggttttgctccagaggttgcatgggttacaaagtctggagacactgatttagaggttccaattgcaatccgtcctacaagtgagaccgtcatgtatccctactattcaaaatggattaggggacatcgtgacttacctttgaggcttaatcagtggtgcaatgttgttcggtgggagtttagcaaccctactcccttcatcaggagtcgtgagtttctctggcaagaaggccatacagctttttgcaacgaaggcagaagcagataaagaggttcttgaaatattggagctgtatcgaaggatttatgaagaatttttggctatcccagttgtgaagggaagaaaagtgagaatgaaaagtttgctggtggcctttatacaacaagtgttgaggcttttattccaaacactggtcgtgggatacaaggtgcaacctcacattgtcttggtcaaaactttgcaaaaatgtttgagataaactttgagaatgagaagggagaaaaaggaatggtttggcagaattcatgggcatacagcactcgaacgattggggtgatggtaatggttcatggagatgacaaaggcttggtgttgccacccaaagtagcatctgtccaagtcattgtgattcctgtaccatacaaagatgccgatatgcaagcaatctttgatgcctgctcctccacagtggaaaagttgaacgaagctggttttcgtgcggaggcagatctaagagacaattactcacctggctggaagtattctcattgggaattaaagggtgttcctttgaggattgagatagggccaaaggacatggctaataatcaggtgcgtgttgttcgtcgagataatggatcaaaagtggatataccaaatgcaaacttagttgaccagattaaagatgtattggacaatatccaacaaagcctgtttgatgctgcaaagctaaaacgagatgctagtgtaacaattgcaaaaacatgggaagaatttataactgctcttaatgagaagaaaatgatcttagctccttggtgtgacgaagaggaagttgaaagagacgtgaaagcacgtactaagggtgaaacaggggctgccaaaaccctttgcactcctttcgatcagcctgaacttccagaggggactctatgctttgcatcgggaaagcctgcgacgaaatggacatattggggtagaagctactaaacaaactgttgcctgttaccgaaccatgagctgcttgattgctcataggactctgcttaatttctgtaatttctctttttttttctgaaaccggaggaagcctaggtcttgtaagtattttgtaatttcgttggttttgtttagttacaaaaagtaacgtaatttaaattaaagaactactagta

SEQ ID NO: 2396 - DNA, 3441 bp, Plantago ovata
taacaagagggaaaggatcaaaccaatgcctcattttttttcgacacttgaaatcttgttactgactttcatcatcatctttgcaaattcatactattacagcatgtaataatgatcccagtaagcatatgagctcttgtttaatagcagtacatatcttcttcatccaaaacccaatcacagtacaatttgaaatacacaactcttcttctactagtacaaattaatattaatatcaatgagaaaattgaataggttgatgaagcgtcttgaccaatgttcaaaaatcaaatctatcagacttttaggctcagaactcggaagaaagaaaaagaataggagaaagagatataaggaaaaccaaatgagaagcagtatcaacaatcttgttttgtgattgattctctggtgtctttcacacggtttagaagcactttctgtgaacgatagaaggacccgattcatcatactcagctttcgctatccacatctgctggaatgtgctaagagaggccaagatggatcctccgatccagacactgtacttcctctcaggtggagcaacgaccttaatcttcatgctgcttggggctagagctgtaatttccttgctcatcctgtcagcaatacccgggaacatggtggtcccaccactgagcacgatatttccatacagatccttcctgatatcaacgtcacacttcatgatcgaattgtaagtggtctcgtgaataccagaagattccattcctatcatggacggctggaagagaacctcaggacaacggaacctttcagcacctatagtgatgacctgtccatcaggaagttcatagttcttttccacggagagctcgtgtttgcggtttctagctcttgttcataatcaagagcaatgtaagccaacttctcttttatgtccctcacaatttctcgctcggcagaggtggtgaaagagtaacctctctctgtcagaatcttcatgaggtggtcggttaaatcacgaccagccagatcaagacgcagaatagcatggggaagtgcataaccttcatagatgggcacggtatggctgacaccatcaccagagtcgagaacaataccagttgtacgaccactggcataaagggagaggacggcctggatggcaacatacatagccggggcgttaaatgtctcaaacatgatctgagtcatcttctcacgattggccttgggattaagaggagcttccgtcaaaagaattgggtgttcctctggagccacacgaagctcgttgtagaaggtgtgatgccaaatcttctccatatcatcccagttgctgacaataccgtgctcaatagggtacttcaatgtcaagatacctctcttggattgagcttcgtcaccaacgtaagcatccttttgccccatgcctaccatgacaccagtgtgacgaggtctccccacaatactggggaagacagcccttggagcatcatctccagcaaacccagccttgaccattccagttccattgtcacagacaaggggctgaatatcctcagattctgccatctgttataataatatattctttgattgaaatgagtttctgtgtgtggtttgattctcgatgagtgaaagagagaggcacaagaaggagactggccttggtctctcttttaagaaggatgaaaatttcggggagtggtactccgagatcgttgtcaatggggagatgatcgagtactatgacatatctggttgctacattctgcggccctgggcaatgtctatttgggagatcatgcatgatttttttgatgctgaaatcaagaaaatgaaaatcaagaattgctatttccctctatttgtttcttctaacgtcctacagaaggagaaggaccatattgagggtttttgctcctgaggttgcttgggtcacaaagtctggcgaatctgagctggagatgcccattgcaatccgtccaactagtgaaactgttatgtatccatatttctcaaaatggattaggggccaccgtgacttgcccctcagacttaaccaatggtgtaatgttgttagatgggagttcagcaatcccaccccatttatcaggagccgtgagttcctctggcaggaggggcatacagcatttgcgaccaaggaggaggctgatgcggaggttcttgacatactggaactctacagacgtatatatgaagagtttttggcagttcctgtttttaagggcagaaagagtgaacacgagaagtttgctggaggactttatacgactagcattgaggccttcattccaaacactggacgtggtgtgcaaggtgcaacttcacactgtctcggtcagaattttgcaaagatgtttgaaattaactttgaaaacgagaaaggagaaaagggcatggtgtggcagaactcctgggcttatactaccagaactataggagtgatgattatggttcatggagatgataaaggcttggtactgcctcctaaagtggcatctcttcaagtaatcgtaattccagtgccctataaggatgctgacatgcaaggaatctataaggcttgtgaagacactgtaaaatccttgactgaggcagggcttcgagctgagtctgatcttagagataactattctccaggttggaaatattccaattgggaattgaaaggtgttcccattagaattgagataggaccgaaagattttgagaaaaatcaggtccgtgctgtcagacgtgacaatggagctaaatctgacattccaatggctgatttggtagagaaggtgaatgaaatgcttgataacattcaaaaaagtctctttgatgctgccaagcaaaaaagagatgcctgcattcaggtcgtacacacatgggaagaatttaccgaagcacttggacagaggaagatgattttagccccatggtgtgatgaggaggaagtggaaaaagatgtgaaagcccgtaccaagggggaaatgggagctgcaaagaccttgtgtactccttttgcccagcctgaactcccagaaggtaccttatgctttgcttctggaaagcctgtgaaaaagtggacttactggggcaggagttattgataaacttttaattgggttgtgctattcttgacatatacacaggttatatagatttgtttaattatgacaggcatgtctgatcatcctagtgctttgtacactctttttggtgttgcttcctgtgatgaaaatttggtttttctgaaccttttagttcgtgtattattgcatttgcatcgccgtgaatcagtgagcggcaccagcctgtttcttcagttgagttcccctcttagccttaggtgattataaagctgatcaaatagctttctgaaaagctaaaagctaatttatgaagatttccgactttatctccgtgtaattgtttgcctgtgac

SEQ ID NO: 2397 - DNA, 1840 bp, Eutrema parvulum
gaattgaaagaaaagatttaaaatggctggtccaagtggaaagaaagaaaaggttgaaaaggctggtccaagtggaaagaaagaaaaagttgaaaaggctggtccaggtggtggaaaaaagaagaaggatgtcaagaaggaaacaggtctcgggctcagtgttaagaaagatgagaatttcggggaatggtattctgaggtctgtaaacacgagatgattgaatactacgatatctctggatgttatatccttaggccatggtcaatggcgatttgggagatcatgcaaagtttctttgatgcggaaatcaagaaaatgaaggtcaagaattgctacttcccactgttcgtatctcctggtgtcctggagaaggagaaggaccacgtggagggtttcgccccagaggttgcttgggttacaaagtcgggcaaatctgacttggaagtcccaattgctattcgtccaaccagtgagacagtgatgtacccttactacagcaagtggataagggggcaccgtgacttgcctttgaagcttaaccagtggtgcaatgttgttagatgggagttcagcaaccctaccccatttatccggagccgtgaattcctttggcaggaagggcacactgctttcgccacgaaagaagaagcagatgaagaggtccttcaaattttggagctttaccgtcgcatatatgaagagtatctcgcagtcccagttgtgaaaggtatgaagagtgaaaatgagaagtttgctgggggactttacactacaagtgtagaggctttcattccaaacacaggtcgtggtgtacaaggtgcaacctctcattgtctgggacaaaactttgcgaagatgtttgagatcaactatgagaatgagaaaggagagacggcaatggtgtggcagaattcttgggcctacagtactaggacgattggagtaatgattatgactcatggagatgacaaaggcctgatacttcctcctaaagttgcatctgtgcaagttgttgtgatccctgtgccctacaaagatgctaatacccaaggaatttttgatgcttgtactgctactgtatctgccttgttagaagccggtatccgcgctgaagaagatttaagggacaactactctcctggatggaagtattcaaactgggaaatgaagggtgtcccattgagaattgagattggaccccgagatctggaaaatgatcaggtcagaactgtgagacgtgacaacggagttaaggaagatatcccaagaggtagcttagtcaaacacgttaaggaactgcttgacacgatccagcaaaacatgtttgaagtggcgaagcaaaagagggaagcatgtgttcaagaaattaagacttgggatgagtttgttgaagctctcaacacaaagaaactcatcttagctccctggtgcgatgaagaggaagtggagagagatgtcaaggcacgtactaaaggtgaaactggagcagctaaaaccctttgttctccatttgaacagccagaactccctgaaggcactctctgctttgcatctggaaagcctgcgaagaaatggacctattggggcaggagttactaagtgttaaccatgttttcgttcaattcatgaaatttacttttggcttgtaaaaactcgcaagttcattgtgctttgatttgatattttgattgaaagctattttagtttctcaactgtaattgcactatgaactacaatgtgctgcttttgtttcaaaacaaactgttagaagaaggagaaaaatcagttgaaatttaagaaaccagaaatagctcttaaatccactgcttgtggggaact

SEQ ID NO: 2398 - DNA, 1965 bp, Papaver somniferum
ctcttaggttttccgcctttctcccttcttttatctctcccactatctccattggtcgtcgctgcaacaacttattagggcacagatttctggaattgatttcacagtactactacctctagctgtctgtcatggaggatgtgaatgaaaaagtggcaaatttggacgtgactaacaaaaaggagaaaaaacacccaagttaaagccctaagactactggtggtggaagcagcggtggcggcgccggtggtggaaaaaagaaggaggtcaaaaaggagactggtctaggtttatctaataagaaagatgaaaatttcggagattggtattctgaggttgttgtcagtggtgaaatgattgaatactatgatatctcggggtgttatatcctcaggccatggtctatggctatttgggaaattatgcaaacattcttcgatgccgaaattaagaaaatgaagatcaagaattgctatttccctgtgtttgtatcttctactgtgttacagaaagaaaaggatcacattgagggcttcgccccagaggttgcatgggtcacgaagtctggagatacagacttagaggttcctattgcaattcgtcctacgagtgaaacagttatgtatccctacttttcaaaatggataagaggtcatcgtgacttgcccttgaggcttaaccagtggtgcaatgttgttcgctgggaattcagcaatcctactcccttcatcaggagtcgtgaatttctttggcaagaagggcatacggcttttgcaacaaaggatgaagcagatcaagaggttcttgaagttttggaactgtatcggagaatttatgaagagttcttggcaatcccagtggtgaaggggaagaaaagtgagaatgaaaagtttgctggaggtttgtatacaacaagtgttgaggcttttgttccaaatactggtcgtggagtacaaggtgcaacctcacattgcctcggccaaaattttgcaaaaatgtttgagatcaactttgagaacgagaagggagaaaagggcatggtgtggcaaaattcttgggcatacagcactcgaacgattggagtgatggtgatggttcatggagatgacaaggggttagtattgccacctaaagttgcatcagtgcaagtcatagtgattcctgtgccttacaaagatgccgacactcaagccatctgtgatgcttgttccgaaactgcagaagagttaaataaagctggtttccgtgctgagacagatctaagagacaactactcacctggttggaagtattcaaactgggaattgaaaggagttcccttgaggattgagataggtccaaaggatatggccaaaaaccaggtacgtgttgttcgccgagacaatggagcaaaagaggatatctcaagaaccaacttggttgatcatattaaggacttgctggaaaatgtccaacaaagcctatttgatgctgcaaagcaaaaacgcgatgcttgtgttaccgtagccaagacatgggaagagtttaccaaggccctaaatgagaagaggatgatcttagctccttggtgcgatgaggaggaagttgagagagatgttaaagcacgtaccaagggtgagatgggagcatgcaagactctttgcaccccttttgatcagccagagctcccagaggggacgctatgctttgcctccggaaaacctgctaaaaagtggacttattggggaagaagctactagttctactggtgttatttgaaagcaggtataagtgttcgtctgcaacagttaaaagagtaggaaaccagttgtgagatttttgaaagtagaggattctttttttttgctatcctggaaatttctgttctggatttcgtcttgaaattttctgtttattgaatttaatgaatccaaattcataaattttggaacaacaaaggtttattgaatcgaaattaagtcttac

SEQ ID NO: 2399 - DNA, 1888 bp, Aquilegia formosa
aatctcccggcgttgtaatacttgattatggataacaatcaggaagaaaaagtgatgaatagtttaaaagaaattgaaattgaatcttctactgacaacaaaaacaacaacaaagcaaagaaggagaagaagaaaccttcatcttcatcatcagacaaaaagactggtggtggtggtagtaaaaagaaggaagtgaagaaagaaacaggtctcggtttaacaaataagaaagatgacaactttggtgaatggtattcggaagttgttgtagctagtgagatgattgagtattatgatatttcgggttgttacattctcagaccatggactatgtctatctgggaaattatgcaaactttctttgatgcagagattaagaagatgaaagtcaagaattgctatttccctgtctttgtttctggaagtgctttaagacgagaagaagatcacattgagggttttgctcctgaggttgcttgggttaccaagtctggagatactgaattagatctcccaattgcaatccgtccaacaagtgagacagtcatgtatccctactattcaaaatggataaggggacaccgtgatctaccattgaagcttaatcaatggtgtaatgtcgtccgttgggagtttagccatcctactccttttatcaggagccgtgagtttctttggcaagaagggcatactgcttttgctacgaaggaggaagcagatgaagaggttcttgatatattggagttgtaccgaagggtatatgaagagtttttagcaattccagttgtaaaggggaagaaaagtgagctcgaaaagtttgctggtgggctttacacaacgagtgttgaggccttcataccaaatactggtcgtggcatacaaggtgcgacctctcattgccttggtcagaacttcgccaagatgtttgatataaattttgagaatgagaagggagaaaggggcatggtctggcagaactcctgggcgtacagcactagaacgattggtgtgatggtaatggttcacagtgacgacaaaggtttggtgctaccacctaaagtcgcatcagtccaggtggtggtggttcccgtgccttacaaggatgctgacatgcaaggcatctttgatgcatgcaccaatactgtcaaaacattgaatgaagctggtttccgtgctgaggaggatttaagagaaaattactcgcctggttggaaatactctcattgggaaatgaaaggtgttcctgtgaggattgagattgggccaaaagacatggctaataaacaggttcgtgtcgtccggcgtgacaattcgtctaagatggatataccaacatccaatttggtagaaaaaattaaggatgttcttgacgatattcagcaaagcctttttgattctgcaaagcagaaaagagatgcttgcattaaagttgcaaaaacatgggaagagttcaccacagctttgaatgagaagaaattgattctagcgccatggtgcgacgaggaggaagttgagaaagatgtgaaagcgcgcaccaagggtgagatgggagcatgcaagactctttgcaccccttttgaccagcccgaacttccagaaggaacactatgctttgcctccggaaagctcgccaagaagtggacctattggggtaggagctactagttgcagcaaacattgacacgtagagtcgcaactggcggtgataagtataaaaaatggaacaatttgcttatggaggcagtgtacttggtttccttgaaaatttatttttaagtgtttgaaatttgaaatataggtctttgagcatgtcacacggattctggtttttgatgattatttagattatacagctttacaattcttaatacacaacttctcattggtc

SEQ ID NO: 2400 - DNA, 1735 bp, Artemisia annua
aagagatccggtggtgaaagaaaagaaaaaaaagaaaaggctgctggtagtaaaggagataataagcctgctgctcctcctactaaatctgctaagggaagaaagaaggagactggtctaggtctcacgaataccaaggatggtaactttggagaatggtattctgaggtggttacaaatggggagatgatagaatactatgaaatatctggctgttacattctccgtccatggacaatggccatttgggagacaatgcaaaactttttcgatccagagattaagaagatgaatatcaaaacatgttacttcccactttttgtgtccaatacggttctacaaaaggagaaggatcacatagagggttttgcccctgaggttgcttgggtaacgagatcaggtagctccgatttggaagttcctattgccattcgcccaaccagtgaaactgtcatgtatccctacttttctaagtggatcaggggacaccgtgacttgcccttaagactaaatcaatggtgcaatgttgttcgctgggagttcagtaatcctactccctttatcaggagtcgtgagtttctttggcaagaaggacacactgcctttgcaacaaaggaggaggctgacactgaggttcttgaaatacttgaactgtatagacgtctttacgaggagtatttggccgtccctgttgtgaaagggaaaaagagtgagctggagaagtttgctggtgggctatatactactagtgtggaggcctttattccaaatactggtcgtggtgtacaaggtgcaacttcacattgcttgggccagaattttgctaagatgtttgagattaactttgaagatgagaagggagaaaaggctatggtgtggcagaactcatgggcttatagcacaagaaccattggtgtgatggttatggttcatggggatgataaaggcctggtgttgcctcctaaaatctcagcagtacaagttattgtgattcacgtgccttttaaagatgcagatgtcaaagaaataatgaatgcttgttcggcgactgtgaaagcattatgtgatttaggtattcgtgccgaggcagaccttcgagagaattattcgcctggttggaagtattctcattgggaaatgaagggtgttcccttgaggattgaaataggaccaaaggatctagctaataaccaggttcgtgctgttcgtcgggacaatggatcaaaggtcgatcttcctatggcagatttgggtgagaaagttaagggtatgttggatgatattcagcaaagcatgtttgatgttgctaaagaaaaaagagatgcatgtattcaagttaccaaaacttgggatgagttcattgaagcattaggccaaaagaaattgatcttggctccatggtgtgatgaagaggaagtcgagaaggatgtgaaagctaagacaaaaggggaggtcggagctgctaagacactttgttctccatttgaccagcctgaactgcctgaaggaacgctatgctttgcatcgggaaaacctgctaagaaatggacgtactggggacgaagctattaaccacactatcattgggttgattttgttgttttccatttaccatactaaaacccttgatgaatgcaggcagggtttaaccctttgctatattagccttttttttgtgtttaaaatcgaaacaatggttcatattacgagagttttgatcttctgtggaaatgac

SEQ ID NO: 2401 - DNA, 1736 bp, Amaranthus tuberculatus
ctggtggtaagaagaaggaagtcaagaaagagactggtttaggattgactcacaaaaaggatgataattttggggagtggtattctgaggttgttgtcaatgctgagatgatagaatattacgatatctctggctgttacattttgaggccttggactatggctatttgggaggctatgcaagaattttttgatgctgaaatcaagaaaatgaagataaagaactgctacttccctctgtttgtatcacccggtgtgctgcagaaggagaaagaccacattgagggttttgccccagaggttgcatgggtgaccaagtctggacaatctgagttggaagtgccaattgctattcgtcccactagtgagaccgttatgtatccatattattcaaagtggatcaggggacatcgtgacttgcccttaagactgaatcagtggtgtaatgttgtccgttgggaattcagcaatcctactcctttcatccggagtcgtgaatttctctggcaagaaggtcatactgctttcgcgacacaggaagaagcagatgccgaggttctcgacatattggaactctacaggaaaatatatgaagaatttttggctgttccagtgatcaagggcaaaaaaagtgaaatggagaagtttgctggtggatactacacaactagtgttgaggcttttattcccaacactggacgtggagtacaaggtgcaacttcacactgtttaggtcaaaattttgcaaagatgtttgaaatcacttatgaaaatgagaaaggagagaaagcaatggtgtggcagaactcatgggcgtacagtactagaacgattggggtcatggtgatgacacatggtgatgacaaaggcctagttttgcctccaaaagttgcagctgttcaagtcatagtggtgcctgtccctttcaaagatgcaaatacacaaggaatctttgatgcatgttctaataccgtaaaagtattgagtgaagcaggtattcgggctgaagcagatcttagggataactattctccaggttggaagtactcacattgggaaatgaaaggtgttcctttgagacttgagattggaccaaaggatttagccaatagtcaggttcgtgctgtacgacgtgacaattcggcgaagaaggatctgccaatggctaatctggttgacgaggtcaaagaacttctggatgcaatccagaagaatttgtatgatcttgcaaaggaaaagagagatgcatgcgttcaaaaggttaggacgtgggatgagtttgttgaggctttggctcagaagaagctgatctttgctccttggtgtgatgaagaggaagttgagaaagacgtcaaagctcgaacaaagggtgagatgggagctgccaagactttgtgctcaccatttgaccagccagagatggaagaaggtaccctttgctttgcttccggaaagccagctaagaagtggacgtattggggcagaagctactaattataatctgcaaatgcaagctcctgtaatttttacatgaaagatgccactcactactcaagatactgtgcatttcttctaatacaatcatattatagataggtcttttggagtttttgtatttttgacactaccagaattgggtgttatttgtctcggactttatagagcgcatcaatatgtcaaggatctttttgttgtacaattcatttttatcaatagtggttacttgatgaagagttt

SEQ ID NO: 2402 - DNA, 1950 bp, Trifolium pratense
aggagagagagtcaattcattacgccaccatcgctcttgcacgctcaattctccctcgccttctgtcaaacaggatcaggtgttcctcctccttcacaatggcggggaccgaagccaccaaacaacaatccggcgccggtgccaaacaacctaaacaacctaaaccacaaaaacaacaacaatctggtggtgggaagaagaaagaagtgaagaaagaaactggattaggtctaaccaataagaaggctgacaatttcggcgagtggtactctgaggttgttgttaatggtgaaatgatcgagtattatgacatttctggttgctatattcttagaccttggtcaatggctatttgggagaatatgcaagcattttttgatccagaaattaagaagatgaagatcaagaactgctacttccctgtttttgtttcttctactgttctggaaaaggagaaggaccatattgagggttttgctccagaggtggcttgggtcacaagatctggaaaatcggagctagaaattcctattgccattcgtccaaccagtgaaacagttatgtacccctactactccaagtggattaggggacacagagacttgccactaaaacttaatcagtggtgcaatgttgtaagatgggagttcagcaatcctacaccattcatcaggagtcgcgagtttctttggcaagaaggacacactgcttttgctactaaggaggaagcagatacagaggttcttgagattttggaattatataggcgtatatacgaagagtatttggcagttcctgtcataaagggtaagaaaagtgagcttgagaagtttgcgggtggactttacactaccagtgttgaggcatttattccaaatactggtcgtggcattcaaggtgcaacttctcattgtttgggacagaattttgcgaagatgtttgacataaactatgaaaatgagaagggagagagagcaatggtctggcagaactcatgggcctacagtacccgaactattggggtgatggtgatggttcatggtgatgataagggattggtgctgcctcctaaagtagcatcagttcaagttattgtgattcctgtgccttacaaagacgccgatactcaaggaatcttggatgcctgttctgcaactgtgactgcgttggtggaagcaggaatacgcgctgagtcagattctagagataactattctcctggatggaagtattctcagtgggaaatgaaaggtgttcctctaaggattgaaattgggccaaaggatttagcaaataagcaggttcgcgctgttcgtcgtgatagtggagcaaaaatagacattgctaatgctgatttggttgaggaaataaagaagttgctcgataatattcaacagaatctgtttgatgttgctaaacaaaagcgagatgagtgtattcaggtcatacatacatgggatgagtttatagaagctttaaatcagaaaaagatgatattagctccttgggctgatgagaaggaggttgaagaagatgtcaaagcaaggacaaagggtgagactggagcagcaaagacactctgcagtccctttgatcagccagaactccccgaaggtaccacatgctttgcgtccggcaagcctgcaaagaagtggtcatactggggcagaagttactagatcttgattatggtattttctgaggctagttcaacatttaatggtgcattgtatgaatttgtggattatgcaaatattagttttcttctgcttgagtaacttttcaatttatagttttactttgatttttatactgtgcaatatttagtcggctttaaagaagagtattattttaactttttccgtttgaatagaaagccaatggaatggaaaattgattgaacaatccaatcctggtaccaaatgttacattagatttagaggtcatgtc

SEQ ID NO: 2403 - DNA, 1909 bp, Prunus persica
ctgtcttgtttctttctttattctcacaagaggaggctaaggagcgagaagaagagagaagccaaaactgcgagccgcaaacttaaccaaccagattcaattttggttgaaaacatccaaacatggccgatgccggtgctaagaagtctaacaccgatgccggtgctaagaagtctaacaccaatgccaagagtggagggaaaaagaaggaggtgaagaaagaaactggcctcggtctttccaaaaagaaggatgagaattttggagagtggtattctgaggttgttgttcatagtgagatgattgaatactatgatatctccggttgttatattttaaggccatggacgatgtcaatatgggagacgatgcaagcattcttcgatgcagaaataaagagaatgaaggtaaaaaatacctatttccctttgtttgtctccccaggtgttctggaaaaagagaaggatcatgtagagggttttgctccagaggttgcttgggtcacaaagtctggaaaatctgaattggaagtgccaatagcaatacgtccaacaagtgagactgttatgtatccttatttctctaagtggatcagaggacaccgtgacttacctttgaagctaaatcaatggtgtaatgttgttcgatgggagttcagcaatcctacaccatttatcaggagtcgggagtttctttggcaagaaggccatacagctttcgcaacacaggcggaggcagatgaagaagttcttgagatattggaattatacagaaggatatatgaggaatatttggcaattccagttgtgaagggaaagaagagtgagcttgagaaatttgctggtggcctttacactacaagtgtggaggcttttattccaaatactggccgcggtgtacaaggtgctacctcgcattgtttgggtcaaaattttgctaaaatgtttgggatagagtttgaaaatgaaaaaggtggaaaggccatggtttggcaaaactcttgggcatatagcactcgaacgattggagtgatggtgatggttcatggagatgacaaaggcttggtattgccacctaaagtggcagctacccaggttattgtggttccagtgccttacaaggatactaatacaaaagaaatgtttgaagcttgcttgagaactgtggataccttgaccgaagcaggatttcgtgttgaggcagatttaagggacaactatggtccaggttggaagtattcacattgggaaatgaaaggtgttcctctaaggattgaaattggaccacgggatttggaaaaaaaacaagtacgcctggcccgccgtgacaattcagataaactggacattcctgtgagcaatttggttgagcaagtaaaagatatcttggatagaattcaggaaaatctgtttgaggtggcaaaacaaaagcgagatgcttctatcagggttgcaaagacatgggatgaatttatggaagctctaaaccaaaagaaaatgatcttggctccttggtgtgacgaaatggaagtagaggaggatgtgaaaaaacgaacgaagggtgaaattggagcagccaagtcactctgcaccccattcgagcagcctgaacttcccgaagggacactttgctttgcctccggaaagccagcaaagaagtggacttactggggcaggagttactagacaacatttccaaatcatgctgttaattaccgccctttattttgctgatgtttttacatttcctatttggcttaagagagaaattttgagtgacccaaaaattgtttgccagggcgttacttctgtagttcacatataatacaatacttgtgataaatttatattgtagacatgattgtttattaatatcttaaatgaatttgggtggtacgtggagatattaa

SEQ ID NO: 2404 - DNA, 1889 bp, Fragaria vesca
tctctctctctctctaaacccttctctttccgaacgcagccactagattcctcgcggttagaagaatcaggacatggctgacattgctgacaagaagcctaatgtcaatgccaaggtgaagaaggccaaaggtggaggtggaggaggtggtggcggtggtgggaagaagaaggaggtgaagaaggaaaccggcctcggtttgaccaagaagaaggatgagaatttcggggagtggtattcggaggttgttgttcacggtgagatgattgagtactatgacatctctggatgttatatattgaggccatggacaatggcgatatgggagatcatgcaagcattcttcgatgctgaaataaagaaaatgaagattaaaaattgctactttcctttgttcgtctcccctgcagttctggaaaaagagaaggatcatatagaggggtttgctccagaggttgcttgggttacaaagtctggaaaatctgaattagaagtgcctattgcaatccgtcctacgagtgagactgttatgtatccttattactcgaagtggattagaggacaccgtgacttaccattgaagttaaatcagtggtgcaatgttgttcgatgggagtttagcaatcccactccatttatcaggagccgggagtttctttggcaagaaggccatacagcttttgcaacaaaggaagaggcggataaagaggtccttgagatattggaactgtacagaaggatatatgaggaatttttggcaattccagttgtgaaggggaagaagagtgagaatgagaaatttgctggtggtctttacaccacaagtgttgaggcttttgttccaaatactggccgtggtgtccaaggtgccacttcacattgtctaggtcaaaactttgctaaaatgtttgacattacttttgaaaatgaaaagggagaaaaagcgatgatttggcaaaactcttgggcgtatagtacccgaacgattggagtgatggtaatggtgcacggagatgacaaaggcttagtattgccaccaaaggtagcatctgtccaggccgtagtgattccagtgcctttcaaggatgctgatacacaagctatatttgatgcctgcttgaaaactgtggaggagttgactgaagctggacttcgtgtcgaggctgatttgagggacaactactcacctggttggaaatattcgcactgggaactgaaaggtgttcctctacggattgaaattggaccaaaggatttggagaagaaacaagtacgcttggctcggcgtgacaattcttcgaaagtggacattcctatggttgacttggtcaaggaagtcaaagagacccttgagaagattcaacaaaatctctttgatgttgcaaaacaaaagagagatgcgtctattcagcttgccaagacatgggatgagttcacggcagccttgggtgaaaagaaactgattctggcaccttggtgtgatgaacaggcggtagaagaggatgtaaaagcgcgaacaaagggtgaaattggagcagcaaagtcgttatgctcgccatttgaccagcctgaactccctgaaggaacactttgctttgcatctggaaagccagcaaagaagtggacttattggggcaggagctactaaatgcacttctccacttacgccgtctgttatttgtcagacgtttgaaatttgggtgaactttgaaactcgcttgagtattactttttgtagtttatattgaacaaatacacaagctctatactagacatgtagacattatgacattgttatctgtatcgtgcaatgtgttatctaggcaccaagcacttgtggttatattggtctggtgttttaatgtgattttcagtctatatgcggtgtt

SEQ ID NO: 2405 - DNA, 1830 bp, Cichorium intybus
ttccctcgatccaaattgctgcgacgccggcggttgaccggaaaatagcaacaagaattcggacaggggagagattcctgcttcttcttctcgtttatcaacggcttccaagcaattgtgcttcgccacaactgaaagtcaaaagacatggctggtggaaagggagaaaaatctgctaatgccaagaaatccgcagatgcgaagtctagtaagggaaggaagaaggagactggtctaggtcttactaacactaaagatggaaactttggagaatggtattctgaggttgttacaaatggtgaaatgattgaatactatgaaatatctggctgttacatccttcgtccatggacaatgtccatttgggagataatgcaatcatactttgatgcagaaatcaagaagatgaagatcaaaacttgctacttcccactttttgtatccaacactgttcttcaaaaagagaaggatcacatcgagggttttgctcctgaggttgcttgggtgacaagatcaggtgattctgatttggaagttcctattgctattcgtccaacaagtgaaactgtcatgtatccttatttttctaagtggataaggggacaccgtgacttgcccttgaaacttaatcaatggtgtaatgttgttagatgggaattcagtaatcctactccttttatcaggagccgtgagtttctatggcaagaaggacacactgcatttgcaacaaaggaggaagcagacaccgaggttcttgaaattcttgagctatacagacgtctgtatgaagagtacttagctgtccctgttgtgaaaggaaagaaaagtgagatggaaaaatttgctggtggactttacaccacaagtgtcgaggcattcatcccaaatactggccgtggtgtacaaggtgcaacttcacattgtttgggacaaaattttgccaaaatgtttgaagttaactttgaagatgagaagggtgaaaaagctatggtgtggcaaaattcatgggcatacagtactagaacgataggggtgatggtgatggtgcatggtgatgataagggcttagtgttaccccctaaagttgcagcagtacaagttattatagtgaatgtaccattcaaagaagcagatactgacaaaataaaaaatgcatgtttggaaactgtaaaaactttatgtgatttaggtattcgtgctgaagctgatttaagagaaaattattcgcctggttggaaatattctcattgggaaatgaaaggtgttcctttgaggattgaaattggaccaagagatgtggccaataatcaggtggtggttgcgcgccgtgacaatggagaaaaagtcagtgttcccatggcggatttggtcaaagtcaaggatttgttggatgatgttcaacaaaatatgtttaatgttgctaaacaaaaaagggatgcgtgtgttgaagttataaaaacttgggatgaatttattaaagcgttagggcaaaagaaattgatcttggctccatggtgtgatgaagaggaagtggagaaggaagtgaaaacaaagacaaaaggagagacaggagcggctaagacactttgttctccatttgaccagcccgaactgcccgaaggtacattgtgctttgcgtcagggaaacctgccaagaaatggacgtattggggacgaagctattaacaaaatttaaaatttggctttattgtttatgttttacttatattgaagcctttgaggaattatggtgttttactgtttggatattggaacgaatgttgatatactgtttttgatcttttattggaaagagcatgtttgatacta

SEQ ID NO: 2406 - DNA, 1690 bp, Cirsium arvense
gcgggatagcttgaggggttctaattttttaaaacaaacagcgcctccagcagccttttctctctgtctctcaggctccgccggcgcaactccggcgaattcacagtctcgactctcattcaatctctcattcagctgaaagtcaaagacatggctggtgcaaagggagacaagcctaataatgccaaaaaatcggctcctgttgccaaatctagtaagggaaggaaaaaggagacgggtcttggtcttacaaatactaaagacggcaactttggggaatggtattctgaggttgttacaaatggtgaaatgatagaatattatgaaatatctggctgttacattcttcggccatggacaatgtccatttgggaaataatgcaaaccttctttgatgcagaaattaagaagatgaagattaaaacttgctattttccgctttttgtatccaataacgttcttcaaaaggagaaggatcacatagagggttttgctcctgaggttgcttgggtcacgagatcgggtgactctgatttggaagtcccaattgccattcgcccaactagtgaaactgtcatgtatccctatttttctaagtggattaggggacaccgtgacttgcccttaaaacttaatcaatggtgtaatgttgtccgatgggagttcagtaatcctaccccatttatcaggagccgtgaatttctttggcaagaagggcatactgcttttgcaactaaggaggaggcagacactgaggttctcgaaatccttgaactgtataggcgtctgtatgaggagtacttggctgtacccgttgtgaaagggaaaaaaagtgagatggagaagtttgccggtggactttatactactagtgttgaggcctttattccaaatactggtcgtggtgttcaaggtgcaacttcacattgcttgggccagaatttcgctaagatgtttgagatcaactttgaagacgagaagggagaaaaggctatggtttggcagaattcttgggcatacagtactagaacgattggtgtgatggtgatgactcacggggatgatagaggcctggtcttacctcctaaagttgcagcaatacaagttattgtgattcatgtgccttacaaagatgcagatattaaggaaatattaaatgcatgttcagccactgtaaaagctttatgtgatttaggtattcgtgctgaagcggatcttagagagaattattcacctggttggaagtattctcactgggaaatgaaaggtgttcccttaaggattgagatcggaccaaaagacctggccaataaccaggtgcgtgctgttcgtcgtgacaatgcagcaaaaaccgatattcctatggacggtttggttgataaagtgaagagtatgctgaatgatattcagcaaaacatgtttgatgttgctaagcaaaaacgagatgcctgtgttcaagttgtgaaaacttgggatgaattcattgaagcattaagccaaaagaaattgatcttggctccatggtgcgatgaagaggaagtcgagaaggatgtgaaaacaaagacaaaaggggagacaggagctgctaagacactttgttctccatttgaccagcctgaactgcctgaaggtatgttgtgctttgcatcggggaagcctgccaagaatggacgtactggggacgagttat

SEQ ID NO: 2407 - DNA, 1851 bp, Cichorium intybus
tggcatactgataactttcctttccctcgatccaaattgctgcgacgccggcggttgaccggaaaatagcaacaagaattcggacaggggagagattcctgcttcttcttctcgtttatcaacggcttccaagcaattgtgcttcgccacaactgaaagtcaaaagacatggctggtggaaagggagaaaaatctgctaatgccaagaaatccgcagatgcgaagtctagtaagggaaggaagaaggagactggtctaggtcttactaacactaaagatggaaactttggagaatggtattctgaggttgttacaaatggtgaaatgattgaatactatgaaatatctggctgttacatccttcgtccatggacaatgtccatttgggagataatgcaatcatactttgatgcagaaatcaagaagatgaagatcaaaacttgctacttcccactttttgtatccaacactgttcttcaaaaagagaaggatcacatcgagggttttgctcctgaggttgcttgggtgacaagatcaggtgattctgatttggaagttcctattgctattcgtccaacaagtgaaactgtcatgtatccttatttttctaagtggataaggggacaccgtgacttgcccttgaaacttaatcaatggtgtaatgttgttagatgggaattcagtaatcctactccttttatcaggagccgtgagtttctatggcaagaagggcacactgcatttgcaacaaaggaggaagcagacactgaggttcttgaaattcttgagctatacagacgtctgtatgaagagtacttagctgtccctgttgtgaaaggaaagaaaagtgagatggaaaaatttgctggtggactttacaccacaagtgtcgaggcattcatcccaaatactggccgtggtgtacaaggtgcaacttcacattgtttgggacaaaattttgccaaaatgtttgaaattgactttgaagatgaaaagggagaaaaagctatggtgtggcaaaattcatgggcatacagtactagaacgataggggtgatggtgatggtgcatggtgatgataagggcctggtgttaccccctaaagttgcagctgtacaagttattatagtgaatgtaccgttcaaagaagcagatgttgacaaaataaaaaacgcatgtttggaaactgtaaaaactttatgtgatttaggtattcgtgctgaagctgatttaagagaaaattattcgcctggttggaaatattctcattgggaaatgaaaggtgttcctttgaggattgaaattggaccaagagatgtggccaataatcaggtggtggttgcgcgtcgtgacaatggagaaaaagtgagtgttcccatggcggatttggtcaaagtcaaggatttgttggatgatgttcaacaaaatatgtttaatgttgctaaacaaaaaagggatgcgtgtgttgaagttataaaaacttgggatgaatttataaaagcgttaggacaaaagaaattgatcttggctccttggtgtgatgaagaggaagtggagaaggaagtgaaaacaaagacaaaaggagagacaggagcggctaagacactttgttctccatttgaccagcccgaactgcccgaaggtacattgtgctttgcgtcagggaaacctgccaagaaatggacgtattggggacgaagctattaacaaaatttaaaatttggttttattgtttatgttttacttatattgaagcctttgaggaattatggtgttttactgtttggatattggaacaaatgttgatatactgtttttgatcttttattggaaagagcatgtttgatacta

SEQ ID NO: 2408 - DNA, 1823 bp, Cichorium intybus
cttggccggggtccacttgctgcgacgccggcggttgaccggaaaacagagaattctgacaggggagagattcctgcttcttcttctcgtttatcaacggcttccaagcaattgtgcttcgccacaactgaaagtcaaaagacatggctggtggaaagggagaaaaatctgctaatgccaagaaatccgcagatgcgaagtctagtaagggaaggaagaaggagactggtctaggtcttactaacactaaagatggaaactttggagaatggtattctgaggttgttacaaatggtgaaatgattgaatactatgaaatatctggctgctacatccttcgtccatggacaatgtccatttgggagataatgcaatcatactttgatgcagaaatcaagaagatgaagatcaaaacttgctacttcccactttttgtatccaacactgttcttcaaaaagagaaggatcacatcgagggttttgctcctgaggttgcttgggtgacaagatcaggtgattctgatttggaagttcctattgctattcgtccaacaagtgaaactgtcatgtatccttatttttctaagtggataaggggacaccgtgacttgcccttgaaacttaatcaatggtgtaatgttgttagatgggaattcagtaatcctactccttttatcaggagtcgtgagtttctttggcaagaagggcacactgcttttgcaacaaaggaggaagcagacactgaggttcttgaaattcttgagctatacagacgtctgtacgaagagtacttagctgtccctgttgtgaaaggtaagaaaagtgagatggaaaaatttgctggtggactttacgccacaagtgtcgaggcattcatcccaaatactggccgtggtgtacaaggtgcaacttcacattgcttgggacaaaattttgccaaaatgtttgaaattgactttgaagatgaaaagggagaaaaatctatggtgtggcaaaattcatgggcatacagtactagaacgataggggtgatggtgatggtgcatggtgatgataaaggcctggtgttaccccctaaagttgcagctgtacaagttattatagtgaatgtaccgttcaaagaagcagatgctgacaaaataaaaaatgcatgtttggaaactgtaaaaactttatgtgatttaggtattcgtgctgaagctgatttaagagaaaattattcccctggttggaaatattctcattgggaaatgaaaggtgttcctttgaggattgaaattggaccaagagatgtggccaataatcaggtggtggttgcgcgccgtgacaatggagaaaaagtcagtgttcccatggcggatttggtcaaagtcaaggatttgttggatgatgttcaacaaaatatgtttaatgttgctaaacaaaaaagggatgcgtgtgttgaagttataaaaacttgggatgaatttattaaagcgttagggcaaaagaaattgatcttggctccatggtgtgatgaagaggaagtggagaaggaagtgaaaacaaagacaaaaggagagacaggagcggctaagacactttgttctccatttgaccagcccgaactgcccgaaggtacattgtgctttgcgtcagggaaacctgcaaagaaatggacgtattggggacgaagctattaacaaaatttaaaatttggctttattgtttatgttttacttatattgaagcctttgaggaattatggtgttttactgtttggatattggaacgaatgttgatatactgttttttatcttttattggaaagagcatgtttgata

SEQ ID NO: 2409 - DNA, 1969 bp, Triphysaria pusilla
cttggtcttaggaggccaaccctaataaataaacgcacactacttattactggacgccgaagattagaaaacaaaaagattcaacgccagaaaaaaccactttatcgctgccgggacatagccagagataaatccggtttccagttggtattgtactctgagttcgccatattatcgccatggctggtaaagatgctaagatcaaagatgccaagatcaaagacgccaagatcaaagatgccaagagctctactggaagtggtaaagatgccaaaagctctgctgggaagggaaagaaaaaggaagtgaaaaaagagactggactaggtctttcttataagaaagatgaaaatttcggagagtggtactctgaggttgttgttagcggtgaaatgattgaatactatgacatatctggctgttacattctgcgaccatgggcaatgtcgatttgggaggtcatgcaaactttttttgatgctgagatcaagaaaatgaaaatcaagaactgctactttcctctgtttgtatcctctaatgtcttgcaaaaggagaaggaccacatagaggggtttgctccagaggttgcatgggttacaaagtcgggagaatctgatttggagatgcccattgctatccgtccaactagtgaaacagtcatgtatccatatttttccaaatggattagggggcatcgtgacttgcctctgagactaaaccagtggtgtaatgttgttagatgggaattcagcaatcccactccatttatcaggagtcgggagtttctttggcaagaaggacatactgcttttgcaactaaggaggaggcagatactgaggtgcttgacattctggaactctacaggcgcatatatgaagagttcatggctgttccagttatcaaagggaaaaagagcgaacatgagaagtttgctggtggactttataccaccactgtggaggcttttataccaaacaccggacgtggcgtgcaaggtgcaacttcacattgtctcggtcaaaatttcgcaaaaatgtttgagatcaattttgaggatgacaaaggagaaaaggctatggtctggcagaattcctgggcatatactaccagaacgataggggtgatgataatggttcatggggacaataagggcttggtactgcctcctaaagttgcatctctccaagtagtcgtaatcccggtgccttataaggatgctaacactcaggggatctatgatgcgtgtgcggacactgtgaaatctttggccgaagcaggaattcgtgccgaggctgattatagagataactattcgcctggatggaaatattctcactgggaattgaaaggtgttcctcttaggattgaaattggacccaaggacttggccaataaccaggtccgtgctgtcagacgtgataattcagctaaaaatgatatccccatggctgatttggtcgaacaagtgaaaaacacgcttgacgatatccatcaaagtctgtttgatgctgccaagcaaaaacgagacgcctgcatccaaacagtaagtacctgggaagaatttacagaagcacttggcgaaaagaagatgattttagcaccatggtgtgatgaggaggaagtggagaaggatgtaaaggcccgcacgaagggagagatgggtgcagctaagtcactttgttctccatttgatcagcctgccatcccagaaggtacgttgtgtttcgcatccggaaagcctgccaaaaagtggacctactggggaaggagttactgatcattgttttggattaatatacatttcatctttactattgtcatatctttgaattaatggtgtgatacggaaacttgggtttagtgactgaaacagttatgagaaaatagcatacagtttttcatattctagaatgtgtttttgctgcagacatgaggagcttatttattgtttaatcattttatcgggga

SEQ ID NO: 2410 - DNA, 1772 bp, Flaveria ramosissima
cgaactgcttcgccgccggcgttgaccggagaccaccgcaaagctccgacggcggtggttaccgtttgttcttctggtgtctgaacttgaagcacttctgcaattcactgtaatttgactgaaagctgaagaaatggccagtggaaagggagataaggctgctaaggccgataaatctactgctgctgccaaatcgagtaagggaaggaagaaggagactggtctaggtcttactaatactaaagatggcaactttggggaatggtattctgaggtcgttacaaatggtgaaatgatagaatattatgaaatatctggctgttacatcctccggccatggaccatggccatttgggaaataatgcaaaacttctttgacccagaaattaagaagatgaagattaaaacatgctatttcccgctctttgtgtccaataatgttctacaaaaagagaaggatcacatagagggttttgctcctgaggttgcttgggtcacaagatcaggtgactctgatttggaggttcctattgctattcgtccaactagtgaaactgtcatgtatccctatttttctaagtggatcaggggacatcgtgatttgcccttaaaacttaaccagtggtgcaatgttgttcgatgggagttcagtaatcccactccatttatcaggagccgtgagtttctttggcaagaggggcacactgcttttgcaacaaaagaggaggcagacaccgaggttcttgaaatcctagaattgtatagacgtttgtatgagaagtacttggctgtccctgttgtgaaagggaaaaagagtgagttagaaaagtttgctggtgggctctatactactagtgttgaggcctttattccaaatactggtcggggtgtacaaggtgcaacttcacattgcttgggccagaattttgttaaaatgtttgagattaactttgaagatgaaaaaggagagaaggctattgtctggcagaattcctgggcgtatagtaccagaacgattggggtgatggtgatggttcatggtgatgataaaggtctggtgttgccccctaaagttgcagcagtacaagttattgtgattcatgtgccttataaagatgcagatgttaaggaaataatgaatgcatgctctgccactgttaagactttatgtgatttaggcattcgggccgaggcagaccttagagagaattattcacctggttggaagtattctcactgggaaatgaaaggtgttcccctgaggattgaaataggaccaaaggatctcgctaataaccaggtgcgtgctgttcgtcgtgacaatggagaaaaagtggatattccaatggctgatttggtcgacaaagtaaagggtatgctggataatatccagcaaaacatgtttgatgttgccaagcaaaaacgagatgcttgtattcaagttacaaaaactagggatgaatttattgaagcattaggtcaaagaaattgatcttggctccatggtgtgatgaagaggaagtcgagaaggaggtgaaagcaaagacaaaggggagacagggctgctaaacactttgttctccatttgaccagccagaactgcctgaaggcacattatgctttgcatcaggggaaacctgcaaaaaaaataggacctactggggacgaagctattaacattattcacgatttcattttctttgtttttttacaataccatgtcaaatgtttgagtaatttttatgagtttaaccatttgctacgattgtgtt

SEQ ID NO: 2411 - DNA, 2086 bp, Sarracenia psittacina
caaagcgaacgaagtcgaaggaatgagaactgagatctgggaagcgaacagtcgaacgaaccagtagcggagtcgccgaaggagcgagaactgagatctgagaaggaatagcggcgacacggcaatcgcgaaggacgacgtcgacgagcggcggcaaccaggcggtgattggcggcgtcgcgagaatcaatagcggcgagcggcggctcgtcaaccgcaaaggacgacgtcgacgaacggcgtgccggaaacagcgaaggagacacagacactgtatgatacagaagaagtggagacggaggcggcggcgggtctagggcaactcagcaacttgggcataacatcaaaatagggcaggagacactaaattgaaagatatggctacaaaagatgctaagaaagctgctggtgccaaaagtggagggaaaaggaggttaaaaaagagactggcctagggctgtccttcaagaaagacgacaattttggcgaatggtactcagaggttgttgttagcagtgaaatgattgaatattatgatatctcgggttgttatattttgaggccatggacaatgtcaatatgggaaactatgcaagatttcttcgatcgagaaataaagaagatgaaaataaaaactgctatttccctctttttgtatcccctaggtgttctgcaaagagaaaggatcacattgagggattgcccggaggttgcatgggttacaaatctggagaatctgagttagaagtgcctattgctattcgcccaacaagtgagactgttatgtatccatactactcaaagtggataagggggcaccgtgacttgccattaaagttaaatcagtggtgtaatgttgttcgatgggagttcagtcatcctactccattcattaggagtcgagagtttctttggcaagaagggcacacggcttttgcaacaaaggaagatgctgatgctgaggtccttgaaatattggaactctatagacggatatatgaagaatatctggcaataccagttgtgaagggcaagaagagtgagctggagaaattcgctggtggcctttacacgacaagtgttgaggcctttatccccaacactgggcgtggtatacaaggtgccacatcacattgtttgggtcaaaattttgctaaaatgtttgagataaattttgagaatgagaagggagaaaaggacgtatggtttggcaaaattacctgggcatatagtacgcgaacgattggggtgaatggtgatggttcatggggatgacaaaggcttggtgctgccacctaaagtggcatcgtccaagttattgtgattcggtgccatacaaagatgctgacacagaaaagattttagaggcctgcaaaacaattgtcgataccttcagtgaagctggtttacgtgtagaggcagatcttagagataattattcacccggttggaagtactctcattgggaaatgaaaggtgtcccgctgaggattgaaattgggcctaaagacttggctaagaatcaggtacgtgttgttcgccgtgacaattcagaaaaggtggatattcctgtggatacagatttggttccgcgaataaaggacatactagctgatgttcaacaaagtttgtttgatgatgcaaagcagaagcgagatgcttgtattaagattgtaaagacatgggatgaatttgtggaagcacttaaccaaaagaaaatgatcttagctccttggtgtgatgaagaggaagtcgagaaggatgtgaaagcgcgaacaaaaggtgagattggagctgctaagacactttgttctccatttgaccagccggaactatcaccagggactctttgctttgcctctggtaagcctgcaaagaagtggacctactggggcaggagttattaatcatatgctaatgtgtcattgagattcttctgattgatctttaatgctaatgaaacgaaatgaaatgaaatgcattgtttaacttcaattttgattgttgaaatatataacaccaaacgagtcattgtatcaactgttcttgagttgttggaaggctaaggttctattaatgattttgt

SEQ ID NO: 2412 - DNA, 1872 bp, Trifolium pratense
agaaagagagagttcagtgagagagtccattcattaccgccaccatcgctcttgcacgctccattctcccacgccttttctcaaacaggatcaggtgctcctccttcacaatggcgggtaccgatgccacaaaacaacaatccggcggtggtgcaaaacaacctaaacaacctaaacaaccaaaacaacaacaatctggtggtggtggagggaagaagaaggaagtgaagaaagagactggattaggtttaactaataagaaggctgataacttcggagagtggtattctgaggttgttgttaatggtgagatgattgagtactatgacatttctggttgctatattctcagaccttggtcaatggctatttgggagattatgcaagcgttttttgatccagaaataaagaagatgaagatcaagaactgctatttccctgtgtttgtttcttctactgttctggaaaaggagaaggaccatatcgagggttttgctccagaggtggcttgggtgacaagatctggaaaatctgagctagagattcctattgctattcgtccaactagtgaaacggttatgtatccttactactccaagtggataaggggacaccgtgatttgccactgaaacttaatcagtggtgcaacgttgttagatgggagttcagcaatcctacaccattcatcaggagtcgcgagtttctttggcaagaaggacacactgcttttgctactaaggaggaagcagatacagaggttcttgagattttggagttatataggcgtatatacgaagagtatttggcagttcctgtcataaagggtaagaaaagtgagcttgagaagtttgcgggtggactttacactaccagtgttgaggcctttattccaaatactggtcgtggcattcaaggtgcaacttctcattgtttgggacaaaattttgccaagatgtttgacataaactatgaaaatgagaagggagagagagcaatggtctggcaaaactcatgggcctacagtacccgaactattggggtgatggtgatggtacatggcgatgataagggattggtgctgcctcctaaagtagcatcagttcaagttattgtgattcctgtgccatacaaagatgctgatactcaaggaatcttggatgcttgttctgaaactgtgaatgcgttgttggaagcaggaattcgcgctgagtcagactcgagagataactattcacccggatggaagtattctcagtgggaaatgaaaggtgttcctctgaggattgaaattgggccaaaggatttagccaataagcaggttcgcgctgttcgtcgtgacagtggagcaaaaatagacattgcgaatgctggtttggttgaggaaatcaaaaaattgcttgataatattcaacagaatctgtttgatgtcgcgaaacaaaaacgggatgagtgtattcaggtcatacatacttgggaggagtttatagaagctttaaatcaaaaaagatgatcttagctccttgggctgatgagaaggaggttgaagaagatgtcaaagcaaggacaaagggtgagactggagcagcaaagacactctgcagtccctttgatcagccagaactccccgaaggaaccatatgctttgcgtccggcaagcctgcaaagaagtggtcatactggggcagaagttattagatcttgattgtggtattttctgaagctagttcaacatttaatggtgcattgtatgaatttgtggattatgcaaatattagttttcttctgcttgagtaacttagttttacttcgatgttatactgtacaatattcattcggctttaaagaagagtattattataattttttccgtt

SEQ ID NO: 2413 - DNA, 1994 bp, Trifolium pratense
attttgatcctaataaaaaaccctagcgaaagagagttgagtgagagagtcaattcattacgccaccatcgctcttgcacgctcaattctccctcgccttctgtcaaacaggatcaggtgttcctcctccttcacaatggcggggaccgaagccacaaaacaacaatccggcgccggtgccaaacaacctaaacaacctaaaccacaaaaacaacaacaatctggtgctggtggtggggagaagaaagaagtgaagaaagaaactggattaggtctaaccaataagaaggctgacaatttcggcgagtggtactctgaggttgttgttaatggtgaaatgatcgagtattatgacatttctggttgctatattcttagaccttggtcaatggctatttgggagaatatgcaagcattttttgatccagaaattaagaagatgaagatcaagaactgctacttccctgtttttgtttcttctactgttctggaaaaggagaaggaccatattgagggttttgctccagaggtggcttgggtcacaagatctggaaaatctgagcttgagattcctattgctattcgtccaactagtgaaacagttatgtacccctactactccaagtggattaggggacaccgtggcttgccactgaaacttaatcagtggtgcaatgttgttagatgggagttcagcaatcctacaccattcatcaggagtcgcgagtttctttggcaagaaggacacactgcttttgctactaaggaggaagcagatacagaggttcttgagattttggaattatataggcgtatatacgaagagtatttggcagttcctgtcataaagggtaagaaaagtgagcttgagaagtttgcgggtggactttacactaccagtgttgaggcatttattccaaatactggtcgtggcattcaaggtgcaacttctcattgtttgggacagaattttgcgaagatgtttgacataaactatgaaaatgagaagggagagagagcaatggtctggcagaactcatgggcctacagtacccgaactattggggtgatggtgatggtacatggcgatgataagggattggtgctgcctcctaaagtagcatcagttcaagttattgtgattcctgtgccttacaaagacgccgatactcaaggaatcttggatgcctgttctgcaactgtgactgcgttggtggaagcaggaatacgcgctgagtcagattctagagataactattctcctggatggaagtattctcagtgggaaatgaaaggtgttcctctaaggattgaaattgggccaaaggatttagcaaataagcaggttcgcgctgttcgtcgtgacagtggagcaaaaatagacattgctaatgctaatttggttgaggaaataaagaagttgctcgataatattcaacagaatctgtttgatgttgctaaacaaaagcgagatgagtgtattcaggtcatacatacatgggatgagtttatagaagctttaaatcagaaaaagatgatattagctccttgggctgatgagaaggaggttgaagaagatgtcaaagcaaggacaaagggtgagactggagcagcaaagacactctgcagtccctttgatcagccagaactccccgaaggtaccacatgctttgcgtccggcaagcctgcaaagaagtggtcatactggggcagaagttactagatcttgattatggtattttctgaggctagttcaacatttaatggtgcattgtatgaatttgtggattatgcaaatattagttttcttctgcttgagtaacttttcaatttatagttttactttgatttttatactgtgcaatatttagtcggctttaaagaagagtattattttaactttttccgtttgaatagaaagccaatggaatggaaaattgattgaacaatccaatcctggtaccaaatgttacattagatttagaggtcatgtc

SEQ ID NO: 2414 - DNA, 2022 bp, Musa acuminata
ggcccatttacttcgtccattctgttgcaggatttatttggtagccgcctttgattgggaattagggttgtctggtcgcagtcgcgggcgaggtggagcgatttgggaaggcgctgctctcggctctctttcctgcgcgtagcggaccgcttcgaagcggggtcactaagtcgagtagctacttgtccagattcatggcgaccgctaatgccaacgccaaaggtgcgaggaagaaggaagtgaagaaagaaactggacttggtttgacctacaagaaaaatgagaactttggtgaatggtactccgaggttgttgttaatagtgaaatgattgagtactacgacatatctggctgctacatcctaagaccatggacgatgacaatttgggaagttttacaaacattctttgatgctgaaataaaaaagatgaatatcaagaatgcgtattttcctctatttgttactgagagtgtcctacagagggagaaggatcatattgagggctttgctcctgaggttgcttgggttactaagtctggtcagtccgagttggaagttcctattgcaattcgtcccacaagtgaaactgtcatgtacccatatttttctaaatggattagggggcatcgtgacttgccattgaagcttaaccaatggtgcaatgtcgttagatgggagtttagccatcctactccctttatcaggagtcgggagtttctttggcaagaagggcacacagcttttgcaacacaagctgaagcagatcaagaggttcttgaaatcttggaactatacaggaaaatatatgaagagttccttgcaattcctgttgttaagggtagaaaaagtgagctagaaaagtttgctggtggttactataccacaagtgttgaggcttttattcctaacacaggtcgtggaatacaaggtgctacctcccattgccttggacaaaattttgcaaagatgttccagataaattttgagaatgataaaggtgtaaaagctatggtctggcagaattcttgggcatacagcactcgcacgattggtgttatggtgatggttcatggagatgataaaggcttagtattaccacctaaagtggcatcagtccaagtgatcgtcatccctgtccctttcaaggatgcaaatactgatgcaatctttagtgcctgctcatcaacagttcaggcactccgtgaagcaggctttagagctgaagcagatttaagagataactactctcctggctggaagtattcacactgggaaatgaaaggtgttcctttgagaattgaaattggacccaaggatttggcaaataaccaggtgcgggttgttaggcgtgacaatggtgcaaaatcagacataccaatgggcaatctggtggaaaaagtgaaagagatactctcaagtatccaggaatgcttgtttaatgcagcaaaacagaagagagatgcatgcataaagattgtcaatacctgggatgagttcatagctgctcttaatgacaaaaaaatgatccttgctccctggtgcgatgaagaggaagttgagaaggatgtaaaagctcgaacaaagggtgaactaggagctgcaaagtctctatgcaccccattcgatcagccaaggcttccagaaggaactctatgctttgcctcaggaaagccagccaagaaatggacatattggggacgaagctactaggcaggttgattacagagatcctactgtcgtttattctggagtttgcatttttatgaaaacgattgcaagtgttccatactttattctcctgtaaaagattttgaaagttttgagttattcctgtttgaaaattgggctgatatgcaagcagtacttcatgcagttgttagatcgagctaatcatatgtcgtctagtaaaaaataaagaagaatgacgagctagaccgaatatatagtttcagtctggagatgttaggattgaatgtttggagatcctatattgccactttcattttggttcttgagtgca

SEQ ID NO: 2415 - DNA, 2345 bp, Phalaenopsis aphrodite
tttcaccgtcgctggctccaaccctcgagctacctcagcagtggcgatgctggtttgatagccgtcattagcacatcaatcagcagtccgttaagctcttctggaggtgaaagacgggcaatttggttgtgcattcgttgcggagctatagttgccagaaaatcacactgaccgggaaactagggttttgggggctcgactggttttgcacactctggccattgcacgatgtcggggattcctttgcaggatttataatgcgaatttgatctcttgttccttcctatcctgtggaagagggagtactgaggggagtaagaaaatttgcaaccggttactagtcattgaggacatggctactgcaaatgcaagtaccagctcaaagaatgctaggaagaaagaagtaaagaaagaaactggattgggtctagcctataaaaagaatgaatcttttggagaatggtactctgaggtggttgttaacggtgaaatgattgaatactatgacatctctggttgttacattttacgaccatggacaatggtgatctgggaaaccatgcaagcattctttgacgcagaaataaagaaaatgaatgtaaaaaatgcatactttcctctgtttgtaacagagaatgttcttcaaaaggagaaaaatcatattgagggttttgctccagaggttgcctgggttactaagtctggccaaagtgatctggaagtacctattgccattcgtccaacaagtgagactgtgatgtatccatatttttccaaatggataaggggccacagagatttgccattgaagctaaaccaatggtgtaatgttgtgcgatgggaattcagtcaccccactccttttataaggagtagggagtttctttggcaagaaggtcatacagcgtttgcaacaaaagaggaagcagataaggaggttcttgagatattggaattataccggagaatttatgaagaataccttgccattccagtagtgaaaggaaagaaaagtgagctagaaaagtttgctggaggcctttataccacgagcgttgaggcttttattccaaatacaggtcgtggaatacaaggtgctacctcacattgccttggtcaaaattttgccaagatgtttgagatagattttgaaaatgagaagggggagaaagctaaggtctggcagaattcttgggcatatagtacccgcacgattggggttatggtgatggttcatggggatgacaagggtttggtgcttccgcccaaagttgcagctgtccaagtcattgtcattcctgtaccttacaaagacgcagacatgcaaactatctttgaagcttgctcatcaactgttcaaacattgcgagctgcagggtttcgtgctgaacatgatttgagggataattattcacctggctggaagtactctaattgggagatgaaaggtgtgcccttgcgaattgaaatcggaccaaaggatatagcaaataagcaggtgcgcattgtacggcgtgataatggagctaaaacagatatacccatctcctgcttggttgaacaagtccaagacgttctctccagtattcatgaaaacttattcaatgctgcaaaagagaaaagagatgcctgcataaaggttgtccatacatgggaggaatttatgacggctctcaatgacaaaaagttgatcttgactccctggtgtgatgaagaggaagttgagaaaaatgtgaaaacacgcacaaaaggtgaacttggatctgccaagacattatgcactccttttgatcagccaagtctccctgaagggactctctgctttgcatcagggaagccagccaagaagtggacttattggggtcgaagctattaattatgtctgatttgctaaatttactactcaattttcacgcttgttgctttttaagaatttcttcttctgatgccgtttactatacccatcttcaaattttattcagcgagttttgccttgttctgtctttgaaaagtgtctggctatgaaatgttttacgtccctctgaaacgtcatcccgttctgccaagattttgtaacccatttgtgacattaaatgactagtttatttcgatcatcattatgtgccaaaaaataaaaaataaagcttacaaattaactatataaacataattgttttttaaacctacttataagctttagtctataatatcatcaccagcaagagaagcaaatatgacatctaagttattaaagttaccactctacttgttctccatcctcaagatttttccttagtttcggtaacaaaaaaatatttcaatcttaaaccctaaaggttgtactg

SEQ ID NO: 2416 - DNA, 1853 bp, Musa acuminata
tcgcgggcgaggtggagcgatttgggaaggcgctgctctcggctctccttcctgcgcgtagcggaccgcttcgaagcggggtcactaagtcgagcagctacttgtccagattcatggcgaccgctaatgccaacaccaaaggtgcgaggaagaaggaagtgaagaaagaaactggacttggtttgacctacaagaaaaatgagaactttggtgaatggtactccgaggttgttgttaatagtgaaatgattgagtactacgacatatctggctgctacatcctaagaccatggacgatgacaatttgggaagttttacaaacattctttgatgctgaaataaaaaagatgaatatcaagaatgcgtattttcctctatttgttactgagagtgtcctacagagggagaaggatcatattgagggctttgctcctgaggttgcttgggttactaagtctggtcagtccgagttggaagttcctattgcaattcgtcccacaagtgaaactgtcatgtacccatatttttctaaatggattagggggcatcgtgacttgccattgaagcttaaccaatggtgcaatgtcgttagatgggagtttagccatcctactccctttatcaggagtcgggagtttctttggcaagaagggcacacagcttttgcaacacaagctgaagcagatcaagaggttcttgaaatcttggaactatacaggaaaatatatgaagagttccttgcaattcctgttgttaagggtagaaaaagtgagctagaaaagtttgctggtggttactataccacaagtgttgaggcttttattcctaacacaggtcgtggaatacaaggtgctacctcccattgccttggacaaaattttgcaaagatgttccagataaattttgagaatgataaaggtgaaaaagctatggtctggcagaattcttgggcatacagcactcgcacgattggtgttatggtgatggttcatggagatgataaaggcttagtattaccacctaaagtggcatcagtccaagtgatcgtcatccctgtccctttcaaggatgcaaatactgatgcaatctttagtgcctgctcatcaacagttcaggcactccgtgaagcaggctttagagctgaagcagatttaagagataactactctcctggctggaagtattcacactgggaaatgaaaggtgttcctttgagaattgaaattggacccaaggatttggcaaataaccaggtgcgggttgttaggcgtgacaatggtgcaaaatcagacataccaatgggcaatctggtggaaaaagtgaaagagatactctcaagtatccaggaatgcttgtttaatgcagcaaaacagaagagagatgcatgcataaagattgtcaatacctgggatgagttcatagctgctcttaatgacaaaaaaatgatccttgctccctggtgcgatgaagaggaagttgagaaggatgtaaaagctcgaacaaagggtgaactaggagctgcaaagtctctatgcaccccatttgatcagccaaggcttccagaaggaactctatgctttgcctcaggaaagccagccaagaaatggacatattggggacgaagctactaggcaggttgattacagagatcctactgtcgtttattctggagtttgcatttttatgaaaacgattgcaagtgttccatactttattctcctgtaaaagattttgaaagtttgagttattcctgtttgaaaattgggctgatatgcaagcagtacttcatgcagttgttagattgagctaatcatatgtcgtctagtaaaaaataaagaagaatgacgagctag

SEQ ID NO: 2417 - DNA, 1918 bp, Malus domestica
caaaaaaagtcttccagtctgctgtcttctctctttctttattctcagaagtgaaaggccacaactgcggagccgcaaacgcaacgaaccagattcaattcggttagagatatcgaaacatggcggaccagggtgctaagaagtccaatgccaagggtggagggaaaaagaaggaggtgaagaaagaaaccggtcttggtctttccaagaagaaggatgagaatttcggagagtggtattctgaggtcgttgttaatagtgagatgatcgaatactacgatatatctggttgttatatattgaggccatggacaattgcgatatgggagacaatgcaagcattctttgatgcagaaataaagaaaatgaagataaagaattgctatttccctttatttgtctcccctagtgttctagaacgagagaaggatcatattgagggttttgctccagaggttgcgtgggtcacaaagtctggaaagtccgacttggaagtgccaatagcaattcgtccaacaagtgagactgttatgtatccttattttgctaagtggattagaggacaccgcgatttgccattgaagctaaatcagtggtgcaatgttgtccggtgggagttcagcaatcctacaccatttatcaggagtcgggagtttctttggcaagaaggccatacagcttttgcaacaaaggcagaggcagatgaagaggtccttgagatattggaactgtaccggaggatatacgaggactatttggcagttccagttgtgaagggaaaaaagagtgagaatgagaaatttgctggtggtctttatactactagtgtggaggcttttattccaaatactggccgcggtgtacaaggtgccacctcacattgtttgggtcaaaattttgccaaaatgtttgagattaattttgaaaatgaaaacagagaaaagggcatggtttggcaaaactcttgggcatacagcactcgaacgattggagtgatggtgatggtgcacggagatgacaaaggcttggtattgccacctaaagtggcagcaattcaggctattgtggttccagtgccttacaagaatactcctatggaagaaatatatgatgcctgcttgaaaactgtggataccttgactaaagctggtattcgtgctgaggcagatttaagtgacaaccaaactcctggttggaagtattcacattgggaaatgaaaggtgttcctctaaggattgaaattggaccaaaggatctggaaaagaatcaagttcgcgttgtccgccgtgacaattcagcaaaagaggacattcctgtgagcacgttggtagagcaagtacaagacatcttggctaaaattcacgaaaatctgttcaatgttgcgaaggaaaaacgagatgcttctatcaaggttgcaaagacatgggaagaatttatggaagctctaaaccaaaagaaaatgatcttggctccttggtgtgatgaacaggaagtagaagaggacgtgaaaaaacggacaaagggtgaaatcggagcagccaagtcactctgtactccatttgagcagcctgagcttcctgaagggacactttgctttgcctctggaaaaccagccaagaaatggacctactggggcaggagttactagacaactcttcaaattacgctgtttaattttatatccctatctgccttgagggatgaatttttaaaatcactcaaaaattgtttattccatggcgtacggtctgtagttaatacaacacttgcagtatacaattagtatgcgaacgttattttctcgtctttttctttttcgaacaacggtgtttgttttagacactcggttgtagccattgttaaactgagcaagtgctgaatactttcttttctgaaaaaaccaccattcacggtatc

SEQ ID NO: 2418 - DNA, 1608 bp, Centaurea maculosa
aaggaaaaaggagacaggtcttggtcttacaaatactaaagacggaaacttttggggaatggtattctgaggttgttacaaatggtgaaatgatagaatattatgaaatatcaggctgttacattctccggccatggacaatgtccatttgggagataatgcaaaccttctttgatgcagaaattaagaagatgaagattaaaacttgctattttccactttttgtatccaataacgttctacaaaaggagaaggatcacatcgagggttttgctcctgaggttgcgtgggtgacgagatcaggtgactctgatttggaagtccctattgccattcggccaactagtgaaaccgtcatgtatccctatttttctaagtggatcaggggacaccgtgacttgcctctaaagcttaatcaatggtgcaatgtcgtccgatgggagttcagtaatcctacgccatttatcaggagccgtgaatttctttggcaagaagggcacactgcctttgcaacaaaggaggaggcagacactgaggtccttgaagtccttgaactgtataggcgtttatacgaggagtacttggcggtacctgttgtgaaagggaaaaaaagtgagatggagaagtttgccggtggactttatactactagtgttgaggcgtttattccaaataccggtcgtggtgttcaaggcgcgacttcacattgcttgggccagaatttcgctaagatgtttgagattaactttgaagacgagaagggagaaaaggctatggtttggcagaattcgtgggcatacagtactagaacgattggggttatggtgatgactcatggggatgataaaggcctggtcttaccccctaaagttgcagaaatacaagttattgtgattcatgtgccttacaaagatgccgatattaaggaaatactaaatgcgtgttcagccaccgtaaaagctttatgtgattcaggtattcgtgctgaagcggaccttagagagaattattcacctggttggaagtattctcattgggaaatgaaaggtgttcccttgaggattgagataggaccaaaagacctggccaataaccaggtgcgtgctgttcgtcgtgacaatggagcaaaagttgatattcctatggacggtttggctgataaagttaagcttatgctggatgatattcagcaaaacatgtttaatgttgctaagcaaaaacgggatgcttgtgttcaagttgtgaaaacttgggatgaattcattaaagcattaagccaaaagaaattgatcttggctccatggtgcgatgaagaggaagtcgagaaggatgtgaaaacgaagacaaaaggggagactggagctgctaagacactttgttcgccatttgaccagcctgaactgcctcaaggtacgttgtgctttgcatctgggaaacccgcgaagaaatggacatactggggacggagttattaacgtcatccacggtttgatttcttgttttcgtttaatataatccaactattaaagagttattatttaggcatttgcaacaatcatgttttgtgtttgaaagttgaaacaagtggtcatattgttagattttttt

SEQ ID NO: 2419 - DNA, 2011 bp, Elaeis guineensis
cccgcgcacctcgccgccacctccctccggtctccgttgtcaccttcctccctatcgtcaccggcatcggccctcccttccgatctctctccctcagatcggagccgcgctacgcggcgttgggctccccctccaatcttccacagcattactctatcagaaggcatggcgactagcaaaactgataccagtaatgcaaggaagaaggaagtgaagaaagaaactcgtctgggtttgacctataagaaagataaggattttggagaatggtattctgaggtttgtgttgctggtgaaatgattgaatactatgacatttctggctgctatatcctaaggccatggacgatggcaatctgggaaacattgcaagcattttttgatgcagaaataaagaagatgaatgtcaagaatgtgtatttccctctttttgtaactgagaatgttctacagaaggagaaggaccatatagaaggttttgctcctgaggttgcttgggttaccaaatctggacagtctgaaatggaaattcctattgcaatccgtcctacaagtgagactgttatgtatccatattactctaaatggataagggggcatcgtgacttgccattgaagcttaaccagtggtgcaatgttgtgagatgggaattcagccatcctactccttttatcaggagtcgagagtttctttggcaagaaggacatacagctttcgcgacacaagatgaagctgatcaagaggttcttgaaatattggaattatatcgaaggatatatgaagaatttcttgcaattccagttattaagggaaagaaaagtgagctagaaaaatttgccggcggtttttatactacaagcgttgaggcttttattccaaatacaggtcgtgggatacaaggtgccacctcacattgtcttggtcaaaattttgcaaagatgttcgagataaattttgagaatgagaaaggtgaaaaggcaatggtctggcagaattcttgggcatacagcacccgcacgataggggtgatggtgatggttcatggggatgacaaaggcttggttttgccacctaaagtagcatctgtccaagttattgtgattcctgtaccatataaggatgctgatacacaggcaatctttgatgcctgcagatcgacagttgatacactatgtaaagcaggtttcagagctgaggtggacttaagagataactattcacctggttggaagtactctcactgggaaatgaaaggtgttcctctgagaatcgaaattgggccaaaggatttagcaaataaacaggtgcgggttgtttgccgtgacaatggtgcaaagatggacataccaatgcacagtttagtagaacaagtaaaagagattctatccaatattcaagagagcctttttaatgcagcaaaacaaaagagagaagcttgcgtcaaggtcatcaatacatgggatgaatttattgcagctcttaataacaaaaagttgattctggctccctggtgtgatgaagaggatgtcgaaaaagatgtgaaagctcgaacaaagggagaacatggagctgctaagacattgtgcacgccatttgatcagccaagacttcctgaaggaactctttgctttgcatcgggaaagcctgcaaagaagtggacttattggggccgaagctactaatcaggtggccgatatgaagattgtggttttcataatcattcaccaaattgattgagaatgggtggtgcctatctcatgggcacagatttgtatttttcacccagtaccgtcctatctttcttgagctttgctcaactgattttgttaaattgaggtgttgcatattggacttcggctgatttcacagagcttttagattatcagatgctgtatattacgttgtggacctaatggtgtctattgtgcaagctatatattagatgaattgaatatactgtaacagtcacagagttcatactcactttgagttgaaagaaatatctattta

SEQ ID NO: 2420 - DNA, 1998 bp, Elaeis guineensis
ccctccggacgtccgtctcatccccgcgcacctcgccgccacctccctccggtctccgttgtcaccttcctccctatcgtcaccggcatcggccctcccttccgatctctctccctcagatcggagccgcgctacgcggcgttgggctccccctccaatcttccacagcattactctatcagaaggcatggcgactagcaatactgataccagtaatgcaaggaagaaggaagtgaagaaagaaactcgtctgggtttgacctataagaaagataaggattttggagaatggtattctgaggtttgtgttgctggtgaaatgattgaatactatgacatttctggctgctatatcctaaggccatggacgatggcaatctgggaaacattgcaagcattttttgatgcagaaataaagaagatgaatgtcaagaatgtgtatttccctctttttgtaactgagaatgttctacagaaggagaaggaccatatagaaggttttgctcctgaggttgcttgggttactaaatctggacagtctgaaatggaaattcctattgcaatccgtcctacaagtgagactgttatgtatccatattactctaaatggataagggggcatcgtgacttgccattgaagcttaaccagtggtgcaatgttgtgagatgggaattcagccatcctactccttttatcaggagtcgagagtttctttggcaagaaggacatacagctttcgcgacacaagatgaagctgatcaagaggttcttgaaatattggaattatatcgaaggatatatgaagaatttcttgcaattccagttattaagggaaagaaaagtgagctagaaaaatttgccggcggtttttatactacaagcgttgaggcttttattccaaatacaggtcgtgggatacaaggtgccacctcacattgtcttggtcaaaattttgcaaagatgtttgagataaattttgagaatgagaaaggtgaaaaggcaatggtctggcagaattcttgggcatacagcacccgcacgataggggtgatggtgatggttcatggggatgacaaaggcttggttttgccacctaaagtagcatctgtccaagttattgtgattcctgtaccatataaggatgctgatacacaggcaatctttgatgcctgcagatcgacagttgatacactatgtaaagcaggtttcagagctgaggtggacttaagagataactattcacctggttggaagtactctcactgggaaatgaaaggtgttcctctgagaatcgaaattgggccaaaggatttagcaaataaacaggtgcgggttgttcgccgtgacaatggtgcaaagatggacataccaatgcacagtttagtagaacaagtaaaagagattctatccaatattcaagagagcctttttaatgcagcaaaacaaaagagagaagcttgcgtcaaggtcatcaatacatgggatgaatttattgcagctcttaataacaaaaagttgattctggctccctggtgtgatgaagaggatgtcgaaaaagatgtgaaagctcgaacaaagggagaacatggagctgctaagacattgtgcacgccatttgatcagccaagacttcctgaaggaactctttgctttgcatcgggaaagcctgcaaagaagtggacttattggggccgaagctactaatcaggtggccgatatgaagattgtggttttcataatcattcaccaaattgattgagaatgggtggtgcctatctcatgggcacagatttgtatttttcacccagtaccgtcctatctttcttgagctttgctcaactgattttgttaaattgaggtgtttcatattggacttcggctgatttcacagagcttttagattatcagatactgtatattacgttgtggacctaatggtgtctattgtgcaagctatatattagatgaattgaatatactgtaacagttacagagtt

SEQ ID NO: 2421 - DNA, 2246 bp, Arabidopsis thaliana
gacttattgggcttggcccatgtaaactaagcatttaggcaaaaaccagatccaaccctaacacgtggccgtatataattggaagttcagtaacaaagctcgtcaagcgagtcaaacgttcgcaacttgtaacgctattttgctctctcgattcctttctctcttctcttatctttgctgcttcttttgctccgccgtcttcagctcagtcctgcttcagctctccggcgaaattgaagaagaaggttgcaatggctgatcccagtgaacaaaaagaaaaggttgtgaaagaaaagaaagaaaaggttaagaaagaaaaggttgtgaaagaaaaggttgcaaaggcttcttcgagtggacagaagaagaaggacgtcaagaaggaaacgggtctcggactcagtgttaagaaagatgagaacttcggggaatggtattctgaggtttgtaaacaagatatgattgagtactacgatatctctggatgttatattctacggccatggtcaatggccatttgggagattatgcaaattttctttgatgcggaaatcaagaaaatgaaggtcaagaattgctatttccctctgtttgtatctcctggtgtcttagaaaaggagaaggaccacatcgagggattcgcccctgaggttgcgtgggttacaaagtcaggtaaatctgacttggaagtcccaattgctattcgtccaaccagtgagacagtgatgtacccttactacagcaagtggataagggggcaccgtgacttgcctttgaagcttaaccagtggtgcaatgttgttagatgggagttcagcaaccctaccccatttatccggagccgtgagttcctttggcaggaaggtcacactgcattcgccacaaaagcagaagcagatgaagaggtccttcaaattttggagctttaccgtcgcatatatgaagaatatcttgcagttccagttgtgaaaggtatgaagagtgaaaatgagaagtttgctggtggactttacactacaagtgtagaggctttcattccaaacactggtcgtggtgtacaaggtgcaacctctcattgtttgggacaaaactttgcgaagatgtttgagatcaactttgagaatgagaaagcagagacagaaatggtgtggcagaattcttgggcctacagtaccaggacgattggagtgatgattatgactcatggagatgacaaaggcctggtactccctcctaaagtcgcatctgtgcaagttgttgtgattcctgttccctacaaagatgctaatacccaaggaatttatgatgcttgtactgctactgcatctgccttgtgtgaagccggtatccgtgctgaagaagatttaagggacaactactctcctggatggaagtattcagactgggaaatgaagggtgttccattgaggattgagattggtcccagagacctagaaaatgatcaggtcagaactgtgagacgtgacaacggagttaaggaagatatcccaagaggtagcttagtcgaacatgttaaggaactgcttgaaaagatccagcaaaacatgtatgaagttgctaagcaaaagagggaagcatgtgttcaagaggtaaagacttgggatgagtttatcaaagctcttaacgaaaagaaactcattttggctccctggtgtgatgaagaggaagtggaaagagatgttaaggcacgtacgaaaggtgaaacaggagcagctaaaaccctttgttctccatttgatcagcctgaactccctgaaggcactctctgctttgcttcaggaaaacctgcaaagaaatggacctattggggcaggagttactaagtgttcatcatgttttgattcaattcatgaaaatttacttttggcttgtaaagactctctcaagtgcattgtgctttgatctgatattttgaccaaaagctatttgagttattttgactgtgattgcactaagaattataaagagttgtttgattcaaagatattgatggaaaacggtaccgaattcgttttagcataaatttcagaccaatattacgtaaaccggaaagtggcctggtttactatttgttaacggaagagaaccccataatcatatcccaaatgtcgttgttaagattaattaatcacattatgttttgttgcattcagggaagcctgcaaagaaagtggacttattgggggcaggactgcaggagttacaaagttgatgaaaattgcttc

SEQ ID NO: 2422 - DNA, 1734 bp, Cocos nucifera
ggaggaggggggtttcctctcctctctcaacgcatcgcctcacccagtcgagaggcaaggtattccacttcctctccggtgccgccgccatccgcacctggcattattctatcagaaggcatggcggctagcaatactgataccagtaatgcaaggaagaaggaagtgaagaaagaaactcgtctgggtttgacctataagaaagataaggattttggagaatggtattctgaggtttgtgttgctggtgaaatgattgaatactatgacatttctggctgctatatcctaaggccatggacgatggcaatctgggaaacattgcaagcttttttgatgcagaaataaagaagatgaacatcaagaatgcatatttccctcttttcgtaactgagaatgttctacaaaaggagaaggatcatatagaaggttttgctcctgaggttgcttgggttactaaatctggacagtctgaaatggaaattcctattgcaatccgtcctacaagcgagactgttatgtatccatattactctaaatggataagggggcatcgtgacttgccattgaagcttaaccagtggtgcaatgttgtgagatgggaattcagccatcctactccttttatcaggagtcgagagtttctttggcaagaaggacatacagctttcgcgacaaaagatgaagctgatcaagaggttcttgaaatattggaattatatcgaaggatatatgaagaatttcttgcaattccagttattaagggacagaaaagtgagctagaaaaatttgctggtggtttttatactacaagtgttgaggcttttattccaaatacaggtcgtgggatacaaggtgccacctcacattgtcttggtcaaaattttgcaaagatgttccagataaattttgagaatgagaaaggtgaaaaggcaatggtctggcagaattcttgggcatacagcacccgcacgataggggtgatggtgatggttcatggagatgacaagggcttggttctgccacctagagtagcgtcggtccaagttattgtgattcctgtaccatataaggatgctgatacacaggccatctttgatgcctgcagatcgacagttgagacactatgtaaagcaggtttcagagctgaggtggacttaagagataactattcacctggttggaagtactctcactgggaaatgaaaggtgttcctctgagaatcgaaattgggccgaaggatttagcaaataatcaggtacgggttgttcgccgtgacagtggtgcaaagatggacataccaatgcacagtttggtagaacaagtaaaagagatactatccaatattcaagagagcctttttaatgcagcaaaacaaaagagagaggcttgcgtcaaggtcatcaatacatgggatgaattcatagcagctcttaataacaaaaagttgattctggctccctggtgtgatgaagaggatgttgaaaaagatgtgaaagctcgaacaaagggagaacttggagctgctaagacattgtgcacgccatttgatcagccaagacttcctgaaggaactctttgctttgcgtcgggcaggcctgcaaagaagtggacttattggggccgaagctactaaccagtttggcctatatgaagattgtggttttcataatcattcaccgaattgattcagaatggatggtgcctatctcatgggcacagatttgtttttt

SEQ ID NO: 2423 - DNA, 1777 bp, Cyclamen graecum
ctctctctctagcagccatggagccgtcggaagccgccgtctccgtcgccaaggatctctcttccatggccttagatggaaaagtggctggtggcaagcccaagaaggctaatgctaacacgaacaacaggaaaaagaaggaagttaagaaagagactggtttggggcttactgctaagaaggatgacaactttggtgaatggtattctgaggttgttgtgagtggtgaattgatcgaatactatgacatttctggctgttatattcttcggccatggactatgtcgatttgggagatcatgcaagccttctttgattcagaaattaaaaagatgcggataaaaaattgttattttccactctttgtatccccaggcgttctacaaaaggagaaggatcatatcgagggttttgctcctgaggttgcgtgggtcacaaaatccggacaatctgacttggaggtgcctatagcaattcgtccaaccagtgaaactgtcatgtacccatactattcgaagtggataagaggtcatcgggatttgcctttaaagcttaaccagtggtgtaatgttgttagatgggagttcagcaatccaactccgtttatcaggagccgcgagtttctttggcaggagggtcacacggcatttgccacaaaggaggaggctgatatagaggttcttgaaattttggaattatatagacgcatatacgaagagtttttggctattcccgtcataaaaggaaagaaaagtgaacacgagaagtttgcaggtggactttatacaactagtgtggaggctttcgttcctcacactggtcgtggtgtccaaggtgccacttctcactgtttgggtcagaacttcgcaaaaatgtttgagataaattttgaaaatgagaaaggtgaaaaggctatggtgtggcagaattcgtgggcatacagtacaagaacgattggagtaatggtgatggtacacggtgatgataaaggcttggtacttccaccgaaagtttctgcagtacaagttattgttattcctgtgccttataaggatgctgacactaaaggtatctatgatgcctgtgagactgctatgaaaactttgaacgaatctggtattcgcgctgaagcagattttagggacaactattcccctggttggaagtattcccattgggaaatgaaaggtgttcccttgagaatagaaattgggccaaaagatcttgcaaacaatcaggtacgtgctgttcgtcgtgatactgcagctaaaattgatattcctatggctgatttggttaatcatgtgggagacttgcttaatagtattcagaaaagtttatttgaagccgcaaaacacaaaagggatgcatgcatccaggtcgtgaaaacttgggatgaattcacagaagctttgagtaataagaaaatgatattggcaccttggtgtgatgaagaggaggtggagaaagatgtgaaagcccggactaaaggggaaattggagcggcaaagactctgtgttctccttttgaacagcctgaactaattgaaggtacattgtgctttgcttccggcaaacctgcgaagaaatggacctactgggggcgaagttactgattttctatcaataactctcttaattgaaagattcatttactagcagcttgatgcacgggatttatgttccatatttgtttttatattcaagttcgagttttaaaaagatacaagttgtttagagatactgagcaaatgctaattttattttaatgtagagc

SEQ ID NO: 2424 - DNA, 1762 bp, Avena sativa
agacaatccttgcgcgctactctgtccccactccccatcctttcccagccgccgccgccgccgctgcctccacttaaaccctaagagcgccgctcgcaatcgcatcgcccccgaagctcctcccggcggacaagagcaagcggcggttcgggatccagccatgtcgaccagcaagggcggaggcggaggaggagggggagggaagaagaagaaggaggtgaagaaggagacgaagctagggatggcgtacaagaaggacgataacttcggggagtggtactccgaggttgttgttaacagcgaaatgattgagtactatgacatctctggttgttatatcttgaggccctgggcgatggaaatatgggaattgatgaaagaattcttcgatgcagaaataaaaaagctgaagctgaaaccatattatttccccttgtttgttactgagaatgtcctgcagaaggagaaagaccatattgagggctttgcacccgaggttgcatgggttactaaatcaggaaaatctgacttggaagctccgattgctatcagaccaacaagcgagactgtcatgtatccatacttctctaaatggataagaagccaccgggacttacctttgaagtgtaaccagtggtgcaatgttgttagatgggagtttagcaatccaactcctttcataaggagccgtgaatttctctggcaagaagggcatacggtttttgcgactaaagaggaagcagatgaagaggtcctccaaatattggaactctaccggagaatatatgaagaatttttagcagttccagtgtccaaagggaggaaaagtgagatggaaaagtttgctggtggactgtatacaaccagtgttgaggccttcatcccaaacactggtcgtggtatacagggtgcaacttcacattgccttggtcaaaattttgcaaagatgtttgacattacttttgagaatgaaaaaggcgaaaggtccatggtgtggcagaattcttgggcatacacgacccgctcgattggggtcatggtaatgacacatggtgatgacaagggcttagtcctaccacccaaggtggcacctatccaggtcatcgtaattcctgtgccatttaaagacgctgacacaactgctattaaaggagcatgcgagtcgaccgtttacaccttgaaccaagcagggattcgagctgacttggatgctcgcgaaaactattctccaggctggaaatattctcaatgggaaatgaaaggtgtgccgttgagaattgagataggtcctaaagatttggcaaacaagcaggtgcgcattgtccggcgagacaatggtgcaaaggttgatattccttcgaccgacttggtagagcaggttagagtgttgctggatgggattcaagtgaacttgttggaaacagcaaagcaaaagagggatgcttgcattgcacccatcagcacttgggatgaattcacagcagctctcaatgacaaaaagttgatcttggctccatggtgtgatgaagaggaagtcgaaaaggacgtgaaagctcggacaaaaggtgaactcggagctgcaaaaacattgtgtactccatttgatcagccagatcttccttccggaaccgtgtgctttgcttctggaaagcctgctacaaagtggtcgttctggggtcgcagctattgatctccatgacctgttacattactattttcttcaaacatttgtcctggcagggccgtttgtcatatacctgat

SEQ ID NO: 2425 - DNA, 2089 bp, Brachypodium distachyon
ctcgtcaacctcacctcacccagcaaagcatccggccggccgccttgtccccttggcaacttgcgccccactcgacccaatcccctttcccagccgccgctgcctccactttaaaccctaggactcgcccgcagtcgtaactcgtaacgcacaaagcattttcctctctccccttcccctgcgcccccccggatcccgtcgcggaagaagagaagcggcggcgggttcggatccagccatgtcgaccaacaagggcggaggtggtggtggaggtggagggaagaagaagaaggaggtgaagaaggagacgaagctggggatggcgttcaagaaggacgagaacttcggggagtggtactccgaggttgttgttaacagtgaaatgattgagtactatgacatctctggttgttatatcttgaggccctgggccatggaaatatgggagttgctgaaagaattctttgatgcggaaattaaaaagctgaagctaaaaccatattatttccctttgtttgttacggagaatgttctccagaaggagaaggaccatattgagggctttgcacctgaggtagcgtgggttactaaatcaggaaaatctgatctggaagctcctattgcaatccgtcccacaagtgaaactgtcatgtatccatacttctctaaatggatacgaagccacagggacttgcctttgaagtgtaaccagtggtgcaatgttgttagatgggagtttagcaatccaactcctttcataaggagccgtgagttcctttggcaggaagggcatacagtttttgcgactaaagaggaggcagatgaggaggtcctccaaatattggaactctaccggaggatatatgaagaatttttagcagttccagtgtacaaagggaggaaaagtgagatggaaaagtttgctggtggactttataccaccagtgtggaggcattcataccaaacactggccgtggtatacaaggtgcaacttcacattgtcttggtcaaaactttgcaaagatgtttgacatcactttcgagaatgaaaagggtgaaaggtccatggtgtggcagaattcatgggcatacactacccgctcgatcggggtgatggtaatgacccatggtgatgacaagggcttagtgctaccaccaagagtggcacctatccaggtcattgttattcctgtgccatttaaagatgctgacacaacggctattaaaggcgcatgtgagtcgactgtttacaccttgaaccaagctgggattcgtgcagacttggatgctcgcgaaaactactctccaggttggaaatattctcagtgggaaatgaaaggtgttcctttgagaatcgagataggtccaaaagatctggcaaacaaacaggtgcgaattgtccggcgagacaatggtgcaaaggtggatattccttcgaccgacgtggttgagcaggttggagcattgctggaagggattcaagcaaacttgttggaaacagccaagcaaaaaagagatgcctgcattaaaaccatcagcacttgggatgaatttattggagctctgaatgacaaaaagttgatcttggctccatggtgtgatgaagaggaagttgagaaggacgtgaaagctcggacgaaaggtgaactcggagctgcgaaaacgttgtgtactccatttgatcagccagatcttcctgccgggaccgtgtgctttgcttccggaaagccagcgcagaagtggtcattctggggtcgcagctattgatctccgtgtcacatcaaatttttcattctggcaaagccgtttatttcacatacttgtggctattttgtatacctgtactctaatgggaatctaattgtttgtttcaaaatcatgctgctgtgatgatgcactgcacctgatcgactgaactttgtggtgattgtattggattatgccagcgtcaatagaaatagagggcttttccatggtcacacccgaactatcttcctcgtctcaaattgttttccgcacgcaatttggagcgtgcgtcgctccggcgctccttgagcactctgatcggcgatcgcaatctcgagtaac

SEQ ID NO: 2426 - DNA, 2244 bp, Brachypodium distachyon
cgtcaacctcacctcacccagcaaagcatccggccggccgccttgtccccttggcaacttgcgccccactcgacccaatcccctttcccagccgccgctgcctccactttaaaccctaggactcgcccgcagtcgtaactcgtaacgcacaaagcattttcctctctccccttcccctgcgcccccccggatcccgtcgcggaagaagagaagcggcggcgggttcggatccagccatgtcgaccaacaagggcggaggtggtggtggaggtggagggaagaagaagaaggaggtgaagaaggagacgaagctggggatggcgttcaagaaggacgagaacttcggggagtggtactccgaggttgttgttaacagtgaaatgattgagtactatgacatctctggttgttatatcttgaggccctgggccatggaaatatgggagttgctgaaagaattctttgatgcggaaattaaaaagctgaagctaaaaccatattatttccctttgtttgttacggagaatgttctccagaaggagaaggaccatattgagggctttgcacctgaggtagcgtgggttactaaatcaggaaaatctgatctggaagctcctattgcaatccgtcccacaagtgaaactgtcatgtatccatacttctctaaatggatacgaagccacagggacttgcctttgaagtgtaaccagtggtgcaatgttgttagatgggagtttagcaatccaactcctttcataaggagccgtgagttcctttggcaggaagggcatacagtttttgcgactaaagaggaggcagatgaggaggtcctccaaatattggaactctaccggaggatatatgaagaatttttagcagttccagtgtacaaagggaggaaaagtgagatggaaaagtttgctggtggactttataccaccagtgtggaggcattcataccaaacactggccgtggtatacaaggtgcaacttcacattgtcttggtcaaaactttgcaaagatgtttgacatcactttcgagaatgaaaagggtgaaaggtccatggtgtggcagaattcatgggcatacactacccgctcgatcggggtgatggtaatgacccatggtgatgacaagggcttagtgctaccaccaagagtggcacctatccaggtcattgttattcctgtgccatttaaagatgctgacacaacggctattaaaggcgcatgtgagtcgactgtttacaccttgaaccaagctgggattcgtgcagacttggatgctcgcgaaaactactctccaggttggaaatattctcagtgggaaatgaaaggtgttcctttgagaatcgagataggtccaaaagatctggcaaacaaacaggtgcgaattgtccggcgagacaatggtgcaaaggtggatattccttcgaccgacgtggttgagcaggttggagcattgctggaagggattcaagcaaacttgttggaaacagccaagcaaaaaagagatgcctgcattaaaaccatcagcacttgggatgaatttattggagctctgaatgacaaaaagttgatcttggctccatggtgtgatgaagaggaagttgagaaggacgtgaaagctcggacgaaaggtgaactcggagctgcgaaaacgttgtgtactccatttgatcagccagatcttcctgccgggaccgtgtgctttgcttccggaaagccagcgcagaagtggtcattctggggtcgcagctattgatctccgtgtcacatcaaatttttcattctggcaaagccgtttatttcacatacttgtggctattttgtatacctgtactctaatgggaatctaattgtttgtttcaaaatcatgctgctgtgatgatgcactgcacctgatcgactgaactttgtggtgattgtattggattatgccagcgtcaatagaaatagagggcttttccatggtcacacccgaactatcttcctcgtctcaaattgttttccgcacgcaatttggagcgtgcgtcgctccggcgctccttgagcactctgatcggcgatcgcaatctcgagtaacgcgtactcctatttacgaaattgtggatgcatcagacggcaagccgcatggaacaatccgcgcttacgctttcacaatttagctgcgtaggaagcttcgtcctatgccacgtcagtatggttctcacgacatgttttatttatttatttattgacgg

SEQ ID NO: 2427 - DNA, 1901 bp, Avena sativa
gcgcgctactctgtccccactccccatcctttcccagccgccgccgccgctgcctccacttaaaccctaagagcgccgctcgcaatcgcatcgcccccgaagctcctcccggcggacaagagcaagcggcggttcgggatccagccatgtcgaccagcaagggcggaggcggagggggagggggagggaagaagaagaaggaggtgaagaaggagacgaagctagggatggcgtacaagaaggacgataacttcggggagtggtactccgaggttgttgttaacagcgaaatgattgagtactatgacatctctggttgttatatcttgaggccctgggcgatggaaatatgggaattgatgaaagaattcttcgatgcagaaataaaaaagctgaagctgaaaccatattatttccccttgtttgttactgagaatgtcctgcagaaggagaaagaccatattgagggctttgcacccgaggttgcatgggttactaaatcaggaaaatctgacttggaagctccgattgctatcagaccaacaagcgagactgtcatgtatccatacttctctaaatggataagaagccaccgggacttacctttgaagtgtaaccagtggtgcaatgttgttagatgggagtttagcaatccaactcctttcataaggagccgtgaatttctctggcaagaagggcatacggtttttgcgactaaagaggaagcagatgaagaggtcctccaaatattggaactctaccggagaatatatgaagaatttttagcagttccagtgtccaaagggaggaaaagtgagatggaaaagtttgctggtggactgtatacaaccagtgttgaggccttcatcccaaacactggtcgtggtatacagggtgcaacttcacattgccttggtcaaaattttgcaaagatgtttgacattacttttgagaatgaaaaaggcgaaaggtccatggtgtggcagaattcttgggcatacacgacccgctcgattggggtcatggtaatgacacatggtgatgacaagggcttagtcctaccacccaaggtggcacctatccaggtcatcgtaattcctgtgccatttaaagatgctgacacaacagctattaaaggagcatgcgagtcgaccgtttacaccttgaaccaagcagggattcgagctgacttggatgctcgcgaaaactattctccaggctggaaatattctcaatgggaaatgaaaggtgtgccattgagaattgagataggtcctaaagatttggcaaacaagcaggtgcgcattgtccggcgagacaatggtgcaaaggttgatattccttcgaccgacttggtagagcaggttagagtgttgctggatgggattcaagtgaacttgttggaaacagcaaagcaaaagagggatgcttgcattgcacccatcagcacttgggatgaattcacagcagctctcaatgacaaaaagttgatcttggctccatggtgtgatgaagaggaagtcgaaaaggacgtgaaagctcggacaaaaggtgaactcggagctgcaaaaacattgtgtactccatttgatcagccagatcttccttccggaaccgtgtgctttgcttctggaaagcctgctacaaagtggtcgttctggggtcgcagctattgatctccatgacctgttacattactattttcttcaaacatttgtcctggcagggccgtttgtcatatacctgatcttcgatgattttgtagtactgtttgcaggttgcatcatcattttcttcatatacctatattgcacatgaatgcaattgattgtaaaaatcttctgttgtgacaatgcaatgcattgatcggcataacttttttctgattatatgttatgtta

SEQ ID NO: 2428 - DNA, 1888 bp, Oryza sativa
atctccttcctcctcctcctccgccgccgccaccactactaaaaccctagctgctcgcctcgcccacgccctcgctcgcctcgcctgatcccgccgcgtcgtagcagcagggcggagccatgtcgtccgggaagggaggtggaggcggcggcaagggaggcggagggaagaagaaggaggtgaagaaggagacgaagctcgggatggcgtacaagaaggatgacaacttcggggagtggtactccgaggttgtcgttaacagtgaaatgatcgagtactatgacatatccggttgttatatcttgaggccatgggcgatggagatctgggaattgcttaaagaattctttgatgcagaaataaaaaagctgaagctgaaaccttattatttcccattgtttgtcactgagaatgtcctacagaaggagaaagaccacattgagggctttgcaccagaggtagcatgggtcactaaatcaggaaaatctgatctggaagctcctatcgcaatccgtcctacaagtgagactgtcatgtatccatacttctccaaatggataagaagtcatcgggacttacctttgaggtgtaaccagtggtgtaacgtcgtgcgatgggagtttagcaatccaactccattcataaggagccgtgagttcctttggcaagaagggcatacagcttttgcaactaaagaggaggctgacgaagaggttctccaaattttggaactctaccgaaggatttatgaagaatttttagcagttccagtttctaaagggaggaaaagtgagatggaaaaatttgctggtggactgtatacaacaagtgttgaggccttcattccaaacacaggacgtggtgtacaaggggcaacatcacattgtcttggtcaaaactttgcaaagatgtttgatatcacttttgagaatgataagggctcaagatccatggtgtggcagaactcttgggcatacaccacccgctcgattggggtgatggtgatgacacacggagatgacaaaggtttagtgcttccaccaagggtggcacctctgcaggtcattgttattcctgttccatacaaagatgttgacacaacagctattgtaaacgaatgcaaaaagactgttgagacactggagaaagctggtattcgagcagacttggatacccgcgaaaactattctccaggatggaagtattcccactgggagatgaaaggcgttcctctaagaattgagataggtccaaaagatatggcaaacaatcaggcccgtgttgttaggcgagacaatggtgcaaaagctgatattcctacggctgacttggttgagaaagttaatgggttacttgatgaggttcagaaaaacttgtttgagacggcgaaacaaaagagagatgcctgccttaaggttgttaacacctgggatgaattcatagtggctctgaatgacaaaaaattgatcctggctccatggtgtgatgaagaggaagttgagaaggatgtgaaggctcggacaaaaggtgacctgggagctgccaagacattgtgtacaccatttgaacagccagatctcccagaaggaaccacatgctttgcttctggaaagcctgcgaagaaatggtcattctggggccgcagctattgatctgtaacggatctcggttgtgatcattcattcctgctggcgaagccgttgattcaccatagacatgtattgcagttttcatactagcaaagcatgatacacatacatctatttaccgtgcagttttgctgcttgtcagaaatcttgacattggaatgtttaagtaacatcttgtttggttcagaatcttgtttacccagcaacttaattgaactaatcgttgacattgtgttttc

SEQ ID NO: 2429 - DNA, 1935 bp, Valeriana officinalis
ttgaaacttgggaaggtttttaggtttagaaccattgccgcctccttagagcctcatttcgtttcatctgctcggagagtgtcagccgctatccactccatctccccctgccgattccaacctctcgctcaatttgctacagaatcgcccaaaatcttcatccacgagatgtcgagcggtgataagaaatcgaatgaaaaggataagtcaagtggtgctaagaaaccaaacgccaaaggtggtaaagtaaaggaggtgaaaaaggagactggtcttggtctttctcacaagaaggatgataactttggagagtggtattctgaggtggttgtgaatagtgagatgatcgagtattatgacatctcaggttgctatattttgaggccatggacaatgtcaatatgggaaattatgcaagagttttttgacaaagaaataaagcagatgaagatcaagaattgctacttcccactttttgtgtccgccggtgtactgcaaagagaaaaggatcacatcgaaggttttgctccagaggtagcatgggttacaaaatcgggtcaatctgatctagaaaatccaattgcgatccgtccaacaagtgagactgttatgtatccatatttctcaaagtggattcgaggacaccgcgatcttccattgaggctaaaccagtggtgtaatgttgttcgctgggaattcagcaaccctactcctttcattaggagtcgcgagtttctttggcaagaggggcatacagcatttgcatccaaggaggaggcagataaagaggttcttgaaatattggaactctatagaagggtttatgaagagtttcttgctgtaccagttttcaagggtaagaagagtgagaatgagaagtttgctggtggactttacacaactagcgttgaggcttttatcccacacactggtagaggtgtacaaggagctacatcgcattgcttgggacaaaattttgctaaaatgtttgacattacttacgaaaatgagaaaggtggaaaggcaatggtttggcagaattcttgggcatatagtactcgaacgattggggtgatggtgatggttcatggagatgacaaaggtttagtgctgccaccaaaagtagcatcagttcaagtaattgtagttccagtgccatacaaagatgtggacaccgaagccatattagaagcttgcacaaatgctgttaaaattttgactgaagctggaatccgtgccgagtccgatcttcgagataactattctccaggctggaaatactctcagtgggaaatgaaaggtgtccctttgaggcttgaaatcgggccaaaagatttagctaaaaatcaggcacgtgctgttcgccgtgacacttttgctaaggttgatcttccagtagcgaacttggttgaacaagtgagtgagatgttggataatattcagcagaatctgttcgaagttgcaacgcaaaagcgagatgcttgtgtcaagaagatacacacttgggaagagtttgtggaagcacttggccagaagaaaatgatattggctccttggtgtgatgaagaggaagttgagaaggatgtgaaagcaagaacaaagggtgagatgggagcggctaagacgctttgctctccatttgatcagctagagctcccagaaggtaccaaatgctttgcctcgggaaaaccagcaacgaaatggagttactggggaaggagttactaaaacttgaaacaatctttctggagtatttttggtgttctcatatgaaggttcaactcttttttaactcagcaaacaaagatatattgtattgttggtgatgccctttgacgcctgtttgcttttttatgattcgctatttgaaaacagatttgtgttttttctatacgttcatacttaattaatacatgaatgagttttactaaaaaa

SEQ ID NO: 2430 - DNA, 1834 bp, Avena sativa
cttccgccggccgcactcgtgctgctgctccccgcatcctgctctctccgtctccgcctcgacgcctcgacgcggggggtccgcgcgcgaggcctcgccgccgtcactccgtcagcggcggtttgggatccagccatgtcgactagcaagggcggaggcggtgccggagggaagaagaagaaggaggtgaagaaggagacgaagctggggatggcgtacaagaaggacgataacttcggggagtggtactccgaggttgttgttaacagcgaaatgattgagtactatgacatctctggttgttatatcttgaggccttgggcgatggaaatatgggaattgatgaaagaattcttcgatgcagaaataaaaaagctgaagctgaaaccatattatttccccttgtttgttactgagaatgtcctgcagaaggagaaagaccatattgagggctttgcacccgaggttgcatgggttactaaatcaggaaaatctgacttggaagctccgattgctatcagaccaacaagcgagactgtcatgtatccatacttctctaaatggataagaagccaccgggacttacctttgaagtgtaaccagtggtgcaatgttgttagatgggagtttagcaatccaactcctttcataaggagccgtgaatttctctggcaagaagggcatacggtttttgcgactaaagaggaagcagatgaagaggtcctccaaatattggaactctaccggagaatatatgaagaatttttagcagttccagtgtccaaagggaggaaaagtgagatggaaaagtttgctggtggactgtatacaaccagtgttgaggccttcatcccaaacactggccggggtatacagggtgcaacttcacattgccttggtcaaaattttgcaaagatgtttgacattacttttgagaatgaaaagggcgaaaggtccatggtgtggcagaattcttgggcatacacgacccgctcgattggggtcatggtaatgacacatggtgatgacaagggcttagtcctaccacccaaggtggcacctatccaggtcatcgtaattcctgtgccatttaaagatgctgacacaacagctattaaaggagcatgcgagtcgaccgtttacaccttgaaccaagcagggattcgagctgacttggatgctcgcgaaaactattctccaggctggaaatattctcaatgggaaatgaaaggtgtgccgttgagaattgagataggtcctaaagatttggcaaacaagcaggtgcgcattgtccggcgagacaatggtgcaaaggttgatattccttcaactgacttggtagagcaggttagagtgttgctggatgggattcaagtgaacttgttggaaacagcaaagcaaaagagggatgcttgcattgcacccatcagcacttgggatgaattcacagcagctctcaatgacaaaaagttgatcttggctccatggtgtgatgaagaggaagtcgaaaaggacgtgaaagctcggacaaaaggtgaactcggagctgcaaaaacattgtgtactccatttgatcagccagatcttccttccggaacggtgtgctttgcttctggaaagcctgctacaaagtggtcgttctggggtcgcagctattgatctccgtgacatgtctcattactattttcttcatccatttgtcctggcaaggccgtttgtcatatacctgatcttggatgattttgtagtactgtttgcaggctgcatcatcatttttttcatatacctgtactgcacatgaatccaattgcttgtaaaaatcttctgttgtgac

SEQ ID NO: 2431 - DNA, 1876 bp, Avena sativa
agacaatccttgcgcgctactctgtccccactccccatcctttcccagccgccgccgccgccgctgcctccacttaaaccctaagagcgccgctcgcaaccgcatcgcccccgaagctcctcccggcggacaagagcaagcggcggttcgggatccagccatgtcgactagcaagggcggaggcggtgccggagggaagaagaagaaggaggtgaagaaggagacgaagctggggatggcgtacaagaaggacgataacttcggggagtggtactccgaggttgttgttaacagcgaaatgattgagtactatgacatctctggttgttatatcttgaggccttgggcgatggaaatatgggaattgatgaaagaattcttcgatgcagaaataaaaaagctgaagctgaaaccatattatttccccttgtttgttactgagaatgtcctgcagaaggagaaagaccatattgagggctttgcacccgaggttgcatgggttactaaatcaggaaaatctgacttggaagctccgattgctatcagaccaacaagcgagactgtcatgtatccatacttctctaaatggataagaagccaccgggacttacctttgaagtgtaaccagtggtgcaatgttgttagatgggagtttagcaatccaactcctttcataaggagccgtgaatttctctggcaagaagggcatacggtttttgcgactaaagaggaagcagatgaagaggtcctccaaatattggaactctaccggagaatatatgaagaatttttagcagttccagtgtccaaagggaggaaaagtgagatggaaaagtttgctggtggactgtatacaaccagtgttgaggccttcatcccaaacactggccggggtatacagggtgcaacttcacattgccttggtcaaaattttgcaaagatgtttgacattacttttgagaatgaaaagggcgaaaggtccatggtgtggcagaattcttgggcatacacgacccgctcgattggcgtcatggtaatgacacatggtgatgacaagggcttagtcctgccacccaaggtggcacctatccaggtcatcgtaattcctgtgccatttaaagatgctgacacaacagctattaaaggagcatgcgagtcgaccgtttacaccttgaaccaagcagggattcgagctgacttggatgctcgcgaaaactattctccaggctggaaatattctcaatgggaaatgaaaggtgtgccgttgagaattgagataggtcctaaagatttggcaaacaagcaggtgcgcattgtccggcgagacaatggtgcaaaggttgatattccttcaaccgacttggtagagcaggttagagtgttgctggatgggattcaagtgaacttgttggaaacagcaaagcaaaagagggatgcttgcattgcacccatcagcacttgggatgaattcacagcagctctcaatgacaaaaagttgatcttggctccatggtgtgatgaagaggaagtcgaaaaggacgtgaaagctcggacaaaaggtgaactcggagctgcaaaaacattgtgtactccatttgatcagccagatcttccttccggaaccgtgtgctttgcttctggaaagcctgctacaaagtggtcgttctggggtcgcagctattgatctccatgacctgttacattactattttcttcaaacatttgtcctggcagggccgtttgtcatatacctgatcttcgatgattttgtagtactgtttgcaggttgcatcatcattttcttcatatacctatattgcacatgaatgcaattgattgtaaaaatcttctgttgtgacaatgcaatgcattgatc

SEQ ID NO: 2432 - DNA, 2163 bp, Castanea mollissima
catctccttgtcacatcctcgatcacttcgcggtctcgccggattcggtggcggaggatttcgttacaaccggtgtaagctgaaactcaggaataagctgaggacatggctggcggcgatgagaaaaagtcaaaccccggcggcggcgttgcgaaaaagcctaatgccggcggcggcggaggtgcgaaaaagcctaatgtcagcggcggaggaaaaaagaaggaggtgaagaaggagactggtttgggactagtgaatcgcaaggatgagaattttggggaatggtattctgaggttgttgtgaatgcagaattgattgagtattacgatatttccggctgttatattctgaggccatggacaatggcgatctgggaggaaatgcaaaaattttttgatgctgaaataaagaaaatggacatccagaactgctacttcccactttttgtttctcctggggtattgcagaaggagaaggatcacgttgagggttttgctcctgaggttgcatgggtgacaaaatctggggagtctgagttggaagtgcccattgcaattcgtccaactagtgaaactgtcatgtatccttactattctaaatggataaggggacaccgtgacttgcctttgaaacttaatcagtggtgcaatgttgttcgatgggaattcagccatcctacgccatttatcaggagtcgcgagtttctttggcaggaaggccatactgctttcgcaacaaaagcagaggcggatgaagaggtgctggatattttggaactctatagacgcatatatgaagagtacttggctattcctgtcataaagggaaagaagagtgaactggagaagtttgctggtggactttacacaactagtgttgaggcatttgttccaaacactggtcgtggcatacaaggtgcaacttcgcattgtctgggtcaaaattttgctaaaatgtttgagataaactttgaaaatgagaagggagagaagggtatggtctggcagaactcatgggcctatagcactcggacgattggtgttatggtgatggttcatggggacgacagaggcttagtgctgccaccaaaagtagcatctgtccaggttattgtaattcctgtgccttataaagatgctgatactcaggcaatctttgatgcctgttctgccactgtggcctccttgtctgaggcaggtattcgtgctaaggcagactctagagataattactctcctggttggaagtactcacattgggaaatgaaaggcgttcctctaagaattgaaattggtccaaaagacttggcaaatagtcaggtacgtgcagttcgccgtgataattcagcaaaaacagacatccctaggggcaagctggttgagcaagtaaaagaaatgctggacaatatccaacaaagcctgtttgatgctgccaaacaaaaacgagatgcttgcattcagactgtaaaaacttgggatgaatttgtggaagcactcggccaaaggaaaatgatcttagcaccttggtgtgatgaggaggaggtggagatagaagtaaaagcaaggacaaagggtgagatgggagcatgtaagagcctttgttccccatttgaccagccagagctcttagaaggtactaaatgctttgcatcgggaaagcctgcaaaaaatggacgtactggggaaggagttactagattattgatttttgacatgatttcttctcctggtgttcctcaatccgtttgagatgttatggaatctgcgattctcaagaattagcgagtaatagtattttctacaaacaaatacaaggacaccattttaaaaagaattaaaaattaatagtccatatgtatggatcttacatgaaaaagtgaaatcatttgctttgctacaagcaaaaggctacaatgtttttatattgttgattttttaatgtcttagatatgactcgttgccttagattgaattctctcttttgagtttcaagttggttggtgatatgaatcagtaactccttttctgaatggtagtcatgggtaaaaaagaaaactggaatgctaatgcgggtgcaatgcatgaatgtctacttttcttattctaatgtgcatacaggacattggcaaatgagatagccttagtgaaggtgtgatgtttgat

SEQ ID NO: 2433 - DNA, 1562 bp, Fagus grandifolia
atattgtgctttctcttctttttctctctggttatcgctttcctttttatttcatctccctccataatcgctttcagtctacgccgtccccaaaaaccaaaatcactgacactcctctctctgacaccgcagggctaagctgaggacatggcgggtggtgatgcaaaaaagtctaatgctaaagccagcggtggggggaaaaagaaggaggtgaagaaggagactggtttgggactagtaaatcgcaaggatgagaattttggggagtggtattctgaggttgttgtgaatggagagatgattgagtattatgatatctctggctgttatattctgagaccatgggcaatggcgatctgggagatcatgcaaaaatttttcgatgctgaaataaagaaaatggacatccagaattgctatttcccactttttgtttctcctggcgtattacagaaggagaaggatcatgttgagggttttgctcctgaggttgcatgggtgacaaaatctggggagtctgagttggaagtgcccattgcgattcgcccaacgagtgaaactgtcatgtatccatactattctaaatggataaggggacaccgtgacttgcctttgaaacttaatcagtggtgcaatgttgttcgatgggaattcagccatcctacgccatttatcaggagtcgcgagtttctttggcaggaagggcatactgcttttgcaacacaagcagaggcagatgcagaggtgctagatattttggaactgtatagacgcatatatgaagaatacttggctattcctgtcacaaagggaaagaagagtgagctggagaagtttgctggtgggctttacacaactagtgttgaggcatttgttccaaacactggtcgtggcatacaaggtgcaacttcacattgtctgggtcaaaattttgctaaaatgtttgagataaactttgaaaatgagaagggagagaagggtatggtctggcagaactcatgggcctatagcacccggacgattggcgttatggtgatggttcatggagatgacaaaggcttagtgctgccacctaaagtagcatctgtccaggttattgtaattcctgtgccttataaagatgctgatacaaagggaatttttgatgctgttgccgccactgtggatgccttgtctgaggcaggtattcgtgctaagtctgaccttagagataattactctcctggttggaagtattcccattgggaaatgaaaggcgttcctctaaggattgaaattgggccaaaagacttggcaaatagtcaggtacgcgctgttcgccgtgataatgcggcaaaaatagacatccctagggcccagttggttgagcaagtaaaagaaatgctggataatatccagcaaagcctgtttgatgctgccaaacaaaaacgagatgcttgcattcagactgtaaaaacttgggacgaatttgtggaagcactcagccaaaggaaaatgatcttagcaccttggtgtgatgaggaggaggtggagaaagatgtaaaagcaaggacaaaaggtga

SEQ ID NO: 2434 - DNA, 1824 bp, Festuca arundinacea
cttaaaccctaacgcgtcgcttgcaatcgcatcggccccaaagctcccggcgttctcccggatcccggcagcggcggttcgggatccagccatgtcgaccaacaagggcggaggcggtgccggaggcggagggaagaagaagaaggaggtgaagaaggagaccaaactggggatggcttacaagaaggacgataacttcggggagtggtactccgaggttgttgttaacagcgaaatgattgagtactatgacatatctggttgttatatcttgaggccttgggcgatggaaatatgggaattgctgaaagaattcttcgatgcagaaataaaaaagttgaagctgaaaccatattatttccctttgtttgttactgaaaatgttctgcagaaggagaaagatcatattgagggctttgcacctgaggttgcatgggttactaagtcaggaaaatctgacttggaagctcctattgctatcagaccaacaagcgagactgtcatgtatccatacttctctaaatggataagaagccaccgggacttacctttgaagtgtaaccagtggtgcaatgttgttagatgggagtttagcaatccaactcctttcataaggagccgtgaatttctctggcaagaagggcatacagtttttgcaactaaagaggaagcagatgaagaggtcctccaaatactggaactctaccggagcatatatgaagaatttttagcagttccagtgtccaaagggaggaaaagtgagatggaaaagtttgctggtggactttatacaaccagtgttgaggctttcatcccaaacactggccgtggtatacagggtgcaacttcacattgccttggtcaaaactttgcaaagatgttcgatatcacttttgagaatgaaaagggtgaaaggtccatggtgtggcagaactcttgggcgtacacgacccgctcgattggggtcatggtaatgacacatggtgatgacaagggcttagtgctaccacccaaggtggcacctatccaggtcatcataattcctgtgccatttaaagatgctgacacaacagctattaaaggagcatgcgagtcgaccgcttacaccttgaaccaagcagggattcgagcagacttggatgctcgtgaaaactattctccaggctggaaatattctcaatgggaaatgaaaggtgtcccgttgagaattgagataggtccgaaagatctggcaaacaagcaggtgcgcattgtccggcgagacaatggtacaaaggttgatattccttcaaccgacttggtagagcaggttagagtgttgctggatgtgattcaagtaaacttgttcgaaacagcgaaacagaagagggatgcttgcattgcacccatcagcacttgggatgaattcacagcagctctcaatgacaaaaagttaatcttggctccatggtgtgatgaagaggaagtcgagaaggacgtgaaagctcgtacaaaaggcgaacttggagctgcaaaaacattgtgtactccatttgatcagccagaccttccttccggaaccatgtgctttgcttccggaaagcctgctacaaagtggtcgttctggggtcgcagctattgatctccgtgacctggcatattactgttttcttcatacatttgtcctggcaaagccgtttgtcgtatacctgatcttccatggttttgcagtactgttattgcaggttgcatcattcatttttttccgtatacctgtattgcaatatgaatccaattgtttgtgtcaaaatcttctgttgtgacaatgcgatgcattgattgaag

SEQ ID NO: 2435 - DNA, 1957 bp, Lolium multiflorum
cgagcatccgccgtgctgtccaattggctccttgcggcctactcctcctgtcgccctactctgcctagtctaccccatatatcctttttcagccgccgccgccgcctccgcttaaaccctagcgcgtcgcttgcaatcccgcatcggccccaaagctcccggcgttttcccggatcccggcaggagcaagttcgggatccagccatgtcgaccaacaagggcgcaggcggtgccggaggcggagggaagaagaagaaggaggtgaagaaggagaccaaactggggatggcttacaagaaggacgataactttggggagtggtactccgaggttgttgttaacagcgaaatgattgagtactatgacatatctggttgttatatcttgaggccttgggcgatggaaatatgggaattgctgaaagaattcttcgatgcagaaataaaaaagttgaagctgaaaccatattatttccctttatttgttactgaaaatgttctgcagaaggagaaagatcatattgagggctttgcacctgaggttgcatgggttactaaatcaggaaaatctgacttggaagctcctattgctatcagaccaacaagcgagactgtcatgtatccatacttctctaaatggataagaagccatcgggacttacctttgaagtgtaaccagtggtgcaatgttgttagatgggagttcagcaatccaactcctttcataaggagccgtgaatttctctggcaagaagggcatacagtttttgcaactaaagaggaagcagatgaagaggtcctccaaatattggaactctaccggagaatatatgaagaatttttagctgttccagtgtccaaagggaggaaaagtgagatggaaaagtttgctggtggactttatactaccagtgttgaggctttcatcccaaacactggccgtggtatacagggtgcaacttcgcattgccttggtcaaaactttgcaaagatgttcgatatcacttttgagaatgaaaagggtgaaaggtccatggtgtggcagaactcttgggcatacacgacccgctcgattggggtcatggtaatgacacatggtgatgacaagggcttagtgctgccacccaaggtggcacctatccaggtcattgtaattcctgtgccatttaaagatgctgacacaacagctattaaaggagcatgcgaatcggccgtttacaccttgaaccaagcagggattcgagcagacttggatgctcgtgaaaactattctccaggctggaaatattctcaatgggaaatgaaaggtgtccctttgagaattgagataggtccaaaagatctggcaaacaagcaggtgcgcattgtccggcgagacaatggtacaaaggtcgatattccttcggccgacttggtagagcaggttagaatgttgctggatgggattcaagtaaacttgtttgaaacagcgaaacaaaagagggatgcttgcattgcacccatcaacacttgggatgaattcacagcagctctcaatgaaaaaaagttaatattggctccatggtgtgatgaagaggaagttgagaaggacgtgaaagctcgtacaaaaggcgaacttggagctgcaaaaacattgtgtactccatttgatcagccagaccttccttctggaaccgtgtgctttgcttccggaaaggctgctacaaagtggtcgttctggggtcgcagctattgatctccgtaacctgttatattactgttttcttcatacatttgtcctggcaaagccgtttgtcgtgtacctgatcttccatggttttgcagtactgttatcgcaggttgcatcatccatatttttccgtatacctgtattgcaatatgaatccaattgtttgtgtccaaatcttctgttgtgaccatttgatgccttgattgaagtaacttttttttttctgatt

SEQ ID NO: 2436 - DNA, 1663 bp, Cirsium arvense
tttccttcaatccagaagtgctgcgacgccggcggttgaccggaaagcagaattcgaacggcggtgaggttcttgcttttgatcatttgtgtttagcctaaagcaagaacttaacgcccttctgtaattacttgaaatcagtttcattgtagctgaaagtcagaagacatggctggtggaaagggagacaagcctgataatgccaagaaatctgctgctgttgccaaatctagtaagggaaggaaaaaggagacaggtctgggtcttacaaatactaaagatggcaactttggggaatggtattctgaggttgttacaaatggtgaaatgatagaatattatgaaatatctggctgttacattctcaggccatggacaatgtccatttgggagataatgcaaaccttctttgatgcagaaattaagaagatgaagattaaaacttgttattttccgctttttgtatccaataacgttctacaaaaggagaaggatcacatagagggttttgctcctgaggttgcttgggtcacgaggtcaggtgactctgatttggaagtccctattgccattcgcccaactagtgaaaccgtcatgtatccctatttttctaaatggatcaggggacaccgtgacttgcctttaaaacttaatcaatggtgtaatgttgtccgatgggagttcagtaatcctactccatttatcaggagtcgtgagtttctttggcaagaaggacacaccgcctttgcaactaaggaggaggcagacattgaggttctcgaagtccttgaactgtataggcgtctgtatgaggagtacttggctgtaccggttgtgaaaggtaaaaaaagtgagatggagaagtttgccggtggactttatactactagcgttgaggcttttattccaaatactggtcgtggtgttcaaggtgcaacttcacattgcttgggccagaatttcgctaaaatgtttgagattaactttgaagacgagaagggagaaaaggctatggtctggcaaaattcatgggcatatagtactagaacgattggggtgatggtgatgactcatggggatgatagagggctggtcttaccccctaaagttgcagcaatacaagttattgtgattcatgtgccttacaaagatgcagatattaaggaaatattaaatgcatgttcagccaccgtaaaagctttatgtgattcaggtattcgtgctgaagcggaccttagagagaattattcacctggttggaagtattctcattgggaaatgaaaggtgttcccttgaggattgagataggaccaaaagacctggccaataagcaggtgcgtgctgttcgtcgtgataatgcagcaaaaattgatattcctatggacggtttggttgataaagtaaagggtatgctggatgatattcagcaaagcatgtttgatgttgctaagcaaaaacgagatgcttgtgttcaagttgcaaaaacttgggatgaattcattgaagcattaagccaaaagaaattgatcttggctccatggtgcgatgaagaggaagttgagaaggatgtgaaaacaaagacaaaaggggagacaggagctgctaagacgctttgttctccatttgaccagcctgaactgcccgaaggtacgttgtgctttg

SEQ ID NO: 2437 - DNA, 1776 bp, Festuca arundinacea
gttcgggatccagacatgtcgaccaacaagggcggaggcggtgccggaggcggagggaagaagaagaaggaggtgaagaaggagacgaaactggggatggcgtacaagaaggacgataacttcggggagtggtactccgaggttgttgttaacagcgaaatgattgagtactatgacatctctggttgttatatattgaggccttgggcgatggaaatatgggaattgctgaaagaattcttcgatgcagaaataaaaaagttgaagctgaaaccatattatttccctttgtttgttactgaaaatgttctgcagaaggagaaagatcatattgagggctttgcacctgaggttgcatgggttactaaatcaggaaaatctgacttggaagctcctattgctatcagaccaacaagcgagactgtcatgtatccatacttctctaaatggataagaagccaccgggacttacctttgaagtgtaaccagtggtgcaatgttgttagatgggagtttagcaacccaactcctttcataaggagccgtgaatttctctggcaagaagggcatacagtttttgcaactaaagaggaagcagatgaagaggtcctccaaatattggaactctaccggagaatatatgaagaattcttagcagttccagtgtccaaagggaggaaaagtgagatggaaaagtttgctggtggactttatacaaccagcgttgaggccttcatcccaaacactggccgtggcatacagggtgcaacttcacattgccttggtcaaaacttcgcaaagatgtttgatatcacttttgagaatgaaaagggtgaaaggtcaatggtgtggcagaactcttgggcgtacacgactcgctcgattggggtcatgataatgactcatggtgatgacaagggcttagtgctgccacccaaggtggcacctatccaggtcattgtaattcctgtgccatttaaagatgctgacacaacagctattaaaggggcatgtgagtcggccgtttacagcttgaaccaagcagggattcgagcagacttggatgctcgtgaaaactattctccaggctggaaatattctcaatgggaaatgaaaggtgtccctttgagaattgagataggtccaaaagatctggcaaacaagcaggtgcgcattgtccggcgagacaatggtacaaaggtcgatattccttcgaccgacttggtagagcaggttagaatgttgctggatgggattcaagtaaacttgttggaaacagcgaaacaaaagagggatgcttgcattgcacccatcaacacttgggatgaattcacagcagctctcaatgaaaaaaagttgatattggctccatggtgtgatgaagaggaagtcgagaaggacgtgaaagctcgtacaaaaggcgatctcggagctgcaaaaacattgtgcactccatttgatcagccggatcttccttccggaaccatgtgctttgcttccgggaagcctgctacaaagtggtcgttctggggtcgcagctattgatctccgtgacctggcatattactgttttcttcatccatttgtcctggcaacgcgtatacctgatcttccatggttttgtacttttgtagtactgctttcgcaggttgcatcatccattttttctatacctgtattgcaatatgaatctaattgtttgtcaaaatcttgctgttgtgacaatgcaatgtattgatcgaagtaacttttatctgatcaaaaaaaaaaaaaaaa

SEQ ID NO: 2438 - DNA, 1868 bp, Lolium multiflorum
cccatatcccgcccctctcttctcttcacggtttctccgaggttattttggtcgtctcctcgtgctgcagcggctgttcgggatccagccatgtcgaccaacaagggcggaggcggtgccggaggcggagggaagaagaagaaggaggtgaagaaggagacgaagctggggatggcgtacaagaaggacgataacttcggggagtggtactccgaggttgttgttaacagcgaaatgattgagtactatgacatctctggttgttatatcttgaggccttgggcgatggaaatatgggaattgctgaaagaattcttcgatgcagaaataaaaaagttgaagctgaaaccatattatttccctttgtttgttactgaaaatgttctgcagaaggagaaagatcatattgagggctttgcacctgaggttgcatgggttactaaatcaggaaaatctgacttggaagctcctattgctatcagaccaacaagcgagactgtcatgtatccatacttctctaaatggataagaagccaccgagacttacctttgaagtgtaaccagtggtgcaatgttgttagatgggagtttagcaatccaactcctttcataaggagccgtgaatttctctggcaagaagggcatacagtttttgcaactaaagaggaagcagatgaagaggtcctccaaatattggaactctaccggagaatatatgaagaatttttagctgttccagtgtccaaagggaggaaaagtgagatggaaaagtttgctggtggactttatactaccagtgttgaggctttcatcccaaacactggccgtggtatacagggtgcaacttcgcattgccttggtcaaaactttgcaaagatgtttgatatcactttcgagaatgaaaagggtgaaaggtcaatggtgtggcagaactcttgggcgtacacgactcgctcgattggggtcatgataatgactcatggtgatgacaagggcttagtgctaccacccaaggtggcacctgtccaggttatcataattcctgtgccatttaaagatgctgacacaacagctattaaaggagcatgcgaatcggccgtttacaccttgaaccaagcagggattcgagcagacttggatgctcgtgaaaactattctccaggctggaaatattctcaatgggaaatgaaaggtgtccctttgagaattgagataggtccaaaagatctggcaaacaagcaggtgcgcattgtccggcgagacaatggtacaaaggttgatattccttcgaccgacttggtagagcaggttagactgttgctgaatgtgattcaagtaaacttgtttgaaacagcgaaacaaaagagggatgcttgcattgcacccatcagcacttgggatgaattcacagcagctctcaatgacaaaaagttaatcctggctccatggtgtgatgaagaggaagttgagaaggacgtgaaagctcgtacaaaaggcgaacttggagctgcaaaaacattgtgtactccatttgatcagccagaccttccttccggaaccgtgtgctttgcttctggaaaggctgctacaaagtggtcgttctggggtcgcagctattgatctccgtaacctggcatattactgttttcttcatacatttgtcctggcaaagccatttgtcgtgtacctgatcttccatggttttgcagtactgttatcgcaggttgcatcatccatatttttccgtatacctgtattgcaatatgaatccaattgtttgtgtcaaaatcttctgttgtgacaattcgatgcattgattgaagtaacttttttattaaaaaacaaaaacgttaaccgtccggccgacc

SEQ ID NO: 2439 - DNA, 1422 bp, Tripterygium wilfordii
gcccaagggtaatgcaagcggcggagggaaaaagaaggaggtgaagaaagagactggtcttgggctttcgtataagaaggaagagaactttggagagtggtattctgaggttgttgtcaatgctgaaatgatcgagtactatgatatctctggctgctatattctgaggccatggacgatggctatttgggagatcatgcaagcattctttgatgctgaaattaaaaaaatgaaaatcaagaactgctacttccctctttttgtatctcctggtgttctagagaaggagaaggatcacatagagggttttgctccagaggtggcatgggtgacaaaatctgggaaatctgacttggaagttcctattgcaattcgcccaactagtgagactgttatgtatccgtactattctaagtggattaggggacaccgtgacttgcctttgaagcttaaccagtggtgcaatgttgttcgatgggagttcagcaatcctacaccatttatcaggagccgagagtttctttggcaggaaggtcatactgcttttgcaacaaagcctgaggcagacgaggaggtcttgcagatattggaattgtatagatgtatatatgaggagttcctggcagttcctgttataaagggcaagaagagtgaaatggagaagtttgctggtggcctgtacacaacaagtgttgaggcatttattcccaacactggtcgtggtatacaaggtgcaacttcacattgtttgggccaaaattttgcaaaaatgtttgagataaactatgaaaatgaaaagggggagaagtctatggtgtggcagaattcttgggcctatagtacacgaacgattggggtgatggtgatggttcatggggatgacaaaggcctggtgttgccacctaaagttgcatctgttcaagttattgtaattccagttccttataaagatgctgatacaaagggaatctttgatgcctgtgctgctactgttgagagcttgtgtgcagcaggaatccgtgctgaggctgatttcagggacaattactcacctggctggaaatattcgcactgggaagtgaaaggtgttcctttaagaattgaaatcggcccgaaagacttggccaataaccaggtacgtgctgttcggcgtgacaatggagccaaaatagatataagtagggtcaatttggttgaggaattgaaagacttgattgacaatattcaacaaagcctgtttgatgctgcaaaacaaaggcgagattcttgcatccaagtcgtaaacacctgggatgaatttagggaggctctcaatcaaaggaaattgatcttagctccttggtgtgatgaggaggaggtggagcaagatgtaaaggcacgtacgaaaggtgagattggagcagctaagacactttgttctcc

SEQ ID NO: 2440 - DNA, 1404 bp, Fagus grandifolia
aggttgttgtgaatggagagatgattgagtattatgatatctctggctgttatattctgaggccatgggcaatggcaatctgggatatcatgcaaaaatttttcgatgctgaaataaagaagatggacatccagaactgctacttcccactttttgttctcctggcgtattacagaaggagaaggatcatgttgagggttttgctcctgaggttgcatgggtgacaaaatctggggagtctgagttggaagtgcccattgcgattcgcccaacgagtgaaactgtcatgtatccatactattctaaatggataaggggacaccgtgacttgcctttgaaacttaatcagtggtgcaatgttgttcgatgggaattcagccatcctacgccatttatcaggagtcgcgagtttctttggcaggaagggcatacagcttttgcaacacaagcagaggcagatgcagaggtgctagatattttggaactctatagacgcatatatgaagaatacttggctattcccgtcacaaagggaaagaagagtgagctggagaagtttgctggtgggctttacacaactagtgttgaggcatttgttccaaacactggtcgtggcatacaaggtgcaacttcacactgtctgggtcaaaattttgctaaaatgtttgagataaactttgaaaatgagaagggagagaagggtatggtctggcagaactcatgggcctatagcacccggacgattggtgttatggtgatggttcatggggatgacaaaggcttagtgctgccaccgaaagtagcatctgtccaggttattgtaattcctgtgccttataaagatgctgatactcagggaatttttgatgctgttgctgccactgtggataccttgtctgaggcaggtattcgtgctaagtctgaccttagagataattactctcctggttggaagtactcacattgggaaatgaaaggcgttcctctaaggattgaaattgggccaaaagacttggcaaataatcaggtacgcgctgttcgccgtgataatgtggcaaaaatagacatccctagggcccaattggttgagcaagtaaaagaaatgctggataatattcaacaaagcctgtttgatgctgccaaacaaaaacgagatgcttgcattcaggctgtaaaaacttgggacgaattcgtggaagcactcagccaaaggaaatgatattagcaccttggtgtgatgatgaggaggtggagaaagatgtaaaagcaaggacaaaaggtgagatgggagcagctaagagcctttgttccccatttgaccagccagagctcccagaaggtactacatgctttgcttcgggaaagcctgacaaaaaatggacatactggggaagaagttactag

SEQ ID NO: 2441 - DNA, 1905 bp, Secale cereale
gactcccagaaaaaaacggctccctctcgaccgggacagctagggttcctagtcgccgccgccgccactgccggccgaagcctccgcagccccgccgccggtacaggagccagcagagccaacctccccaccagcaacgcctccctccctgcggtggttcgggagctaagccatgtcgaccaacaagggcggaggcggaggcggagggaagaagaagaaggaggtgaagaaggagacgaaactggggatggggtacaagaaggatgataacttcggggagtggtactcagaggttgtcgttaacagcgaaatgattgagtactacgacatctctggttgttatatcttgaggccttgggcgatggaaatatgggagttgctgaaagaattttttgatgcggaaataaaaaagttgaagctgaaaccatattatttccctttgtttgttacggagaatgttctgcagaaggagaaagaccatattgagggcttcgcccctgaggtagcctgggttactaaatcaggaaaatctgatctggaagctcctattgcaatccgtccaacaagtgagacagtcatgtatccatacttctctaaatggataagaagccaccgggacttacctttgaagtgtaaccagtggtgcaatgttgttagatgggagtttagcaatccaactcctttcataaggagccgtgaatttctttggcaagaaggccatacagtttttgcaactaaagaggaggcagatgaagaggtcctccaaatattggaactctacaggagaatatatgaagaattttagcagttccagtgtccaaagggaggaaaagtgagatggaaaagtttgctggtggactttacacaaccagtgtagaggccttcattccaaatactggccgtggtatacaaggtgcaacttcacattgtcttggtcaaaactttgcaaagatgtttgatatcacttttgagaatgaaaagggtgaacggtccatggtgtggcagaactcttgggcttacactacccgctcgattggagtcatggtaatgacacatggtgatgacaagggcttagtgctgccaccaaaggtggcacctatccaggtcattgttattcctgtgccatttaaagatgctgacacaacagctattaaaggggcgtgtgagtcggctgtttacaccttgaaccaagctgggattcgagcagatttggatgctcgtgaaaactactctcctggttggaaatattctcaatgggaaatgaaaggtgttcctttgagaatcgagataggtccaaaagatctggcgaacaagcaggtgcgcattgtccggcgagacaatggtacaaaggttgatattccttcaacagacttagttgagcaggttagagtgttgctggatgggattcaagcaaacttgttggaaacagcgaaagcaaagagagatgcctgcattgtaatcatcagcacttgggatgaattcatagcagctctcaatgacaaaaaattgatcttggctccatggtgtgatgaggaggaggtggagaaggacgtgaaagctcggaccaaaggtgaacttggggctgcgaaaacattgtgtactccatttgaccagccagatcttccttccggaaccgtgtgctttgcttccggaaagcctgctcaaaagtggtcgttctggggtcgcagctattgatctcagtgttctgtcacctatacattgccatttttgtggatcgtttgttctggcaaagctgtttatttcttgtactacctgatttttgagtaatgctttcgcatgatataactgtaactgtggattggttgtccatttgctattttgtaatgattgcatgtctcagttcggtgtcgagaaatatacattgtgtacaaccttataagtgcc

SEQ ID NO: 2442 - DNA, 1791 bp, Triticum aestivum
gcccagcagcgccaacctccgtcgagcagccgctcccaccagcagcgcctccctccctgcggtggttcgggatctagccatgtcgaccaacaagggcggaggtggagggaagaagaagaaggaggtgaagaaggagacaaaactggggatggcgtacaagaaggatgataactttggggagtggtactctgaggttgttgtgaacagcgaaatgattgagtactatgacatctctggttgttatatcttgaggccttgggcgatggaaatatgggagttgctgaaagaattttttgatgcagaaataaagaagttgaagctgaaaccatattatttccctttgtttgttacggagaatgttctgcagaaggagaaagaccatattgagggttttgcccctgaggtagcgtgggttactaaatctggaaaatctgatctggaagctcctattgcaatccgtccaacaagtgagactgtcatgtatccatacttctctaaatggataagaagccaccgggacttacctttgaagtgtaaccagtggtgcaatgttgtcagatgggagtttagcaatccaactcctttcataaggagccgtgaatttctttggcaagaaggccatacagtatttgcaactaaagaggaggcagatgaagaggtcctccaaatattggaactctacaggagaatatatgaagaatttttagcagttccagtgtccaaagggaggaaaagtgagatggaaaagtttgctggtggactttatacaaccagtgtagaggccttcattccaaataccggccgtggtatacaaggtgcaacttcacattgtcttggtcaaaactttgcaaagatgtttgatatcacctttgagaatgaaaagggtgaacggtccatggtgtggcagaactcttgggcatacactacccgctcgattggggtcatggtaatgacacatggtgatgacaagggcttagtgctgccaccaaaggtggcacctatccaggtcattgtcattcctgtgccatttaaagatgctgacacaacagctattaaaggggcatgtgagtcggctgtttacaccttgaaccaagctgggattcgagcagatttggatgctcgtgaaaactactctcctggttggaaatattctcaatgggaaatgaaaggtgttcctttgagaatcgagataggtccaaaagatctggcgaacaagcaggtgcgcattgtccggcgagacaatggtacaaaggttgatattccttcaaccgacttggttgagcaggttagagtgttgctggacgggattcaagcaaacttattggaaacagcgaaagcaaagagagatgcctgcattgtaatcatcagcacttgggatgaattcatagcagctctcaatgacaaaaagttgatcttggctccatggtgtgatgaggaggaggtggagaaggacgtgaaagctcggaccaaaggtgaacttggagctgcgaaaacattgtgtactccatttgaccagccagatcttccttctggaaccgcgtgctttgcttccggaaagcctgctcaaaagtggtcgttctggggtcgcagctattgatccgagtgttctgtcacctatacattgccattttcgtggatcgtttgttctggcaaagctgtttatttcttgtactacctgatgtttgagtaatgattgcatgtcgatcagttcagtgttgactggctagccagaaatatattgtgtacaaccttaagtgatggatctgaaaatattacccctctcccccgacc

SEQ ID NO: 2443 - DNA, 1713 bp, Cirsium arvense
gttgagtaccaccaccactttgcacaccgatagcatttcgttcatctccttcgatccgaattgctgcgacggacggcggcggttgaccggaaaagcagcaacaaggattccgacgccggaggagagtcttttttctggttagtgaacagcttctgatcatttgtgcttagcctcaagcaacaacttatctcctttctgcaattactagaaatcagcttaaagtcaaagctatggctggtggaaagggagacaagcctgataatggcaagaaatctgctgctgttgccaaatctagtaagggaaggaaaaaggagacgggtcttggtcttacaaacactaaagatggcaactttggggaatggtattctgaggttgttacaaatggtgaaatgatagaatattatgaaatatctggctgttacattctccgcccatggacaatgtccatttgggagataatgcaaaccttctttgacgcagaaattaagaagatgaagattaaaacttgctattttccactttttgtatccaataacgttctacaaaaggagaaggatcacatagagggttttgctccagaggttgcttgggtcacaagatcaggtgactctgaattggaagtccctattgccattcgcccaaccagtgaaactgtcatgtatccctatttttctaagtggatcaggggacaccgtgacttgcctttaaaacttaatcaatggtgcaatgttgtccgctgggagttcagtaatcctaccccatttatcaggagccgtgagtttctttggcaagaaggacacactgcctttgcaacaaaggaggaggcagacactgaggttctcgaagttcttgaactgtatagacgtctatatgaggagtacttggctgtacctgttgtgaaagggaaaaaaagtgagatggagaagtttgccggtggactttatactactagtgtcgaggccttcattccaaatactggtcgtggtgttcaaggtgcaacttcacattgcttgggccagaattttgctaagatgtttgagattaactttgaagatgagaagggagaaaaggctatggtctggcagaattcttgggcatacagtactagaacgattggggtgatggtgatgactcatggggatgatagaggcctggtcttaccccccaaagttgcagcaattcaagttattgtgattcatgtgccttacaaagatgcagatattaaggaaatattaaatgcatgttcagccaccgtaaaagctttatgtgattcaggtattcgtgccgaagcagaccttagagagaactattcacctggttggaagtattctcattgggaaatgaaaggtgttcctttgaggattgagatcggaccaaaagacctggccaataaccaggtgcgtactgttcgtcgtgacaatgcagcaaaaattgatattcctatggacggtttggttgataaagtaaagggtatgctggatgatattcagcaaagcatgttcgatgttgctaagcaaaaacgagatgcctgtgttcaagttgcaaaaacttgggatgaattcattgaagcattaggccaaaagaaattgatcttggctccatggtgcgatgaagaggaagttgagaaggatgtgaaaacaaagacaaaaggggagacaggagctgctaagaccctttgttctccatttgaacagcctgaactgcctgaaggta

SEQ ID NO: 2444 - DNA, 2067 bp, Secale cereale
gttagaagcgagtctcccagaaaaaaagcggctccctctcgtccgggacagctagggttcctagccgccgccgccgccgccgccgccgctgccggccgaagcctccgctgcgccgctgccggtacaggagaccagcagagccaacctccccaccagcagcgcctccctccctgcggtggttcgggatctaagccatgtcgaccaacaagggcggaggcggaggcggagggaagaagaagaaggaggtgaagaaggagacgaaactggggatggggtacaagaaggatgataacttcggggagtggtactcagaggttgtcgttaacagcgaaatgattgagtactacgacatctctggttgttatatcttgaggccttgggcgatggaaatatgggagttgctgaaagaattttttgatgcggaaataaaaaagttgaagctgaaaccatattatttccctttgtttgttacggagaatgttctgcagaaggagaaagaccatattgagggcttcgcccctgaggtagcctgggttactaaatcaggaaaatctgatctggaagctcctattgcaatccgtccaacaagtgagacggttatgtatccatacttctctaaatggataagaagccaccgggacttacctttgaagtgtaaccagtggtgcaatgttgttagatgggagtttagcaatccaactcctttcataaggagccgtgaatttctttggcaagaaggccatacagtttttgcaactaaagaggaggcagatgaagaggtcctccaaatattggaactctacaggagaatatatgaagaatttttagcagttccagtgtccaaagggaggaaaagtgagatggaaaagtttgctggtggactttatacaaccagtgtagaggccttcattccaaatactggccgtggtatacaaggtgcaacttcacattgtcttggtcaaaactttgcaaagatgtttgatatcactttcgagaatgaaaagggtgaacggtccatggtgtggcagaactcttgggcatacactacccgctcgattggggtcatgataatgacacatggtgatgacaagggcttagtgctgccaccaaaggtggcacctatccaggtcattgttattcctgtgccatttaaagatgctgacacaacagctattaaaggggcgtgtgagtcggccgtttacaccttgaaccaagctgggattcgagcagatttggatgctcgtgaaaactactctccaggttggaaatattctcaatgggaaatgaaaggtgttcctttgagaatcgagataggtccaaaagatctggcgaacaagcaggtgcgtattgtccggcgagacaatggtacaaaggttgatattccttcaaccgacttggttgagcaggttagagtgttgctggatgggattcaagtaaacttgttggaaacagcgaaagcaaagagagatgcctgcattaaaatcatcagcacctgggatgaattcatagcggctctcaatgacaaaaagttgatcttggctccatggtgtgatgaagaggaggtggagaaggacgtgaaagctcggaccaaaggtgaacttggagctgcgaaaacattgtgtactccatttgaccagccagatcttccttccggaaccgtgtgcttcgcttccggaaagcctgctcaaaagtggtcgttctggggtcgcagctattgatctcagtgttctgtcaccttatacattgccattttcgtggatagtttgctctggcaaagctgtttatttcttatactacctgatttttgagtaatgcgttcgtatgataactgtaactgcggattggttgtccatttgctatttcgtaatgattgcatgttggttggatcagttcggtgttgaccggctagccagaaatgtactccctccgtcccaaaataattgtcttgacctttgagtacaaattactttgggacggagggagagagtacatttgtacaaccattgaatgaattaagggcatctctagcccttccccaaaagtcaaatttaattcaagattctatga

SEQ ID NO: 2445 - DNA, 1891 bp, Secale cereale
cgccgccgccgccgccgccgccgctgccggccgaagcctccgctgccgccgccgccgccgctgccggccgaagcctccgctgcgccgctgccggtacaggagaccagcagagccaacctccccaccagcagcgcctccctccctgcggtggttcgggatctaagccatgtcgaccaacaagggcggaggcggaggcggagggaagaagaagaaggaggtgaagaaggagacgaaactggggatggggtacaagaaggatgataacttcggggagtggtactcagaggttgtcgttaacagcgaaatgattgagtactacgacatctctggttgttatatcttgaggccttgggcgatggaaatatgggagttgctgaaagaattttttgatgcggaaataaaaaagttgaagctgaaaccatattattttcctttgtttgttacggagaatgttctgcagaaggagaaagaccatattgagggcttcgcccctgaggtagcctgggttactaaatcaggaaaatctgatctggaagctcctattgcaatccgtccaacaagtgagacagtcatgtatccatacttctctaaatggataagaagccaccgggacttacctttgaagtgtaaccagtggtgcaatgttgttagatgggagtttagcaatccaactcctttcataaggagccgtgaatttctttggcaagaaggccatacagtttttgcaactaaagaggaggcagatgaagaggtcctccaaatactggaactctacaggagaatatatgaagaatttttagcagttccagtgtctaaagggaggaaaagtgagatggaaaagtttgctggtggactttatacaaccagtgtagaggccttcattccaaatactggccgtggtatacaaggtgcaacttcacattgtcttggtcaaaactttgcaaagatgtttgatatcactttcgagaatgaaaagggtgaacggtccatggtgtggcagaactcttgggcatacactacccgctcgattggggtcatgataatgacacatggtgatgacaagggcttagtgctgccaccaaaggtggcacctatccaggtcattgttattcctgtgccatttaaagatgctgacacaacagctattaaaggggcgtgtgagtcggctgtttacaccttgaaccaagctgggattcgagcagatttggatgctcgtgaaaactactctcctggttggaaatattctcagtgggaaatgaaaggtgttcctttgagaatcgagataggtccaaaagatctggcgaacaagcaggtgcgcattgtccggcgagacaatggtacaaaggttgatattccttcaacagacttagttgagcaggttagagtgttgctggatgggattcaagcaaacttgttggaaacagcgaaagcaaagagagatgcctgcattgtaatcatcagcacttgggatgaattcatagcagctctcaatgacaaaaaattgatcttggctccatggtgtgatgaggaggaggtggagaaggacgtgaaagctcggaccaaaggtgaacttggggctgcgaaaacattgtgtactccatttgaccagccagatcttccttccggaaccgtgtgctttgcttccggaaagcctgctcaaaagtggtcgttctggggtcgcagctattgatctcagtgttctgtcacctatacattgccatttttgtggatcgtttgttctggcaaagctgtttatttcttatactacctgatttttgagtaatgctttcatatgatataactgtaactgcggattggttgtccatttgctattttgtaatgattgcatgtcgaccagttcggtgtcgagaaatatacattgtgtacaacc

SEQ ID NO: 2446 - DNA, 1897 bp, Saccharum officinarum
agacgcccgcctcgctcgcgccgccatctcatcctccctgatcggcgctgcgcagatgtgccaccgagaacctactccgcgagccatgtcgaccagcaagggcggcgcatccaatggcggcggagggaagaagaaggaggtgaagaaggagacgaagctcgggatggcgtataagaaggacgacaacttcggggagtggtactccgaggttgttgttaacagtgaaatgatcgagtactatgacatctctggttgttatatattgaggccatgggcgatggagatctgggagctactgaaagaattctttgatgcagaaattaaaaagctgaagctcaaaccatattatttccctttgtttgttactgagaatgttctacagaaggaaaaggaccacattgagggctttgcaccagaggtagcttgggttactaagtcagggaaatctgaactggaagcacctattgcaatccgccccacaagtgagactgtcatgtatccatacttctccaaatggataagaagccaccgagacttacccttgaggtgtaatcaatggtgtaatgttgttagatgggagtttagcaatcctactcctttcataaggagccgtgaatttctgtggcaagaggggcatactgcttttgcgactaaagaagaggcagatgaagaggttctccaaatattggaactgtacagaaggatatatgaagaatttttagcagttccagtgtccaaaggtaggaaaagtgagatggaaaaatttgcaggtggactttataccaccagtgttgaggccttcattccaaacactggtcgtggcatacaaggcgcaacctcacattgtcttggtcaaaacttcgccaagatgtttgatatcacttttgagaatgagaagggtgttagggaaatggtttggcaaaactcttgggcctacactacccgctcgattggagtgatggtgatgacacatggtgatgacaaaggcttagtattaccaccaaaggtggcaccaatccaggtaattgtgattgcagtgccttataaggatgctgacacaactgccataaagggagcctgtgaatcaactgtttacacactcaatcaatctgggattcgagcggatcaggacacccgtgaaaattactctccaggttggaagtattctcactgggaaatgaaaggtgttccattgagaattgagattggtccaaaagatctggcaaacaagcaggtgcgcattgtccgccgggacaacggtgcaaaggttgacattcctgtgaccaatttggttgaagaggttaaagtgttactggatgagattcaaaaaaatctgttcaaaacagcccaagaaaagagagatgcctgtgttcaagtcatcaagacttgggatgaattcacaactgctctgaataacaaaaggttgatcttggctccgtggtgtgatgaggaggaagttgagaaagatgtgaaagctcggacaaaaggggaactcggagctgcaaaaacattgtgtactccatttgagcagccagaacttccagaaggtaccctgtgctttgcatctggaaagccagcgaagaagtggtcgttctggggccgcagctactgattgcctttgctggttgtcttttcggattcagttcttgtttcagatacaaatccgaaaatccatttacattgtgttttacatcgacttgcagttctcttgtaattggcaaaagccatttattccagcatacattgctattcgagtttggatgttgcaagaatgagaagacatacattcgtttactgtcgtgcagtgttgctattaagtaggaaaaaaaacgcgtcatatctgattacaacacatgattctcaccggaatttaactgtacctctttttctcccacca

SEQ ID NO: 2447 - DNA, 2044 bp, Panicum virgatum
tggccgctactctaccctaccccaccccaccccaccccacctcttagccctaccccattccgcccgccgccgccgccactaaaccctagcgcgccgccctctctcctcgctccctcccgtcccggatcccccgcgcaccggatccgccagccatgtcgtccggcggaggcaagggcggcggaggggggaagaagaaggaggttaagaaggagacgaagctcgggatggcgtacaagaaggacgaaaacttcggggagtggtactccgaggttgttgttaacagtgaaatgatcgagtactatgacatctcgggttgttatatactgaggccatgggcgatggaaatctgggagctgctgaaagaattctttgatgcagaaattaaaaagctgaagctcaaaccatattatttccctttgtttgttactgagaatgttctacagaaggagaaggaccacattgagggctttgcacctgaggtagcttgggtgactaaatcagggaaatctgagctggaagctcctattgcaatccgccccacaagcgagactgtcatgtatccttacttctctaaatggataagaagccaccgtgacttacctttgaggtgtaaccagtggtgtaatgttgttagatgggagtttagcaatcctactcctttcataaggagccgtgagtttctgtggcaagaagggcatacagcttttgcaactaaagaagaggcagacaaagaggttctacaaatattggaactgtacagaaggatatatgaagaatttttagcagttccagtgtccaaagggaggaaaagtgagatggaaaaatttgcaggtggactctataccaccagtgttgaggctttcattccaaacactggtcgtggtatacaaggtgcaacctcacattgtcttggccaaaacttcgccaagatgtttgatattacttttgagaatgagaagggtgcaagggaaatggtttggcaaaactcttgggcatatacaactcgctcgattggagtgatggtgatgacacacggtgatgacaaaggcttagtattaccaccaagggtggcaccaatccaggtaattgtgattccagtgccttacaaggattctgacacaactgccataaagggagcttgcgaatcaactgtttacactctcaatgagtctggattccgagcggatttggacacccgcgaaaattactctccaggttggaagtattctcactgggaaatgaaaggtgttcctttgagaattgagattgggccaagagatctggccaaccaacaggtgcgcgttgtccgccgagacaatggtgcaaaggttgatattcctgtggccaatttagttgaggaggttaaagtattgctggatgagatccaagcaaaccttctcaaaacagccaaagaaaagagagatgcctgcattgaagtcatccacacctgggatgaattcacaactgctctgaacaacaaaaggttgatcttggctccatggtgtgatgaggaggaagttgagaaagatgtgaaagctcggaccaagggggacctcggagctgcaaaaacattgtgtactccattcgatcagccagaacttccagaaggaaccctgtgcttcgcctctggaaagccagcaaagaagtggtcgttctggggccgcagctactgattggtcttccatgacatggcggcccgcttggagttttgaactgaatcctgtagcgtcggacatggatctgaagatccatttacattgtgcttttacaaccagtcactttagtttctcatgaatcattgactcattgctactggcctgctgggtactggcaaaagtcatcgattcgatatacctgtaacatttgacggtcgtgttgggtttggttgtggcaaaggatgagacttgcatctgttttgctaaatatgcgattttgctatatgcaacctgaatgtttgctgcacaataccacaccacctgaatttcggaccttttctccttaacttctcatttttcagaccttttatttattattatttcacttt

SEQ ID NO: 2448 - DNA, 1667 bp, Gossypium hirsutum
cccgctttacttcaatttgtctaatccctccttctttttctctttgatcatagtaaacaacaaaaacagggaaaataaggcaaagaaaatctttcaaccatggtgggtctcggcgataacaacaatcccagttgccaaaacaacatcagcagcaaagcaaaagacaagaagaagaacaagaagaagaagcgtgggggaagcaagagaaagatgacggctgagcaaacctcggctttcaaatcggtgaccgaatgggtttatttagaccggcaccaccaccccaattcttcttcgacggcgggtttatcgtcgtgggtggtggatgattttggtgtgcaaaagagtttggggagagggatggagaaaatggtgtttgaattgcattcccattcgaaacacagtgatgggttcttgtctccttctaagctcgttgagagagcacatggcaatggggtgaaagttcttgctctgacagatcatgatacaatgtctggaatcaccgaagctgtagaagctgctcgcagattcggtatcaagataatccctggtgttgagatcagcaccatattctctccaagaaatcctgaaatggaggaaccagtgcacatccttgcatattacagcggctgtgggcccatgaggtatgaggagctggataaattattggctaacataagggagggacgttacgtacgtgctaaggacattgttttgaaactcaataaactcaagctacctcttaagtgggagcatgttacaaagattgcaggcaagggagtggctcccgggagattgcatgtggctcgagctatggttgaagcaggttatgtggagaatctaaagcaagcttttgcaagatatttatatgatggaggacctgcttattccacaggaagtgagcctcttgcagaagaagtagtgcagctgatatgtgaaactgggggtttagcagtcctcgctcatccttgggcactaaaaaatccgattcctatcataagacggttaaaagatgcaggccttcacggaatggaggtttatagaagtaatggaagacgggcagcatacaatgacttagcggatacgtacaaccttctgaagcttggagggtcagattatcatgggagagatggccatggtgagtccgaactaggaagcgtgaaccttccagtggtggttctgcacgactttcttaaggtagctcgacctatctggtgcagtgccattaaggacattctagagggttatgcaaaggaaccctctgacacaaacctcgccaagatagcgagatttacaaggatgggcagtttcaagggaagttctccctcgagttgtggcaaggacttgattgatcgttgtttagcatcgtggttgactgccgaagaacggcagaacgatgaattcgaggccattaggttgaagctttcccatgctacgatcaaccttagtggagttcaagttcctatagagaccaaatagtacttgattggaggaaaaaaaaaaagactaggtaccatttgcttcttgccattgttgcaaagataaagagcgagtggcatattcttttggttttgttaaaatcccaactaactaatcacatttggtgattcaacctgtgtgtatttttggttttattgcccaagtataaaccatgtaccatctatatcttg

SEQ ID NO: 2449 - DNA, 2334 bp, Theobroma cacao
ttggggacatgccattttgaatgtagcaaaacttgtaagcatcaagccattgaattatcataaattttcccttatacaattggtttatgtcatcctctttttctcttttactatttctactgttctctctctactctccctcccccccccccccccccccccccccaactccctttctctccctcgggtcaaaagaaaaacaaagaattcatcatccatggttgggcttggcgatagcaattccagttgcaataataacaacaaagcaaaagacaagaagaggaagaagaagaagaagcgtgggggtagcaaacggaagatgaccgctgagcaaactctggctttcaagtcggtgactgaatgggtttatttggatcaccagaattcttcttccacagcggccttatcttcgtgggtggtggatgattttggggtgcagaagagtctgggaagaggcatggagaaagtggtgtttgaattgcattcccattctaaacacagtgatgggttcttgtccccttctaagctcgttgagagagctcatggcaatggggtgaaagttcttgctctgacagatcatgatacaatgtctgggatccctgaggccatagaaacagctcgcagatttggtatcaagataatccctggtgttgagatcagcacaatattctcaccaaggaactctgaaatggaggaaccagtgcacatccttgcatattacagcagctgtggcccaacaaggtatgaggagctggaaacgttcttggctaacataagggatggacgttatctccgtgcaaaggacatggttttgaaactcaataaactcaagctacctcttaagtgggagcatgttactaagattgcaggcaagggagtggctcctgggagactgcatgtagctcgagctatggttgaagcaggttatgtagagaatctaaaacaagctttcgccagatatttatatgatggtggacctgcttattccacgggaagcgagcctcttgcagaagaagcagtgcagcttatatgtgaaacagggggtttagcagtgctggctcatccctgggcactaaagaatcctattcccatcataagaaggttaaaagatgcagggcttcatggaatggaggtttacagaagtgatggaagattggcagcgtacagtgacttggcagatacttatgaccttttgaagcttggaggagcagattatcatgggagaggtgggcatggtgagtctgaactaggaagtgtgaaccttccagtgttggttttgcatgactttcttaaggtagctcggcctatctggtgtggtgccattaaggacattttagagacttatgcagaggaaccctctgattcaaatctagccaggattgcaagatttgggaggatgggcagtttcaggggaagttctcccttgagttgtggccaggactttattgattgttgtttatcatcctggttgactaccgaagaaaggcagaatgctgagtttgaggctattagattgaagctttcctatatttcaatcgatctgggtggagtacaagctcctatagggagtaaatgatagttgattgaaaaagattacgacatttgcttcttggaatgatgctgagaacactgagtggcagattcttttccttttgaatagtttggaaaagactggaatttaaaagtagtcatagtctgtgttagctgctgggatcttgattcaaccgagtcgttttaatttttttggcccttttttattttcttgccagcatgaaaaaacatgtatatcaatgtaccatctactcgctttattctcctgtctgtcctttctagaagctgatataattcttgttttctaaaggttaaaatagagtattcctttggctacttggaattcattcagttaagcttggtattcagaacattatccaagagtcatccatcctgtgttatagttgtgcactgaagattttccactgcctagctcaatcagagggagaagatagcataggtcgttcatttctggcgtctatcgaacgccctgcccttaagccacattttccaggtagccaaagcatttatccgattggatccaaagttagctaattgatacaaagaggccgcattctgctgattgaccaggccttttcaactttttggtgtgttcatcaacaaaatactcccaccaaatcccagtcactacacattcccacggtattagaggagttggacatctctgccaagattctaaaagcattttctgtcaataagaatcaaaaaggaaaatcaattgcgacgttcatagattcttctaatgcgtagttttaagtttca

SEQ ID NO: 2450 - DNA, 833 bp, Gossypium hirsutum
actttgacaccccattaatctctgcttctccctctctcaaactcctttttgctttgctatttgaagtaaagaaagaaaatatgggtgccttggactctctttctgactatatttctgatttggtaaccgtccatggcaaaagaaagaagcgtaaagtcatgcagactgttgagatcaaggttaagatggactgtgatgggtgtgaaaggagagtcaaaaacgccgtttcctccatgaaaggtgtgaaatcagtggaggtgaatcgaaagaaaagctatgtgagcgttagcggatacgtggagccaaacaaggtactaaacaaagtgaaaagcacagggaaaagagcagagttttggccttacgtcccctacaacttagtggcatacccatacgtagctcaagcatacgacaagaaggcaccgtctgggtacgttaaagaggcggtgcaagctttgccgagtccgaatgctgtggacgagaagtttgtcactttctttagcgacgaaaaccccaacgcctgttccatcatgtaggctggccaagagaattaaaggttaaggagggcatgtttgggtggatgggacgcaattttgtctgtacaaatgcttaaatttggtgtgtagggttgagtctttgtgaaggaatttcctttttgaaattttgtttccgaatgttgtatgtgtgcggattttcatgtagtcgactaatcatacttaatttcctcagggctttatgtagttataaatgaattatataccattcatgtatttggattatatactcatgttatgcatgggttaaatttattattgtgatttgatattctatacagg

SEQ ID NO: 2451 - DNA, 875 bp, Theobroma cacao
ccatgcccaaacctctgacccatttctctccttcaaaactctttcaaactctcccaaactcctcttgcttttgcataactagttgaaaagaaaaaaatgggtgctttggactctctttctgactacatttctgatttaattactgttcataccaaaaggaagaagcgaaaagtaatgcagacggttgagatcaaggttaaaatggactgtgatggctgtgaaaggagagtcaaaaacgctgtgtcctccatgaaaggtgcgaaatcagttaacgtgaacagaaagcaaagccgagtaaccgtgaccggatacgttgagccaaacaaggtgttaaagaaagtgaagagcacaggaaagagagctgagttttggccctacgtcccttataacttagtggcttatccttacgttgctcaagcttatgacaagaaggcaccgtcaggctatgttaaaaacgctgtgcaagctttgcctagtccaaatgcagcagatgagaagttcattactctctttagtgacgaaaatccaaatgcatgttcggtcatgtaggcgcggttttgatggaagaactttaaaagccatggctgtttaggacatgttaattttgctcttgtgacgacaggttgagttaggtgttttcagtttttgtgaagggaggttttgaatgcttctagagtagggtttttcatgtagttacacttgagttccatatggctatttatatacttctacagaatatgcttatatatatatatagccctgcttagcacgtactttattcccatcccttctttaaagaggagttgaaaattcaagtcatctttaattttttatactgatcacctgcaattagacgtgcttttgttctatgcggg

SEQ ID NO: 2452 - DNA, 704 bp, Manihot esculenta
acccacccttaattaactctccatacacaaccccctctttctctctgaaactctctgctttagttttggaaaaacaaaatgggagttcttgattctctttcagattacctctctgacttatttaccgacgccagaaaaaggaggaagcgcaagccaatgcagacggttgatatcaaagtgaaaatggactgtgatggctgtgaaaggagagttaagaattctgtttccaacatgaaaggtgtgaagtcggtggaggtaaacagaaagcaaagccgggtaacagtaagtggatacgttgagccaaacaaggtcttaaagaaagtgagaagcacaggaaaaagagctgagttttggccatatgtaccctacaacttggtggcatatccttacgttgctcaagcctacgacaagaaggcaccttctggctatgttaagaatgtggttcaagccattcctagccccaacgcagcagacgagaaattcataaccatgtttagcgacgaaaacccaaatgcatgttccattatgtaggagttaatttaatgaatttctgagctgaaaatggaaaatcacatagatgcagattagggtcagttgaggtatttagaaaaatttggtttttgagttaattagaggagttttggttttgtatgtttaattaccttttggcttttgttttagttaatgaaatgaaacttgttgac

SEQ ID NO: 2453 - DNA, 809 bp, Hevea brasiliensis
tcatagtttttaccttcttatatatatatacaccgattacgctacatttatttccatcaatcctcaactcttctgtcttctccatacttataaccctctctctctctctctctctctgaaacgctctgctttagctttggaaagaaaatgggtgctcttgattctctttcagattatctttctgacttatttaccgtcgcaagaaaaaagaggaagcgcaagccaatgcagacagttgatatcaaagtgaaaatggactgtgatggctgtgaaaggagaattaagaattctgtttccaacatgaaaggtgtaaggtcggtggaggtaaacagaaagcaaagccgggtaacagtaagtggatacgttgagccaaacaaggtcttaaagaaagtgagaagcacaggaaagagagctgagttttggccctatataccctacaacttggtggcatatccttacgttgctcaagcctacgacaaaagggcaccttctggctatgttaggaatgtggttcaagcacttcctagccccaacgcagcagacgagaaattcacaaccttctttagcgatgaaaacccaaatgcatgttccattatgtaggaattaatttctaagccaaaaaatagaaaatcacatatatacagaatatcagcagttggaaatttggaacttttagttaattagaggagttttggttctgcttttgaatgtaggttttgtatgtttaattagcttttgttacggcaaattgatactgagaatgaaatagaaatatttatatttctaccaaatcaaaaaaaaaaaaaaaa

SEQ ID NO: 2454 - DNA, 857 bp, Humulus lupulus
ttgtatatataggacctatccacattccataatatttactttcttagcccaaaatcctctctctccccctgtttctaaggagttctgtttttctaggctctttaagttgagcttggttttttgctcatatattcacgttaaggagaaaaacaaaagatgggagtcctcgaccatctgtcggattatttcacagtggacaggccaaggaagaaacgaaaagcaatgcagacagttgaaatcaaggtgaaaatggactgtgatggctgtgaaaggagagttaaaaatgctgtctcctccatgaaaggagctaaacaagtggaagtgaacagaaagcagagccgggtaacggtgacgggttatgtggagccaaacaaggtgttaaagaaggtgaagagcacagggaagaaagccgagttctggccttatgtgccgtacaacctggtggcttatccatacgtggcacaggcatacgacaagaaagcaccgtcgggttacgtgaagaatgtttctcaagcactccccagtccaaacgcacaagatgaaaagttcgtcaccatgtttagcgatgaaaatcctaatgcatgttccatcatgtaaaataatcaatatatcattataattagctaagagtaattatttattagaagcaattaagagatagagtactatctttttttttgttagttaggatgagatgttttatgcagtggtgatttgtttctctgagtttgactttagttgactgggcgataaaactttcttttttgtaaaacttggtatgatgtgcattaatgatatttatcttttccttttgcctaactttgttaaaaatatatgatatgatatactattatgag

SEQ ID NO: 2455 - DNA, 988 bp, Populus trichocarpa
attcttgcaagcttctcctgcatatctctctcctctcgctctctctctctccctgtctctctcaaaactttctgctagctttgtctttgagaagcaaatgggtgctcttgacgatctctcagattacctctcagacttgtttacagttgccaggaagaagaggaaaagaaaaccaatgcagacagttgatatcaaagtgaagatggattgtgatggctgtgaaaggagggttaaaaattctgtttcctccatgaagggtgttaaatcagtagaagtgaacagaaagcaaagccgggtgacagtcagcgggaatgttgagccaaacaaggtcttgaagaaagtgaagagcacaggaaagagggctgagttttggccatatgtcccatacaacttggtggcttatccttatgctgctcaagcctatgataagaaagcacctgcaggctatgtgaagaatgtggttcaggcacttccgagccccaacgcaacagatgaaagatttacatctatgtttagcgatgaaaacccgaatgcatgttccatcatgtaggaaatctaatttcatttggcaaaatgaaagagcaagagctagcatatatatacatatagtttgttttttgttgtaagctttgctgtttaattagggctagtttagctagttagtgtaagtagttaagtagaaggggcttgggttttcactgagagtttaggttatatatatatatattacagggcatgtaggctctcctaattgcgagggatatctatcgatgtgctgatcatgcttagttagataaccttcttatctatagatgtttatgacgatcacatcatcaagtttccaattttcatgaaaattaattaagagatgtaaattaaacagaaatgcatcaagaaaaagctctgttaatttgaacccatctgatctatattctgtatttatttgatatgggacaaaattacaccattgtttacgccacaaaaaaag

SEQ ID NO: 2456 - DNA, 649 bp, Quercus alba
atgggggagtcctgcaaaaactttcataaaatctctctctctctctctcacagacacataaaagaactctttgctttgccttttgtgaaaagggaggagaaatgggtgctctggactttctctcagactatatcactatttccaccccaaggaagaaacgaaaagcaatgcagacagttgaaatcaaagtgaaaatggactgtgatggttgtgaaaggagagttaaaaatgctgtttccaacatgaaaggtgcaaaatctgtggaggttaaccgaaagcaaagccgggtaaccgtaacgggctatgtggagccaaacaaggtcttaaaaaaggtgaagagcaccggaaagagagctgagttttggccctatgtgccatacaacttggtggcttacccttatgtggctcaggcctatgacaagaaggcaccggctggttacgtgaaaaatgcagtccaagcacaccctattccaaatgcaacagatgagaagttaactacactctttagtgatgaaaatccaaatgcatgttccatcatgtaagcaattttaatggaataaggataggagagaatgagaattagaatctgtttttagttggtactttgagtttgaatggagagaactcagagaagtctctcttttttttt

SEQ ID NO: 2457 - DNA, 764 bp, Ricinus communis
ctccatttctctcttttctctctctctctccctgaactgagactctctactttggctttgagaagcaaagatgggtgctcttgacgatctctcagattacctttcagacttgttcacctacgccagaaaaaagagaaagcgtaagccaatgcagacagttgagattaaagtgaaaatggattgcgatggctgtgaaagaagagttaaacatgctgtttccaacattaaaggtgtgaaatcagtggaggtaaacagaaagcaaagccgagtagtagttagtgggtatatagagccaaacaaggtcctaaagaaagtaaggagcacaggaaaaagagccgagttctggccttatgttccatacaatttagtggcatatccttatgttgctcaagcttatgataagaaggcaccatctggttatgttaagaatgtgtttcaagcacttcctagccctaatgcaccagatgagaagtataccaccatgttcagtgatgagaatccacatgcatgttccattatgtaggcaaactttaaggaaaataatttgtatacattttatgtttcagcttcaattaaagtaggagtaccagttcagctctataactaggtgtttttcagttgagaagttttgagtcgtgcttttattttgaacgtaggatttgaaatagtacttctgaatgtacgttctgaaggagagatatattttcattttctgtacttaaatatatgcttaacttctctttgttattgttagtgaaacgtgc

SEQ ID NO: 2458 - DNA, 933 bp, Ricinus communis
tatatatatatacaccccaatacgctacatttatttccatatagcgtaaccctccatttctctcttttctctctctctctccctgaactgagactctctactttggctttgagaagcaaagatgggtgctcttgacgatctctcagattacctttcagacttgttcacctacgccagaaaaaagagaaagcgtaagccaatgcagacagttgagattaaagtgaaaatggattgcgatggctgtgaaagaagagttaaacatgctgtttccaacattaaaggtgtgaaatcagtggaggtaaacagaaagcaaagccgagtagtagttagtgggtatatagagccaaacaaggtcctaaagaaagtaaggagcacaggaaaaagagccgagttctggccttatgttccatacaatttagtggcatatccttatgttgctcaagcttatgataagaaggcaccatctggttatgttaagaatgtgtttcaagcacttcctagccctaatgcaccagatgagaagtataccaccatgttcagtgatgagaatccacatgcatgttccattatgtaggcaaactttaaggaaaataatttgtatacattttatgtttcagcttcaattaaagtaggagtaccagttcagctctataactaggtgtttttcagttgagaagttttgagtcgtgcttttattttgaacgtaggatttgaaatagtacttctgaatgtacgttctgaaggagagatatattttcattttctgtacttaaatatatgcttaacttctctttgttattgttagtgaaacgtgccttgcagacatcaggctttgcctgccagttcttcccctgttgatgaggactaatgggtttgattgtttgatattgtctggtctctctcttcctctctccaatctcacatggatgattt

SEQ ID NO: 2459 - DNA, 566 bp, Castanea mollissima
acacacagacacataaaagaacagaactctttgctttgccttttgtgaaaagggaggagaaatgggtgctctggactttctctcaaactatatcactattccaccccaaggaagaaacgaaaagcaatgcagacagttaaaatcaaagtgaaaatggactgtgatggttgtgaaaggagagttagaaatgctgtttccaacatgaaaggtgcaaaatctgtggaagttgaccgaaagcaaagccgggtaaccgtaacgggatatgtggagccaaacaaggtcttaaacaaggtgaagagcaccggaaagagagctgagttctggccctatgtgccatacaacttggtggcttacccttatgtggctcaggcctatgacaagaaggcaccgtctggttacgttaaaaatgctgtccaagcacaacctgacccaaatgcaatagatgagaagttaacttcactctttagcgatgaaaatccaaatgcatgttccatcatgtaagcaattttaatggaagaaggataggagagaatgagaattagaatatggttttagttggtactttg

SEQ ID NO: 2460 - DNA, 944 bp, Cannabis sativa
gggacacaagtcattttctaagctatataatttaatataaccacaacttgtaccctaagtaatttttactaaacaatcatctcattatacaaacttttaatgtgtgtgtataaataggaccaatccacattgcataacattaactttctttgcccaaaaaaccactttctctcacactctctctccttctccctgtttcaaaggagctctgtttattaaagttgaacttgatttttaattttagatcataagatcacgttataggaaaaaaaaaatgggagtccttgaccatctgtcggattatttcacaatagacagaccaaggaagaagcgaaaagcaatgcagacagttgaaatcaaggtgaaaatggactgtgatggctgtgaaaggagagttaaaaatgctgtcacctccatgaaaggagctaaacaagtggaagtgaacagaaaacagagcaaagtaacggtgacgggttatgtggaggcaaacaaggtgttgaagaaagtgaagagcacagggaagaaagcagagttgtggccttatgttccgtacaacttggtggcttatccttacgtggcacaggcatacgacaagaaagcaccgtcaggttacgttaagaatgtcgttcaagcccttcccagtccaaacgcatctgatgaaaagttagtcaccatgtttagcgatgaaaatcctaatgcatgttccatcatgtaaatgtaaatgtaaatgtttttaattattaaataaatccaatataaaatagtaattagttaagaataggattatatgttttatgtctttttactagctccaaccttgtacgttctctgagtttgtttttagttaactgggcgaaagaactttttctttttaatctttttggttaaactttgtatgctctgcattaatattagttagctttttttaatcatgttctaatttt

SEQ ID NO: 2461 - DNA, 722 bp, Manihot esculenta
atgcaccacttatacaacatttatttccatccttccctcttgtacttctctccttacaagtacttctctatctctctcactttctctctgaaaccctctggtttagctttggaaattaagcaaatgggtgctcttgactctttctcagattacctttccgacttatttacgcttgccaaaaagaagaggaagcgcaagccaatgcagacagttgatatcaaagtgaaaatggactgtgatggctgtgaaaggagagttaagaattctgtttccgacatgaaaggagtgaagtcagtggaggtgaatagaaagcaaagccgggtaacagtaagtgggtatgttgacccaaacaaggtcttaaagaaagtgagaagcacagggaagagagctgagttttggccttatgtgccatacaacttggtgacctacccttacgttgctcaggcctacgacaagaaggcaccctctgggtttgttagggacgtgtttcaagcacttcctagccctaatgcagctgatgagaaattcacaaccttgtttagcgatgaaaacccacatgcatgctccattatgtgaaatcacatgtttaaaaattagacctagctagctgatcgttgtataatttttgtttctgctttggatgtaggttttgtatgcttaattaccttttgttatatatggtttttttttatatatttaacttaacataaatttaaactcag

SEQ ID NO: 2462 - DNA, 1178 bp, Gossypium hirsutum
atccaaatctattctcttctgaaaatatcctattcctttggaactctctctctctctcccactaattttctcctcctttcttccctcttctctcattcatttctctacttctctccgccatggtttcgcaccttgtcaccactatccgaaatgtagttggaatcacagggaatgtaatctccctcttcttgttcttgtctcctgtaccaacttttattagaatttggaagaaaggatcagtggaacagttctccccagccccataccttgcaaccttaatcaattgcatggtttgggtggtttatgggctgcctatggtgcaccccaacagcaccctggttgtaaccatcaatggcacagggactgccattgagattgtatacctaaccctcttcctcatctattgccatgacaagaaaaagagagtgaaagtgatgctaatagtgctagttgagattatttttattgcgggtgtcaccgctctggttcttatcatagctcacaccactcaacgtcgatccatggtggtcggaattatagctattttgttcaatatcatgatgtatgctgcccctttatccgtcatgaaactggtgatcacgacgaaaagtgtggagtatatgccatttttcctgtcactagcatcctttgccaatggtgttgcttggactgcatatgctttcctcccttttgatccttttattgctgttccaaatggactagggacattgtttagtttagcacagctgttgttgtatgccacatattacaagtccacaaagagaataatagcagcaagacaagaggccaagatggagatgcatctctcggaggtggtggtcaatggtgataataaggatcccaaaaagaactccacagcaccttagagacccatccttctactatatataactagagagggtgtttaattttgttatgaacatcaatcaccataaacatggtgctatgcagcagcttgtttacctaatcattttccctttcaagtcttctttttcttttgcggggtaacgtgcgggctgaactatcaagttttagatttttgtaaacttattattatgtggcccaacttttctgcatatggttttctccaatccaataataagaggtccctgcaaacttctatgtttaaatctcaaaaaagaaaaagtaccgatgcg

SEQ ID NO: 2463 - DNA, 2097 bp, Vitis vinifera
aatcggctctttcttcctccccaaaccccaatcgattccctgcccgaatagagcgaaacacggccactgtgctgacgccattctcagagctttgagccatggactatcacatctatggcgtccctaggctcaagtggatcaagatcttcttccttactgctgtcttctgcctctctacccatgctcatgcttctgcattgcccaggaagccctcttcttcctccaactctcctcaaatcaactccaactccgtcctcgtcgctcttctcgactcacgttataccgagctcgctgagcttgttgagaaagctctccttttacctacccttgaggatgctgtcggcaaacataatatcaccatcttcgcccccagaaatgaggctttggagcgtgaccttgaccctgagttcaagcgctttcttctcgagcccggaaatctcaggtctctccagactcttcttttgtttcatatcattcctaaccgtattgggtctggcgagtggccggggggccttgccggagaccccacgcatggcaccttgtccaatgaccgacttagtttggccagtaagggttctggcgtgaaaagtgtggatctggcggcggtggttcaccctgacgccattgttcggccggacggggttattcacgggatcgagaggctgttgattcccctgtccgtcgaggaggattttaaccgcaggaggagtcttcggtccatttctgcggtgctgcctgagggggcgccggaggtggatcccaggactcaccgcctgaaaaaggcagtgccggtacctgccggagctcctccggtgcttccgatctacgacgccatggcccccgggccgtctctggctcctgcgccggcgcctgggcctggaggtccccgtggccacttcgacggcgagagccaggtcaaggacttcatccaaaccctactacattacggcggttacaacgaaatggcggacattctcgtcaacctcacctccctcgccaccgaaatggggcgactggtctctgaaggatacgttttgacagttttggcacccaacgacgaggccatggccaagctcaccaccgaccagctgagcgagccaggagcaccggagcagattatgtactaccatctggtgccggagtaccagacggaggagagtatgtataatgccgtgagacgattcggcaaggtccgatacgatacgctgcgtttgccgcacaaggttgtggctcaggaggccgatgggtcggtcaaattcggagaaggtgacggctcagcatatctttttgatcccgatatttacaccgacggccggatttcagttcagggtatcgacggcgtgctgtttccgccggaggagaaggagtccaaacccgaaactaaaacgagtcgggccgccaaggttgtttccaagtccaggagagggaaattaatggaagtagcatgtaggatgctaggagcttttggtcaagattctcgtttcaccacctgtcaataagaacactctcctccccaaaaatcatacaaggaaagataaacatgtaaagatgaagaaaggatgatgaagggatgtgtgcttccattgctggatttgtttggaaacccagagaagagaaaattagtttttcaagtgagtttgtgtttgaacaccgccagcccaacaccatctggttcacccgaactcactctcatttttggttaaatgtgcatccactgcttgtgagtcaaatataaacaacctctattattattattattatttttctttggttatataagaatggctttgtatgtgtgtatggaagtggaccttcatttggtttggtgatatctcttgccagcaatggtggtgggtggtggcgcttttgtctcattgaatttattttttgcgagtaggacagctgaggtagatagtctgtcactgtaggctccatcgcagtcttccctgaataatatgaaaaccaataattgtcaattatccttggctttcaagccgaattcttttgtattaatctgttattttagctttctcttaagggatgatgtgggttactttttatttaattttaattttaattttttcccctttctcttgg

SEQ ID NO: 2464 - DNA, 2090 bp, Ricinus communis
ctcttattcagcacagttcagtgcaaggctcattccaatacaatacattacttgtcaagtctcctttcatacctttctcctactttttctcttctctaagcaaaacccaaacccattatcacttaaacataacacccccccaccatctatccctcacttccctccacattaattcactctaagaaaacccaatacccattttccctaaagttttgatcttttcccccctcccccttcaaacctcatttatttttcttgatctttctttgagacagagcaccatggatcctcacatctatggtgtctccaagttcttgttattcactttctttttctttttcttttcttctttttcttcagcattgccacaaaactcatcttcgaaaccttcgtctaattctggaatcaactctaactcagttctcgttgcgcttcttgattcccattacactgagttagctgaactcgttgaaaaggctctccttctgcagacccttgaggaatctgtcggtaaacacaatattaccatctttgcaccgagaaatgaagctttagagcgacaacttgaccctgagttcaagcgtttcttgcttgaaccggggaatctcaagtctcttcagactcttttgatgttccacattatacccaaaagagtcggatccagtgactggcctacagatgcatcaaaccctacctggcacatcactttatccaacaatcatcttcacttagacgtcagagattccggcaagaaagttgttgattcagctgagttagttagacccgacgatgtgatcagaccagacggagttatccatggaatcgagaggctattaattccacaatcagtacaagaagatttcaacagaaggagaagtctcagatccatatcagcagtgttaccggaaggcgcgccggaggtggatccaagaacccacaggcttaaaaaaccagcagccccagtgccagtaggtgcaccccctgtgctgccaatatacgatgcaatggcaccaggtccttccttggctccggcaccagcgccgggacctggcggacctcaccatcactttgatggggagagtcaggtgaaggactttatccaaacactattacattatggtgggtataatgaaatggctgatatattagtgaacctaacttcactagccaccgaaatgggccggcttgtatcagaagggtatgtgttaaccgtgttggcaccaaatgatgaagctatggctaaacttacaacggaccagttgagcgagccgggtgcaccggagcagattatctactatcatataatacccgagtatcaaacagaagagagtatgtacaatgcagtcaggagatttgggaaagtaaagtatgatactttgcgtttgccacataaggttgttgcacaggaggctgatgggtctgttaaatttggatcgggtgatgggtctgcgtatttgtttgatcctgacatttactcagatggaaggatttcagtgcaaggtattgatggtgttttgttccctgaggaggagaaagagactactgatgcaaaacccaccacctcggtcaaggttgtcactaaggccaggagagggaaattaatggaagtagcttgtagaatgcttggagcttttggacaggattcgcaattcagtacgtgtcatcaatgaatctgcacagctataaaatcttaataatagtaaagatggaaccatgaaaaccaatagagaaatggaaagacttttgtgtaataaaaatcacaaattgaaggggatggagcaatggctttgtatgaatgatttcctcagaaaattccaacataagagagagagtttgttgttattttgtcataattactgtaattacatatcaattttttaattaattttttttttaaaattttaatttttctttttctttttccttgttaaatgtatgattcactgtcaatgtatgcatgaacaaccttggaaaacttttgtctttttgttttttaattatttttgctgtcctaaagtctttctagtcacgggttgtgttctttcttagggcctggctggctctgcctccgttgcttgtgaatcaaactg

SEQ ID NO: 2465 - DNA, 2332 bp, Ricinus communis
tgacagcgctacatttgtaagtcttcccgtgtgatccccacttccagcctgtcctgccccttacactaaattataagcatttactctctttctatttttctaattttctttttggtcttaaaaagaaaaccaaaaaaaaaaaaaaatactacttagtagtagtctgtctgtctcttattcagcacagttcagtgcaaggctcattccaatacaatacattacttgtcaagtctcctttcatacctttctcctactttttctcttctctaagcaaaacccaaacccattatcacttaaacataacacccccccaccatctatccctcacttccctccacattaattcactctaagaaaacccaatacccattttccctaaagttttgatcttttcccccctcccccttcaaacctcatttatttttcttgatctttctttgagacagagcaccatggatcctcacatctatggtgtctccaagttcttgttattcactttctttttctttttcttttcttctttttcttcagcattgccacaaaactcatcttcgaaaccttcgtctaattctggaatcaactctaactcagttctcgttgcgcttcttgattcccattacactgagttagctgaactcgttgaaaaggctctccttctgcagacccttgaggaatctgtcggtaaacacaatattaccatctttgcaccgagaaatgaagctttagagcgacaacttgaccctgagttcaagcgtttcttgcttgaaccggggaatctcaagtctcttcagactcttttgatgttccacattatacccaaaagagtcggatccagtgactggcctacagatgcatcaaaccctacctggcacatcactttatccaacaatcatcttcacttagacgtcagagattccggcaagaaagttgttgattcagctgagttagttagacccgacgatgtgatcagaccagacggagttatccatggaatcgagaggctattaattccacaatcagtacaagaagatttcaacagaaggagaagtctcagatccatatcagcagtgttaccggaaggcgcgccggaggtggatccaagaacccacaggcttaaaaaaccagcagccccagtgccagtaggtgcaccccctgtgctgccaatatacgatgcaatggcaccaggtccttccttggctccggcaccagcgccgggacctggcggacctcaccatcactttgatggggagagtcaggtgaaggactttatccaaacactattacattatggtgggtataatgaaatggctgatatattagtgaacctaacttcactagccaccgaaatgggccggcttgtatcagaagggtatgtgttaaccgtgttggcaccaaatgatgaagctatggctaaacttacaacggaccagttgagcgagccgggtgcaccggagcagattatctactatcatataatacccgagtatcaaacagaagagagtatgtacaatgcagtcaggagatttgggaaagtaaagtatgatactttgcgtttgccacataaggttgttgcacaggaggctgatgggtctgttaaatttggatcgggtgatgggtctgcgtatttgtttgatcctgacatttactcagatggaaggatttcagtgcaaggtattgatggtgttttgttccctgaggaggagaaagagactactgatgcaaaacccaccacctcggtcaaggttgtcactaaggccaggagagggaaattaatggaagtagcttgtagaatgcttggagcttttggacaggattcgcaattcagtacgtgtcatcaatgaatctgcacagctataaaatcttaataatagtaaagatggaaccatgaaaaccaatagagaaatggaaagacttttgtgtaataaaaatcacaaattgaaggggatggagcaatggctttgtatgaatgatttcctcagaaaattccaacataagagagagagtttgttgttattttgtcataattactgtaattacatatcaattttttaattaattttttttttaaaattttaatttttctttttctttttccttgttaaatgtatgattcactgtcaatgtatgcatgaacaaccttggaaaacttttgtctttttgttttttaattatttttgctgtcctaaagtctttctagtcacgggttgtgttctttcttagggcctggctggctctgcctccgttgcttgtgaatcaaactgaaaaagattttctttttttcttcttcgttgtgtttttttatttattaattttatttggacatggaaacaga

SEQ ID NO: 2466 - DNA, 1628 bp, Manihot esculenta
cgccatggatcttcacgtctatggtgtctccaagttcttttcttttctctcctgttttctcttccttttcttcaccatctctgcatttcctcaacacccatcttctaataacactggtatcaactctaactctgttcttgttgctcttcttgactcgcattatactgagttggctgaactcgttgaaaaggctcttcttcttcagactcttgaagatgctgttggtaatcataatattaccatttttgctcctagaaatgaagctttggagcgtcagcttgaccctgagtttaagcgattcttgcttgagcctgggaatcttaagtctcttcagactctcttgatgttccacattattcctcagcgcgttggatccagtgattggcctagtgaaaaatccaagcctgctaggcattccactctgtgtaatgaccatcttcacttgatcagcaagagttctggcaagaaagtcgttgactccgccgagattatccgacccgacgacgttatccgtcccgatggtgttatccacggcatcgagcgccttctaatcccacaatccgtgcaagaagactttaaccggaggaggaatctcagatctatatctgctgtgttaccagagggcgcacctgaggtggatcccagaacccacaggttgaagaaaccagcagcacctgttccagttggtgcaccaccagtgctacccatttatgacgctatggctccaggtccttctctggctccggcgccagctccaggtcccggcgggcctcaccaccacttcgacggtgagagccaggtcaaggatttcatccaaacactattacattacggtgggtacaacgaaatggcagacatcctagtgaacttaacctcgctagccaccgaaatggggcgtttggtttccgaagggtatgtgctcaccgtcttagcaccaaacgacgaagccatggccaagctaacgacggaccagctaagcgagcccggtgcaccggagcagattatttactaccatatcatcccggagtaccaaacggaggaaagcatgtacaatgcagtgaggagatttgggaaaataaagtacgacacactgcgtttgcctcacaaggtggtggctctggaggctgatggatcggtgaaattcggatctggtgatacgtcggcgtatttgttcgatccagacatttatacagacggcaggatttccgtgcagggaattgatggagttttgttcccggaggaggagaaagagactgttaaaaaaccaacggccgccgtcaaggttgtcaccaaggcgaggagagggaagttgatggaggtagcttgtagaatgcttggagcttttggacaagattcacatttcaatacatgtcaatgaatctgcacagctaaaaataatagtaaaagatgggaaccatgaaaaaagaaaagagaaaatggtgagtccttaaggcttttgtttaataaaaatcacagacaaatgggatttgatggattgccatgtttgtatgattttcactcagaatcccagaagagagagagaaagagttgttattttgttataattactgtaattacatatcaattttttaattaaattttctatttttaaatgtatgattcagtgt

SEQ ID NO: 2467 - DNA, 2167 bp, Aquilegia formosa
cttccaaaactcaccacaaaaccaaactccacttgaaccaaaccaaataaaccaataagaaaacacatttgttcttcttcaatttcttctctaccaattggtttctcttctacaatcgccatggattctcatgtctatggcgttgcaaagatgattttcacaatttatcttatctctgttcttggaatttcagctgcattgccggaaaattcaactttgaaaacaaattctactcaaatcaactcaaattctgttttggttgcattacttgactcacattatacagaactagcagaacttgttgaaaaagctcttcttttacaaacattagaagatgctgttggtaaacacaatataaccattttcgcaccaagaaatgaagctttagaaagagatcttgatccagagttcaaaagattccttcttgaacctggaaatctcaaatctttacaaactcttctaatgtttcacatcattccaaaacgaattggttcaaatgagtggcctgaaaaagtttctgagtcaaatcggcacttaacactcaccagagatactcttcacttaactaattgtaaagattccggcaagaaagttggtttagctaaggttattcatcctgacgctgtgattcgacctgatggtgtgattcatggtattgaaaggcttttaattcctagatctgttcaagaagacttcaatcgtcgtcgcagtttacgttcaatctctgctgttttacctgaaggagcacctgaagtcgatccaaggactaatcgtttgaagaaaccagcttctccatctcctgctggtgcaccaccggtattaccaatttacagtgccatggcacctggaccatctctagctccggcacctgcacctggaccaggtggtgcgcaccgccatttcgatggagaaagtcaggttaaagattttattcaaacacttctacattatggtggatacaatgaaatggcagatattttggttaatttgacctcattagcaactgaaatgggaagattagtctctgaaggatatgtgattacagttctagctccaaatgatgaagcaatggcaaagttaacaaccgatcaacttagtgaacccggtgcaccggagagaattatgtattatcatatcataccggaatatcaaacggaagagagtatgtataattctgtcaggagattcggtaaaattcgatatgataccttacatttgccacataaggttatggctcaagaagctgatggatcggtgaaatttggggaaggcgatgaatcggcttatctgtttgatcctgatatttatactgatggtaggatttcagttcaaggcattgatggagttttgtttcctgctgaagaagtacctaaaacagaaacaactaaaacggttcaatctagtaagattgttaccaccaaaccaaggagaggaaaattgttggaagtagcatgcagtatgttaggggcctttggtcgaaattctcatttcaccacttgccaataatttttctcttccagccaaccaaacacataccaaatgaagttgcttcaaaaatgatgtcagcaaagaatgtataaacactcagatgggcagaaggaaggcttgtttagattggaaatagtggtgttcttatttttcttcttttgttcttatggcatcacagctaagggaaaagttggaagttataggaaggatgagtttacctcgtgggtggcttaaccttgcagaatttctacgcttcccatcgagtaaaatatcaaaaaaatcaaacaaagaagtccttgttaattagccataaagtattctaagtaaatatatgatatttttttagttttttttttttgtctatgagatggggcttttgtatttgtttattcttagaaagaaagacatataatgaatgggggttaaattttgtgtgatggagatgggaagtgggtggggtggcttattatcccccacttgaataaaaataaaaggtaacatcagaaacatttgtgggaataaagaattcttttcttcttgtgtttatataggggaaccagccaaataactgtaattatctcttgtaaaatgcagcatttgatcaacaagacaccttttgtctctttctttgttctctgctgattttttttcatatttattacactatgtgcttgcttgt

SEQ ID NO: 2468 - DNA, 1410 bp, Manihot esculenta
cgccatggatcctcccatctatggtgtctccaggattttcttcactctctgccttttcgttctcctctctgcttcctctgcttcctctgcattgcctcaatacccatcttctcctagtaacaagaacacgggtatcaattcaaactctgttcttgtcgcgcttcttgactcgcattacactgagttggctgaactcgttgaaaaggctcttcttcttcagactcttgaagaagctgtcggcagaaataatatcaccattttcgcacccaaaaatgaagctttggagcgccaacttgaccctgagtttaagcgtttcttgctcgaacctggtaatctcaagtctctccagactctgttgatgttccatgttattcctcaacggctcggatccaatgactggccctctgaaagatccaagctttctaggcataccactttgtgcaatgaccatattcacttaatcagtaaaacttctggtaagaaactcgttgactccgccgagataatcaaaccggacgacgttatccgtcccgacggtgttatccacgggattgagcgactcctaatcccgcaatctgtacaagaagacttcaatcggagaaggaatctcagatccatatccgcagtgctaccagagggtgcgccagaggtggatccaagaacccaccggctgaagaaaccagcagcacctgtgcctgtcggagcaccaccagtgctacccatttacgatgccatggctccaggtccttccctggctccggcgccggctcccggtcccggcggacctcatcatcactttgacggtgagagtcaagtcaaagactttatccagacactattacattacggaggctacaatgaaatggcggatattttagtgaacttaacctcattagccactgaaatggggcggctggtttccgaaggatatgtgctcaccgtcttggcaccaaacgacgaagccatggccaagctgacgacggaccagctaagcgaacccggtgcaccggaacagataatttactaccatattatcccggagtaccagacagaagagagtatgtacaatgcagtaaggagatttgggaaaataaagtacgatacgctgcgtttgcctcacaaggtggtggctcaggaggctgatgggtcggtgaagtttggggcgggtgatacgtcagcgtatttgttcgatccagatatttataccgacggcaggatttcagtgcagggaattgatggggttttgttcccggaggaggagaaagagagcgttaaaaaatcgacggccgccgttaaggttgtcaccaaacccaggagagggaagttgatggaagtagcctgtagaatgcttggagcttttggtaaggattcacatttcagtagatgtcaatgaacctgcacagctaaaat

SEQ ID NO: 2469 - DNA, 988 bp, Gossypium hirsutum
gacttaagagaactaatcaccccttttcctaaccatcaaaatacccccatccttttttatattctaatcttcatcctttttgcagatcaacgatcctctggatttttcttttcagattcctaaatccaacaaatacctaaagcctttgagatatttatatagatcgatcgaaatcgaagacagcagggtggcttgagaaaagggtaagtctggggtttggtggttattggaagtaaatggcgaatctgtatgtgaaagcggtgccaccggcggatctgaaccggaacaccgagtggttcatgtacccaggagtatggactacttatattctaatcctattcttctcctggctccttgttctctccatcttcggttgctctcctggcatggcttggaccgtcgtcaatctcgctcacttcctcgttacataccacttctttcactggaagaaaggaaccccatttgctgaagatcaagggatttacaatggcttgacttggtgggagcagatagacaatggaaagcagcttacacgcaataggaagtttctaactgtcgtacctgttgtgctgtacttgatagcctcgcatacaaccgactatcaacatcctatgctcttttttaacacacttgcagtgcttgtgcttgtcatcgccaagttccccaacatgcacaaggtccggatctttggaatcaatgcagacaagtgaatgagtctcccctgaaagaatagttggttttgcctgctagaaagccactgctgcttcccctctgctaaaaacgggcatcttttgtataggaggacatttcgaaagctgtcttttgtgtttttggtttttgctgagtctgcggactgcatttacaagctctcttagatcaataagtgtacagtggagaaatctaatgtatgttaaatacttcactatgctcttatcagcgtatcacatatcttcataccgtaatccatatctttgaatctcttatggca

SEQ ID NO: 2470 - DNA, 1064 bp, Gossypium raimondii
cgttggtttggttggttgttgttgtaataatggtcggcttagagaactaatcaccccttttcctaaccatcaaaatacccccatccttttttatattctaatcttcctcctttttgcagatcaacgatcctctggatttttcttttcagattcctaaatccaacaaatacctaaagcctttgagatatttatatagatcgatcgaaatcgaagacagcagggtggcttgagaaaagggtaagtctggggtttggtggttattggaagtaaatggcgaatctgtatgtgaaagcggtgccaccggcggatctgaaccggaacaccgagtggttcatgtacccaggagtatggactacttatattctaatcctattcttctcctggctccttgttctctccatcttcggttgctctcctggcatggcttggaccgtcgtcaatctcgctcacttcctcgttacataccacttctttcactggaagaaaggaaccccatttgctgaagatcaagggatttacaatggcttgacttggtgggagcagatagacaatggaaagcagcttacacgcaataggaagtttctaactgtcgtacctgttgtgctgtacttgatagcctcgcatacaaccgactatcaacatcctatgctcttttttaacacacttgcagtgcttgtgcttgtcatcgccaagttccccaacatgcacaaggtccggatctttggaatcaatgcagacaagtgaatgagtctccccttaaagaatagttggttttgcctgctagaaagccactgctgcttcccctatgctaaaaacgggcatcttttgtataggaggacatttcgaaagctgtcttttgtttttttggtttttgctgagtctgcggactgcatttacaagctctcttagatcaataagtgtacagtggagaaatctaatgtatgttaaatacttcactatgctcttatcagcgtatcacatatcttcataccgtaatccatatctttgaatctcttatggcactacctggatgactccagttcggtttaagcattaatgtgaaa

SEQ ID NO: 2471 - DNA, 880 bp, Heritiera littoralis
gaaaaaaggcttcttggagaggctctgggtttctgcattttagattccaaaatcagacaaatacccaaagaagccaagtctttgatatacctatttatacaaatcgatcaaatcaaaaaacagagtggcttgagagaagggaatttttggatttggtgggtattcaaaataaatggcgaatctgtatgtgaaagccgtgccacctgcggatctgaataggaacacggagtggtttatgtaccctggagtatggactacctatattctaatactcttcttctcgtggcttcttgttctctccattttcggttgctctcctggcatggcttggaccgtcgtcaatctctctcacttcctcgtcacataccaattctttcactggaagaaaggaaccccatttgctgaagatcaagggatttacaatggcttgacttggtgggagcagatagacaatggaaaacagcttacacgcaacagaaagtttctaactgttgtacctgtggttctatacttgatagcctcacatacaacagactaccaacaccctatgctctttttgaacactcttgcagtgattgtgcttgtcattgccaagttccccaatatgcacaaggttcggatctttggaatcaatgcagacaagtgagagggcctccggttagctggttttgcctgctagaaagccaccactccttaccctctgttaaaatgggtatatgttttgtatagaacattttgaaggtgtaatggttttttttctgctgagtatgctgactgcatttacaagctctcttagatcacgaaggaataataagcgtatctagcgatcttttgtacagtagagaaatctaatgtatgtggaatatcactgtactggaat

SEQ ID NO: 2472 - DNA, 1032 bp, Cucumis melo
gcccaaccccaccaagaagaaaataaaaccatccctagaaataaaggagaaagaaagaaaaaagctatctgggtttcgtttgtaattttttgaactactgagcacgcgatcaaacgcttcaatcttgtttccaaaatttcatcttttttttttttttttggttctttcttctcagtcaaatcccatacggttgttggaattggaattagtgttttctaacaaaatcagaatctgggtcgatggctaatctctatgtcaaggctgtacccccggcggatctgaataggaacacagaatggtttatgtatcccggtgtttggacgacctatattctcattctcttcttcgcttggcttctcgttctatctgtatttggctgctctcctggcatggcttggaccgtcgtcaatctatctcattttgctgtcacttaccacttcttccattggaagaaagggacaccatttgctgaagaccaggggatctacaacaggttgacatggtgggagcagattgataatggaaagcagcttacgcgcaacagaaaattcttgaccgttgttcctgtggtgctgtacttgatagcctcgcacacaactgactatcaacatccaatgttgtttctcaacactcttgcagtaattgtactagttattgcaaagtttccccacatgcacaaggtacgtatcttcggaatcaacgccgacaagtgaaggtcacatcaagaaatatttggttcgacttgccaaaaagcttctcgtcctcctctcaatctggtaaaatgttatatctctgtatagtagttgggactggaaggatactgaaaaatttgtagttttttcttttctttttctctttttcttttttgtaccgactgcttgttccgcctgttgcttaatgaataagtaaatgcaattatcttttatacagtagagaaatgtgatgcatttaagtttcactgttcttataaagtattttttgggacaacacacttcataattcttacatgttatttctccttcttgtgttgct

SEQ ID NO: 2473 - DNA, 991 bp, Theobroma cacao
gttgccccctccccgtgggtttttgttgtggtaattattatcgccgtagataattaaatcaaaattattgagggctgcccaattcttcatcatcatcatccttttacagataacaaaactcttgaagggaccctgggtttgtgcttttgagattcctaaatcaacccaattaaaaccaagtctttgaaaggataaataaatcgatcaaatcaaagaaggcagggtggcttgagaaaaagcaaagtctgggatttggtggatattgaaaaaaatggcgaatctttatgtgaaagcggtgccaccggcggatctgaatcggaacacggaatggtttatgtacccaggagtatggactacctatattctaattctcttcttctcgtggctcctcgttctctccatcttcggttgctctcctggcatggcctggaccatcgtcaacctctctcacttcctcgtcacataccacttctttcactggaagaaaggaaccccatttgctgaagatcaagggatttacaatggcttgacttggtgggagcagatagacaatggaaagcagcttacacgcaacagaaagtttctgactgttgtacccgttgtgctgtacttgatagcttcacatacaacggactaccaacatcctatgctctttttgaacactcttgcagtccttgtgcttgtcattgccaagttccccaacatgcacaaggtccggatctttggaatcaatgcagacaagtgagtggcctcctgttaagaaaagttgattttgcctgcttgaaagccaccactccttcccctctctcgctaaaatggggtgtatctttgtataggaggacattttgaaggtgtaatgtttttttctgccaagtgtgctgactggatttacaatctctcgtagataatgaaggaataattgtatcaagttatctttgtacagtagagaaatctaatgtatgtcgaatatcattatgctgttatcaactta

SEQ ID NO: 2474 - DNA, 934 bp, Cucumis sativus
gcccaaccccaccaagaagaaaataaaaaccatccctagaaaaggaaaaggaaaagagaaaagagagaagagaaaaaagctatctgggtttcgtttgtaattttttgaactactgagcacgcgatcaagcgcttcaatcttgtttccaaaatttcatcttttctttttcttcttagtcaaatcccatacggaggttggaattggaattagtgtgtttcctaacaaaatcagaatctgggtcgatggctaatctctatgtcaaggctgtacctccgacggatctgaataggaacacagaatggtttatgtatcccggtgtttggacgacctatattctcattctcttcttcgcttggcttctcgttctctctgtatttggctgctctcctggcatggcttggaccgtcgtcaatctatctcattttgctgtcacttaccacttcttccattggaagaaagggacaccatttgctgaagaccaggggatctacaacaggttgacgtggtgggagcagattgataatggaaagcaacttacgcgcaacagaaaattcttgaccgttgtccccgtggtgctgtacttgatagcctcgcacacaactgactatcaacatccaatgttatttctcaacactcttgcagtgattgtactagttattgcaaagtttccccacatgcacaaggtacgtatctttggaatcaacgccgacaagtgaaggtcacatcaagaaattttcggttcgacttgccaaaaagcttctcgtccttctctcaatctggtaaaatgttatatctctgtatagtagttgggaccggaaggatactgaaaaatttgtagttttctcttttctttttttctttttcttttttgtaccgactgcttgttccgcctgttgcttaatgaataagtaaatgcaattatcttttatacagt

SEQ ID NO: 2475 - DNA, 685 bp, Euphorbia peplus
atcaatctctgctgccagccattaaatcaaatccttctttgcttccacaattgatcttgccagcttatctatcaaccgaagagttgctaaaccatcagcgcctgattaagattaattgcagaatcgaagaggcatggcgaatctttatgtgaaggcagtgccaccggcggatctgaacaggaacaccgagtggttcatgtatccaggtgtatggactacctatatactcatcctattcttctcttggcttatcgttctctccgtctttggttgctctcccggcatggcctggaccatcgtcaatctcgcccatttctgtgtcacttaccacttctttcactggaagaaaggaacgccatttgctgaagaccagggaatctataacagactaacttggtgggaacagatagacaacggaaagcagcttactcgcaacagaaaatttctaactgttgttcctgttgtgctgtacttgatagcctcgcacacaaccgattatcaacatcctatgctgtttttcaacactctagcagtaatagttcttgtcattgcaaagttcccgaatatgcacaaggttcgcatcttcggaatcaatgcagaccggtgatcgggctatgcctgaacggccacggtggtctcgactttcaagaaaccagcatctgataagtccatcggctctgcttaa

SEQ ID NO: 2476 - DNA, 861 bp, Castanea mollissima
atttgcttgtggttttgttatctgtgtgtattttatcgaggttttgaattggaacccatcaaacccagaatcataaagaaccaatcttgtctgaatattctgagtcaaaggaaagagttgatgatggcgaatctatatgtaaaagctgcaccaccggtggatctgaataggaacacagagtggttcacatacccaggtgtttggaccacttacatccttatcctcttcttcgcttggcttcttgtcctttcaatctttggctgctctcctggcatggcctggaccattgttaatctcgcccactttgctgtcacttatcactttttccactggaaaaaaggaactccatttgctgacgatcaggggatctacaacgcgctgacatggtgggagcaaatagataatggaaagcagctcacacgcaacagaaagtttttaactgttgttcctgttgtgctgtacttgatagcctcacacacgactgactaccagcatcctatgctcttcctcaatactcttgcagcgattgtgctggttattgccaagttccctaatatgcacaaggtccggatctttggaatcaatgcagataagtgagtagggtatgcatcaggaaggtgttgattaaacctgcttaagagcctcatatccttcacttgttctggtaaaaagtcattgtatagtaatcagactgagaggattttcaaatatatataatgttttgtgcaaactgttttcaagcttcttggtgattgaaagaaaaaatatttgtactgagttatctttgtacagtagagaaagtttatgtatctggattatcatggtgctgttatcagcttatcacgtattttgacattgcaa

SEQ ID NO: 2477 - DNA, 1086 bp, Quercus alba
cgatcccaatacgacgccgtctcctctagatattttttggttcatctgtgtgatccagatcaatttttcattttcaatcagccccacgaaaagttagagagagagagagaaaaacagagactgttatttgctgcttgtggttttattatctgtgtgtatttatcgaggttttgaattggaactcatcaaacccagagccataaagaaccaaacttgtctgaatattctgagtcaaaggaaagagttgatgatggcgaatctatatgtaaaggcggcgccaccggtggatctgaataggaacacagagtggttcacatacccaggtgtttggaccacttacatccttatcctcttcttcgcttggcttcttgtcctttcaatctttggctgctctcctggcatggcctggaccattgttaatctcgcccacttcgctgtcacttatcactttttccactggaaaaaaggaactccatttgctgacgatcaggggatctacaatgcactgacatggtgggagcaaatagataatggaaagcagctcacacgcaacagaaagttcttaactgttgttcctgttgtgctgtacttgatagcctcacacacgactgactaccagcatcctatgctcttcctcaatactcttgcggcgattgtgctggttattgccaagttccctaatatgcacaaggtccggatctttggaatcaatgcagataagtgagtagggtatgcatcaggaaggtgttgcttaagagcctcatatccttcgcttgttctggtaaaaagtcattgtatagtaatcagaactgtgaggattttcagatatatataatgttttgtgcaaactgtttttcaagcttctgggtgattgaaagaaaaaatatttgtatggagttatctttgtacagtagagaaattttatgtatctggattatcatggtgctgttatcagcttatcacatattttgacattgcaattatattcattctaaaacttaaaaagtgaaaagttatactagattagcatatatggtaagaaatttgacagttcttgtttgtgataacaaagtgtttctcattaaa

SEQ ID NO: 2478 - DNA, 841 bp, Castanea mollissima
ttttggtcatctgtgcaatcaacttttcattttcaatcaaccccacgagaagttagagcaaaagagagagaaaagcaaaggactgttatttgcttgtggttttgttatctgtgtgtattttatcgaggttttgaattggaacccatcaaacccagaatcataaagaaccaatcttgtctgaatattctgagtcaaaggaaagagttgatgatggcgaatctatatgtaaaagctgcaccaccggtggatctgaataggaacacagagtggttcacatacccaggtgtttggaccacttacatccttatcctcttcttcgcttggcttcttgtcctttcaatctttggctgctctcctggcatggcctggaccattgttaatctcgcccactttgctgtcacttatcactttttccactggaaaaaaggaactccatttgctgacgatcaggggatctacaacgcgctgacatggtgggagcaaatagataatggaaagcagctcacacgcaacagaaagtttttaactgttgttcctgttgtgctgtacttgatagcctcacacacgactgactaccagcatcctatgctcttcctcaatactcttgcagcgattgtgctggttattgccaagttccctaatatgcacaaggtccggatctttggaatcaatgcagataagtgagtagggtatgcatcaggaaggtgttgattaaacctgcttaagagcctcatatccttcacttgttctggtaaaaagtcattgtatagtaatcagaactgagaggattttcaaatatatataatgttttgtgcaaactgtttttcaagcttcttggtga

SEQ ID NO: 2479 - DNA, 1086 bp, Citrus clementina
taattattatggtcctagtagaaagtaatcaatattagctataagctttcattacaaatcgccacgccatcaccgtcattgaggccatttggttttttggattggtctccggaaaaagcaaaaaatcatcaaatcattcaatttctctttattagaacctgaatccaaaaacctgtcattcaatttctctttttcagaacgtgaacccaaaaacctccataacagaaccgtctaatcgaagagagctggtaagcagtttgcttagggtttacaaaaaattattataataataatttgaaaaagaaaaaagagaaatcatatgatggcgaatctatacgtgaaggcgacgccaccggcggatctgaacagaaacacggagtggttcacgtatccaggagtatggactacgtatatactgatactattcttcgcttggcttatcgttctctctgttttcggttgctctcctggcatggcttggaccattgtcaatctcgcccattttctcatcacgtatcacttctttcactggaaaaaaggaacaccctttgctgaagaccagggcatttataacgggttgacttggtgggagcagatagacaatggacagcagcttacacgcaatagaaagttcctaactgttgtacctgtggtgctgtacttgatagcctcgcacacaactgactaccaacatccaatgctctttttcaacactttagcagtgtttgttcttgttgttgccaagttcccgaatatgcacaaggtccggatttttggaatcaatgcagataagtgagttggtattgtgataaagatagatgggataaccattacctactcaaaaggaactgctcctattctgtatagaagactgaactgtaatgaacaatatcgtatgtaatgttcttttgctggctgctttcacaagttgtctcttagataacgaaggaataagtgtatctgtgtcatatttgtacagtggataatttatgaatgtggattatctgtcagtttatcacatatttcgcccgcttgatgccaattatgttgtgtccaataatgaaatgaaatgcaacagtttcttat

SEQ ID NO: 2480 - DNA, 1060 bp, Cucurbita pepo
cttcttattgttatcatcagagcttgattcccaattttaagctctgtttttcgatcattgcccaaccccacgaacgaaagaaaccatacctagagaaaagccatctgggtttcgtttctaatatttgaactattaaccacgccatcaatcgctgcgatttgatttgcaaattccgttctttttcttagttgattccgtaggagaggttggattttttcgcatcaccggtgtttcggagcaaaatcagaatctgggttgatggctaatctctatgttaaggctatgcctccggcggatctgaataggaacacggaatggtttctttatcctggtgtttggacgacttatattctcattttgttcttcacttggcttctcgttctctctgtatttggctgctctcctggaatggcctggaccatcgtcaatctatctcattttgctgtcacctaccactgcttccattggaagaaagggacaccatttgctgaagaccaagggatctacaacagattgacatggtgggagcagattgacaacggaaagcagcttacccgcaaccgaaaattcttgactgttgttcctgtggtgctgtacttgatagcctcacacacaactgactatcaacatccaatgttatttctgaacaccctagcagtaatcgtactagttattgccaagtttcctcatatgcacaaggtacgcatcttcgggatcaacgcagacaagtgaaggtctcacatgaagagattttcggttcgacttgcccaaaacgcttctggttcgtctctcaacctggtaaaacgttatacctttgtatagtagttgggacaggaaggatactgaaaaattcgtagttttcttttttgtaccgactgctggctccctccctccgcttgttgctgaatgaatttaagtaaatccaattatcttttctacagtggagaaaaatgttgatgcatttgagtttcactgttgttattataaagtaatttttaggactacacacttaaatgcttcttcagttggttcttctgcacaaatatgaaccttgattttc

SEQ ID NO: 2481 - DNA, 878 bp, Heritiera littoralis
ggcctattatcctatcgccacgccatcattttattcttcttcatcatcgatcttctacagaaagaaaactcttgggggttgtctgggtttttgccttttagattcgtgataaatcgaatacccaaagaagcaaagcctttcatatattttcgtataaaccgatcgaatcgaaaaaaacagggtggcttgagaaaaaggaagtcggggatttggtgggtattgaaaataaatggcgaatctttatgtgaaagcggtgccaacggcggatctgaatcggaacacggagtggtttatgtaccctggagtgtggactacctatattctaatcctcttcttctgctggctccttgttctctccatcttcgggtgctcccctggcatggcttggaccatcgtcaatctatctcacttcctcgtcacataccaattctttcactggaagaaaggaactccatttgctgaagatcaagggatttacaatggcttgacttggtgggagcagatagacaatggaaagcagcttacacgtaacagaaagtttctgactgttgtacctgttgtgctgtacttgatagcctctcatacgaccgactaccaacatcctatgctctttctgaacactctcgctgtgattgtgcttgtcgttgccaagttccccaacatgcacaaggtccggatctttggaatcaatgcagacaagtgagtgggcctcctgttaagcataagtggttttaccagctagaaagacaacactccttcacctgttaaaaaatgagtatatctttgtatatgacattttgaatgtgtattttttttgtttttctgtgagtgttctgactgcatttacaagctccctgaaggaataataaatgtatcaa

SEQ ID NO: 2482 - DNA, 829 bp, Momordica charantia
gaactactgagcacgcgatcaaacgcttcaatctgatttgcgaatttgatcatttgtctcagtcaaatcccaaggtaagaaggttggattttccctcatcagcagtgtatcggaacaaaaatcagaatctgggtcgatggctaatctctatgtgaaggctgtgcctccggcggatctgaataggaacacagaatggttcctgtatcccggtgtttggaccacctatattctcattctgttcttcgcctgggttctcgtcctctccgtatttggctgctctcctggcatggcctggaccatcgtcaatctctctcatttcgctgtcacttaccacttcttccattggaagaaagggacaccatttgctgaagaccaggggatctacaatagattgacgtggtgggagcagatagataatggaaagcagcttacccgcaacaggaaattcttgactgttgttcccgtggtgctgtacttgatagcctcacacacaactgactatcaacatccaatgttatttctcaacagtcttgcagtaattgttctagttattgcaaagtttccccatatgcacaaggtacgtatctttggaatcaatgccgacaagtgaagctcgcatcaagagattttcagttcgacttgccaaagagcttctcgcccttgtctttgatctggtaaaatgttatatctttgtatagtagttgggactggaaggatactgaaaaatttgtagcttttttgtaccgactgcttgttccacctgttgcttattgaataagtaaatgcaattatcttttatacagtagaaaaaatgtgatgcatttgagtt

SEQ ID NO: 2483 - DNA, 1087 bp, Citrus sinensis
taattattatggtcctagtagaaagtaatcaatattagctataagctttcattacaaatcgccacgccatcaccgtcattgaggccatttggttttttggattggtctccggaaaaagcaaaaaatcatcaaatcattcaatttctctttattagaacctgaatccaaaaacctgtcattcaatttctctttttcagaacgtgaacccaaaaacctccataacagaaccgtctaatcgaagagagctggtaagcagtttgcttagggtttacaaaaaattattataataataatttgagaaaagaaaaaagagaaatcatatgatggcgaatctatacgtgaaggcgacgccaccggcggatctgaacagaaacacggagtggttcacgtatccaggagtatggactacgtatatactgatactattcttcgcttggcttatcgttctctctgttttcggttgctctcctggcatggcttggaccattgtcaatctcgcccattttctcatcacgtatcacttctttcactggaaaaaaggaacaccctttgctgaagaccagggcatttataacgggttgacttggtgggagcagatagacaatggacagcagcttacacgcaatagaaagttcctaactgttgtacctgtggtgctgtacttgatagcctcgcacacaactgactaccaacatccaatgctctttttcaacactttagcagtgtttgttcttgttgttgccaagttcccgaatatgcacaaggtccggatttttggaatcaatgcagataagtgagttggtattgtgataaagatagatgggataaccattacctactcaaaaggaactgctcctattctgtatagaagactgaactgtaatgaacaatatcgtatgtaatgttcttttgctggctgctttcacaagttgtctcttagataacgaaggaataagtgtatctgtgtcatatttgtacagtggataatttatgaatgtggattatctgtcagtttatcacatatttcgcccgcttgatgccaattatgttgtgtccaataatgaaatgaaatgcaacagtttcttat

SEQ ID NO: 2484 - DNA, 1157 bp, Carica papaya
ccctaagaaaatactgaattggagtcgggcgtaattaccatcgccggctctcgctggctgaagtcctttccatctccagttgccacctaatcatctttattagcctttacccttacccatacccacacacaaaaggaagaaaaagaaatctctgggtggtctttctctgggttttgtaaatctacccagtaacgcgaaataccataacaaatcattatcgttatcgcgacagcaaccaccgcagcacaaaaccaaggccaattcctgccaatcaaatcgaccagggaagcttcaatacttttgaggaagacgaaaaagaatcggagataagtggagaagaaatttcgacgtataaatggcgaatctgtacgtgaaggcggtgccaccggcggatctgaatcgaaacacagagtggttcatgtacccgggggtgtggaccacctacatactcattctcttcttctcctggctgctcgtcctctctatcgtcggttgctctcctggcatggcctggaccatcgtcaatctcgcgcattttctcgtaacttatcatttctttcactggaagaaaggaaccccgtttgctgatgaccagggaatctataatggcttgacttggtgggaacagatagataacggacagcaacttacacggaatagaaaatttctaactgttgtacctgtggtgctatacttaatagcctcgcatacaactgattaccaacacccaatgctcttcttcaatactcttgcggttattgtgcttgttgttgccaagttccctaacatgcacaaggtccgaatatttggaatcaatgctgataagtgagctggcttgggttgaaaaataaggtcttgcctgctttaaacccactgatccttccattctgcttataaaagttgaatctgtgtatagtagtagtcagaagtccaaggatctctgaatctgtaatgtttttgggccaactgtttttaggggtgatcttagttaatgaagcattaagtaataagcgtgtgttgagttactctgtacagtaggagaaattccatattgtatctggaaacgggaatattactagtggctgttattaggttattccatgttctgactggatcatctcctctcttaaaatatatatatatttttggaacattaa

SEQ ID NO: 2485 - DNA, 1053 bp, Fagus grandifolia
atcaaaaaaaataacccactcattaaagagacgaaaaataaaataaaaattatatccccaacatcccaagacgacgccgtctcgtctagatttttgtgttgtctggttaatcaagttttcattttcaatcagccccacgaagatagagcaaaagagagcgagagagagagaaacaaacccaatcatccagaagcaattttgtgtattttttaaggttttgaattcgaacccaccaaacccaatcatcaagaagcaattttgacacataaattggttagtttggaaatcaaagaaaattgtggatggcaagtctatacgtgaaggcggagccaacgacggatctgaataggaacacagaatggttcacatacccaggggtttggaccacctacatccttatcctcttcttctcttggctccttgtcctctccatctttggctgctctcctggcatggcctggaccgttgtcaatcttgcccacttccttgtcacttatcacttcttccactggaaaaaggactccatttgctgaagatcaggggatctacaatgctttgacttggtgggagcaaatagataatggaaagcagctcacacgcaacagaaagttcttgactgttgttcctcttgtgctgtacttgatagcctcacacacaactgactacgagcatcctatgctcttcttcaatactcttgcggtgattgtgctggttattgccaagttccctaatatgcacaaggtccggatctttggaatcaatggagataagtgagtagggtttgcatcaggaaagagtatatataagctgctcaaaagccctcttatccttcacttgttctggtaaaaagttatatttttgtatagtagtcagaactgagaggatattcaagagtgtaatgtttttgtgcaactgtttttcaagctgtctcttagtgattgaagaaaaaatttgtaacgagttatcgttgtacagtagagaaatttatgtatctggattgtcacatgctgttttcagcttatcacatattgtcatcgcaattatcttcattct

SEQ ID NO: 2486 - DNA, 893 bp, Ricinus communis
ccacatccattttaagaaagaggaatagaaaaataaaaaattcccttcgttcagcgatttatttcttcgcctttttcgtcttcgccttcatcaaagtctcgttgaagggagataatatttaattaacatacaaattattatttttttaaatacagctatggcaaatctgtatgtaaaggcggtgccaccggcggatctgaacaggaacacggagtggttcatgtatccaggtgtatggaccacatacatactaatcttgttcttttcatggcttctcgttctctcagtttttggttgctctcctggcatggcctggaccatcgttaatctcgcccatttttgtataacttatcacttctttcactggaagaaaggaacgccatttgcagaagatcaggggatctataataggctaacttggtgggaacagatggacagtggaaagcagctcacacgcaacagaaagttcttaactgttgttcctgtggtcttgtacttgattgcctcgcacacaactgactatcaacatccaatgctctttttcaacacgcttgcagtagcagtgcttgttattgccaagtttccaaatatgcacaaggttcggatctttggaatcaatgcagacacgtgagttgggcttgtgctaaaatcgtttgtcatttaaaagccattgtccagtgatccatccgcccctctgctctgctgaaaggttatctctgtatagaagtcagaactggaaggatatttgcacatgtaatgttttttgctgcctacttttacaagttctctctctagataacagaaagaataaatgtatctgagttaatctttttgtacagtatatgtatctttggttattacattgttgtggttgggttgttacatattttatc

SEQ ID NO: 2487 - DNA, 851 bp, Acacia harpophylla
ggttctcaaccaatttttgttcggaccgcagccttagattttttcttctccagtcatcaacaatcaacatcgtcattaacgtcgccgattattcatatttagctcagtcggccacccccttatagatcgttctgatcaggcgttgtagagcgaggagagagaatcacagctttttgtgggtttttaggtttgagcatcggacacaccacaatcgtcaacacataaatccggcaccgactattctattttagcttcttattgtcaaaatcttgccttttcctgctttcaatccatagaatttaaatggcaaatctttatgtcaaggccacgccaccggctgatctgaataaaaacaccgagtggttcacctatccgggggtgtggaccacctacatccttatcctcttcttcgcatggcttcttgtcctctccatctttggctgcactcctggcatggcttggaccatcgtcaatctcggccacttcgcggtaacatatcactttttccactggaagaaaggaaccccatttgcggatgaccagggaatatacaatggattgacatggtgggagcagatagatagtggaaagcagctcactcgtaacaggaaatttcttacagttgtccctgtggtgctgtacttgatagcctcgcacacgactgactatcaacacccaatgctcttcttcaatacccttgcagtgatggtgttagttgttgcaaagttccccaacatgcacaaggttcgaatctttggaattaatgccgatacttgacgatatcgtcatgtcaatggggtcttggtttacctgctaatcatgagcctcttatgatccttctcacttcgtct

SEQ ID NO: 2488 - DNA, 826 bp, Manihot esculenta
attgggactgggtttggaatcacgtcacctcagccattaaaattcttttgtttctggaaaattttatttccttacaatctcaagagctcgttgattaccgtctaggagatacagtagattaagagatatggcgaatctctatgtgaaggcggtgccgccggctgatctgaacaagaacactgagtggttcatgtacccaggggtgtggaccacctacatactcatcttgttcttctcctggcttctcgtgctctccatctttggctgctctcccggcatggcctggaccatcgtcaatctcgcccatttctgtatcacttatcacttctttcactggaagaagggaacgccatttgcagaagaccaggggatctataatagcctaacttggtgggaacagatagataatggaaagcagcttacacgcaacagaaagttcctaacagttgttcctgtggtgctgtacttgatagcctctcacacaactgactatcaacatccaatgctgttcctcaacactcttgcggtgacagtgctcgttattgccaagttcccaaatatgcacaaggttcggatctttggaatcaatgcagacaaatgaggtgggcttgtgctgaaaatgtttgtttttgcctgtttaaaacccgctgtgcactaatccatctgctgctctgcttaaaaggttgtatctctgtatagaagtgagaaactctaaggctacttgaatatgtaatgttattgtgctacttttactagccatcaatgcaataaatgtatcaagtttctttgtacagtatagaaaaatcatattacctattttgacagt

SEQ ID NO: 2489 - DNA, 1092 bp, Ricinus communis
gaatgaattaagatttatatggcatcattatcaccattgtcactcagcaataaaggctaaaacacaaaacagcaactgatttggagtcagaaatcaccacatccattttaagaaagaggaatagaaaaataaaaaattcccttcgttcagcgatttatttcttcgcctttttcgtcttcgccttcatcaaagtctcgttgaagggagataatatttaattaacatacaaattattatttttttaaatacagctatggcaaatctgtatgtaaaggcggtgccaccggcggatctgaacaggaacacggagtggttcatgtatccaggtgtatggaccacatacatactaatcttgttcttttcatggcttctcgttctctcagtttttggttgctctcctggcatggcctggaccatcgttaatctcgcccatttttgtataacttatcacttctttcactggaagaaaggaacgccatttgcagaagatcaggggatctataataggctaacttggtgggaacagatggacagtggaaagcagctcacacgcaacagaaagttcttaactgttgttcctgtggtcttgtacttgattgcctcgcacacaactgactatcaacatccaatgctctttttcaacacgcttgcagtagcagtgcttgttattgccaagtttccaaatatgcacaaggttcggatctttggaatcaatgcagacacgtgagttgggcttgtgctaaaatcgtttgtcatttaaaagccattgtccagtgatccatccgcccctctgctctgctgaaaggttatctctgtatagaagtcagaactggaaggatatttgcacatgtaatgttttttgctgcctacttttacaagttctctctctagataacagaaagaataaatgtatctgagttaatctttttgtacagtatatgtatctttggttattacattgttgtggttgggttgttacatattttatcagttatatcattgtcacacctacttttatttttatttttatttttataatttttaggtacaatagatctcaattaagggcatccataactgccctggttttga

SEQ ID NO: 2490 - DNA, 1023 bp, Cucurbita pepo
tcgttataatgctttctaaatatcaccagagcttggttaccaattttgagcactgggtttcgatcattcatccaaccccacgaagaaaccatacctaaaatctatctgggtttcctttgtaatattcgaactacttagcacgcgatcgaacgctgcaatctgttttgcaaatcggatcatttttctcagtcaaatccgaaggggaggtttgatttttcccatcagcagtgtttcggggcaaaatcagaatctgggtcgatggctagtctctatgtgaaggctgtacctccggcggatctgaacaggaacacagaatggtttctgtatcctggtgtttggaccacctatattctcattctcttcttcgtttggcttctcgtcctctctgtatttggctgctctcctggcatggcctggaccatcgtcaacctatcccattttgctgtcacttaccactttttccattggaagaaagggacaccctttgctgaagaccaagggatgtacaaccgattgacgtggtgggagcagattgataatggaaagcagcttacccgcaacagaaagttcttgactgttgttcccgtggtgctgtacttgatagcctcacacacaactgactatcaacatccaatgttatttctgaacactcttgcagtaattgtactagttattgccaagtttccccatatgcacaaggtacgtatcttcggaatcaatgccgacaagtgacgctcacatcaaaacatttgtggttgggtttgtcaaaaagcttctcgtcctctcaatctggtaaaatgttatatctttgtatagtagttgggactggaaagatactgaacaacttgtagttttctttttgttttgtactgactgcttgtttcgcctgttggttaatgaataagtaaatgcagttatcttttttacagtacagaaatgcgatgcattgagtgatcttttaataacatacacttcacatagtatctgatagtttgcattgaaatgaaattgctctgtttcact

SEQ ID NO: 2491 - DNA, 1075 bp, Gossypium raimondii
cttcatcttcatcttcatcgtagaacgcctagtgtttgaatttatataaattcaatcaaatacaaaaactgggtcgttttagaagaagggtctcgtctctgattttggcgggttaaattgaaaaacataaatggcgaatctatatgtgaaggcggtaccaccggctgatctgaaccggaacaccgagtggttcatgtacccaggtgtatggactacttatattctattcctctttttctcttggctccttgttctttccatctttggttgttctcctggcatggcttggaccatcgttaatctcgctcacttccttgttacttaccacttctttcactggaagaagggaaccccgtttgctgatgatcaaggaatttacaatggcttgacttggtgggagcagatagacaatggaaagcagctaacacgcaacagaaagtttttaaccgttgtacctgttgtgctatacctgatagcttcgcatacaacagactaccaacatcctatgctctttctgaacacgcttgcagtgatcatcctcgtcgttgccaagttcccaaacatgcacaaggtccggatcttcggaatcaatgcagacaagtgagtttatctccccgttcagaacagttgatttcaccagctagaaaagccatacatacagctccttcacctctgttgaaaatgggtatatctctttgtatagaacattttgaaggcttaatgtccttctttcgttttcgtggtgaattttctgactgcacacttagaagctcccctttgatcatgatgaaggaataatgagtgtatcaagttaaaatctttgtatagtagagaaacataatgtatgttcaatatcatttgtgtgtatatgtatttatgctgctttcatgttcttatttatgtgtgtgtgtgtatatatatatatatatatttatgcagctatcatgttcttattttcagaccagtggcagccatgggaaatatcttagaaaagactatacctaggccttttttgtttggttactctttttctctgataattaagacattgtataatctggtacaactttaagga

SEQ ID NO: 2492 - DNA, 1246 bp, Prunus mume
gctttttcctgtcgatatcaatattcacctccattttgtttgtaataagcctccatcgttaaccccacagagaaataatagactatataaagaaaaacagagtgatctgcctttgggttttggatttcgaaaccattaaatacccaaaacgactaaattacaatccaatacacagattcaagcttatcccaatcaaaacccacaaatacttcaaattttcgaaaccagaagagtcgctgaatcaaaacccagaaacgggaatttttggatggcgagtctgtatgtgaaagctgtgccacctgcggatctgaataggaacacagagtggttcatgtaccctggtgtttggaccacctatattctcatcctcttcttctcttggcttcttgtgctctcaatctttggctgctctcctggcatggcttggaccatagttaatctctctcattttttggtcacttatcacttcttccactggaagaaaggaactcccttcgctgaagatcaggggatctacaatggacttacttggtgggagcagatggatagtggaaagcagctcacccgcaacaggaagttcttaactgttgttcctgtggtgctgtacttgatagcctcacacacaactgactaccagcacccgatgctctttttcaacagtcttgcagtcattgtgctagttattgccaaattccccaatatgcacaaagtccggatcttcggaatcaatggagataagtgagttgggcttaaggttgacatgttcagaaatcacatatcattctcttgtttggatgaagagctatatccttgtatagaagttggaacgtgagggatattcaaaaatataatgtgtttttgttcttacggcttttcaagctgcctcccagtaaagaataattgtattgagttatctttgtacagtagagaaattttatgtatcttgagaatcacggtgctatatgagcatatgccccatattttgatgtctcttttccaaattcccatcggtttgattatcttttccaccctggaaacagagtttatgcctgaaacagaacaatattgtgtggatacagattcgacggcatgaccgcaataatgcactgtataggtttgtgtcatcattttgggtttattcatttcttatgttgtgtaggatacgccaagtacaactgcgcagctcaatgacgtctttcatctgtgtaatgactatgatcggaaagttcatgtttggatcagggcc

SEQ ID NO: 2493 - DNA, 934 bp, Prunus persica
cacggagaaatactatataaagaaaaacagagtgctctgcctttgggttttggatttcgaaaccattaaagacccaaaacgaccaaattacaatccaatacacagattcaagcttaatcccaatcaaaacccacaaagacttcaaattttcgaaaccagaagggtcgctgaatcaaaacccagaaacgggaatttttggatggcgagtctgtatgtgaaagctgtgccacctgcggatctgaataggaacacagagtggttcatgtaccctggtgtttggaccacctatattctcatcctcttcttctcttggctccttgtgctctcaatctttggctgctctcctggcatggcttggaccatagttaatctctctcattttttggtcacttatcacttcttccactggaagaaaggaactcccttcgctgaagatcaggggatctacaatggacttacttggtgggagcagatggatagtggaaagcagctcacccgcaacaggaagttcttaaccgttgttcctgtggtgctgtacttgatagcctcacacacaactgactaccagcacccgatgctctttttcaacagtcttgcagtcattgtgctagttattgccaaattccccaatatgcacaaagtccggatcttcggaatcaatggagataagtgagttgggcttaaggttgacatgttcagaaatcacatatcattctcttgttctgatgaagagctatatccttgtatagaagttggaactggaaggatattaaaaaatataatgtgtttttgttcttacggcttttcaagctgcctcccagtaaagaataattgtattgagttatctttgtacagtagagaaattttatgtatcttgagaatcacggtgctatatgagcatatgtcccataatttgatgtctctcttccgaatt

SEQ ID NO: 2494 - DNA, 877 bp, Fragaria vesca
gctctgcttttgggttttgccttttccaacttgtccaatctccaatccctcgatcaaaaacccaccaaagattcaagctttctgcaccaaagggtccccgaatcgaaacgcagaaacgtttgattcgtgaatggcgagcctctatgtgaaagctgtgcctcctgcggatctgaataggaacacagagtggttcatgtaccctggggtttggaccacctatattctcatcctcttcttctcttggctcctcgtgctctcgatctttggctgctctcctggcatggcttggaccattgtcaatctctctcatttcttggtaacttatcaattcttccactggaaaaaaggaactccctttgccgaagaccaggggatctacaatggactgacttggtgggagcagatggataatggaaagcagctcacccgcaacaggaagttcttgacagttgttcccgtggtgctgtacttgatagcttcacacacaactgactaccagcacccgatgctctttctcaacactcttgcagtcattgttctagtgattgccaaattccccaatatgcacaaagtccgaatttttggaataaatggagataagtgagtgggcttttcattgggtttgacatgttcaaaagtcacatatcattctcttgttctgatgaacagctactttgtatagaattagaactggagggatgctcaaatatataatgttcttttttgtggtttactgcttttcaagctgtgcctcctagatgttgaaagaataattgtattgagttatttgtacagtagcgaagttttaatgtatcttgacaccactttgttttacaattgagcaaatcacatgttttgacaagtgtttctcttcatc

SEQ ID NO: 2495 - DNA, 889 bp, Carpinus betulus
gaaaaaaaaaaaactagtactgagagctctgcttctcggttcttttctttttctttgaggttttggtattcgacccaacaaagccacaattagcaaaactattctggcacgtaaatcggtttccaatcaaagaatttgatcggtaacgaagattgattgaaaatttggatggcaaatactgtacgttaaggccgtgccgccggcagatccgaataagaacacagagtggtttatgtacccaggggtgtggactacgtatatcccccattctgttcttctcttggctcctcgtcctctccatctttggctgctctcctggcatggcctggaccattgttaatatcgcccacttcgctgtcacctatcacttctttcactggaagaaaggaactccatttgctgaagatcaggggatgtacaataggttgacttggtgggagcaaaatagataacggaaagcagctcactcgcaacagaaagttcttaacagttgttcctcttgtactctacttgatagcctcacacacgactgactaccagcaccctatgctcttcttcaatactctggcagtgattgtgctggttattgccaagttccccaatatgcacaaggtccggatctttggaattaatgcagatacgtgaagtgcggtttgcatcaggaaagagttagatttacctacttaagactgttatccttcacttgttctggttagaagttatatctctgtatagaaatcagaactggaaggatattcaaatacgtaatgtttttgtgccagtgttaatttcttcaagtctcttagatattgaagaaatgattgtattgagttatctttgtacagtagagaggtttaatacatatggattatcatggtgctcttttgac

SEQ ID NO: 2496 - DNA, 1130 bp, Amaranthus tuberculatus
acttaccagggaggagagagaaaacaacaaaattgaaatttctcttaaaattcattcaatttcattcctatcaacaactcaattttccattttctcgaggttttacagagtttaacaatggcgaatttgtacgtgaaagcttctccacctgcagatctgaataggaatactgaatggtttacgtatcctggagtttggactacttatattttgattctctttttttcatggcttcttgttctttccgtctttggctgtactcctggcatggcttggaccgttgttaatcttgctcattttcttgtcacttatcatttctttcactggaaaaaagggacaccattctctgatgatcaaggaatatacaatcgcttaacttggtgggagcaaattgataatgggaaacagctaacacgtaacaggaaattcttgaccgttgtacctgtggtgctgtatctgatagcttcacatacaacagattacgaacacccaatgctcttcttcaacaccattgctatgctcgttttggtaatagccaaattcccgaacatgcataaagtccgcatctttggtatcaatggtgatgagtaagacagtcaaggcagtcagctcgttttaacactcaaaggtgacttctgaacctttccagctgctggaggaacacactactgtataggaaaaccagaaaagaaaatggttgtggatgatgtaatacttttgcatcgcctaaattatagcctacctgaaagagattatgaacaaataattagtaatcttttgtacagctatattgcttgttcgtttaggtgtttggtttctgatatgcgcacgtttctggtttttcagaacgatatgtcaagaaccttttgaatctgtaatggaagagaaactcgatactagatttgttatacttgtatggatcaatatcggggggacttgcttcagatattaaagcccatgcagaaaaattttatatatttgcatttgaatgttgattgtatttgaaaaatatagccaccttggcagacacattccctaatctctaatgtgggtagaagaagcaaatgctgggctttggagtgattgactaaccaactagttgtaatatatgtgcatcatcattatcaaat

SEQ ID NO: 2497 - DNA, 1074 bp, Vaccinium corymbosum
cattacgccgggggatggtctgatctaatctaatgatccacgacaccaccttgacacggcaggcaacacaaatatctgtaggcgtaacattcgaaatcctttgatcgtccctctcctcctacttctaatctaaatccaatcatcatcgtcatcaaattccccatcaaaccaaaccagaggccaacccacaaaatcaaatcaataaaagaaaaagaagcggccaaggggattcattcaaaatggcaaattactacgtgaaggcggagccgccgacggatctgaacaggaacacggagtggttcacgtacccaggtgtttggaccacttatatattgatcctcttcttctcttggctccttgtcctctccatcttcggatgctcacctggcatggcctggaccatcgtcaatctctctcatttcgctgttacttatcacttcttccactggaagaaaggaactccctttgctgatgatcaggggatctataattcgctgacatggtgggagcagattgacaatggaaagcagctcaccaggaacagaaagtttctaactgttgtacctgtggtgctgtacttgatagcctcgcacacaactgactaccaaaacccaatgctcttcttgaatactcttgctgtgatggtgctagttattgccaagttcccaaatatgcacaaggtccggatcttcggaatcaatggtgatctgtgagttgtggacctgaattatgaatcattttgctttacagttgtaaaagcctccgatccttccatgttctgcaaagatgacatttccatgtatagaagctggaacctgaaaggatttgaaaccttttttgtgcactttcactagttgttttcgctttgatattggaggaataattgtatcgacgtactttttgtatagtagagttattatgtgcgaggaggatcaaggtgctgttatccgcttatccagtatcttaaaaattctcttgtatgtgtaatttctcatgtgtgacttgtccaatctcttttggcctttggaaagaaattctgccgagaatagggatgctgttctcatacatggcgaa

SEQ ID NO: 2498 - DNA, 915 bp, Actinidia deliciosa
gtgtcgaatgattcggcttccttttctccccctcccaaccccaaacccaaaaccaagcagcgaagaatcatcatcatcatcgccatcgtcgtcacatcccacgaccagatcccaagaacgaaggttaggctagggtttgcgacctccggacatcgaatatgcccaatttgtacgtgaaggcggcccctccggcggatctgaaccggaacacggagtggttcacgtaccccggcgtctggaccacctacatattgatcctcttcttctcttggctcctcgtcctctccatcttcggttgcagtcccggcatggcctggaccatcgtcaatctctcccatttcgccgtgacttatcactttttccattggaagaaaggaactccatttgctgatgaccaggggatctataatgggctgacttggtgggagcagattgacagtggaaagcagctcacccgcaacagaaagttcctgactgttgtccctgtggttctgtacttgatagcctcgcacacaactgactaccaacacccaatgctcttcttcaacactcttgcagtgattattctagttattgccaagttccccaatatgcacaaggtcagcatctttggtattaacggagatcagtgagttggacccgcattatgaaccattttgttcgactggtgtaaaagcatccgatccttccttgtttgggatgaaatgttatcctcgtatagaagtcagaaatgtaaagaattttcagaaacgtgatatgttgttttgctgactttttcatatgctgttttccctagatatctaaggaataatcttgtcgagttatttttgtacagcagaagtttttttatgtatcgggaggatcatgcttgttatcagcttatgcaatatcttacaaatggtagtattgttttct

SEQ ID NO: 2499 - DNA, 894 bp, Rosa hybrid cultivar
aaaaacagagtgctctgctttgggttttgcatttccaactcctccatctccaatctcaatcaaaattccgagctcatctctatcaaaacccaccaaagattcaaactttctgcaccaacgggtccccgaatcaaaacccagaagcgttgattcgtgaatggcgagcctgtatgtgaaagctgtgcctcctgcggatctgaataggaacacagagtggttcatgtaccctggcgtttggaccacctatattctcatcctcttcttctcttggctccttgtgctctcgatttttggctgctctcctggcatggcttggaccatagtcaatctctctcatttcgtggtaacttatcaattcttccactggaaaaaaggaactccttttgccgaagaccaggggatctacaatggattgacttggtgggagcagatggataatgggaagcagctcacccgtaacaggaagttcttaacggttgttcctgtggtgctgtacttgatagcctcacacacaactgactatcagcacccgatgctctttctcaacactcttgcggtcattgttctagtgattgccaaattcccaaacatgcacaaagtccggatttttggaatcaatggagataagtgagtggctttacatttgggtttgacatgttcaaaagtcacatcattcccttgttctgatgaacaactactttgtatagaattagaaccggagggatgctcaaatatataatgtttttttttgtgctttactgctttcaagctgtgcctcctagatgatgaaagaataattgtattgagttatttgtacagtagcgaaattttaatgcatctcgattatcactttgtttaaaaaaaaaacaaactagagacttagttctctctagg

SEQ ID NO: 2500 - DNA, 1667 bp, Trifolium pratense
tcattttcaatttcaatttccaatttctttcacattcacacacacgcacattatcattgacataatattaaccagaaaaataaaataatcaaagggttacgttacgtttctgggttttggaattttcattcttcattcagaaaataaccctaattcaaacctttttcatctgggatcaacatcatcaagttcaaatctttttcatctgggatcaaaatatttcagtttctaatcaaaagggtatctttagatttttgaaattttgatggcaaatctgtatgtgaaagctgtgcctccagcggatctgaacaggaacacagaatggtttacgtatcctggtgtttggactacctatattctcatccttttcttcacatggatccttgttctttctgtgtttggttgttctcctggaattgcttggacgattgttaatctcgctcattttcttgtaacatatcacttttttcactggaagaaaggaactccgtttgccgatgatcaggggatctacaacagattgacatggtgggagcaggttgacaatggaaagcagctcactcgtaacaggaagtttttgacagttgttcctttggttctgtacttgatagcctcacacacaactgactatgaacatccaatgctgttcttcaacacggttgccgtgattgtactagttgttgccaagttcccaaacatgcacaaggtcaggatattcggaatcaacgctgataagtgacaaagtgaaactgtttctttctcgatgaaactttggttgttagtagctcatgagcctctcttcttccttctcttgttctgaaaaaaaaggttgcaacctttgtatagaaaaggcagagctattgaaggatactcaaaatccatgttttgttgccaaccgtttttattttattttattttattttattaagcttcatcatcatcatcatcttctaaggtattaaacaaacaaataaatatgttgagttattatttctgtacagtagagaaaaatacatgtaccagagattataacggtgctttaaaatttagtagtaagtacctttcttttatcaatgccttataaaactttatacaagaatcatccttttccttaacattaaattctatgagagtttaaggtgatatgattgggtagattgcttaatcaaactcttaatcaatgttgctatgattggcttgaaactactatgctatgtgttgtcaacttataggtaacataattgtcataaacagtttaaaaggttgtgaaaagactacatcttgaaagggaaagttgtttatttttgtgagaggaaaattaagaattgcatttaagtttagtcctttttcttattgattaatttcctgtatttattcctactatttatatcttagatagttcaaagattattctatactgtataaaactatgaaaatcttaaatgtattttaagtcccttttaactattgtgattgtatgatgttaaataaccttaaattagggtagagcattgagcaggttaaatcaggctcaaaatgtttcacccaaaagaaattgagtgtaaaattttagcctaactccgaccactttaaacttggttttgtcgggtgttggtttaagtcggtcacaagttggtcggttcaatttattcggattagcacataca

SEQ ID NO: 2501 - DNA, 635 bp, Cyclamen graecum
catcgaatatcagatttcagaaaccctaaaattgttacaaaagatggccaatttgtatgtgaaggcggtgccgcctttggatctcaatcggaacacggagtggttcacctaccccggcgtgtggacaacatatatattgattttattcttttcatggctcgttgtgttgtctattttcgggtgttcccctggcatggcttggtccatcgttaatctctcccattttgctgtcacttatcactttttccattggaagaaaggaactccctttgctgacgaccaggggatgtataatgcattaacttggtgggagcagatcgacaatggaaagcagctcactcggaatagaaagttcttaaccgttgttcccgtggtgttatacttgatagcctcacacacgactgattaccagcacccaatgctctttttcaacactctggcagtgattgtgttggtgattgctaagtttccgaatatgcacaaggtccggatctttggaatcaacggggaaggttagtgattcgaacggaaggccactaattccgttgctctggtgtaaaatcttctgataattccttagttaatacttattcgaaatgttatatccgtatagaagtcggaagtatcaaaattga

SEQ ID NO: 2502 - DNA, 1005 bp, Malus domestica
acggagagaaataatagacttcatatataaaaagcaaagcaaaacagagtgctctgctttttgggttttggattttcgaaaccatcaaacacccaaaaaaggaccaaatcttgaatccgacacgcagattcaatcccagcttatcctcaaatcaaaacccaccaaattcttcaagttttcgaccaaacgggtcgccgaatcaaaacccaggatccgaaattttggatggctagtctgtatgtaaaagctgtgccacctgcggatctgaataggaacacagagtggttcatgtaccctggtgtttggaccacctatatcctcatcctcttcttctcttggcttctcgtgctctcaatctttggctgctctcccggcatggcttggaccatagtcaatctctctcattttgcggtcacatatcacttcttccactggaagaaaggaactccctttgctgatgaccaggggatctacaatggactgacatggtgggagcagatggatagtggaaagcagctcactcgcaacaggaagttcttaaccgttgttcctgtggtgctgtacttgatagcttcgcacacaactgactaccagcatccgatgctgtttttcaacagtcttgcagtcatcgtgctggtcatagcgaaattccccaacatgcacaaagtccggatctttggaatcaatggagataagtgagttgcgcttacatatgggttgacatgttcaaaagtcagaacattgttatcttattcagatggagagctatatcgttgtatagaagttggaactggagggatattagaaaatataatgttttttctttgtgcttacggcgtttcaaggtgcctcccagatgatgaaggaataattgtattatctttgtacagtagagaaatttttatgtatgtgggagagtcactgtgctatatgagcgtatcacatattttgtctgttttttcttcgtaacttacatctatttgataattttccatcctgaaaaca

SEQ ID NO: 2503 - DNA, 815 bp, Vaccinium corymbosum
aaagcccgaaacgccaaaaaagaagccaagacataaaccgaaaagcaaaatcgattcgccatcatcatcatcgtcagattcgacgggaagaaagatcgaagggaaaacagaagggtcgattgccaaagatggcgaatttgtacgtgaaggcggtaccaccgacggatctgaatcggaatacggagtggttcacgtacccaggggtttggaccacctacatcttgattctcttcttctcttggcttctcgtcctctccctcttcggttgctctccaggcatggcctggaccatcgtcaatttctcccatttcctcgtcacttaccactttttccattggaagaaaggaactccttttgctgatgaccaggggatctataatgggctgacttggtgggagcagatagacagtggaaagcagctcacccgcaacagaaagtttctgactgttgtgcctgtggtgctgtacttgatagcttcacacacaaccgactaccaacaccctatgctcttcttcaacactcttgcagtgtttgtgctagttgttgccaagttccccaatatgcacaaagtccgtatctttggtataaatggagatcagtgatttgggactacattatgatccttttgttctactgctgtaaaagccttgatcctttcttgatctagctagaacgttatatccttgtacagttatgagaactgcaaaaatttggaaatgtgaattttgtcattctgccgactatgtatcagaagtgtcacactcatgtaagcttatctgatacatacaaatcctattgcctctgtaaaacaattt

SEQ ID NO: 2504 - DNA, 1617 bp, Trifolium pratense
acacacacgcacattatcattgacataatattaaccagaaaaataaaataatcaaagggttacgttacgtttctgggttttggaattttcattcttcattcagaaaataaccctaattcaaacccatcaaaatcaacatcatcaagttgaaaactttttcatctgggatcaaaatatttgagtttctaatcaaaagggtatctttagatttttgaaattttgatggcaaatctgtatgtgaaagctgtacctccagcggatctgaacaggaacacggaatggtttacgtatcctggtgtttggactacctatattctcatccttttcttcacatggatccttgttctatctgtgtttggttgttctcctggaattgcttggacaattgttaatctcgctcattttcttgtaacgtatcactttttccactggaagaaaggaactccgtttgcagatgatcaggggatctacaatagattgacatggtgggagcaggttgacaatggaaagcagctcactcgtaacaggaagtttttgacagttgttcctttggttctgtacttgatagcctcacacacaaccgactatgagcatccaatgctgttcttcaacacggttgccgtgattgtactagttgttgcaaagttcccaaacatgcacaaggtcaggatattcggaatcaacgctgataagtgacaaactgaaaccgtttctttgtcgatgaaactttggttgttagtagctcatgagcctctcttcttccttctcttgttctggaaaaacaaggttgcaacctttgtatagaaaaggcagaactattgaaggatactcaaaatccatgttttgttgccaactgtttttattttattttattttattaagcttcttcatcatcatcttctaaggtattaaacaaacaaataaatatgttgagttattatttctgtacagtagagaaaaatacatgtaccagagattataacggtgctttaaaatttagtagtaagtacctttcttttatcaatgccttataaaactttatacaagaatcatccttttccttaacattaaattctatgagagtttaaggtgatatgattgggtagattgcttaatcaaactcttaatcaatgttgctatgattggcttgaaactactatgctatgtgttgtcaacttataggtaacataattgtcataaacagtttaaaaggttgtgaaaagactacatcttgaaagggaaagttgtttatttttgtgagaggaaaattaagaattgcatttaagtttagtcctttttcttattgattaatttcctgtatttattcctactatttatatcttagatagttcaaagattattctatactgtataaaactatgaaaatcttaaatgtattttaagtcccttttaactattgtgattgtatgatgttaaataaccttaaattagggtagagcattgagcaggttaaatcaggctcaaaatgtttcacccaaaagaaattgagtgtaaaattttagcctaactccgaccactttaaacttggttttgtcgggtgttggtttaagtcggtcacaagttggtcggttcaatttattcggattagcacataca

SEQ ID NO: 2505 - DNA, 1060 bp, Trifolium pratense
ctgggttttggaattttcattcttcattcagaaaataaccctaattcaaacccatcaaaatcaacatcatcaagttgaaaactttttcatctgggatcaaaatatttgagtttctaatcaaaagggtatctttagatttttgaaattttgatggcaaatctgtatgtgaaagctgtacctccagcggatctgaacaggaacacggaatggtttacgtatcctggtgtttggactacctatattctcatccttttcttcacatggatccttgttctatctgtgtttggttgttctcctggaattgcttggacaattgttaatctcgctcattttcttgtaacgtatcactttttccactggaagaaaggaactccgtttgcagatgatcaggggatctacaatagattgacatggtgggagcaggttgacaatggaaagcagctcactcgtaacaggaagtttttgacagttgttcctttggttctgtacttgatagcctcacacacaaccgactatgagcatccaatgctgttcttcaacacggttgccgtgattgtactagttgttgcaaagttcccaaacatgcacaaggtcaggatattcggaatcaacgctgataagtgacaaactgaaaccgtttctttgtcgatgaaactttggttgttagtagctcatgagcctctcttcttccttctcttgttctggaaaaacaaggttgcaacctttgtatagaaaaggcagaactattgaaggatactcaaaatccatgttttgttgccaactgtttttattttattttattttattaagcttcatcatcatcatcttctaaggtattaaacaaacaaataaatatgttgagttattatttctgtacagtagagaaaaatacatgtaccagagattataacggtgctttaaaatttagtagtaagtacctttcttttatcaatgccttagaaaactttatacaagaatcatccttttccttgacattaaattctatgagagtttaaggtgatatgattgggtagattgcttaatcaaactcttaaaaaaa

SEQ ID NO: 2506 - DNA, 1159 bp, Eucalyptus grandis
aggcggttgggatggtggggaatcataattatcatcagattcatcgccatcgtctccaccaccaccaccaccaccaccaccgaacccatcccatccatccaccctcctcttcgtccttccttgaattcccgatttcgttctgcagcaaccgaaagctctctcgaattacctccctcctcggccttccttcttcagcccgtccgttgctgtggcagctgcggggacaaccgaaacgagaagcttcttcttcttcttcttcttcttcgtgttccctcggtttatgccgtcggactgattcccggcgggccctgagagggtggatagcgctccgcgttgccggaagggcgatggcgaatttgtatgtgaaggcggtgccgccggcggatctgaaccggaacaccgagtggttcatgtaccctggagtgtggaccacctacattctcatcctcttcttctcctggctcctcgtcctctccctcaccgcctgctctcccggcatggcctggaccgtcgtcaacctctcccacttcctcgtcacttaccacttcttccattggaagaaaggaacccctttctcagaagatcaaggaatctacaatagcctgacatggtgggagcaaatggacaatgggaaacagctcacacggaacagaaagtttcttactgttgtaccggtggtgctttacttgatagcatctcacacaaccgactaccagaatcctatgctcttcctgaacacacttgctgtgatagtgctagttgttgccaaatttcctaatatgcacaaggtccgaatctttggaatcaatgcagacaaatgatcggactcccaaggacctttgagtatgatctaatgagaagtgggctgttggtctgcttcatctatgtataagtcagaccagtgtatgctcgaatagtgttatcgtgcggattgcttttgcaggctctgtcatataagtgtagcagtttacttatgtacagcaaagaaactccacctatccagataacagagcaagcacttgttgcttttgtcagtgtatagcgcatcgtcagtgttatatcagtacatccgttgctttttattatggtaaaatttctgtactcttttatgttctagatgacgactagaagtttctgccataaaaataagagtcacagg

SEQ ID NO: 2507 - DNA, 825 bp, Nicotiana tabacum
gtggataattatgaactagtccactgcttccaaattaatagtcgttccaataggagcaaagaagaagaagaaaactggtttggatttgatagaattagtgttaggattgagctgaagagaaaagggaaatggcaaatttgtatgtaaaagcagtgcctccggcggatctgaacagaaatacagactggttcatgtacccaggagtatggaccacctatatactcatcctcttcttctcatggcttcttgttctttccctttttggctgctctcctggcatcgcctggaccgtcgtcaatctcggtcactttcttgttacatatcacttctttcattggaagaaaggaaccccttttgctgatgaccagggaatgtacaatcaattgacctggtgggagcaaattgacaatgggaaacagctcactcgtaacaggaaattcttaactgttgtgcctgttgtgctgtatttgatagcctcacatacaactgattaccaacatccaatgctcttcttcaataccattgctgtgatggtgctggttattgccaagttccccaatatgcacaaggtccgaatcttcggaattaatgaggatccatgaatggttcttttttattttcagtttgttgtttttcaagatctaagctttctctcctctcctgcgtaaagctcgtctctgtatagaagtcaggacagcaaagagtactttgcttctttagtgctagtccttctctccctaatatactgcagcaataaatgtaacaagttttctgtacagtgtaattttaccttgtactgttacatgagaatactataattagtcc

SEQ ID NO: 2508 - DNA, 685 bp, Catharanthus roseus
cagaattcatcaagattgccgcaaaattagtgtttgaatggcgaatttgtacgtgaaggcgtctccgccgacggatctgaataggaataccgagtggttcacgtacccgggggtctggactacatatatactcatccttttcttctcctggctcatggtgctctccgtcttcggttgctctcctggcatggcctggaccgtggttcacctttctcatttccttgtcacatatcacttcttccattggaagaagggaacaccatttgctgaggaccaaggtatctacaataggttgacatggtgggagcaagtagataatgggaaacaactcactcgcaatagaaaatttctgacagttgttcctgttgtgctatatttaatagcttcacacacaacagactatcagcatcccactgctattcttcaacacagtggcagttttcgtactagtggttgccaagttcccccactatgcacaaggttcgcatttttgggattaatgcagatcagtgattggaggagaggagatccattaaaaagattgcataaaaaggttatatatcctttttattatatatttagacactcttttggtatttagtagtattagcaaaatgaacttgtacagagagagattttagaacttgcaagtgtatttttaattgattgaaaggggcaattctcc

SEQ ID NO: 2509 - DNA, 984 bp, Sarracenia psittacina
gaccacgcaacaatctacgattcacgagtatacattactacactacacacatatatatatatactacacacatagagagacaggggggattggaaaagaggaactggtggtggtgatcttcttgtctgtgaggagatacacagagaaatggcgaatttgtatgtgaaagcgattgccaccgacggatctgaatcgaaacacggagtggttcatgtaccccggggtgtggaccacctacatactcatcctattcttctcctggctcgtcgtcctctccgtattcggttgttcccctggcatggcctggaccatcgtccacctctctcattttctcgttacatatcacttctttcattggaagaaggggacgccatttgctgatgaccagggtatctacaataggttgacttggtgggagcaaatagataatggcaagcagcttactcgcaataggaagtttctcactgttgtacctgtggtgctgtacttgatagcctcacacacaactgactaccagcacccaatgctgttcttcaacacacttgctgtttttgtgttggtggtcgccaagttcccgcacatgcacaaggtccggatttttgggatcaatgcggatcagtgagcccaagtccaacaacaaaaagaaagaatgcactttccatcttattctagttacaatgttttgaagcactcaaatgtaatagtaatatccctgtacagaccttgatatactggaaagggtatgttatttttttcatcttttaagcaattttcttatctaaaaatgcagaagaggaaatgcatctatttgtataatactgtctttgcagaaactaaatttgctgatcactcacggctaaaaagtcaatttttgctcacggctaaaaagtcaatttttcctctacttgccgacaagctagaattgtgcctttgacttaccctataactcatcccttcgtactttaatcgttgaatagttagtta

SEQ ID NO: 2510 - DNA, 964 bp, Sarracenia psittacina
aagcgtcgatttgaaattgaatcgattgatcaacttccttatcgtttctaatctaaccctaatctcaaacaaaccaatccaatcttcgtcaaattcatcatcatcctcctcgccatcaaatcaaattcttgggggcagagacagatccgagaaaggatcataacgaaagaacgagagagaaagatctcctgtgggcttttcagttttggggaggtttcaaaaatggcgaatttatacgtgaaggcgacgccgccggtggatctgaaccggaacacggagtggttcacgtacccaggggtttggaccacctatatcttgatcctcttcttctcttggctgctcgtcctctccgtctttagatgcacacccggcatggcctggaccgtcgtcaatctctcccatttcgccgtcacttatcactttttccattggaagaaggaactccatttgcagatgaccaggggatctataacgcactgacttggtgggagcaaatcgacaatggaaagcagcttacccgcaacagaaagttcctaactgttgtacctgtggtgctgtacttgatagcctcgcacacaaccgactaccaacacccaatgctcttcttcaacactcttgctgtgatagtgctagttgttgccaagttccccaatatgcacaaggttcggatctttggaatcaatggagatcagtgagttgaccggtgtaaactgtaaaagccccgatccttcccttttgttctgccaatgtaatctccatgtgtagaaagctaaaattgtgtaaaggatatttcgatgaaatatttttgtgctcgaccttctttcagaagctgttttccctagatattggaggaataattgttgagttatttttgtacagtggtgctgcttacaaatgttattgtttctgtaattcccacggaacagatctctccttcggcccttggaaaagagttcatggcaag

SEQ ID NO: 2511 - DNA, 696 bp, Euphorbia peplus
aaaaaaacacacactactcaatttgggaataaatttcagctcaaccatcaaatttaaaaatcattgcttggaaatttgatttcaccagcttatctatcaaccataatcaataatcaccctagaaagaagaagagcttgcttaatccaaataacctgcgcataatttgaaaggattgataccaaaatcgaagagaggaggagataaaccatggcgagcctttatgtgaaggcagtgccgccggcggatctgaaccggaacacggagtggtttatgtatccaggtgtatggactacttatatactcatcttattcttctcttggctcgccgttctctctgtctctggttgctctcccggtatggcctggactatcgtcaatctcggccacttttgtgtgacctaccacttctttcactggaagaaaggaacaccattttctgaagaccaggggatctataatagactaacttggtgggaacagatagacaatggaaagcagcttacccgcaacagaaaatttctaactgtcgttcctgtttgctgtatttaatagcatctcacactacggattatcaacatccaatgttatttttgaacacacttgctgtggcagtgcttgttattgccaagtttccaaatatgcacaaagttcgtatctttggaatcaatgcagatgacaggtgaattttttttttt

SEQ ID NO: 2512 - DNA, 619 bp, Capsicum annuum
attctttgatgaacccaaaataaaaattagtaacaaaatttgatcaaatcactgttcaattgagctaaagagaaaaaggggaaatggcgaatttgtatgtaaaagcagtgccaccggcggatctgaatcggaacacagactggttcatgtaccctggtgtatggacaacctatatactcatccttttcttttcatggattcttgttctttccctttttggttgctcacctggcatggcgtggaccgttgttaatcttggtcactttctggtcacatatcacttcttccattggaagaaaggaactccatttgcagatgatcagggaatgtacaatcaattgacgtggtgggagcaaatagacaatgggaagcagctcactcgtaaccgaaaattcttaactgttgtgcctgtcgtcctgtacttgatagcctcacatacaactgattaccaacatccaatgctcttcttcaataccattgctgtgactgtgctggttattgccaagttcccgaatatgcacaaggtccgaatctttggaataacagcgatccgtaaatgtttctttttttgcgtccagtttgactgtttctcagagtttaagctttctcatcctcctgc

SEQ ID NO: 2513 - DNA, 1007 bp, Amsonia hubrichtii
gggcatttcgattaataaagtagtagcgaaacaatcaagacaagagcacaaatatcgactaacttcggcgacttgaagtcgatcaaatcagcttccacttcacaatttgggcgcaagaagattcagtgtttctaattagtcggagggaggtagctgattgcttatttgctgaagtgaatttgctgttaaattacacaatttgatcgggcctgccggaagagtatcagtttgtcggagcaaaggattatattaattttaaagaaaagaacaaggatggccaacttgtatgtaaaggcggtgcagccggcggatctcaatcggaacaccgagtggtttatgtacccgggagtgtggaccacctacatattgatcctattcttcgcgtggctgatcgttctctccctcttcggttgcactcccggcatggcctggacaatcgtcaatctttcccacttcgcagtaacatatcactttttccattggaagaaaggaacaccatttgctgatgatcagggcatatataatagattgacttggtgggagcagatagataatggaaagcagcttactaggaataggaagtttttgacagttgtcccggtggtcctgtacttgatagcttcacatacaacagactaccaaaacccgatgcttttcttcaacactcttgcagtgcttgtgctagtggttgctaagtttcccaatatgcacaaggttcgtatctttggaattaatggggatcagtgagctgtgacgtttgattaactgcttcgttttccttgaacatatgcccttgttcctcccgtttactgcaaaaaggttctcgctgtatagaaattagacaggacgttagcttatgtagcagttttatgctttgttttttaaaaggctcttgagattgaaggaataaatgtaacgagtaatctctgtacagtagaattttcttgtaagtcacgatcaatgttctattttcttttatcactattgctaatgctagcaatatttgt

SEQ ID NO: 2514 - DNA, 1122 bp, Phaseolus vulgaris
tgtaaaaatcaattttagcattgaatttcaattcctccacacgccatccaccatccttgatattttaatcagagagagagagggagagagaaggagaaggagaaggagaaaaagagagaaagaaagaaagaaagagaagagggtgtgtttctgggttttgaaattttgaggccccatcaatcaaagccccatcgaatcatccaagcatttgaaaggtggagacttttgcatctgggatcgtgtaattggggttttgcgtcagaagggtatctatcaatctatcttcggtttgatggcaaatctgtacgtgaaggcggtgccaccggcggatctgaacaggaacacggagtggttcacttaccctggcgtctggaccacctacatcctcatccttttcttttcttggatcctcgttctctccgtcttcggttgctcccctggcatcgcatggaccatcgttaatctcgtacattttgctgtaacatatcacttttttcactggaagaaaggaactccatttgcagaggaccaaggtatctacaatagattgacatggtgggagcaggtagacaatggaaagcagcttacccgtaacaggaagtttctaacggttgtccctttggtcttgtacttgatagcctcccacacaaccgactatcagaatccaatgctcttcttcaacactgttgcggtgattgtgcttgttgttgcaaagttcccccacatgcacaaggtgaggatatttggaatcaatgctgataagtgaaatgttgctgtgtccctgaaaacctggtctcctgctcaagagcctcttgtccttttgttctggaaaaaggtcacacctttgtatagaaggcagaagtggaaggatactcaagtaatgttttgttgccaactgctttttaagctgcttctaaagtattagtaaacaaataaatatgttgagttatttctgtacaatagagaagtatatgtatcggattataatggtgctttcaaaatgtacctttcttttattcatgcctccgaactcaaatatacaaaaatatgatcctttgcgttggtattcaagtttattgccataaccttttcttttggaaataaaggtcttactttataatc

SEQ ID NO: 2515 - DNA, 1224 bp, Cannabis sativa
aaatcaaataataataaaaaaacaaaatccaaaacagagaataaaaagagagagtgctctgttttttggggttttctttaaattttgcaatcgaattcgaaccaatcatctataattaaaaaaaattacaatttcattttattgagtattaaattggagctttgtcttagaaagaatctaatcttgggtgagaagggtcttttgaatttagacaaaaaggaaaattcgaatcttcaatggcgaaactctacgtgaaggcggtgccacccccggatctgaaccggaatactgagtggttcacgtacccaggtgtatggaccacttatatcctcatcctcttcttcgcttggcttattgttctctccatcatcggttgctctcctggcatggcttggaccattgtcaatctcggtcactttcttgtcacatatcacttttttcactggaagaaaggaactccgtttcctgatgaccaggggatctacaacggattgacttggtgggagcagatagataatggaaagcagctaacacgcaacaggaaatttttaacagttgttcccgtggtgttgtacctgattgcttcacacacaactgactatcaacatccaatgctcttcctcaacacgattgcggtggttatactagtcatagcaaagttccctaatatgcacaaggtccggatctttggaatcaatgcggataagtgagtttagctttgcataaaggcacactcctgtttgatttggttccatctttctttgattttggtagaaagttacaactttgtatagaagtttgaacatgaaggacatccacaaatatgtgctcttccttcttttcaagatatctccctagtgggtgaaagaataattgtatcgagttatcttttgtatagtagagaaattgtatgtgtttcttgagtatcaatgttattagaccctataatactctgtttatatataattatatatatattatctataccacaagaggtgctcactagtgtttgttatatttgctggtatttttaactttgtgccgttcttaacttatgtcagttttttctgggccagtctccctgacttggtctccggcttccaaattaacaaaactacatgacccaagacatatatatagacacaaaaatagggtccctttttcctttttgaaaagtaaaaaggagggggaatttgtagttaaaatatgcaaaattttatttta

SEQ ID NO: 2516 - DNA, 1082 bp, Vigna unguiculata
ggacacagaaacacacgccatccaccatccttgatattttaataaaagagagagagagaaagggagaaggagagagaaggagaaggagaaagagagagaaagagaagagggtgtgtttctgggttttgaaattttgaggccccatcaatcaaagccccatcaaatcgtccaagcgtttgaaaggtggaaacttttgcatctgggatcgtgtaattggggttttgcgtcaaaagggtatctatcaatctatctttggtttgatggcaaatctgtacgtgaaggcggtgccaccggcggatctgaacaggaacacggagtggttcacgtaccctggcgtctggaccacctacatcctcatccttttcttttcttggatcctcgttctctccgtcttcggttgctcccctggcatcgcatggaccatcgttaatctcgcacattttgctgtaacatatcacttttttcactggaagaaaggaactccatttgcagaggaccaaggcatctacaatagattgacatggtgggagcaggtagacaatggaaagcagcttactcgtaacaggaagtttctaacagttgttcctttggtcctgtacttgatagcatcccacacaaccgactatcagaatccaatgctgttcttcaacactgttgctgtgattgtgctggttgttgcaaagttcccccacatgcacaaggtgaggatttttggaatcaatgctgataagtgaaatgttgctgtgtccttgaaaacctggtcacctgctcaagagcctcttgtccttttgttctggaaaaaggtcacacctttgtatagaaggcagaagtggaaggatactcaagtaatgttctgttgccaactgctttttaacctgcttctaaagcattattaaacaaataaatatgttgagttatttctgtacagtagagaagtatatgtatcgaattataacggtgcttttaaaatgtacctttcttttcttgcctttttccttttattcatgcctccgaactcagatatacaagaatcatcctttgcattggtattcaagtttattgctataaaaaaaaaaaaaaaa

SEQ ID NO: 2517 - DNA, 1086 bp, Euonymus alatus
acatcagtcggcatcaatggcttctgtctggtattaaaatccaaatccatcacaaaaaaaaatccaaatccatcaaaagcatttatgatcactgttccaacaagaagcagatcgcactgaattcatcagacctcgattggataaaccagaacaaatcgattgaagaagaagaagacgaagaggaggattcgaagagaaataaatggcgagtctgtacgtgaaggcggtgccaccggcggatctaaaccggaacacggagtggttcatgtacccaggggtttggaccacatatatcctcatcctcttcttttcatggcttcttgttctatccgtcttcaactgctctcctggcatggcatggacaattgtcaatctcgctcacttcggcgtaacctatcacttcttccactggaagaaaggaactccgtttgctgaagaccaggggatttacaacaggctgacttggtgggagcaaatagacagtggaaaacaactaacacgtaacagaaaattcctaacagttgtacctatagtgctgtacttgatagcttcgcacacaactgattaccagcatccgatgctcttcttcaacactcttgcagtgctagtgctagttattgccaagctaccgaatatgcacaaggttcgaatctttggaatcaacgatgatcagtgagtttatccttgaaaacgccgagtttacaagcttaaaatgcgactgatcctacttttgtgcttgaggattgttttggctttgtagataagtcagcacctgaaggatgtctgttgtgcactgatgtgctgactgggtgcgcctcttctgtaatgaagtaaataagtgtattctgttgtctttgtatagtagaaagagtgacatatctggaattcacgatgctctatctttgagtgctacagtctctttgttctcgaacttgtttaagctgttaagaacaaagttgatattcaagtgtgtcctaaaacatgcaactctagtgcaattttggtagggtgtcaaaattctatccgatgattgatttgtccgatttgaattaattcaaagtttagaaacaacaaagttaataatag

SEQ ID NO: 2518 - DNA, 974 bp, Euonymus alatus
cacatcagtcgtcatcaatggcttctgtcaggtattaaaatccaaatccatcacacaaaaaaatccaaatccatcaaaatcatttatgatctctgttccaacaagaaatacagatcgcactaaattcatcagacctcgattggataaaccagaacaaatcgattgaaaaaagaagaagacgaaggggaggattcgaagagaaataaatggcgagtttgtacgtgaaggcggtgccaccggcggatctaaaccggaacacggagtggttcatgtacccaggggtttggaccacatatatcctcatcctcttcttttcatggcttcttgttctatccgtctttaactgctctcctggcatggcatggacaattgtcaatctcgctcacttcggcgtaacctatcacttcttccactggaagaaaggaactccgtttgctgaagaccaggggatttacaacaggctgacttggtgggagcaaatagacagtggaaaacagctaacacgtaacagaaaattcctaacagttgtacctatagtgctgtacttgatagcttcgcacacaactgattaccagcatccgatgctctttttcaacactcttgcagtgctagtgctagttattgccaagctaccgaatatgcacaaggttcgaatctttggaatcaacgatgatcagtgagtttatccttgaaaacgccgagtttatgagcttaaaatgcgactgatcctaacttttgtgcttgaggattggtttagctttgtagataagtcagcacctgaaggatgtctgttgtgcactgatgtgctgactgggtgcgcctcttctgtaatgaagtaaataagtgtattctgttgtctttgtatagtagaaagagtgacatatctggaatttcacgatgctctatctttgagtgctacagtctctttgttctcgaacttgtttaagctgttaagaacaaagttgatattcaag

SEQ ID NO: 2519 - DNA, 972 bp, Lupinus angustifolius
agacacaaatatatattatagagataaaatagagattcagaaagtttggtgtttttatttctgggtttcgaaattaataatcgtgagccaaccccataagatccacgatcatcaaaacacgaattcagagttaaagtttgaatctttagcataaaaaatcaaaaggggtgtgatggcaaatctatatgtgaaagcggtgccaccaccggatctgaataggaacacggagtggttcacataccctggtgtttggaccacttatattcttatcctcttcttctcatggatccttgttctctccgtctttggttgttcccctgggattgcatggaccaccgttaatctcgcccatttcgctgttacatatcactttttccactggaagaaaggaactccatttgcagatgaccaggggatctataatagattgacatggtgggagcagatagataatggaaagcaactcactcgtaataggaagtttctaaccgttgttcctttggtgctgtacttgatagcttctcacacaactgattatcaacatccaatgctcttctacaacacctttgcagtgattgtgcttgttgttgcaaagttccccaatatgcacaaggttcggatattcggaatcaatgctgataagtgaaatgtttttgtatctgtcaaacttatttacctgctcaagagcctcttgttctgagaaaaaatatgcacctttgtataggaaagtcagaacttttaaggatactgaagtaatgttttgttgacaactgttttttatgctgcttctaaggtattaaaccaataaatatgtcgagttgtttctgtacagtagagaattttatgtatcagattataagggtgctttaaaatgtaccttcttttcctatccggtttttattaatggtctaaaatatgtgccttagaacttatacaagaattaatggtctacaagaattatccctatgcttc

SEQ ID NO: 2520 - DNA, 1044 bp, Medicago truncatula
caatttcccaatttccttcacattttcacacagacacacacgcacgctaatatcattgaatccaaaatcaaaataagggttacgtttttgggttttggaattttcattcacaaacaaccctaaatcaaacccatcaaaatcaaattcatcaagtttcaatcttttctatctagatttattctattcaacgtttcaatcaaaagggtgtatttagattttccaaattttgcaaaatttgatggcaaatctctatgtcaaagctgtgccacctgcggatctgaacaggaacacagaatggtttacgtatcctggtgtttggacaacatatattctcatcctcttcttttcatggatcatggttttgtctgtctttggttgttctcctgggattgcttggactattgttaatctcgctcattttcttgtaacatatcactttttccactggaagaaaggaactccatttgcagatgatcaggggatctacaatagattgacatggtgggagcaggtcgacaatggaaagcagctcactcgtaacaggaagtttttgacagttgttcctttggttctgtacttgatagcctcacacacaactgactatgagcatccaatgctgttcttcaacacggttgccgtgattgtgctagttgttgcgaagttccccaacatgcacaaggttaggatattcggaatcaatgctgataagtgataaagtgtttgtttgtccatgaaactatggttgttagtagctcatgagcctctcttctttcttccttctcttgttctggaaaaaagatagcaacctttgtatagaaaaggcagaactgtggaaggaaactcaaaatcatgttttgttgccaattatttttttttcttttcttttcttctaagcttcttcttctaaggtgttaaacaaacaaataaatatctgagttattatttctgtacagtagagaaatacgtgtaccagagattataacggtgctttcaaatttagtagtaactagtaagttcctttctttcattaatgccttagaaaag

SEQ ID NO: 2521 - DNA, 980 bp, Arachis hypogaea
aacgcagacgccatctttgatatttagtatctcaaacacacacacgacacatagataaataagactaaaaataattttagcaaaataaaaagaactttcttattagtaacacaaagggaaaaagaaaaagaaaaaaaaagaaaagtctaattacgttctgggtttttgtatcaacaacaacccttcttctccaatcccccaaatcacaatccatcacaccccataatcaaaatccaccaaagcttgaagctttcagcatcgaaatccaaaagggtatcctcaaattcgtgactatttgatggcgaatctgtacgtgaaggcggtgccaccaccggatctgaacaggaacacggagtggttcacgtaccctggcgtctggacaacgtacatcttaatcctgttcttctcatggcttcttgttctctccgtctttggttgttcccctggcatggcttggaccaccgtcaatctcgctcatttcgctgtaacttatcacttttttcactggaagaaaggaactccattcgcagatgatcaggggatctacaataggctgacttggtgggagcagatagacaacggaaagcagctcactcgcaacaggaagtttctaactgttgttcctttggtgctgtacttgatagcctcgcatacaaccgattatcaaaatccgatgctcttcttcaataccgtggcagtgatggtcctagtgatcgcgaagttcccccatatgcacaaggtccggttattcggaatcaacgctgataaatgaaaaacaatcttttgtatccatgaaaacttggattttctgctcagaagagcctttctttgtccttctcttgttaaaaagggtttgcacttttgtataggagtcttctgaactggaaaataatgttccagtttatgttttgtttgccaactttgtcttttaagctactaataaatattatatatatatattgagtttcttcttgtacagt

SEQ ID NO: 2522 - DNA, 1050 bp, Cajanus cajan
gtcgcccccattttattaattatataatcattattttagcgagtaaatgagagtataattttagcttttttctttttaattttgattttggcatcacagaaggcctcagagagaaaggagagagagagagagagagagagagaaagaaaaggttgtgtttctgtctgggttttggaattttgagcccccatcaaagcccccatttgaaaggtggaagctttagcattcggatcgcgtaattggggttttgcacatcggtggtggttttgtttgtttggatggcgaatctgtacgtgaaggcggtgccaccggcggatctgaacaggaacacggagtggttcacttaccccggcgtttggaccacctacatcctcatccttttcttttcttggatcctcgttctctccgtcttcggttgttcccccggcatcgcttggaccatcgttaatctcgctcatttcgctgtaacatatcacttttttcactggaagaaaggaactccatttgcagaggaccaggggatctataatagattgacttggtgggagcaggttgacaatggaaagcagcttactcgtaacaggaagtttctaacagttgtccctttggtgctgtacttgatagcctcacacacaacagactatcagaatccaatgctgttcttcaacacagtggctgtgattgtgctggttgtggcaaagttcccccacatgcataaggtcaggatatttggaatcaatgctgataagtgaaatcatggttacctgctcaagagcctcttctcttgtccttttgttctggaaaaaaaaggtgtatagaaggcagaatcggaaggatactcaagtaatgttctgttgccaactgcttctaaagtattattaaacaaataataaatatgttgagttatttctgtacagtagagaagtatatgtatcggattataacggtgcttctaaaatgtacctctcttttcccctttatttcatccctcacaactcaaatatacaacaacgatgatcttttgcgtttgcattaaattttgttgccata

SEQ ID NO: 2523 - DNA, 972 bp, Rhizophora mangle
tcgggactagcagaatcgccatctccattaacgttgccatcaccgtcaccatcatcatcaccatcctggctcgttgaagattaaaatcatcaacataaacgaaatttaaaatttccatttcaatataaatagggaaaataaatttttcggttggttgcttaatttatcacatatataattgcgtacactttgagagagagagagagagagagagagagagagtttggggaagggtgagggaaggatggcgaatctatatgtgaaggaggtgccgccggctgatctgaatcggaacacggagtggttcatgtacccgggggtatggactacctacatacttatactgttcttcgcttggcttctcgtactttctgtctttggctgctcccccggcatggcctggaccattgtcaatctctcccattttgtcatcacttatcacttcttccactggaagaaaggaaccccatttgcagacgaccaaggtatctataatggactaacttggtgggagcagatggataatggaaagcagctcacacgcaatagaaagttcttaactgttgtacctgtggtgctgtacttaatagcctcacacacaactgactaccaacatccaatgctctttttcaacactcttgcggtgatggtgcttgttgttgccaagttcccaaatatgcacaaggttcggatctttggaattaatggagacaagtgagttgggcttatctttaaaatggtttgcttcaacagttttacaagccgctgatctttttgccattctgctttcaaaaattatatgtttgtatagaaattagaactggaactataattgaatgtgtaatgcttttagctgactgccaccagaagctgtctcttagacaatgaaggaataagtgtacaaattatgtctgtacagtaggaggctgtcactgcctttggattagcacacatgactagcttggcttattg

SEQ ID NO: 2524 - DNA, 1045 bp, Trigonella foenum-graecum
cacacacgcacgctatcatttgacacatatagcagaaagagaaaatcaaaatcaaaataagggtttttgcaattttcattcataaacaaccctaaatcaaacccaccaaaatcatcatcaccaagtttcaatcttttccatctagattcattctattcaacgttttaatcaaaagggtgtgtttagattttcgaaattttggaaaatttaatggcaaatctgtatgtgaaagctgtgccacctgcggatctgaacaggaacacagaatggtttacatatcctggtgtttggacaacatatatccttatcttgttcttctcatggatcatggttttgtctgtgtttggttgttctcctgggattgcttggactattgttaatctcgttcattttcttgtaacatatcactttttccactggaagaaaggaactccatttgcagatgatcagggaatctacaatagattgacatggtgggagcaggtcgacaatggaaagcagctcactcgtaataggaagtttttgacagttgttcctttggttctgtacttgatagcctcacacacaacggactacgaacatccaatgctgttcttcaacacggttgccgtgattgtgctagttgttgcaaagttccccaacatgcacaaggtcaggatattcggtatcaacgccgataagtgataaaatgaagtgtttatttgtccatgaaactatggttgttagtagctcatgagcctctcttctttcttccttctcttgttctggaaaaaagatagcaacctttgtatagaaaaggcagaactgttgaaggatggatactcaaaatcatcatgttttgttgccaactgttttcttttttctttttcttcttcttctaaggtattaagcaaacaaataaatatgttgagttattattatttctgtacagtagagaaatacgtgtaccagatattataacggtgctttaaaatttagtagtaagtacctttttttcattaatgccttagaaaactcttataaaagaattatcatttgccttagc

SEQ ID NO: 2525 - DNA, 952 bp, Valeriana officinalis
tccatcgccataattcttccatcctcaatccatccatccaatcctcaattccactcctccatcactatatctcaattccagattcacaaacctagctttcgatccacgcaatcaggtttgagagtgtatgaattgagattgattgaggtttgaggttgagctctaatggcgaatttgtatgtacaagcggttccaccgacggatctgaacaaaaacaccgagtggtttacgtatcctggcgtgtggacgacgtatatttcgattctgttcttcgcttggcttgttgttctctccgtttttggatgctctcctggcatggcctggactgttgttcatctcgctcattctctggtgacatatcagttctttcactggaaaaaaggaacaccgtttgctgatgatcagggaatctacaaccgattgacatggtgggaacaaattgacaacggaaaacaactcactcgcaacagaaagttcctcactgttgtaccagtcgtcttgtacttgatagcatcacacacaaccgattaccaacatccgatgctattcttcaacacactcgctgttttcgtgcttgttgttgcgaaattcccaaacatgcacaaggtccgcatttttggaatcaacgcagatcagtaattcaaatatcgtttcatcgctttcgaatcacgcagctaatactttgtagccaaaattttcgttttctttttaaaacttcttatgtacattgctagtaaatcgcgagcccggatattcgaacctcaaaagggtgttattgcttgtttcttttttcttgtttttcttctttggtctatcgatatccgggaagtgttttagattgtgataagtttatattggttgtatgttatctttctacgacaaggtgctaaattgaaccgaaaatactatatattaccataattctgaggggtcgtgaattctatgtaaaaaa

SEQ ID NO: 2526 - DNA, 717 bp, Euphorbia peplus
caaaaccctaatttcaaagtattggtaccaaaatcagaggaggtaataataaatggcgagtctttacgtgaaggcggtgccgccggcggatctgaaccggaatactgagtggttcatgtatccaggtgtatggactacttatatactcatcttattcttctgttggctcgtcgttctatccgtctccggttgctctcccgggacggcatggactgtcgtcaatctcggtcacttttgtgtcacctaccacttctttcactggaagaaaggaacgccattttctgaagaccaggggatctataatagactaacttggtgggaacagatagacagtggaaagcagcttactcgcaacagaaaatttctgactgttgttcctgttgtgctgtacttgatagcctcccacactacggattatcaacatccaatgctgttcttgaacacacttgctgtggcggtgcttgttatcgccaagttcccaaatatgcacaaggttcgcatctttggaatcaatgcagacgacaggtgaattcgtgcaaaacttcctaaaagcatctgctaatcccacccacctgcttaaagattatatatctgtattctgtatagaaatcacaacgggaacaaacatgtttgaaatatgtgtactatgctgtctagttttaacaagttcttttgttaatcaaataataagtgtatttgagttatttttgtacagcc

SEQ ID NO: 2527 - DNA, 965 bp, Sarracenia psittacina
cgtcgatttgaaattgaatagattgatcaacttccttatcgtttctaatctaaccctaatctcaaacaaaccaatccaatcttcgtcaaattcatcatcatcctcctcgccatcaaatcaaactcttgggggcagagacagaaccaagaaaggatcataacgaaagaacgagagagaaagatctcctgtgggcttttctagtttggggaaggtttaaaaaataggcgaattatacgtgaaggcgacgccgccggtggatctgaaccggaacacggagtggttcacgtacccaggggtttggaccacctatatcttgatcctcttcttctcttggctgctcgtcctctccgtctttagatgcacacccggcatggcctggaccgtcgtcaatctctcccatttcgccgtcacttatcactttttccattggaagaaaggaactccatttgcagatgaccaggggatctataatgcactgacttggtgggagcaaatcgacaatggaaagcagcttacccgcaatagaaagttcctaactgttgtacctgtggtgctgtacttgatagcctcgcacacaaccgactaccaacacccaatgctcttcttcaacactcttgctgtgatagtgctagttgttgccaagttccccaatatgcacaaggttcggatctttggaatcaatggagatcagtgagttgaccggtgtaaactgtaaaagccccgatccttcccttttgttctgccaatgtaatctccatgtgtagaaatctaaaattgtgtaaaggatatttcgatgaaatatttttgtgctcgagcttctttcagaagctgttttccctagatattggaggaataattgttttgagttatttttgtacagtggtgctgcttacaaatgttattgtttctgtaattcccacggaacagatctctccttcggcccttggaaaagagttcatggcaag

SEQ ID NO: 2528 - DNA, 1002 bp, Vicia sativa
cgcacgctatcattgacataacattaacaccaggtacacaaaaaaaagggttgcgtttctgggttttgcaattcccattcacaaatagccctaaatcatcgacccaccacaaccaccatcgtcaagctgtaaacttttcaatctgagatcattgaattcgtgatttcgatcgatatcgtgtatttacatttgtgaaatttgatggctaatctgtacgtgaaagctgtgccacctgcggatctgaacaggaacacggagtggtttacgtatccgggtgtttggactacttatattcttatcctgttctttacgtggatccttgtgctgtctgtgtttgggtgttcgcctggaatcgcgtggacgattgttaatctcgctcattttcttgtaacatatcactttttccactggaaaaaaggaactccgtttgcggatgatcaggggatctacaacagattaacatggtgggagcaggtcgacaatggacagcagctcactcgtaacaggaagtttttgacagttgttcctttggttctgtacttgatagcctcacacacaaccgactacgaacatccaatgctgctcttcaacacgattgctgtgatcgtgctagttgtcgcaaagttccctaacatgcacaaggtgaggatattcggaatcaatgctgataagtaatacaagtgtttctatgtatccatgaaactatggttgttagtagctcatgagccttctcttgttctggaaaaaaagctgcacctttgtatagaaaaggcagaactgtgggaaggatactcataaatcatgttttgttgccaactgtttaattttttatttgtaagcttcttcttttaaggtattattcaacaaacaaataaaatatgttgagtttattatttctgtccagtagagaaatacgtgtcccagatattataatggtgctttaaaattagtagtaagtccctttctttcattaaatgacttggaaaaaacttttttcccggg

SEQ ID NO: 2529 - DNA, 933 bp, Amsonia hubrichtii
tcttctacctttctatatatcaacacatttctttgaaactccgtttttgcatcggaatctagcttgttttgtgcatcaagattggatattttctgcctgaatatacagattggcttttcaattgatacagagggaaaagagggtctttctagaattcaagattgtgcaaaattagttgcagaatggcgagtttgtatgtgaaggcggttccgccgacggatctgaataggaatactgaatggttcacgtacccgggggtctggactacgtacatactcatccttttcttctcctggctcatggtgctctctgtctttggttgctctcctggcatggcctggaccgttgtccacctttcccatttccttgttacgtatcatttctttcattggaagaagggaacaccatttgctgaggaccaaggtatttacaataggttgacttggtgggaacaagtagacagtggcaaacaactcactcgcaatagaaagtttctaactgttgttcctgttgtgctgtacttaatagcatcacacaccactgattatcaacatcctatgctattcttcaacacagtggcagtttttatactggtggttgccaagttcccacatatgcacaaggttcgcatttttgggattaatgcagatcagtgattggagatccatttcaaaagtagcacaaaacgttacatatcaactacaatattttgactctctttttggcatttagtatatcagcaatgaacttgtacagattttagaacttgcaagtgtatgttacttgattcaagtatggggctttctctcagatatttaacgttccttctacggataattgtacaagcaaaattgccaaatttttataatagtcttgtttagtcttctatcttctgcattagcatcagcaggctgtttgtttcatatgaatgct

SEQ ID NO: 2530 - DNA, 1397 bp, Cicer arietinum
aaaagaaaaaataactatctcattcttttagatatatatgtaaaatttgtttccaacaaagatgcattcatttttttctctttaattttaatatttactacgaagcaaatcaattttaggcttagctatcattttcaatattgaatacgctatcattgacatattaaccaggtagaaagagaaaataaaaaaaaaaaaaaactaaaaagggttgcgtttctgggttttggaattttcattcagaaaattaaccctaaatcaaacccaccataatcaatatcatcaagttacaatcttttacatctaccatcattctattctggttttcaatcaaaagggtatttttagattctcgaaattttgatggcaaatctgtacgtgaaagctgtgccacctgcggatctgaacaggaacacagagtggttcacgtaccctggtgtttggacaacctatattctcatcttgttcttttcatggatccttgttctctctgtttttggttgttcacctggaatcgcttggaccatcgtcaatctcgctcatttccttgtaacatatcactttttccactggaagaaaggaactccatttgctgatgatcaggggatctacaacagattgacatggtgggagcaggttgacaatggaaagcagctcactcgtaacaggaagtttttgacggttgttcctttggttctgtacttgatagcctcacacacaactgactatgaacaccccatgctgttcttcaacacggtcgcagtgtttgttctagttgtcgcgaagttcccccacatgcacaaggtcaggatattcggtatcaacgctgataagtaataagtgttttatgtgtgtccatgaaacaaaactgtggttaagtagctcatgagcatctcttgttccttctattgttctggacaaaaaaaaaaggttgaacctttgtatagaaaggcagaactttggaaggatactcaaaatcaatcaatgttttgttgccaactgttttttcttaagcttcttattctaaggtattgaaacaaataaatatgttgagttattatttctgtacagtagagaaaatacgtgtaccagagattatgacggtgcttttaaatgtagtaactagtaagtacctttctttctttaatgccttagaaaactcttatacaagaatgatcctttgcattagcgttaaattttattgttgaaagttatgttttttatttttccaatatagaaataaaactatctaattcattagaagcatgagttagctgatatgatcggtaattgaaaattgtccaaaactttttatattggtaatgtcatttctctgaagtagaagtttatgatcctctttgttgtaatgtttgtaatgagtgcttcaaaattcagca

SEQ ID NO: 2531 - DNA, 913 bp, Humulus lupulus
ggaagaatctaatcttgggcgagaaggctcctttttgaatttagaagaagaaaattcgaatcttcaatggcgaatctctacgtgaaggcggtgccacccccggatctgaaccggaatacggagtggttcacgtacccaggtgtatggacctcttatatcctcatcctcttcttcgcctggcttattgttctctccatcatcggctgctctcctggcatggcttggaccattgtcaatcttggtcacttccttgtcacatatcacttttttcactggaagaaaggaactccgtttcctgatgaccaggggatttacaatggattgacttggtgggagcaaatagatagtggaaagcagctcacacgcaacaggaagtttttaactgttgtccctgtggtgttgtacctgattgcttcacacacaacagactatcaacatccaatgctcttcctcaacaccattgcggtggttatactagtcatagcaaagttccctaatatgcacaaggttcggatctttggaatcaatgcagataagtgagtttagcttgcacaaggcataaatactctgtttgattgtggttctatctttctttggttctggtagaagaatatccacaactttgtatagaagtttgaacatgaaggatatccacaaacatgtactcttccttcttttcaagatatatctccctagttgatgaaagaataattgtatcgaattatcttttgtacagtagagaagttatatgtttcttgagtatcaatgttattagaccctatatatatagtctgtttatatctattatctctactacataaacctcaagagttgctcactaatgtttgacttagttttatggctttcttttgtattaaaagaagattgtggctgtacctggatactgtctctt

SEQ ID NO: 2532 - DNA, 1016 bp, Lupinus angustifolius
atgttatataatataaaacatgcagagatagaaagagagaaaagcattcagaaaatttggtgttttttgttgtttctgggtttggaaaataacaatctttaccgaactccataagatccacgaccactaaaacacgaatccggtttcaaagttagaatctttagcataaaaaatcaaaaggggtgatggcaaatctgtatgtgaaagcggtgccaccaccagatcttaacaggaacacagaatggttcacataccctggtgtttggaccacttacatccttattctcttcttctcatggatccttgttctatccgtctttggttgttcccccgggattgcttggaccaccgtcaatgtcgcccatttcgctgttacctatcactttttccactggaagaaaggaactccatttgcagatgaccaggggatgtataatagattgacatggtgggagcagatagataatggaaagcagctcacccgtaacaggaagtttctaacggttgttcctttggtgctgtacttgatagcttctcacacaactgattaccaacatccaatgctcttattcaacacccttgcagtgattgtgcttgttgttgctaagttccccaacatgcacaaggtccggatattcggaatcaatgctgataagtgaaatgtttttgtatccatgaaacttatttccttgcttaagaccctcttgtcctttcttgttctgaaaaaagaaaaaaagatgcacctttgtatagaaaagtcagaacttgaaggatacccaagttatgttttgttgccaaatgttttttttatgctgtttctaaggtattaatctaataaatatgttgagttgtttctttaagagaattttatgtatcggattataaggtgctttaagatgtaccttcttttcctatctggttttattaatgccttagaactgatacaagaattgtgctaatgtttcaatatgttgtgttaagtcattttgtttagatcaattacagaagttctctct

SEQ ID NO: 2533 - DNA, 1048 bp, Tropaeolum majus
atggtggttcagataagatgcttatcatctaggtaatcaatgtcttaattacctaaaatcttcaatctttcacttgctgagaaatacgatctcgcgaaggaggagaggaaaaatcataatcaatttcactgtctaatcatcatcaccaaaaaacatcgcccaaatcaaagattgatacccgagagaacgaacttgttggcgtgattaatcgaaaaaaagagagaaacacgaagtgggtcagcaaaaaaaatggcgaatctgtacgtgaaggcggtgcaaccggtggatctgaacaagaacactgagtggttcatgtatccaggtgtatggacaacctatatactcatactattattcgcatggctacttgttctctccgttttcggttgctctcctggaatggcctggacccttgtcaatctcggtcacttccttgtaacttatcacttctttcactggaagaaaggaaccccgttcgcagacgatcagggaatctataataggttgacttggtgggagcagatagatagcggaaagcagctaacacgcaacagaaagtttctcacagttgtacctttggtgctgtacctgatagcttcacatacaaccgattaccaacatccaatgcttctgttcaacacactcgcagtcattgtgctcgttgttgctaagtttcctaacatgcacaaagttcgtatcttcggaatcaatggagacacgtgaaagattattctaggggtctcagcatggttttgatcgagcaaaaaacgatgtttcattttctctcttatgcttttatatatatataggtgttgtgtttcttgtataggaaccagaagtagaagtatgtatatgtatatgtatgtatacatacttttatatctgtaatgtttttaatgcatactgtttatatgagaattatatttagcgaatgaaaaagcgtattcttgtatctcgagtttttcgtttcgtgtacagtagaaattttatgtatgttagaacaagttatttgtttcgtcggttttcggaatgaaggagtgatgtttct

SEQ ID NO: 2534 - DNA, 942 bp, Olea europaea
agggcacacgcaattatcattgccttctgtttcgaatctactccaattccatttccatttccatttcgtttaatccacaagattaattatcacacgatatcaattttggaagggggaaagaaaggagagcgtgaaattagtaatcggattaaaaatttctagaggaacgtgatttgtgatggcgaatttgtatgttcaggcggtgccgccgacggatatgaatcggaatacggagtggttcacgtaccccggtgtgtggaccacctacatcctaatattgttcttctcgtggctggttgtgctttccgtttttggttgttcccctggcatggcatggacaattgttcatctctcccatttcctcgttacttatcactgctttcactggaagaagggaacaccgttttcagaagaccagggcatctacaataggttgacttggtgggagcaaatagacaatggcaagcagcttactcgcaataggaagtttttgacagttgtgcctgtggtgctgtacttgatagcctcgcacacaacagactatcaacatcctatgctcttcttcaacacactagctgtttttattctggtagttgccaagttcccaaatatgcacaaggttcgcatctttggaattaatgccgatcaatgagctgagatccattagtgcaggtttaccactggtattggcattaatttacagcattttattatattggaaatactgcaacgctggaacaggcaaccgaaccatacatctttgtgaaatactaagctctacagatgttggaagttcttgacttcttgtatgaactttttacaagttgaatttataaattcgcatgagctatatttcttttccttgaagttgcagaaaagtatttcgtattgttctgatgaagttggtcaactaaacatgcttaatcagggtgaatatatctt

SEQ ID NO: 2535 - DNA, 1110 bp, Chenopodium quinoa
atcatttttatttatgtgggaaggtgtaaattagagaaaaagatcatcaaaaatgcacgtttccaggaattaatccacccactcatcatcaaatcaatttaagagaggagagagaaactcataaattctccaaattaatcaattctatcaaatcaaatcaatttctttttttaaacctaattcaatccaatcaaattcaattctattgaagtccaatcaaatcaatttcgaagaagttttggaggttttacagagtaagcttgtacaacaatggcgaatttgtatgtgaaagcttcgccacctgcggatctgaataggaacacagagtggtttacatatcctggagtttggacaacatacatcttgttcctcttcttttcatggcttcttgttctttctgtctttggttgttctcctggcatggcttggaccgtcgtcaatctcgctcactttcttgtcacatatcatttctttcactggaagaaaggtaccccattctctgatgatcagggaatatataatcgtttgacttggtgggaacaagttgacaatgggaagcagcttacacgtaacaggaaatttttgaccgttgtgcctgttgtgctgtacctgatagcctcacatacaacagattaccagcacccaatgcttttcttcaacaccattgcaatgatcatcttggttgtagccaaattcccacatatgcacaaggtccggatctttggtatcaatggtgaataataagggcatctaaggcagtcagctcgttttaacactcaaaggtgacttctgatcctttctccagctgccggaaggacactactgtataggaaaaccagaaaggaaaacggttatggatgatgtaatgcttttgtatcgcctaaacttctgcctctactctccaaagagatgatgaacaaataagtagatactatcttttgtacagaattgtcgcatgttcttttagattttctttttctgatatgagcatgattttggtttctcattgttatatgccataaacctttttattttgtaatggaagagacactgtttttactagtattctagtattgagcaaaaccaacgtattatcttcatatatctagc

SEQ ID NO: 2536 - DNA, 981 bp, Chenopodium quinoa
atcatttttatttatgtgggaaggtgtaaattagagaaaaagatcatcaaaaatgcatgtttccaggaattaatccacccactcatcatcaaatcaatttaagagaggagagagagaaactcacaaattttccaaattaatcaattcaatttctttctttctaaacctaattcaatccaatcaaattcaatccaattgaagtccaatcaaatcaattgaactcaaatcaatttcgaagaagttttggaggttttacagagtaagcttgtacaacaatggcgaatttgtatgtgaaagcttcgccacctgcggatctgaataggaacacagagtggtttacatatcctggagtttggacaacatacatcttgttcctcttcttttcatggcttctcgttctttctgtctttggttgttctcctggcatggcttggaccgtcgtcaatctcgctcactttcttgtcacatatcatttctttcactggaagaaaggtaccccattctctgatgatcagggaatatataatcgtttgacttggtgggaacaagttgacaatgggaagcagcttacacgtaacaggaaattcctgactgttgtgcctgttgtgctgtacctgatagcctcacatacaacagattaccagcacccaatgcttttcttcaacaccattgcaatgatcatcttggttgtagccaaatttccacatatgcataaggtccggatctttggtatcaatggtgaataataaggcatctaaggcagtcagctcgttttaacattcaaaggtgacttctgatcctttctccagctgccggaaggacactactgtataggaaaaccagaaaggaaaacgattatggatgatgtaatgcttttgtatcgcctaaacttctgcctctactctccaaagagatgatgaacaaataaatagatactatcttttgtacagaattgtcgcatgttcttttagattttctttt

SEQ ID NO: 2537 - DNA, 921 bp, Malus domestica
ttttcgaaaccatcaagcacccaaaaaacgaccaaatttcaatccaatacgcagattcaaatccagcttatccccaaatcaaaacccaccaaattccacaagttttaggccaaaagggtcgccgaatcaaaacccagaatccgaaattttggatggcgagtctgtatgtgaaagctgtgccaccagcggatctgaataggaacacagagtggttcatgtaccctggtgtttggaccacctatatcctcatcctcttcttctcttggcttctcgtgctctcaatctttggctgctctcccggcatggcttggaccatagtcaatctctctcattttgcgatcacatatcacttcttccattggaagaaaggaactccctttgctgaagaccaggggatctacaatggactgacatggtgggagcagatggatagtggaaagcagctcactcgcaacaggaagttcttaaccgttgttcctgtggtgctgtacttgatagcctcacacacaactgactaccagcatccgatgctgtttttcaacagtcttgcagtcatcgtgcttgtcattgcaaagtttcttaacatgcacaaagttcggatctttggtattaatggagaagataagtgagttgcgtttacatttgggttgacatgttcaaaggttagaacatcattattttattcggatgaagagctatatcgttgtatagaagttggaactggaggtatttagaaaatataatgttttttctctgtgcttacggcttttcaaggtgcttcccagatgatgaaagaatgattgtattatctttgtacagtagagaaattttatgttcgtggagtcaccgtgctatacgagtatatcacatattgactctgttttttacttcataacttccatctacttgataattttttca

SEQ ID NO: 2538 - DNA, 866 bp, Artemisia annua
aatggtatcaacgcagtactccgacgggggatataataataatcggataagtataatatagttttggttggttacccatttcacttgtcgtctctgtccaactttacgtgctaattatttccacctccctccctcctcctccaccgtcccacaatctccatcatcatcaaaatctttaaaaaaaaataataataataaaatggcaaagttatatgtacaagcggaaccaccaacagatctaaaccggaacacggaatggtttatgtatccaggcgtatggactacttatattcttatcttgttctttgcttggcttgttgttctttctgttactggttgttctcctggcatggcttggactgttgttaatctcggtcacgctcttgttacatatcacttttttcactggaagaagggaacaccttttgctgatgaccagggtatctacaacaggttgacttggtgggagcaaattgatagtggcaagcagctcacccgcaacaggaagtttcttactgtcgtacctgtagtgctgtacttgatagcatctcacacaaccgattatcaaaatccgatgctcttcttaaacacactcgcggtttttgtgctagtgattgccaaattcccacatatgcataaggtccggatttttggaatcaatgctgaagaataagtgaccagtcatgaagcaaatactagttaagttccatccatgaatatatgtgcatccttaattttgacatatcataacaattaaaggcacggaactggtaaaagggtatattatctttttatgttttcgtcccttttcccgttgtgttttgtgaatgatccaagaaatatgaaaaaggactcgacttaactca

SEQ ID NO: 2539 - DNA, 1152 bp, Coffea canephora
gaagccttacaattagggagccataacattcattacgtcaggcgcagaaaaagaagaaagggagaaagggagaaagcgagagaaggttaagatacccacaaatcagtttagagggtagatagctcatcctaaccatcctttcgttctaattctatagcttggattgattgcaagattagccataatatagtgggtcttagaagactaattatagcagtattaccccaaaagcgaaaattgatctgggttgccgggtctgagtaaagaagaagaaaaagaagaagaggaggggttggtttcgatggcgaagctatacgtgaaggcagtgccaccggcggatctgaaccggaatacggagtggttcacctacccgggtgtatggaccacctacatattgatcctattcttctcgtggctgctggttctctccatcttcggctgcactcctggcatggcttggactatcgtcaatctttcccacttcgtcgtcacctatcaattttttcactggaagaaaggaactccgtttgctgatgaccaggggatctataatgcattgacttggtgggagcagattgacaatggaaaacagctcactcggaataggaagttcctaacagttgtaccagttgtcctgtacttgatagcttcacacacaactgactaccagaatccaatgcttttcttcaacactgttgcagtgcttgtgctagtggttgccaagttccccaacatgcacaaggttcgtatatttggaatcaatggggagcagtgagatgggaaaacaaactaaaagaactgcttggattacactgaatataagcccgtgttccttcctcgtcctgcagaagggttcttgatgtacagaggtcagaactggaaaggatatcttgctcatgtagcattttttgtgtcttaaactgcttttgtatgcctttggagattgaagcaataaatgttgtatcgagtaatctctgtatagtagtagtgttattgtgatgtccaagagtacaatattttgtttgtatttcatatagttctcgcgataattatgtctctttcaatctctctgacttatagctggaaaatgaatggacaagcaagtgaaaatatgaatccttgctgggtccgacgtctgaggtaagacgaagg

SEQ ID NO: 2540 - DNA, 860 bp, Echinacea purpurea
tatgctttactttattgtcaaagtttgcgtgctaattattgtcatcatcaccaccgttaccagttaccatcatcatcaccatctcttccagtccacacaaccaccaccttccgacctacttcaccgtcatacttccaccgacctcaccggaacatcatcatcacacacaattctcccaaacaaactcgcacaaatggctaacttgtacgtccaagcggtgccaccaacagatctcaaccgaaacaccgagtggttcatgtatcccggcgtctggactacctacatactcatcctcttcttcgcttggctcgttgttctctccgtcaccggctgctctcctggcatggcttggaccaccgtcaatctcattcacgctctcgttacatatcacttctttcactggaagaagggaacaccttttgcggatgaccagggtatctacaacaggttgacttggtgggaacaaattgatagtggcaagcagctaactcgcaatagaaagtttcttacagtcgttcccgtagtattgtacttgatagcatcccacacaaccgactatcaaaacccaatgctgttcttcaacacattagcggtttttgtgctagtgattgccaagttcccacacatgcataaggtccggattttcggaatcaacgctgaagaatgaaaagtgtcatgttcagttcagctcagctcagttccgttcagttccatccatgaatatatgtaagtcgttaatattgatacatcccgacagttaaagggtacggaactggtaaaagggtatattaacttttctttttctttgtcatttcttctttttcccttgtgttttgtggatgatccagaaaatataaaaa

SEQ ID NO: 2541 - DNA, 952 bp, Solanum melongena
attgcagagtggataattatgaacttgtctattacttggtcctccttccaataggaggaacccagaaaacaagaagaaaaactgagcctattgtggcatgaaccccaaatacaattgatagattttgatcgaattagtgttagattgagctaaaggaaaagggaaatggctaatttgtatgtaaaggcagtgcctccggcggatctgaaccggaacacagactggttcatgtatcctggagtatggaccacctatatactcatcctcttcttctcatggcttgttctcaccgcttttggctgctctcctggcatggcctggaccgtcgtcaatctctctcactttgttatcacatatcacttcttccattggaagaaaggaactccatttgcagatgatcagggaatctacaatcaattgacttggtgggagcaaatagacaatgggaagcagctcactcgcaacagaaaattcttgactgttgtgcctgtcgtgctgtacttaatagcctcacatacaactgattaccaacatccaatgctcttcttgaataccattgctgtgactgtgctggttattgccaagttccccaatatgcacaaggttcgaatcttcggaattaatgaggatccgtaaatggttctttcatttttgtttccagtttgtgtttctcaaaatctaagctttctcatcctcctgctgttctgcggaaagtttgtctctgtatagaagtcaggacaggaaagagtacttgctgctttagtgctaatgtcttttacaagtgcttctctagatagtgaagcaataaacgtaacaagttttctgtacagtgtaattttccttgtaaactttatatcagtactataattagttcaatctctgtgaactatactacaatatcaacatctttttttgagcttatgctggaaaatgtatggtctttgtttggtac

SEQ ID NO: 2542 - DNA, 946 bp, Fraxinus spp
aattccaattaattatcgattaatcaacaatattagttatcatacaaaacaattttggaaggggataaggaaggaggagcgtgaaattagtaattggatttaaaatttgaagtttttagaggaacgtgatttgagatggcgaatttgtatgttcaggcggagccgacgacggatctgaatcggaacacggagtggttcacgtaccccggtgtgtggaccacctacatcctaatattgttcttctcgtggctgattgtgctctccgttttcggctgttcccctggcatggcatggaccattgttcatatctcccatttcctcgttacttatcacttctttcactggaagaagggaacaccatttccagaggaccagggtgtctacaataggttgacttggtgggagcaaatagaaaatggcaagcagctgactcgtaataggaagtttttgacagtcgtacccgtggtgctgtacttaatagcctcacacacgacagattatcaacatcctatgctcttcttcaacacactagctgttttcgttctggtagttgccaagttcccacgtatgcacaaggttcgcatctttggaataaatgccgatcaatgagctgagatccatcagtccgggcttaccactgttactggcatttatatttgcagtattttggtgtatttggaatactgcaaaaagttggaacagggaaccgaactatacatcactttgtgaaatactaagatctacatcagatgtcggaaatccttgtatgtacgagttgaatttataaattcggattgtttttttcgtgctttaaatttgaaagtttgcaagaaagctaccggtttgtctgatggattgatggtagtgtaagggttgtaagagattgagccaaagcttcccgttcatatataaatctcatttgaacaaaaaaaaagaaaaaacaaac

SEQ ID NO: 2543 - DNA, 2153 bp, Actinidia deliciosa
tttcggcagctgcaaatggacctgattctggcaaagcaccgagtcttgtattcaagattacaagcaaagttccgtataagactgttcttaaagctcatagcgctgttttgttaaaggctgagagtatggcagacaaggttgagtggctaaacaagttcgggaatctgattcaaccttctaacggaggtcaactaaagggggattccagtcttccaatgcggcaaagtctttctgatggttctcttgatacaatgaccagaagacctgttgatccagaggaagaacttaggtggatgtcccaagaagtacgtggatatgttgaagctgttctgaacagccttgcagccaatgtcccaaaggcagtggttctttgccaagtggagaaagccaaggaagacatgcttaataagttgtacagttcagtcagtgctcaaagtacggcaaggattgaggagttgctccaggaggaccaaaatgtgaagcacagacgggaacgtattcagaaacaatcctctcttctttcaaagctcactaggcaactcagtattcatgacaatcgagctgctgcagcctccagcatgttggattctgaaagtagtccaagaaccagcggacccggtgatgattggagatccgcatttgatgctgctgccaatggtcccagtgactcatacagtgactcatctaggtatggatccaacggtcacagtcgtcggaacagtgaccccacccaaaacggtgatataagctcaagatcaaactccaacagccgccgcacccctaaccggttgcctccagcaccgcctggttcttcatacaagtattagataagttttcttgacggatccattaatgcattcttgttgggcgagtggttccttttggtccccattttgagccgttgttgagctcaaagcatgttatcatagcttttgtagaatggaaaatacgcgtctgtgtagatagattgcagttgattttgaggtgtacttgctatgtattcattgagattctctctcatatctctctttctctctctctctctctctctctctgtttgagcggctgccatctattttccaatctatggcgggggctatggatgtaattctatcaaacgccattagaaagacagaattatgaacaactgaaattgatatttttggcctttgttacttgcccttgttatgatgattgatgttatattactatctgccttgagagaggtttttgcgaatatggaagttggaaataaaaacctcgtgccgaattcggcacgaggctcccctctgaatatatcatcccgacttcttttctctctcttcacataaatcttccttcgttcgccattctagtaaacatacaatacagagccccgtctgccacaaaaacacacaagagagagagagagattgaagtggaggaattttggtctgaggattgaggtgccgtgtgtgtgtgtgagagagagagagagagacagacatggcgaatttgtatgtgagagcgattccaccgacggatctgaacaggaacacggagtggttcacgtatccaggggtttggagcacctacatactcatcctgttcttctcgtggcttgtcgtcctctccgtcttcggttgctcccctggcatggcctggaccatcgtccatctctctcactttctcgttacatatcagttctttcattggaagaaggggacaccatttgccgatgatcagggtatctacaataggttgacttggtgggagcaaattgagaatgggaagcagcttactcgtaatagaaagtttctcactgttgtacccgttgtcctgtatttgatagcctcccacacgaccgactaccaacacccaatgctcttcttcaacacactcgcagtttttgtgttggtggttgccaagttcccgcacatgcacaaggtccgtatttttggaatcaatgccgatcagtgagccacgctcctcttccatgttactctagtttcaatgcttttgatcaatccggcttttgagtgtgatggtaatatccctgtacagacgttgatccaggaaagggtatattgtttttcgtataagaaaataaaaattttctcttggtggtaatgatatttattccaagtcagattccaaaaaagctaaaaaaaaaa

SEQ ID NO: 2544 - DNA, 892 bp, Olea europaea
aacagggaggcaaatatacacccaaatatcattgtccttttttctgcctccaactaaattccaacaacaattaattatagattaatccaaaatattagttattatacaaaaacaattttggaaggtgataaggaaggagcgtgaaattagtaattggatttaaaagttttagaggaacgtgatttgagatggcaaaattgtatgttcaggcggtgccgccgacggatctgaatcggaacacggagtggttcacgtaccccggtgtgtggaccacctacatcctaatattgttcttctcgtggttgattgtgctctctgttttcggttgttcccctggcatggcgtggacaattgttcatctctcccatttcctcgttacttatcacttctttcactggaagaagggaacaccattttcagaagatcagggtatctacaataggttgacttggtgggagcaaatagaaaatggcaagcagctgactcgtaataggaagtttttgacagtcgtacctgtggtgctgtacttaatagcctctcacacaacggattatcaacatcctatgctcttcttcaacacgctagctgttttcattctggtagttgccaagttcccacatatgcacaaggttcgcatctttggcattaatgccgatcaatgagctgagatccattcagtccaggcttaccactgttattggcattaatatttgcagcattttggtgtgtttgcaatactgctacgttggaacagggaaccgaactatacatcactctgtacaagttgaacttataaattcgaatgttttttcttactttgtgaaagttgcagaaagaaagtaatccctttttgttctgatggagttgatgctataaatgtcattttctatat

SEQ ID NO: 2545 - DNA, 930 bp, Populus trichocarpa
aatcttcataattatcaacaaccaaccaaaccgagagagagagagagagagagcgctgttgttcaatcaccaaaccacaatacttgattgaaacgaaacgaaaagaaggaaaaattcattgaaagaaagaaagaaagagaaaagatagagatggcgaatctgtacgtgacggcggtgccaccggcggatctgaacaggaacacggagtggttcatgtatccaggggtttggactacttacatattaatattgttcttttcttggcttattgttctctctatctttgcttgctctcctggcatggcttggaccatcgtcaatctctctcactttgccatcacttatcactttttccactggaagaaaggaaccccatttgcagaagaccaggggatctataatcggctgacctggtgggagcagatggatagtggaaagcagctgacacggaacagaaagtttctaactgttgtacctctggtgctgtacttgatagcctcacacacaactgactatcgacatccaatgctctttttcaacactgttgctgtgatagtgcttgttgttgcgaagttcccaaatatgcacaaagttcgcatctttggaataaatgcagacaagtgagctgggcattgttaaaaagctgctttacttgtttaacgccaccaatccttctgcagttatgcttgaagattatcatatctttgtatagatgttaggactggaaggatatttgaatatgtaatgtttttttttgtgctgactgcttttgacaagttgctccttagatgaaggaataactatattcgttgtacagttgagaaatgttgtgtatctttggcgtatcacacggtgcattttcgcagcattacaacttccataactacgagtgattatatttcattttttggcttgtagccttaccgttga

SEQ ID NO: 2546 - DNA, 922 bp, Populus trichocarpa
aataatttaaaatacaatcactgtgctaccaaactggttgtaaatcataaaagtacttgatatagaaacgaaaagaaaagacattgaaagagacagcgagagggaaatggcgaatttgtatgtgacggcggtgccaacggcggatctgaacaggaacacggagtggttcatgtatccaggggtttggaccacttacatattaatattgttctttttttggctcattgttcttgctatctttggttgctctcctggcttggcctggaccatcgtcaatctctctcacttcgctatcacttatcactttttccactggaagaaaggaaccccatttgctgaagaccaggggatctataatcggctgacctggtgggaacagatagataaagggaagcagcttacacgcaacagaaagtttctaactgttgtacctgtggtgctgtacttgatagcctcacacaccactgactatcaacatccaatgctcattttcaacactcttgctgtgatggtgcttgttgttgccaagttcccgaatatgcacaaggttcggatctttggaataaatgcagacaagtaagttgggcatgtgttaaaagagtggtcgtttttcgtgtttaaaagcctccaatccttctgcagttctgcataaaggttatcatatctttgtatagaagtcggaacttgaaggatatttgaatatgtgtaacgttcttgcactggctactgtttacaacctgttcctcaagtgaaggataaaggtatcgagttagaaaaggatgtctgtcgagctaatctctgtacagttgagaaatgtcgtgtatctttggcgtatcacacagctgttatcagcgtatggcgcattttcacagcactgtaactttggttaaattaaattaaattacttacttttaatttttaa

SEQ ID NO: 2547 - DNA, 1148 bp, Glycine max
attttgttccattgatcagtttccactatcattatttgcccattaaaaatcaatttttagctctcattttcatttttttgcaattcctccacacacaccatccaattcccgtctttgatattttaatcacagagagagaagagggtttgtttctgggttttggaaatttcagcccccatcaaagaagaagccccataatcttcgaatcgaaggcatttgattgaaaggtcgaaactttagcatctgggatcgcgcaattggggttttttttggttaaaagggtatcttcggaattcatggcaaaactgtacgtgaaggcggtgccaccggcggatctgaacaggaacacggagtggttcacgtaccctggcgtttggaccacttacatcctcatccttttcttttcttggatcctcgttctctccgtcttcggttgctcccccggcatcgcttggaccatcgttaatctcgcacactttgctgtaacatatcacttttttcactggaagaaaggaactccatttgcagaggaccaagggatctacaatagattgacttggtgggagcaggtagacaatggaaagcagcttactcgtaacaggaagtttctcacagttgttcctttggtgctgtacttgatagcctcacacacaacagactatcagaatccaatgctgctcttcaacactgttgcagtgattgtgctggttgttgcaaagttcccccacatgcacaaggtcaggatatttggaatcaatgctgataagtgacatgttgcatgtgtccgtgacacttggctaccaccaccacctacctgctcaagagcctcttgtccttttgttctggagaaaaggtcacacctttgtatagaaggcagaactggaaggatactcaagtaatgttttgttgccaactgcttctaaggtattattaaacaaataaatatgttgagtttttttctgtacagtggaaaagtatatgtatcggattatatcggtgcttttaaaatgtaccttttctagcctttttttccctttatttgatgccttagaactgagatatacaaggatgatcctttccgttaccattaaaattctattgggtataactttttcttttggaaataaaagtccttctttatataactc

SEQ ID NO: 2548 - DNA, 1233 bp, Glycine max
agcgccctctgaatatgtgtataagaggggcacttaggcttttattcgaagatattttgtccactttatcaatttctactatcattaattttcccatttaaaaattgaattttcagctctcatttacatttttttcaattcctccacacacgccatccaatttctgtctttgatatttttaattagagagagaaaaagaaaaagaaaaaacaaagagagaaagagagaagagagagggtgtgtttctgggttttggaaatttcagccaatatcgaaaaacaagaagccccatcaataataatcatcgaaggaatttgaaaggtcgaaacttgagcatctgggatcgcgaaattggggtttttggttaaaagggtattatcttcggaactgattgatggcaaacctgtacgtgaaggcggtgccaccggcggatctgaacaggaacacggagtggttcacgtaccctggcgtttggaccacatacatcctcatccttttcttttcttggatcctcgtactctccgtcttcggttgttcccctggcatcgcttggaccatcgttaatctcgcacactttgctgtaacatatcacttttttcactggaagaaaggaactccatttgcggaggaccaagggatctacaatagattgacttggtgggagcaggtagacaatggaaagcagcttactcggaacaggaagtttctcacagttgttcctttggtgctgtacttgatagcctcacacacaacagactatcagaatccaatgttcttattcaacactgttgcagtgattgtgctggttgttgcaaagttcccccacatgcacaaggtcaggatatttggaatcaatgctgataagtgaaatgttgctgtggccatgacacttggttaccactccttacctgctcaagagcctcttgtccttttgttctggaaaaaaaggtcacacctttgtatagaaggcagaactggaaggatactcaagtaatgttttgttgccaactgctttttaagctgcttctaaaagtattattaaacaaataaatatgttgagttatttctgtacagtagagaagtatatgtatcagattatatcggtgcttttaaaatgtacctttcttttctagtattttttcctttatttgatgctttagaactgagatatacaaggatgatcctttccgttggtattaactttttcttttggaaataatagtcctttttgat

SEQ ID NO: 2549 - DNA, 680 bp, Tabernaemontana elegans
tcctccccttttgcatcgtaatctagcttgttttgggaatcaaaattgaaatcttttctacccttatgtatagattggcatttcatttgatacagatataggggggaaagaaaggtcttttgagaattcaaaggttgcagaaacctagttgttgaaatggcgaatttgtacgtgaaggcggatccgccgaccgatctgaataggaataccgagtggttcacgtatccgggagtgtggactacatatatactcatccttttcttctcctggctcatggtgctctccgtcttcggctgctctcctggcatggcctggactgttgtccacctttcccatttccttgttacatatcacttctttcattggaagaaggggacaccatttgctgatgatcagggtatctacaataggctaacttggtgggagcaagtagacagtggcaaacaactcactcccaatagaaagtttctaactgttgttcctgttgtgctgtacttaatagcttcacacaccactgattatcaacatcccatgctattcttgaacacagtggcagtttttgtactggtggttgccaagttcccacatatgcacaaggttcgcatttttgggatcaatgcagatcaatgattggagatccattaaaaagtcgcaaaaagatatatagactacaatattct

SEQ ID NO: 2550 - DNA, 493 bp, Vinca minor
attggaatggcgagtttgtatgtgaaagcagttccaccgacggatctgaatagaaatacggagtggttcacgtatccaggggtttggactacatatatcctaatcgtattcttcgcatggcttatggttctctccgtctttggttgttctcctggaatggcctggaccgtcgtccacctcgcccatttccttattacatatcacttctttcactggaagaagggaacaccgtttgccgatgaccagggtatctacaataggttgacttggtgggagcaagtagacagtggcaaacaactcacccgcaatagaaagtttctaacagttgttcctgttgtgctgtacttaatagcttcacacaccaccgattatcaacatcccatgctcttcttcaacacggtggcagttttcgttctggtggttgccaagttcccccatatgcataaggttcgcatttttgggattaatgcggatcagtgattggagatccatt

SEQ ID NO: 2551 - DNA, 988 bp, Primula obconica
cttccttttaccttaacccaacatttatctttcccaactaaatatatttatatacacattaaagcttttttgagtcttaaaccaactcacaatcaaccaaaaaatcaaaacccaccagagatcaaatttgtataaacacaaaaaaaaataaaaaaaatggcgaaattgtacgtaaaggctgtgcagccggcggatctgaaccggaacacggagtggtttacatacccaggcgtttggacgacttatatattaattttatttttcgcatggcttattgttctttctctcttcggctgctcacctggcatggcttggtccatcgtcaatattggtcatttcgctgttacttatcactttttccattggaagaaaggaactccctttgctgatgaccagggaatgtacaatgctttgacttggtgggagcagattgacaatggaaagcagctcacacgtaacagaaaattcttaactgttgttccagtggtgttgtacttgatagcctcacacacgaccgattaccagcacccaatgctcttcttcaacacgttgtcagtgattgtgttggttattgccaagttcccaaatatgcacaaggtccggatctttggaatcaatggtgaagatcagtgatttgaatgtcatctcggagtatgggggtgaaaaacgtttatgcttatttaaaatgttatatccgtatataaaagccggaaggacccgaacggatcgttgagtaagttagtttttgtgctcgacttttctttgtcagaagtgagtttccttgaggaacaattgtaactatatgattgctttctgtacagcataaactttcaagtatttgaaatgagatactgttatgtactcttaattttatttatttatcttcctttggttgctatagagtctcatgaagagtcatattccaggtttggatgatttatgttgaaatgtacacccatttgctgcttaccagaataaataggtttgt

SEQ ID NO: 2552 - DNA, 888 bp, Amorphophallus konjac
cgtcttctcctctggctatctatatatggaactctgagtgctcttccccattgttcctcggtgcttggctcggaatagatcgagcgaacccatcagcgccgccgccgctctgtttctgtagatggcgaagctgtacgttgaggcgtcaccgccgccggatctgaacaagaacacggagtggttcatgtaccccggggtgtggacgacctacatcctcatcttgttcttcttctggctcatcgtcctctccgtcttcggctgcgcgcccggcatggcctggaccatcgtcaacctcttccactttgtggtgacttatcactttttccactggaaaagggaactccctttgctgaagaccagggtgtctataacgcattgacatggtgggaacagatagacaatggcaagcagttgacacgtaatagaaagtttttgactgttgtaccacttgtgctgtaccttatagcttcacacacaactgattaccagcatccaatgcttttcctaaacacccttgctgtcattgtgctggttgttgccaagttcccaaacatgcacaaggtccgcatctttggaatcaatgcagatcattgactagcatgcatggtgcttgaaagatgtattggctgatgacctttctcttatgtctggatcattatactactcagatggagatgaggggcaggctgttgagtagaactttgagtcccaatgtcatctgtcttgtgggtggttgctatatatgtacatggattttgaggtacctggagaactaggagagatgctgcttttgataggtgggaccatcgatgtagacttttcccactttcttgttcttgtaatcttgttactcgtataaaagaattaatatattttccgatcccattt

SEQ ID NO: 2553 - DNA, 759 bp, Guizotia abyssinica
ggttacatgtctattgttaagtttgctttctaattattatcaccaccaccatcaccaacaccaacaccaacaccccatcgccgctaacaattaccatcaccaaccaccaatccacacaccgaccatccacaaccaccttcacacacacctacttcacaatcacaaacacaccgaaccctagcaggaacacactacacaattcttctaaacgaactctcagaaatggccaacttgtatgtcaaagcggtgccaccgacggatctcaacagaaataccgagtggttcatgtatcccggcgtctggaccacctacatactcatcctgttcttcgcttggctcgtcgttctctccgtcaccggctgttctcccggcatggcttgaaccaccgtcaatctctgtcatgctctcattacatatcacttctttcactggaagaagggaacaccttttgctgaggaccaaggtatctacaacaggttgacttggtgggaacaaattgatagtggcaagcagctcactcgcaacaggaagtttcttactgttgtacctgtagtgctgtatttgatagcatcgcatacaacggactatcagaacccgatgctgttcttgaacacactggcggtttttgtgctagtgatcgctaagttcccgcacatgcataaggtccgaatatttggaattaatgctgaagagtgaaaaatatactgtttaaacacgggtactagttcacttcgctgaatatatgtgcatcgttaattt

SEQ ID NO: 2554 - DNA, 1026 bp, Chrysanthemum coronarium
ccaaccttaaccatttcacttgtcatcgtctaactttgcgtgctaattatttccacctccctccctccaccgtcacaatccccatcatcatcatcattacccaaacccacacacactaaaaacaccttcaattacacacacataaagaaaggaatggcgaagttatatgtacaagcggtacaaccaacggatctaaaccgaaacacggaatggtttatgtatccaggcgtatggactacttatattcttatcttgttctttgcgtggcttgttgtcctttctattactggctgctctcctggcatggcttggactgttgttaatctcggtcacgctctcgttacatatcactttttccactggaagaagggaacaccttttgctgatgaccagggtatctacaacaggttgacttggtgggagcaaattgatagtggcaagcagctcacccgcaacaggaagtttcttactgtcgtacctgtagtgctgtacttgatagcatctcacacaaccgattatcaatatccgatgctctttttaaacacgctcgctgtttttgtactagtgattgccaaattcccacatatgcataaggtccggatatttggaatcaatgcagaagaataagggaccagtcatgaagcagatactagttcagttccatccatgaatatatgtgcatccttaattttgacatatcataacaattaaaggcagggaactggtaaaacggtaaattatctttttctgtcttcgtcccttttcccgttgtgtattgtgaatgatccaagaaatatgaaaaaggaatcgacttaactcacctggacagtaaaaaggaatcttatgtttggtgcttgagctttgcatgtagacatgctacaaagcattaaatgtttaattttggtgtcggtaagctatgaatgttatctaaagaaccacaacgtgagtaggaacttgggtatgtacgaagtctatgctatatactttggtaatttagatgtaatcaatggtgaagcatataatcgc

SEQ ID NO: 2555 - DNA, 983 bp, Chrysanthemum coronarium
actttacgtgctaattatttccacctccctccaccgtcacaatctccatcatcattcatcatcattaaacaccaacacacactagaaacacctttaaaaaacacacacatggcgaagttatatgtacaagcggaacaaccaacagatctaaaccgaaacacggaatggtttatgtatccaggcgtatggactacttatattcttattttgttctttgcttggcttgttgtcttatctgttactggctgctctcctggcatggcttggactgttgttaatctcggtcacgctcttgttacatatcacttttttcactggaagaagggaacaccttttgctgatgaccagggtatctacaacaggttgacttggtgggagcaaattgatagtggcaagcagctcacccgcaacaggaagtttcttactgtcgtacctgtagtgctgtacttgatagcatctcacacaactgattatcaaaatccgatgctcttcttaaacacacttgcggtttttgtgctagtgattgccaaattcccacatatgcataaggtccggatttttggaatcaacgccgaagaataagtgaccagtcatgaagcagatactagttcagttccatccctgaatatatgtgcatccttaattttgacatatcataacaattaaaggcacggaactggtaaaagggtatattatctttttctgttttcgtcccttttcccgttgtgttttgtgaatgatccaagaaatatgaaaaaggactcaacttaactcacctggacagtaaaaaggaatcgtatgattggtgcttaagttttgcatgtagacatgctacaaagcattgaatgtttaattttggtgtcggtaagctacaaatgtgattcaaagaaccaaaacgtaagcatgaacttgggtatgtacgaagtctatgatatatactttgctaatttagatataatgaatggtgaagcatataaacactg

SEQ ID NO: 2556 - DNA, 832 bp, Arnica chamissonis
gacctcacagctacataatacgcgattctcctgaacgaactcccaaaatggccaacttgtatgtccgagcggagccgccgacggatctcaaccgaaataccgagtggtttatgtatcccggcgtctggaccacctacatactcatcctattcttcgcttggctcgttgttctctccgtcaccggctgttctcctggcatggcttggaccaccgtcaatctctgtcacgctctgattacatatcacttctttcactggaagaagggaacaccttttgctgatgaccagggtatctacaacaggttgacttggtgggagcaaattgatagtggcaagcagctaactcgcaataggaagtttcttactgtcgttcctgtagtgctgtacttgatggcatcccacacaaccgactatcaaaacccgatgctgttcttgaacacattggcggtttttgtgctcgtgattgccaagttcccaaacatgcataaggtccggattttcggaatcaacgctgaggagtgaaaagcttcctgttcagttcagttccgtccatgaatatatgtaagtcgttaattgtgatatatgtcacagttaaaaggtacggaactagtaaaagggtatattaacttctcttttattgtccgtcttttctccttttcccttttgttttgtggatgacccagaaaacataaaaaaaaaagaagaattttatggttggtgcatatttcttcgaagacgtatttttgagtgcatttgaagaaaattctcattgcagataacactcttaatatatgtatgttgaacatgattgctgaaagatgagtattttatct

SEQ ID NO: 2557 - DNA, 1243 bp, Beta vulgaris
taattagcaaaacaaaatatcaaggaagcaagctttatgtttgggggttaaataaagagaaaaaaaagatcatcaaaattgcatgaatccaggaaattgatccacccactcatcaaaaacccataacaaaaaggcaagtgacaggaaggagaggagagagagagaaatttctccgaaatcaattcaattcaattcaatcgttcgatcaattcaatattcttttctaggttttcctaaaacctaatttcatcaaatcaaaatttaaaagttgaagaaatcttgaggttttagagtgcgttcaacaatggcgaatttgtatgtgaaggcgtcaccaccgccggatctgaacagaaacacagagtggtttacatatccaggagtatggacgacatacatcttgttcctcttctttgcttggcttcttgttctttctgtctccggttgtactcctggcatggcttggaccatcgtcaacctcggtcactttgctgttacatatcatttttttcactggaagaaaggaaccccgttttctgatgatcagggaatatataatcgcttgacttggtgggagcaaattgataatgggaagcagcttacgcgtaataggaaatttttgactgttgtgcctgtggtgctgtatctcatagcttcacatacaacagattacgagcacccaatgcttttcttcaacacaattgcgatgatcatcttggtcatagccaaattccctcacatgcacaaggttcggatctttggtatcaatggtgatcagtaaggcagtgtagcagtctgctcgctataacacactccgagtcaaaggtgacttctgatccttttctccatcaactactggaactgtgaaggacattattgtataggaaaaccagaaaggaaaacggttatggatgatgtaatgctcttttgtatcaccaaaactctaagccttcgtgaaaaaaaaagatgttgaacaaacaaatagttcatcttttgtacagcaatatcgtatgttcttttaggtctttgttttctgaaatgagcatgattttggtgttccggtactatcttccctgaacctttttatttgtaatggaagagaaacttgtttaatagatttgtatacttgtattagtattggtttcatcaaaatcaacgcattagcttcaaatattgaaccccatgtcaaaattttcatatattggatttgtatttttaaaaacatattactaaaaaaaaaaaaaaa

SEQ ID NO: 2558 - DNA, 781 bp, Centaurea maculosa
ccatcgccgttaccaattgcaatcatcatcaccaaccataaccaacatctttcttcttcttccttccttcttcttctcttctagtccacacaaccaccacaaaccaccgtctacaaccaccaccattagcttcttcttcatcatcatcatcctcctttctacaatctacactgataataaggaataataataatggctaacttgtacgtccaggcggttccgccaacggatctcaaccggaataccgagtggttcatgtatccaggcgtctggaccacctacatactcatcctcttcttcgcttggctcgtcgttctctccatctccggctgttctcccggcatggcctggaccaccgtcaatctcggtcacgctctcgttacatatcacttctttcactggaagaagggaactccctttgctgatgaccagggaatctacaacaggctgacttggtgggagcaaattgatagtggcaaacagctcactcgcaacaggaagtttcttactgttgtacctgtggtgctgtacttgatagcatcccacacaacggactatcagaacccgatgctgttgttgaacacattggcggtttttgtactggtgatcgccaagttcccgcacatgcataaggtccgaattttcggaatcaatgctgaagagtgagggaggaagagatagtagttgagttccagttccatccatggatatatgtgttaattttgacatataacagacatttcaaaaaaagggtatattaactttcttttggggttatgtc

SEQ ID NO: 2559 - DNA, 706 bp, Centaurea maculosa
caatctacactgatacctaataataataatggctaacttgtacgtccaggcggttccacccacggatctcaaccggaataccgagtggtttatgtatccaggcgtatggaccacctacatactcatcctcttcttcgcttggctcgtcgttctctccatctctggttgttctcctggcatggcctggaccaccgtcaatctcggtcacgctctcgttacatatcacttctttcactggaagaagggaacaccctttgctgatgaccagggcatctacaacaggctgacttggtgggagcaaattgatagtggcaaacagctcactcgcaacaggaagtttcttactgttgtacctgtggtgctgtacttgatagcatcccacacaacggactatcagaacccgatgctgctgttgaacacattggcggtttttgtactggtgatcgccaagttcccgcacatgcataaggtccggattttcggaatcaatgctgaagagtgagggaggaattagtagttgagttccagttccatccatggatatatgtgttaattttgacatataacagacatttcaaaaaagggtatattaactttctttttggggggtatgtctctgcattcacgtcttttgtggatgagcccgaaacaggaagaagaaaaaaaaggaatcttgtgattggggttgtgtgctagaaaaaaaaaa

SEQ ID NO: 2560 - DNA, 703 bp, Cirsium arvense
ccacaaaccaccttccttccaccttcttcttcatcatcctcctcctttctacagtaagaacaacaaaggataataataataatggctaacttgtacgtccaggcggttccaccaacggatctcaaccggaataccgagtggtttatgtatccaggcgtatggaccacctacatactcatcctcttcttcgcttggctcgtcgttctctccatctccggctgttctcccggcatggcctggaccaccgtcaatctcggtcacgctctcgttacatatcacttctttcactggaagaagggaacaccctttgctgatgaccagggcatctacaacaggctgacttggtgggagcaaattgatagtggcaaacagctcacccgcaacaggaagtttcttactgttgtacctgtggtgctgtacttgatagcatcccacacaacggactatcagaacccgatgctgttgttgaacacattggcggtttttgtactggtgatcgccaagttcccgcacatgcataaggtccggattttcggaatcaatgctgaagagtgagggaggaattagtagttgagttccagttccatccatggatatatgtgttaattttgacatataacagacatttcaaaaagggtatattaactttctttttgggggttatgtctcttcattcatgtcttttgtggatgatcctgaaaca

SEQ ID NO: 2561 - DNA, 897 bp, Panax ginseng
acatacatagagcttctctttcgggtttgatgaaattacagttcttggggtctctaaataaagtttattgagatagtgaagttgattgctattccatttttccagctccaaagaaaatctatcttcgggagaaaagaagaagaaaaaagatggcgaattattacgtgaaggcgacgccgccgacggatctgaataagaacacggagtggttcacttatccaggtgtttggaccacctacatcttaatcctgttcttcgcctggctcgttgttctctccgtcttaaattgttctcctggaatggcttggaccatcgttcatctctcccacttcctgatcacttatcatttcttccactggaagaaaggaactccatttgctgacgaccaggggatctataatgggcttacttggtgggagcagattgacaatggacaacaactcacccgtaacagaaagtttttgactgttgtacctgttgttctatacttgatagcttcacacacgacagactatcaacacccaatgttgttcttgaatactcttgcggtgattgtacttgttatcgccaagttcccaaatatgcacaaggtccgtatcttcgggattaatggagatcagtgagatggctttatgaatttgttagcatgacttgtgcaaaaaaaaagaaggttaaatcattgtatagtagtcagaaatgaaaaagattttggatatgtaatgttctatggcttcttttctcaagctctcttacccctggatattgaaggaataaaagtcaagtttatttttgtatagcagaaaattcacgtatccagatggttactttagaattcaatgtcaaaacgatgtcaatatatgtggggggccagaacaggttactgtttggcaccatttt

SEQ ID NO: 2562 - DNA, 767 bp, Panax ginseng
gggtttgatgaaattacagttcttggggtctctaaataaagtttattgagatagtgaagttgattgctattccatttttccagctccaaagaaaatctatcttcgggagaaaagaagaagaaaaaagatggcgaattattacgtgaaggcgacgccgccgacggatctgaataagaacacggagtggttcacttatccaggtgtttggaccacctacatcttaatcctgttcttcgcctggctcgttgttctctccgtcttaaattgttctcctggaatggcttggaccatcgttcatctctcccacttcctgatcacttatcatttcttccactggaagaaaggaactccatttgctgacgaccaggggatctataatgggcttacttggtgggagcagattgacaatggacaacaactcacccgtaacagaaagtttttgactgttgtacctgttgttctatacttgatagcttcacacacgacagactatcaacacccaatgttgttcttgaatactcttgcggtgattgtacttgttatcgccaagttcccaaatatgcacaaggtccgtatcttcgggattaatggagatcagtgagatggctttatgaatttgttagcatgacttgtgcaaaaaaaagaaggttaaatcattgtatagtagtcagaaatgaaaaagattttggatatgtaatgttctatggcttcttttctcaagctctcttacccctggatattgaaggaataaaagtcaagtttatttt

SEQ ID NO: 2563 - DNA, 933 bp, Humulus lupulus
agcactgtcacgacacctcttctctccaaactactctctctctctctctctgatacgcaaaaccggtaacgataaaaactccattcgccataacccaatctctatctcctcgtaacccatcaatcttgaatcgtttcagctttgttttcgaatcaatcgataaaggaagtcgaagaagacgatgtacgtacaggcggtgccacccacggatctgaatcggaacacggagtggttcacgtaccctggggtttggaccacctacattctaatccttttcttctcatggctcaccgttctatctatattcggttgctcctccggcatggcctggaccatcgtccacctagcccattttctcgttacctaccacttctttcattggaaaaaggggaccccatttgctgatgatcaaggtatttacaatggattgacttggtgggaacagattgacaatggcaaacaactcacacgaaacagaaagtttctaactgttgtccctgttgtgctgtacttgatagcctctcacacaacagattatgaacaccctatgctcttcttcaatacactggcggttttcgtgttggtagtggccaagttcccaaacatgcacaaagttcgaatatttggaatcaatgctgatcattgatttgagttaatgacaagacagaattcaagcttggatttactctggtttcctggtctaatcattttgacctttccaatctctgtagagatgttgaaacttacttggaaagggagatatatcatgtctaatgaagtgagcttttcctcttttttaagcattagctgtaagttacacatggaaatattttcaatgcattttctggttatacgagctaatctcgaaaaatctcactcctctattcattgatatcatttttttacgtgatagaactcttttattattctctc

SEQ ID NO: 2564 - DNA, 603 bp, Ipomoea nil
gaatttaagaagttttacatattttgctcttcctgttcttttagaaaaccctattgaattaaatttgacagtatatgatccatcgattgattgaggtgcgagaaaaacgatggcgaatttgtacgtgaaggcggtgccgccggcggatatgaaccggaacaccgagtggtttacgtaccccggtgtgtggaccacctacatactcatcctcttcttctcctggctcgtcgttctctccgtcttcggctgcacccccggcacggcttggaccatagtcaatctctcccacttcgccatcacttatcatttctttcattggaagaaaggaaccccatttgctgatgaccagggaatgtacaatcggttgacttggtgggagcaaatagaccatggcaagcaactcactcgcaatagaaaattcctaacagttgtgcctgtggttttgtacttgatagcctcacatacaactgattacgaacatccaatgcttttcttcaatacacttgcggtactagttttagtgattgcgaagttccccaatatgcacaaagtccgaatctttggaatcaatggggatcagtgagttggttcctctgaaatctt

SEQ ID NO: 2565 - DNA, 674 bp, Nicotiana benthamiana
aattggaaattgtgaatggcgaatttgtatgtaacggcggtgccgacgacggatctgaatcgaaacacggagtggttcacgtatcccggtgtatggacaacttacatcttaattctattcttctcatggctcgttgttctctccatctttggttgctctcctggcatggcttggaccattgttcatctctctcattttctagtcacatatcaatgttttcactggaagaagggaacgccattttctgatgaccaaggtatctacaatagattgacttggtgggagcagatagataatgggaagcagcttactcgcaacaggaagtttctaacagttgtccctgtggtgctgtacttgatagcctctcatacaaccgattatcaacacccaatgttgttcttcaacacagtcgcagtttttatactggtggttgccaaatttccaaatatgcacaaggttcgtattttcgggatcaatgcagatcaatgaactgggtttaattgagcacatacaacagaaagaaatagtatttgacttacattagcatctcgagtaaactaagatgcccatgtacacggttttgaaagatttcaattcgatttttcgatttttggttttagaagtgtaataccagcatcatatagaaatatatttgttatggttctgttcttccc

SEQ ID NO: 2566 - DNA, 1225 bp, Elaeis guineensis
aagactccccggacttgaccgatcgatcgctctctctctctctccgtctctccctttctctctctctccgtctctttccttcgctccccttctttgaaattttctcctctcctccggtcctgcgctcgtgattccatctgttcttctgtaaaaccccaacgttgttctcctgttctcgatcgactgatcccaattccaatcccaataggaatcctcctctatttcggtttcttcttcttctcgatatatgtacgagtaggtggttgggatttgtatagatagaccgggagagatatcgaggaggggatggcgaagctctacgttcaggcggtgccgccggcggatctgaacaagaacacggagtggttcatgtatcccggggtgtggacgacctacatccttatcctcttcttctcgtggctcctcgtgctatcgatcttcggctgcacccccgggatggcctggaccatagtcaatctgttccactttgcgatcacctatcactttttccattggaagaagggaactccctttgctgatgatcagggtatttacaataccttgacatggtgggagcagatggacaatggcaagcagcttactcgtaatcggaagtttttgactgtcgtacctgtggttctgtacttgatagcctcacacacaactgattaccagcatccgatgcttttcctcaacacgcttgcagtgattgtgttggttgtcgccaaattgcccaacatgcacaaggtccgtatatttggaatcaatgcaggtaattgagtggtggtgctcgaaagatatcgcggtagatgcctttttgtcgattgcctggggctgaccctggactagcaagaaatcctcaagtctgttagcagatggtttgcaatttctgtagagaaagcacttggagatgctaaaattgtctgttatgctgtgtctgataaatgaaagctgcctgtagattatctttcatgttgcaatctgttttccataagaatcagtgtttggggtgtaatgtacagtttctctctttgggaaggacttggttgctatttgtcgtgctgcttctttttttcaatccacagccatttctgggcatttcacgtgatggaacaatagtggtgaaccttttctttcttgtttcttcttttgtcttgatttatagtgaatgatttgaaacagtatcttaaatcagcactgattggataacagacaaaaaaaaaaa

SEQ ID NO: 2567 - DNA, 721 bp, Elaeis guineensis
gagggggaatggcgaagctctacgtgcaggcggtgccgccggcggatctgaacaagaacacggagtggttcatgtatccgggggtgtggaccacttacatccttatcctcttcttctcctggctcctcgtactctctgtcttcggttgtacccctggaatggcgtggaccgttgtcaacctcttccatttcgctgttacttatctcttcttccactggaagaagggaactccttttgctgaagaccagggtatgtacaattctttgacttggtgggagcagatggacaatggcaagcaactgacacgtaacagaaaatttttgactgttgtacctgtggtcctgtacttgctagcctcccacacaactgattaccaaaatccaatgcttttcctcaatacacttgcagtaatggtgctggtagttgccaaattcccaaacatgcacaaagtccgcatctttggaatcaatgcagatcattgagcagcattgcacatgaaagatatcttacctgatatctcttttggttgataaaacgatccttgtacgatatattgtcagacagcatccagttctgcatcatcatagtaagtctcagtagatgttcttgttatccctgtacaaaattgtcagaaaataagaaattgtatttgtgctactcttaatatttttaagctatttgtagactctatgttatgtttcatccatctgattacgacaat

SEQ ID NO: 2568 - DNA, 805 bp, Solanum tuberosum
caaattgggcgacgaaagttccatattattatcttcctatacattggatctcactttcattgaattttgaagaatttattgtatggcaaattattatgtaacggcggttccgccgacggatctgaatcggaataccgagtggttcacgtatcccggtgtatggacgacctacatcctaattctattcttctcatggcttgttgttctctccgtatttggttgctctcctggcatggcttggaccatcgtccatctttctcattttctcgtcacatatcaatgttttcactggaagaagggaacaccatttgctgatgaccaaggtatctacaacaggttgacttggtgggagcagatagatagtgggaagcagcttacacgcaataggaagtttctaacagttgtccctgtggtgctctacttgatagcctcccatacaactgattatcaacaccccatgctgttcttcaacacaattgcagtttttgtactggtcgttgccaaatttcccaatatgcacaaggttcgtattttcgggataaatgcagatcaatgagcttgggttcaactcaatacataccacaggaagaaggaaaaaaaaaagtactaattgatttgcttttaagcatcatgagtaaaactgggatgtccctgtacagatgcaagaactggaaagggtatatcattattttgtaaaagaaatcaacatgttctctctttgtggatatttttttcttgtaaaaactgtttgtatgagaatgctggaatatcgattgagttatgatatttttcgtgttacaactca

SEQ ID NO: 2569 - DNA, 728 bp, Carthamus tinctorius
gcacaataacaaacgtctctttcttcttcttcttcttctcttcaagtccacacacccaccgtcttcaaccaccacaaaccaccttccttagcttcttcttcttcttcttcatcctcctcctcctcctctctacactgataataataaggaataataatggctaacttgtacgtccaggcggttccgcccacggatctcaaccggaataccgagtggtttatgtatccaggcgtctggaccacctacatactcatcctcttcttcgcttggctcgttgttctctccatctccggttgttctcctggcatggcctggaccaccgtcaatctcggtcacgctctcgttacatatcacttcttccactggaagaagggaacaccctttgctgatgaccagggcatctacaacaggctgacttggtgggagcaaattgatagtggcaaacagctcactcgcaacaggaagtttcttactgttgtacctgtggtgctgtacttgatagcatcccacacaacggactatcagaacccgatgctgctgttgaacacattggcggtttttgtactggtgatcgccaagttcccgcacatgcataaggtccggattttcggaatcaatgctgaagagtgagggattagtagttgagttccagttccatccatggatatatgtgttaattttgacatataacagacgtttcaaaaaaagggtatattaacttccaaaaa

SEQ ID NO: 2570 - DNA, 1312 bp, Sesamum indicum
caaactcaaagaccatccaccaacttgatcaaacaatcaaatttgccttccccttcggtcaaatggtttgacccttacatccccccacctcccttctctccgatcttctctatttatataaatacacgaatcagaaattacttgctataagcaatttttgttttatcgttcctgataggatcagaaaattcgtgaaataaagaaaaaatttgcgcctacttgatatatatcggagaaattcgaagagggacttgccggagatggcgaatttgtatgtgcgggcggtgatgccgacggatctgaatcggaacaccgagtggtttacgtacccaggtgtatggacaacctacatcctgatattgttcttctcgtggctggtggtgctctctgttttcggctgctctccaggcatagcgtggaccgtcgttcatctgtcgcattttgttgtaacctatcagttctttcattggaagaaggggacgccgtttgctgatgatcaaggtatctacaataggttgacttggtgggagcaaatagataatggcaagcaactcactcgtaacaggaagtttttgacagtcgttcctgtagtcctgtacttgatagcatcgcacacaactgactatcaacatcccatgctcttcttcaatacactagcagttttcattctggtggttgccaagttccctcatatgcacaaagttcgtatctttggaatcaatgccgatcaatgattcttggtccgttaatctcccaccgcacctttaccttcagttccaacgtctttggtcagtacagttgttgaaactgttgcagtggtgcagcttgggaagcggacggaagctggatattctctgtatgaactctctaaatcaatttctgttggttgcatgcgttataaaattttctttcactttatttcatagatacggaaacttaagtagctgcttttttcccccttatcaaggggattgctagtggagtggcttatctttgttgagttgattatgttcccattaagtttagggaattgtaagatacaggggacaatcttctttcttacctttataaattgtggtccaagagacttgggattcattttgatggcatttgtcgcactgatgttctcagaggccctacttgtttgagagaacattgcggtttatgaaattacacccgtaacaagtcaatctactgtattatatttcattgtcctgtgttccttcagtttgtgcaagtggtttattccgatcgatctgcgatgccatgttcgttctgctaaaatccaataacaaaaagacaccgtttttcc

SEQ ID NO: 2571 - DNA, 899 bp, Solanum phureja
tcctaccgaccaaacccactggctataggctcgtcgtttcatattcctttgataaaaaatatactttgaactccattttttttcatcttcagatcaaattgggcgacgaaagctccatattattatcttcctatacattggatctcactttcattgaattttgaagaatttattgtatggcaaattattatgtaacggcggttccgccgacggatctgaatcggaataccgagtggttcacgtatcccggtgtatggacgacctacatcctaattctattcttctcatggctcgttgttctctccgtatttggttgctctcctggcatggcttggaccatcgtccatctttctcattttctcgtcacatatcaatgttttcactggaagaagggaacaccatttgctgatgaccaaggtatctacaataggttgacttggtgggagcagatagatagtgggaagcagcttacacgcaataggaagtttctaacagttgtccctgtggtgctctacttgatagcctcccatacaactgattatcaacaccccatgctgttcttcaacacaatcgcagtttttgtactggtcgttgccaagtttcccaatatgcacaaggttcgtattttcgggataaatgcagatcaatgagcttgggttcaactgaatacataccacagaaagaagggaaaaaaaagtactaattgatttgcttttaagcatcatgagtaaaactgggatgtccctgtacagatgcaagaactggaaagggtatatcattattttgtaaaagaaatcaacatgttctctctttgtggatatttttttcttgtaaaaactgtttgtatgagaatgctggaatatcgattgagttatgatatttttcgtgttacaactcaa

SEQ ID NO: 2572 - DNA, 910 bp, Solanum lycopersicum
gcggaatagagcggtcctaacgatcgaacccaccggctataggctcgtcgtttcatattcctttgatcaataatatacttcgaacttcaatatttttcatcttcaaatcaaatttgggcgacgaaagctccattttttttaacatcttcctatacattggatcttactttcattgaattttcaagaatttattgtatggcaaattattatgtaacggcggttccgccgacggatctgaatcggaataccgagtggttcacgtatcccggtgtatggacgacctacatcctaattctattcttctcatggctcgttgttctctctgtatttggttgctctcctggcatggcttggaccatcgtccatctttctcattttctcgtcacatatcaatgttttcactggaagaagggaacaccatttgctgatgaccaaggtatctacaataggttgacttggtgggagcagatagatagtgggaagcagcttacacgcaataggaagtttctaacagttgtccctgtggtgctctacttgatagcctcccatacaactgattatcaacaccccatgctgttcttcaacactatcgcagtttttgtactggtcgttgccaaatttcccaatatgcacaaggttcgtattttcgggataaatgcagatcaatgaactttggttcaactgaacacataccacagaaagaaggaaaaagaaaagtagtcattgatttgcttttaagcatcatgagtaaaactgggatgtccctgtacagatgcaagaactggaaagggtttatcattattttgtaaaagaaatctctttgtggataatcttttcttgtaaaaactgtttgtatgagaatgctggaatatcgattgagttatgatatttttcacgttacaactcaata

SEQ ID NO: 2573 - DNA, 948 bp, Solanum lycopersicum
tgcagagtggataattatgaagtggcctattaacttccaaaaatattagtccttcttcctataggagcaaagcaacccagaaaaagtgagcaaatttttgcctgaaccccaattacaattgatagattttgattgaatcagtgtttgattgagataaagaaaaaaaaattatggctaatttgtatgtaaaggcagtgcctccggcggatctgaaccggaacacagactggtttatgtaccctggagtatggaccacctatatactcatcctcttcttctcatggcttgttctcaccgcttttggctgctctcctggcatggcttggaccgtcgtcaatctatcccactttattgtcacataccacttcttccattggaagaaaggaactccatttgcagatgatcaggggatgtacaatcaattgacttggtgggagcaaatagacaatgggaagcagctcactcgtaacagaaaattcttaaccgttgtgcctgtcgtgctgtacttgatagcctcacatacaactgattaccaacaaccaatgctcttcttcaataccattgctgtgactgtgctggttgttgccaaattccccaatatgcacaaggtccgaatcttcggaattaatggggatccgtaaatggttctttcttctttttttgtttccagtttgtgtttctcaaaatctaagctttgtcattctcctgctgttctgcgtaaagctcgtctctgtatagaagtcaggacaggaaagtgtacttgctgcgttagtgctaatgtcttttacaactgcttctctagatagtgaagcaataaaaatgtaacaagttttctgtacagtgtaattttccttgtaaactttatatgagtactataattagttcaatctctatgaactatatatactagcatttttttgagcttatgctggaaaatagacggtcttt

SEQ ID NO: 2574 - DNA, 1101 bp, Cajanus cajan
tttttggttatgataaagattaaaggacttttatttccataagaaaaagttatggcaacaaaatttaatgcaaacgcaaaagatcatcgttgttgtatatttgagttgtgagggatgaaataaaggggaaaagagaggtacattttagaagcaccgttataatccgatacatatacttctctactgtacagaaataactcaacatatttattatttgtttaataatactttagaagcagttggcaacagaacattacttgagtatccttccgattctgccttctatacacctttttttccagaacaaaaggacaagagaagaggctcttgagcaggtaaccatgatttcacttatcagcattgattccaaatatcctgaccttatgcatgtgggggaactttgccacaaccagcacaatcacagccactgtgttgaagaacagcattggattctgatagtctgttgtgtgtgaggctatcaaaacttacagcaccaaagggacaactgttagaaacttcctgttacgagtaagctgctttccattgtcaacctgctcccaccaagtcaatctattatagatcccctggtcctctgcaaatggagttcctttcttccagtgaaaaaagtgatatgaagatacagcgaaatgagcgagattaacgatggtccaagcgatgccgggggaacaaccgaagacggagagaacgaggatccaagaaaagaaaaggatgaggatgtaggtggtccaaacgccggggtaagtgaaccactccgtgttcctgttcagatccgccggtggcaccgccttcacgtacagattcgccatccaaacaaacaaaaccaccaccgatgtgcaaaaccccaattacgcgatccgaatgctaaagcttccacctttcaaatgggggctttgatgggggctcaaaattccaaaacccagacagaaacacaaccttttctttctctctctctctctctctctctctcctttctctctgaggccttctgtgatgccaaaatcaaaattaaaaagaaaaaagctaaaattatactctcatttactcgctaaaataatgattatataattaataaaatggggg

SEQ ID NO: 2575 - DNA, 993 bp, Cocos nucifera
ctccgtctcttttcttcgctccccttctttgaaattttctcccctcctccggtcctccgctcgcgattccatctgttctctataaaaacccaacgttgttctcgatcgactgatcccaatactaatcccaattggaatcctcctctgtttcggtttcgtcttcttctcgatatatgtacgagtgagtagtaggttgggatttgtcttgatagactggggagatatcgaggaggggatggcgaagctctacgttcaggcggtgcatccggcggatctgaacaagaacacggagtggttcatgtatcccggggtgtggacgacctacatccttatcctcttcttctcgtggctcctcgtgctatcgatcttcggctgcacccccgggatggcctggaccatagtcaacctgttccactttgcgatcacctatcactttttccattggaagaagggaactccctttgctgatgatcagggtatttacaatactttgacttggtgggagcagatggacaatggcaagcagcttacacgtaatcggaagtttttgactgttgtacctgtggttctgtacttgatagcctcacacacaaccgattaccagcatccgatgcttttcctcaacacgcttgcagtgatcgtgttggttgtggccaaattgcccaacatgcacaaggtccgtatatttggaatcaatgcaggtaattgagcggtggtgctcgaaagatatcacggtagacatctttttgtcgattggatggggctcagcttggactagcaagtaatcctcaagtcttttagcggatggtttgcaatctctgtacagaaagcactcggagaaactaaagaatgtctgttatgctgtctgataaatgcctgtagattatctttcatgttgcaatctgttttccataagaatcagtgtgtggggtgtaatgtacagtctctctgtttgggaaggacttggttgctatttgtcgcgctccatttttt

SEQ ID NO: 2576 - DNA, 1713 bp, Ananas comosus
ttttcagcattcaactgcctttgagtagtttcacgttgtgcactaagtattttagcaacagcaataaaagatgtgacaagctggagacccaccaatgatgcaactagacgatagacccttggaggagtacatgacaaagctatgacataatccgcacatttctcaaacaagactttatcaaataatgggccattttgacactcaagtaccagagagttccagaatgatgcgagattttccttgaagttttttagctctttctgctttgcaccgtaatagtcttctacctcaccatttcttgctagctgtacaagagcgaccactacatcatctacatctgtctcatcaagagattccgcatcaagttgatatttggcaccgcaggcctcaaaaagcatcattagaagatcaaccatagctgatttgggatctgcctcgtaccgctccacccatcgttttaccgcatggtcaataaccttcccattgaactttacaacatcaatcaatctctggtcgtccttccacccggcggcccgtgcggcggccccgcgcttcctcttcgccctcggggcaagctcgtcgaacgactcgtcgtccgacccctgctccgcgccgccggggctccccgcgtcggtcgatttgctcggcccgccatcggccgactccaaaaccctactcttcctggggcgaccggggcgacggcgaacggaggtctccgaggccaccgcgacctccatggttgggaattgggaggaggaggacgacgaggaggaggagaaggaggcgaattgagcccatccatggcgaagctatacgtgcaaacggcgcccccaccggatctgaacaagaacacggagtggttcatgtacccgggcgtgtggaccacctacatcctcatcctcttcttctcctggctcatcgtgctctcggtcttcgggtgcacccccgggatggcgtggaccgtcgtcaacctcttccacttcgcggttacctatcactttttccactggaagaagggaactccctttgctgaagaccagggtatctacaatactctgacttggtgggagcagatggacaatggcaagcaactaactcggaatagaaagtttttgaccgttgtccctgtggtcctgtacttgatagcctcgcatacaactgactaccaacatccgatgcttttcctcaacacacttgctgtgtttgtgctggtggttgccaaattccctaacatgcacaaagttcgcatcttcggaatcaatgcgggtagttaagaggttctgctgcatgtagaaaagtctcaatttttatatcattcaaggttgataccttgaatcttgctcgttatctgatgagcgatagtaaacctcttttttcgcccttttttgctgtaatctgtgcatgaaactatcgtctgtagttatttctaggttgtatttccctgctttgcttttaatgaaatcacgaaaacctgtcaaatgaaatccattcagcatactatactatttattggatgaaatatcaatctctgttgatttcgccgtattattctgagaactgtaattaatttgagaatattgttcagctgcaattacagagactaatggttctttttgtttgcaagaggcaaagatgaaagctttcatgatgaagctacaaggcttaggttctgtttggattcatgaacatcttattctgtagttttctttgatt

SEQ ID NO: 2577 - DNA, 1033 bp, Ananas comosus
ggggacgaggacgacgaggaggaggagaaggaggcgaattgagcccatccatggcgaagctatacgtgcaaacggcgcccccaccggatctgaacaagaacacggagtggttcatgtacccgggcgtgtggaccacctacatcctcatcctcttcttctcctggctcatcgtgctctcggtcttcgggtgcacccccgggatggcgtggaccgtcgtcaacctcttccacttcgcggttacctatcactttttccactggaagaagggaactccctttgctgaagaccagggtatctacaatactctgacttggtgggagcagatggacaatggcaagcaactaactcggaatagaaagtttttgaccgttgtccctgtggtcctgtacttgatagcctcgcatacaactgactaccaacatccgatgcttttcctcaacacacttgctgtgtttgtgctggtggttgccaaattccctaacatgcacaaagttcgcatcttcggaatcaatgcgggtagttaagaggttctgctgcatgtagaaaagtctcaatttttatatcattcaaggttgataccttgaatcttgctcgttatctgatgagcgatagtaaacctcttttttcgcccttttttgctgcaatctgtgtatgaaactaccgtctgtagttatttctaggttgtatttccctgctttgcttttaatgaaatcacgaaaacctgtcaaatgaaatccattcagcatactatactatttattggatgaaatatcaatctctgttgatttcgccgtattattctgagaactgtaattaatttgagaatattgttcagctgcaattacagagactaatggttctttttgtttgcaagaggcaaaaatgaaagctttcatgataaagctacaaggcttaggttctgtttggattcatgaacatcttattctgtagttttctttgatttaggcccactttggatgcataagcatcttattctgtatgtccttttcatttactcataaagcatatagca

SEQ ID NO: 2578 - DNA, 641 bp, Arnica chamissonis
accatcggcaccaactacacaggtcattccaagctgcatacgacggaggttacgcaggaccagtctttacatcaaagcttcgcgatcgatacatggccaatttgtatgtgcaagcggagccgcccacggatctgaacaaaaatacggagtggttcacgtaccccggcgtctggacaacctacatacttatcctcttcttcgcttggctagtcgttctctccgttttcggttgttcgcctggcatggcttggaccaccgtcaatctctctcacgctctgctgacgtaccagttcttccactggaaaaagggcacaccttttgctgatgatcagggtatctacaacaggttgacctggtgggagcaaatcgatagtggcaaacagctcactcgcaacaggaagtttctcactctcgtccctgtggtcctgtacttgatagcatctcacacaacagactaccagaacccaatgctgtttttcaacacggttgcagttttcgtgctagttgttgccaagtttccaaacatgcacaaggtccgaatatttggaattaatgctgaagagtgaagctttacctgttcaattgcttcacacgtctctgtaattctaacatcttaaatttcgaacccgacaaatggtata

SEQ ID NO: 2579 - DNA, 1074 bp, Bupleurum chinense
atcttgcgttttgggaattgatctatataggtgtcaacaacagttgcgcaaacaatcacagctgaatcaatacaagagaaagagagttgtatatatatataatagattgttggatggcgaattattacgtaaaggcgacaccaccggcggatctgaacaaaaacaccgagtggtttacatatccaggcgtatggactacttatattctcatcctcttcttcgcctggctcgttgttctctccatccttaattgttctcctggaatggcttggaccatcgttcatctctcccacttcctcgttacctatcacttttttcactggaagaaaggaactccatttgctgatgaccaagggatctataatgggcttacttggtgggagcaagtcgacaatgggaagcaactcacacgtaacagaaagtttttgactgttgtacctgtcgtgctgtacttgatagcttcacacacaacagactatcagcacccaatgctgctcttaaatacaatagcagtggccgtgctggttattgccaagtttccaaatatgcacaaggtccgtatctttgggattaatggggagcagtgagatggtttattagcttggaagcatgacttatgcaagaaggaaaagtaaaaaaagataaatctttgtatagtaatcagaactgaatacgattttgggagtgtaatatttagtgactttgttcttttcacaagctccttgctggataatgagggaataaaagtttactagtttgtttatgtatagcaaatatcttatatattcaggagattttatttgactttaagttaagcaggttacatgatgcaatacttccagagggaaatgttatgtccagagcaatgctctatgaaaatcattgtatgtgtataataaacaagaaaatgactctagaacataaagtaaatttaccttttgtaccttaaaattaaaaaaccgttaggtaaggtaacctaggtacccaaacggggaccaaccgaacgaacgggggggaattaaggggacacgtgtacacagacgtagacacgtcgtacgatatagtacgtagagc

SEQ ID NO: 2580 - DNA, 953 bp, Cannabis sativa
tacccaaaaccattaacaataaaaaccccattcgccataaccgaatccttctctctctctttctctctgtgtaagccatcatcgtatctgaatcgatttctgatttttctattttttgtttggtctggtttggtttggttttgaattgaatcgataaaggaagaagaagaagacgatgtacgtacaggcagtgccacccacggatctgaatcggaacacggagtggttcacgtaccctggggtttggaccacttacattctaatccttttcttctcatggctcaccgttctatctattttcggttgctcctccggcatggcctggaccatcgtccacctcgcccatttcctcgttacctaccacttctttcattggaaaaaggggaccccatttgctgatgatcaaggtatttacaatggattgacttggtgggaacagattgacagtggcaaacaactcacacgaaacagaaagtttctaactgttgttcctgttgtgctgtacttgatagcctctcacacgacagattacgaacaccctatgctgttcttcaatacactggcggttttcgtgttggtggtggccaagttcccaaacatgcacaaagttagaatattcggtatcaatgctgatcattaagatttgagttactactacttctaaacagaattacatcttggattcactctggtttcaaatcattttgacctttccaattttttttgttaaaaacttggaaaaggagtatattatgtctaatgaaaatgagctcttcttcttctttgtttttttaaagcattagttgtaagttacagataacttgaggagaaaaatgtttttcaatgcattttgtggttatacgagctgagataatctccaagaattttactactcaattaaattgataatcattttttattttatatgtccacacttattattatatatatac

SEQ ID NO: 2581 - DNA, 1121 bp, Cichorium intybus
tccgataagtattgaatttatttttggttggttatgcgtttaaattatgtataactttgcgtgctaataattacgaccaccatcgccgttaacaattaccatcaccaagcaacaataatctcttccagtccacacaccgaccgtctacaaccaccacgcactaccttccgacctacatacacctacttcacaatcatacatacacccgagcttcacaggatcacagtacacgattctcctagaggaactcccaaaaatggccaacttgtatgtccaagcggtgccgccgacggatctcaacagaaataccgagtggttcatgtaccccggcgtatggaccacctacatactcatcctattcttcgcttggctcgttgttctctccgtctccggttgctctcctggcatggcctggaccaccgtcaatctcggtcacgctctggttacatatcacttttttcactggaagaagggaacaccttttgctgatgaccagggtatctacaacaggctgacttggtgggagcaaattgatagtggcaagcaactcactcgcaacaggaagtttcttactgttgtccctgtagtactgtacttgatagcatctcacacaacagactatcaaaacccaatgctgttcttgaacacagtggcagtttttgtgttagtgattgccaaattcccacatatgcataaagtcaggatttttggaatcaatgctgaagaatgaatcatgtttctaaaagggacaaactagttcagttccatccatggatatatgtgcatctttaattttgaaatatcttgacgattaaaagggtaaaaaaggtatattaactttttttgttatatcttctttttttcccctttgtgtcttgtggatgatccaaacactagaaggtaaaaagacaaagacttttcttgcatattttggtggtgagtttttaatccaagttgtatgatgtcatgttatatggacttgtccatgattaaaaattacaagttaaacaagcgattagattatttaacagtttgtaaggctgttcatttcacagttgtacaaaataatgcttaaacttgtgaattttttggatctaaataagagtctgaaatttactttc

SEQ ID NO: 2582 - DNA, 864 bp, Cichorium intybus
taatctcttccagtcacacactgactgtctccaaccaccacgcactaccttccgacctacatacacctacttcacaatcatacatacacccgagcttcacaggatcacagtacacgattctcctagaggaactcccaaaaatggccaacttgtatgtccaagcggtgccgccgacggatctcaacagaaataccgagtggttcatgtaccccggcgtatggaccacctacatactcatcctattcttcgcttggctcgttgttctctccgtctccggttgctctcctggcatggcctggaccaccgtcaatctcggtcacgctctggttacatatcacttttttcactggaagaagggaacaccttttgctgatgaccagggtatctacaacaggctgacttggtgggagcaaattgatagtggcaagcaactcactcgcaacaggaagtttcttactgttgtccctgtagtactgtacttgatagcatctcacacaacagactatcaaaacccaatgctgttcttgaacacagtggcagtttttgtgttagtgattgccaaattcccacacatgcataaagtcaggatttttggaatcaatgctgaagaatgaatcatgtttctaaaagggacaaactagttcagttccatccatggatatatgtgcatctttaattttgaaatatcttgacgattaaaagggtaaaaaaggtatattaacttttttgttatatcttctttttttcacctttgtgtcttgtggatgatccaaacactagaaggtaaaaagacaaagacttttcttgcatattttggtggtgagtttttaatccaagtgtatgatgtcatgttatatgggagtg

SEQ ID NO: 2583 - DNA, 791 bp, Cleome gynandra
cccacagatataaagaagcacccagattaaacccatcaagtttgggaaattgttgcgtcgaatccacgtgaaaatatcagattttgataggaatcccatctttggaatcatcgccagaaagaagaagaaacaaccaaggcgaaagagtgttcctttttctgttcagggtttgagatattttcgaggttcgatcatagaaggcaaatggcgaatctgtatgtgaaagcggtgccgccggcggatctgaataggaatacggagtggttcatgtacccaggtgtgtggacgacgtatatacttatattgttctttgcttggctcgtctttctctccgtcttcggttgctcccctggcatggcctggactgttgttaatctcgctcacttcgccgtaacttatcatttcttccactggaaaaaaggaacgccctttgcagaagaccaaggaatgtacaatagtttgacatggtgggaacagatggacgaaggaaaacagcttactcgcaaccgaaagtttcttacagttgtacctgttgtgctgtacttgatagcatcgcatacaacagactataaacatccatggctgttcctcaacacactggcagtgatcatccttgtcgtggctaagttccctaacatgcataaggttcgcatcttcggcatcaacggctgatatgtaagcaatgaatcattctcataaaatgccactgatgaatctgtttcttctctgtatcgtctttgtatagaaggagaatgccagtaaatacatgcataaatatatatatatatata

SEQ ID NO: 2584 - DNA, 878 bp, Taraxacum officinale
cgccgttaccatagccatcactaagcaacaatcatctcttccagtccacacaccgaccatccacaaccaccacgcaccaccttaagacctacaaacacctactccacaatcacacatacacccaaagcttcccacaccatacgattctccgacaggacctcccaaagatggccaacttgtatgtccaagcggtgccgccgacggatctcaacagaaataccgagtggttcatgtaccccggcgtctggaccacctacatactcatcctattcttcgcttggctagtcgttctatccgtctccggttgctcccctggcatggcctggaccaccgtcaatctgtgtcacgctctggttacataccacttctttcactggaagaaaggaacaccttttgcggatgatcaaggaatctacaacagattaacatggtgggagcagattgatagtggcaagcaactcactcgcaacagaaaatttcttactgttgtccctgtagtcctgtacttgatagcatcacacacaactgattatcagaatccgatgttgttcttaaacacagttgcagtttttgtgcttgtgattgctaaattcccacatatgcataaggtcaggatttttggaatcaatgctgaagaataagtgatgttttaaaaaaagaaaaaaaggataacagttcagttttatccatggatatatgtgcatctttaattttgacatattgcgagatttaaaaggttaaaaaaggtatattaactttttttttttgtatttttttttctattaccctttgtgtctggggatgataaaaaaaagagacttagtttgcatcttttggtcttcatttttaatgtgaatgtatgattggatgttatatgg

SEQ ID NO: 2585 - DNA, 997 bp, Fagopyrum esculentum
aatgttgaattgtttttctacgattcatccccaaaatatctgcataatttctcaacgccaccaacacacgctatcgcaaccagagagaatttagggcgtttacaaaccaaatcctgtttttgcttttgaggtcaaattcaagatatcttcctgcaattcaataagaatcggcggttcttctatggcgaatttatacgtaaaggcggtgcccacgacggatctgaaccgtaataccgagtggttcatgtaccctggcgtttggacgacttacatattgatcctcttcttcgcgtggcttgttgttctctccgtctttggttgtacccctggcatggcttggactatcgttaatctcgtccatttcgctgtcacttatcactttttccactggaagaaaggaactccgttttctgaagatcaaggaatatacaatcgcttgacttggtgggagcaggtcgacaatggaaaacagcttacacgcaacagaaaattcctaacagttgttcctattgtgctgtacctaatcgcgtctcacacaaccgattaccagcatccaatgctattcttcaacacacttgccgtctttatcctagtcgtggcgaaattccctcatatgcacaaggttcgaatcttcggcatcaatggagatcagtaaaaattaccacaggaggtttcacacttgcaaggctaaacgcctctgttttcgtcatcatcgcgaaaatgtcaccattgtatagaaacggaaacctgaaggtaaaaactatagttgtttgtatgtttttcttttcatatcacctggatctggaagtggagactcgacgacgacaaggaactaatagttaagatttgagttatgtttgtacagtaatgatcctaatgtatgagaggatcatgctttgattggtctcagctgttataatgctttcaaatgatgtcagatgatacttctcactagaacattttgccttaaatagaatagttatgaaatcttatgtta

SEQ ID NO: 2586 - DNA, 684 bp, Fagopyrum esculentum
tgttgaattgttttctacgattcatcccccaaaatatctgtcataatttctcaacgccaccaacgcacggtatcgcaaccagagagaatttagggcgtttacaaaccaaatccggttttgcttttgaggtcaaattgaagatatcttcctgcaattcaataagaatcggctgttcttctatggcgaatttgtacgtaaaggcggtgcccacgacggatctgaaccgtaataccgagtggttcatgtaccctggcgtttggacgacttacatattgatcctcttcttcgcatggcttgttgttctctccgtctttggttgtacccctggcatggcttggactatcgttaatctcgtccatttcgctgtcacttatcactttttccattggaagaaaggaactccattttctgaagatcaaggaatatacaatcgcttgacttggtgggaacaggttgacaatggcaaacagcttactcgcaacagaaaattcctaacagtggttcctattgtgctgtacctaatcgcctcacacacaactgattaccagcatccaatgctattcttcaacacactcgctgtctttatcctagtggtggcaaaattccctcatatgcacaaggttcgaatcttcggcatcaatggagatcagtaaaaacaccataggaggtttcacacttgcaagg

SEQ ID NO: 2587 - DNA, 846 bp, Flaveria ramosissima
agcatattgtctaagtttgcgtgctaattattacgatcaccatcgccgttacccgttaccatcaccaagccacaatcatctcttccagtccacacaaccaccaccaccacaccacaccacaccactttccgacctacttcaccaccaccaccaccaccccccaccgtcctcaccggccattctcccatcgcacaaatggccaacttgtacgttcaagcggagcctccgacggatctcaaccgtaacaccgagtggttcatgtaccccggcgtctggaccacctacatcctcatcctcttcttcgcctggctcgtcgttctcgccgtcaccggctgctcccccggcatggcctggaccaccgtcaatctctgtcacgctctgattacatatcacttctttcactggaagaaaggaacaccttttgctgatgaccagggtatctacaacaggttgacatggtgggagcaaattgatagtggcaagcagctaactcgcaacaggaagtttcttactgtcgttcctgtagtgctgtacttgatagcatcccacacaaccgactatcaaaacccaatgctgttcttgaacacgttggcggtttttgtgctagtgattgccaagttcccacacatgcataaggtccggatttttggaatcaacgccgaagagtgaaaaatgtcccgttctgttcagttcgttccgtgcatgaatatatgtaagtcgttaattttgatatatctcgacagttaaaaggtacggaactggtaaaagggtatattaacttttctctttttgtttgtcttttcttctttttcccttgtgttttatggatgatccagaaattatatt

SEQ ID NO: 2588 - DNA, 866 bp, Panax ginseng
tttcgggtttgatgaaattacagttcttggggtctctaaataaagtttattgagatagtgaagttgattgctattctatttttccagctccaaagaaaatctatcttcgggagaaaagaagaagaaaaaaaagatggcgaattattacgtaaaggcgacgccgccgacggatctgaataagaacacggagtggttcacctatccaggtgtttggaccacctacatcttaatcctgttcttcgcctggctcgttgttctctccgtcttaaattgttctcctggaatggcttggaccatcgttcatctctcccacttcctgatcacttatcatttcttccactggaagaaaggaactccatttgctgacgaccaggggatctataatgggcttacttggtgggagcagattgacaatggacaacaactcacccgtaacagaaagtttttgacagttgtaccagttgttctatacttgatagcttcacacacgacagactatcgacacccaatgttgttcttgaatactcttgccgtcatcgtacttgttatcgccaagtttccaaatatgcacaaggtccgtatctttgggattaatggagatcagtgagatggctttatgaatttgttagcatgacttgtgcaaaaaaaaaggttaaatcattgtatagtagtcagaaatgaaaaagattttggatatgtaatgttctatggcttcttttctcaagctctcttacccctggatattgaaggaataaaagtcaagtttatttttgtatagcagaaaattcacgtatccagaattcaatgtcaaaaacgatgtcaatatatgtgggggccagaacaggttactgtttggcaccatttta

SEQ ID NO: 2589 - DNA, 884 bp, Panax ginseng
aagcagtggtatcaacgcagagtacatgggggaagagactatagatagatacagccatatatatatatacacacatacatagagcttctcgggtttgatgaaattacagttcttggggtctctaaataaagtttattgagatagtgaagttgattgctattctatttttccagctccaaagaaaatctatcttcgggagaaaagaagaagaaaaaaagatggcgaattattacgtgaaggcgacgccgccgacggatctgaataagaacacggagtggttcacttatccaggtgtttggaccacctacatcttaatcctgttcttcgcctggctcgttgttctctccgtcttaaattgttctcctggaatggcttggaccatcgttcatctctcccacttcctgatcacttatcatttcttccactggaagaaaggaactccatttgctgacgaccaggggatctataatgggcttacttggtgggagcagattgacaatggacaacaactcacccgtaacagaaagtttttgacagttgtaccagttgttctatacttgatagcttcacacacgacagactatcgacacccaatgttgttcttgaatactcttgccgtcatcgtacttgttatcgccaagttcccaaatatgcacaaggtccgtatcttcgggattaatggagatcagtgagatggctttatgaatttgttagcatgacttgtgacaaaaaaaaaagggttaaatcattgtatagtagtcagaaatgaaaaagattttggatatgtaatgttctatggcttcttttctcaagctctcttacccctggatattgaaggaataaaagtcaagtttatttttgtatagcagaaaattcacgtatcc

SEQ ID NO: 2590 - DNA, 1039 bp, Lactuca sativa
atatggttggttatgcgtttaaataatgtctaactttgcgtgctaataattaccaccaccatcgccgttaccaattaccatcaccaagcaacaatcatctcttccagtccacacaccgaccatctacaaccaccacgcaccaccttctgacctacatacaactactttacaatcaatcacacacacacacacccaaactttacagggatacaccacacaattctcctacaggaagtcccaaaaatggccaacttgtatgtccaagcggtgccgccgacggatctcaacagaaataccgagtggttcatgtaccccggcgtttggaccacctacatactcatcctattctttgcttggctcgtcgttctctccgtctccggctgttctcctggcatggcctggaccactgttaatctctgtcacgctctggttacatatcacttctttcactggaagaaaggaacaccttttgctgatgaccaaggtatctacaacaggttgacatggtgggagcaaattgacagtggcaagcagctcacccgcaacaggaagtttcttactgttgtgcctgtagtgctatacttgatagcatcacacacaaccgattatcagaacccaatgctgttcttgaacacaatagcagtttttgtgttggtgattgccaaattcccacatatgcataaagtcaggatttttggaatcaatgctgaagagtgaatcatgttatctttttaaaaaaaggatactagttcagttctatccgtggatatatatgtgcatctttaattttgacatatcatgacaattaaaaaggtttggaactggataaaaaaaaggtatattaacttttttgttatattttttttttctctttgtgtcttgtggatgatccaaaaactagaaaaaaaaagtacttttcttgtgtcttttggtggttgatgtgtaatgctgagtgtaacatctcttgtagggttgtttggaaatattgtttactcaattttaagaacaaatattttctcaaaatgttgtggaaagtgcc

SEQ ID NO: 2591 - DNA, 952 bp, Tropaeolum majus
cactggaagattagatagaacggaaccaaagaagatccgatccgggagcgaggtttgaacaattaaaaaaaagaaaagaatgggaaattaagattgacgaggaggagggcgtaaccatttccaagcaagaccactatccgtatatcacaatctggcctgctctaattctcttaacagcatccttcttcatattcatcttctctgaatcttgaaatctaatcctgttgcggtgtattgacggaagagaagagaaggagaaaggtgaaaaaagagaggaaggaaggatgtacgtaagggccgtgccaccgacggatgttaataggaacacggagtggtttacatacccaggcgtatggaccacctatattcttatcctcttctttgcttggcttcttgttctctcggtcttcggatgctctcctggaatggcgtggaccatcgtccatctctctcatttcctagtcacatatcaattttttcactggaagaagggaacaccatttgctgatgatcagggcatttacaatgggttgacatggtgggagcagatagaaaatggcaagcagctcacacgaaataggaagtttttgactgttgtaccagtcgtactgtacctgatagcctcacacacaacagattatcaacatcctatgctctttttcaatactctggcagttttcgtactcgtcgtggcgaagttcccgcacatgcacaaggtccgtatatttggaatcaacgctgatcattgaacaagaaaaggaaatcatgtttggttttagattagttactagaaagttgttgatggggttatttggataaaactaatgttatgtccctgtacagatgatgaaaactgaaatgggtgtattatttttgcttcatgacgttttatacgtatacctcttcatgcattgcgtaatgctaaaacaaaaatatataatctcatattata

SEQ ID NO: 2592 - DNA, 780 bp, Nicotiana benthamiana
gtggtcctacccatcaaacccaccggctaatacagtcgtcgtttccatatcaacaacgttttgatcaaatatcttaaactatttccaataaaaattaatccccatttttattttcattcaataatcggaagcttcgatttcctcttcctaatttgtatatacaaaaactcaattcagaaaaggattatcggatcttgtttagttgaattggaaattgtggatggcgaatttgtatgtaacggcggtgccgacgacggatctgaatcggaacacggagtggtttacgtatccaggtgtatggacaacttacatcttaattctattcttctcatggctcgttgttctctccgtctttggttgctctcctggcatggcttggaccattgttcatctctctcattttctcgtcacatatcaatgttttcactggaagaagggaacaccattttctgatgaccaaggtatctacaatagattgacttggtgggagcagatagataatgggaagcagctgactcgcaacaggaagtttctaacagttgtccctgtggtgctgtacttgatagcctctcatacaactgattatcaacacccaatgttgttcttcaacacagttgcagtttttatactggttgttgccaaatttccaaatatgcacaaggttcgtatttttgggatcaatgcagatcaatgagctgggtttaactgaatacataccacagaaatcaatagcatctgatttgcattagtatcttgagtaaactaagatggccctgtaca

SEQ ID NO: 2593 - DNA, 1305 bp, Elaeis guineensis
ttaatccaacggcgcccacaccacggccaacgatcgacggcgaccaacgccatcgggagtaaaagctctcatattgaccgatcgatcgttcgttcgttcgttctcttttcttcgcctccctctttgaaatttcatccactccttccgtcctccgttcgcgattccttctcctcttctattaaaagcccaaagcttctgtcctctcctcctctcgatcgacctatcccaattccaatcgcaatcccaatccctatccaagtcggaatcctcccccgtgtcgatttcgtctatttctatatatatttatataagagtagtaagaagggatttatatagatagagatttaggaggaggaggaggcgatggcgaagctctacgtccaggcggtgccgccggcggatctgaacaagaacacggagtggttcatgtaccccggggtgtggacgacctacatccttatcctcttcttctcgtggctcctcgtgctctcggtattcggctgtacccccgggatggcctggactatcgtcaatctgttccactttgcgataacctatcactttttccattggaagaagggaactccctttgctgatgatcagggtatttacaatactttgacttggtgggagcagatggacaatggcaagcagcttacacgtaatcggaagtttttgactgtcgttcctgtggttctgtacttgatagcctcccatacaactgactaccagcatccaatgcttttcctcaacacgcttgcagtgattgtgttggttgtcgccaagttgcctaacatgcacaaggtccgcatctttggaatcaatgcaggtaattgaatggcagtgctcaacagatatcccagttgatatcttttttgttgattgctggatccctatactctactaatttgggggcccggcatggtctagcaagtagcactctagtcttttagtaggtggtttgtaatctctgtatagaaagcacttcagaagctagaaatgtttgtcaagctgtgtctgataaattaatgctttctttagacttttgataaattaaagctgtctgtagactgtctttcatgttgcaatcttttttctggtaagagccagtgttctgggtgtaatgtacacttccctctctgggaaggactttgttttgtggctatttgtggtgccacctttttaatcgttcctcatccatttctgggcttatgttcatgtatggaacaatagtcgtgaatgatctttttccttctttcttcttttggtgcagctaatagtgaatgatcttaagcacaaaaaaaa

SEQ ID NO: 2594 - DNA, 784 bp, Ananas comosus
acgaggaggaggaggagaaggaggcgaattgagcccatccatggcgaagctatacgtgcaaacggcgcccccaccggatctgaacaagaacacggagtggttcatgtacccgggcgtgtggaccacctacatcctcatcctcttcttctcctggctcatcgtgctctcggtcttcgggtgcacccccgggatggcgtggaccgtcgtcaacctcttccacttcgcggttacctatcactttttccactggaagaagggaactccctttgctgaagaccagggtatctacaatactctgacttggtgggagcagatggacaatggcaagcaactaactcggaatagaaagtttttgaccgttgtccctgtggtcctgtacttgatagcctcgcatacaactgactaccaacatccgatgcttttcctcaacacacttgctgtgtttgtgctggtggttgccaaattccctaacatgcacaaagttcgcatcttcggaatcaatgcgggtagttaagaggttctgctgcatgtagaaaagtctcaatttttatatcattcaaggttgataccttgaatcttgctcgttatctgatgagcgatagtaaacctcttttttcgcccttttttgctgcaatctgtgtatgaaactaccgtctgtagttatttctaggttgtatttccctgctttgcttttaatgaaatcacgaaaacctgtcaaatgaaatccattcagcatactatactatttattggatgaaatatcaatctctgttgatttcgccgt

SEQ ID NO: 2595 - DNA, 915 bp, Senecio madagascariensis
gttatagttatccgctatgcatcgaattgaattattagtttaatagtttgggtatccgtcacacttgtctgtctaactttgcgtgctaattatcatcatccatcgccgttactaaattaccacccggaaatggcaaacttatatgtccgagcggttccgccgacggatcttaaccggaataccgagtggtttatgtatcccggcgtctggactacttatatactcatcttattcttcgcttggctcgttgttctttccgtctccggttgctctcctggcatggcctggaccaccgtcaatctcggtcacgctctggttacatatcatttctttcactggaagaagggaacaccttttgcagatgaccagggtatctacaacaggttgacatggtgggagcaaattgatagtggcaagcagctcactcgcaacaggaagtttcttactgttgtacctgttgtcctgtacttgatagcgtcccacacaaccgactatcagaacccgatgttgttcttgaacacagtggcggtttttgtgctggtgattgccaagttcccacacatgcataaggtccggatatttggaatcaatgctgaagagtgagtgccttgccgtgtgtaaaaacggatactagttcagttgatcagttccatccatgaaaatatgtgcatcgttaattttgatatatcacgacaattaaaagggtacggaactggtaaatgggtatattaacttctttcctttgtcatttcttcctttccccttgtgttttgtggatgatccaaacatatataaaaataggacttaacatccatactctcgacagaaaaaagttatcctgtttctgtgcgtagtatttgtatgcctatatgatggttccactaaaacaaaaatgatatatccgaggtttaaata

SEQ ID NO: 2596 - DNA, 804 bp, Helianthus annuus
accatcgccgttaccggttaccaccatcatctcttccactccacacaaccaccaccttcaccgtcacacatccaccatcctcaccggaacctcaacacacacacaatcctccataacaaactcgcacaaatggcgaacttgtacgtccaagctgtaccgcccacagatctcaacagaaacaccgagtggttcatgtatcccggcgtctggaccacctacatactcatcctattcttcgcttggctcgttgttctctccgtcaccggctgttctcccggcatggcctggaccaccgtcaatctctgtcacgcgctgattacatatcacttctttcactggaaaaagggaacaccttttgctgatgaccaaggcatctacaacaggttgacttggtgggagcaaattgacagtggcaagcagctaactcgcaacaggaaatttcttactgtcgttcctgtcgtgctgtacttgatagcatcccacacaaccgactatcaaaacccgatgctgttcttaaacacattggcggtttttgtgctagtgattgctaagttcccacacatgcataaggtccggatattcggaatcaacgccgaagaatgaaaagtgtcatgttcagttaagttcagttccgtaccatccatgaatatatgtaagccgttaattttgatacattccgacagttaaaaggtacggaactggtaaaagggtatattaacgtttctttttctcttttgtttgtcatttcttctttttcccttgtgttttgtggatgatccagaaaatatacaaaaaaaaaaaaag

SEQ ID NO: 2597 - DNA, 983 bp, Tragopogon dubius
attatttctggttggttatgcgtttaaatgtctaactttgcgtgctaataattacgaccaccatcgccgttaccaattaccatcaccaagcaaacaatcatctcttccagtccacacaccgaccatctacaaccaccacgcaccaccttccgacctacatacacctacttcacaatcatacatacacctaagcttcacaggaccacaacacacgattctcctccacgaactctcccaaaaatggcgaacctctatgtccaagcggtgccgccgacggatctcaaccgaaataccgagtggttcatgtaccccggcgtttggaccacctacatactcatcttattcttcgcttggctcgttgttctctccgtctccggttgttctcctggcatggcctggaccaccgtcaatctctgtcacgctctggttacatatcacttctttcactggaagaagggaacaccttttgctgatgatcagggtatctacaacaggttgacttggtgggagcaaattgatagtggcaagcagctcactcgcaacaggaagtttcttactgtggtgcctgtagtgctgtacttgatagcatcccacacaaccgactatcaaaacccaatgttgttcatgaacacggtggcagtatttgtgctagtgatcgccaagttcccacacatgcacaaggtccggatatttggcatcaatgctgaagaataaaaaaaagaacactagttcagttccatccatggatatatgtgcatcgtttaattttgatatatcgcgacaattaaaagggtatggaactggataaaaagggtatattaacttttttgttatattttttcttcttctatccttctttgtgtcttgtggatgatccaaaaactaagaaaaaaaagacttttcttgcttgttttggtggttgaattttaatgcaagtgtatgatatagcatgtgacatcaagaaatgaaatctaagtttgaga

SEQ ID NO: 2598 - DNA, 622 bp, Vinca minor
tgaatggtgaatttgtatgtgaaagcagttccgccgacggatctgaatcggaatacggagtggttcacatatccaggggtatggactacatatatactcatcgttttcttctcatggcttatggttctctccgtcttcggttgttctcccggcttggcctggaccgtcgtccacctttgccatttccttgttacctatcaattctttcattggaagaagggaacaccgtttgccgatgaccagggtatctacaataggttgacttggtgggagcaagtagacagtggtaaacaactcactcgcaatagaaagtttcttacagttgttcctgttgtgctgtacttaatagcttcacacaccactgattatcaacatcccatgctgttcttcaacacagttgcagtttttgttctggtggttgccaagtttccccatatgcacaaggttcgcatttttgggatcaacgcagatcagtgattggaaatctattaaaaaaaagtagcataagtttatatgttatatgttgattataatgtttttttgactctcttttggcgttttagtatagcagcaatgaacttgtacagattttagaagaacttgcaagtgtatgttacttgat

SEQ ID NO: 2599 - DNA, 2005 bp, Cocos nucifera
ggctaatctaatattaatccaacggcgtccacgcacggccaacgatcgacgccgactcaaaagagtctctcccgttgaccgatcgatcgtccgttcgttcgctctgtccttcgctctccctcattgaaatttcctccactccttccgtccgtcgttcgcgattccttctcttcttctataaaaacccaacgcccctctcctcctcttgatcgacctatcccaatcccaatcccaatcccagtaggaatcaacccctgtttcgatttcgtctggttcaatatatttatataagagtagtaagaagggatttatatagatagagatttaggaggaggcggcgatggcgaagctctacgtccaggcggtgccgccggcggatctgaacaagaacacggaatggttcatgtaccccggagtgtggacgacctacatccttattctcttcttctcgtggctcctcgtgctctcggtcttcggctgcacccccggcatggcctggaccatcgtcaatctgttccactttgcgataacatatcactttttccattggaagaagggaactccctttgctgatgatcagggtatttataatactttgacttggtgggagcagatggacagtggcaagcagcttacacgtaatcggaagtttttgactgtcgttcctgtggttctgtacttgattgcctcccatacaactgactaccagcatccaatgcttttcctcaacacgcttgcagtgattgtgttggttgtcgccaaattgcctaacatgcacaaggtccgcatctttgggatcaatgcaggtaattgaatggcagtgctcaacaggtatcaactgaaatcacagttgatatcttttttgttgattgctggatccccatccgctactaaattttgggcccagcatggactagcgagtagccctcaagtcttttggtaggtggtttgtaatctctgtacagaaagcacttgagaaggtagaaatgtttgtcatgctgtgtctgataaattaatgctgtctgtggacttctgatatattacagcagctgtctgtagaccatctttcatgttgcaatcttttttctggtaagaaccagtgttctgggtgttatgtacagttctctctttgggacggactttgttttgtggctatttgtggtgctactttttcttcttttttccccccccccccccccccccccttttgtcattcctcatccatttctgggcttacatgcatgtatggaacagtagtggtgaatgatctttttatcttctttcttctttctgggcagctaatagcctaataatagtgaatgatcttaaacaatgtataccttcattatgtgatggaagaaacaaccaccttgctcaaggcaagcactgattggataccaatcaatcctatcggaaaggtgtctacaagtaatgaatttaaacctctctttcaaaggaaggaaactttcagagatcccccccccccccaaaagagttatggtttcctaaatgaatgatatccgggaattgctggatggtgaaagctctccacggatggtgctgcgagaagattgattgtgaagtatgtgagaacgacttccctgcaagcaaagcccaactaggtggcgcaggaaaaaaggcaaaggttgtgttagccaataatggaccgggtttccagagtttggattctcagataattttggatggtgatgcatccccaagtcaaatttcaggtgcttggattgcttggtggtaaggtttgctgaatcgttccataccatacagtactgagtatatagtctcatattatactaatatttggtattgtcttaacatctcatattataccgtatatcaattaacgatatagggttcggtatcgagatgatgaattttgcttgatgatttgagatgctaatataagaatagtttcgactctatggactttaaatccgaatgcggatgggaaacaattcaacagaggacattgtaacttacaggtgaa

SEQ ID NO: 2600 - DNA, 1805 bp, Ananas comosus
gattcttcgtcctcgttccatctcttccccaattaacccctctctctctccatttcgccattttcgatcctatttattccaatccaaaaccctacctccccattcctacgtagctcgatctctcaccacaatttgagaagcggaagtggggggaaaaagggtaaaggaaggaggggacatggcgaagctctacgtacaagcggtgccccccgcggatttgaacaagaacacggagtggttcatgtaccctggcgtatggaccacctacatcctcatcctcttcttctcctggctcctcgtcctctcggtcttcggatgcacccccggcacggcgtggaccatcgtcaacctcggccatttcgcgatcacttatcacttctttcattggaagaaaggaactccttttgctgatgatcagggtatctacaacagactgacttggtgggagcaaatggacaacggcaaacagcttactcgtaacaggaaatttctgactgtggtacctgtcgttctgtacttgattgcttcacacacaacagactaccagcatccgatgcttttcctaaacacccttgcagtgattgtgctggtcgtcgccaaattacctaacatgcacaaggttcgtattttcggaataaatgcaggcgattaagcggctgtgctcgaaatatatatctgtctatatcttttatatattttagttcttgtatgcccataaagctagttaaaggacttcagcggatgatacgacgcatagtgtttaaagacagtaatcattgtacagcaaaccacttgacggagaagatagagatgatgagttgtgttgttactatgaaagcgaaactctgtacactgtccatattgctatatgcgtgtggaaatccgttttgagtcttttctatgtaaaatttctcgtgttatatatgtcatatttcatttctggtattcaaataagaggagtctcttttgtgttttgcattgtgcctgtggtgataaagtggaataccgaatatgacaccacgatagagaaaattatgtagatgcacttcctaaatgattgtgtgtagttaatacagcgcttctaaaacacttttgctatgattctttcttattctggttgaggctctaactcatttcctatctcgcgagatctgcaaagactactataagggcctatttgcgtgcatgagtattttgttcggcttatctacggggggggggggggggggggggggggggggggggggggggtctacaaatttatagtcttgaatgtgatagaattgcaaaatgcctccttaaagaataataatttagatgccgttcctcatgtgcattataaagcatgtctcaattttgtggaagagatgtaaaatacggtcgctatagtaacagttgaaataggctgtgatagcgcagagaaaacttttgccatgaatcaaaactggttacacactaataatctgaagagagggggggggggggggggggggggggggggggggggggggggggggggggggggggggggggggggggggggggggggggggggggggggggggggggggggcttatttctattgtataacatacagcctatggttttctattgtagtgttaattcgatctaatcaaaatcaacgcctcattcccatcaacacacctcaacagcaggtcgtagaccaaaattttacgggcgtgttttaaacttggagattataaattttaaattatataattttcatgttattagaaatttgtgtcaccttcaggtttctgcaagaaatacgtttaatctaaac

SEQ ID NO: 2601 - DNA, 754 bp, Ambrosia trifida
aagttagccttctcattattatcaccatcaccaccaccgccgttaccaattaccatcacttcaccaaccaaacaaacaaacatcttcagtcaccactttccgaccaacaaacacacccactttacaaccacaccacaccacaccacttgattaatccaaaccaactctaatatcaaatggccaacttatatgtgcaagcagagccaccaacagatctgaaccgaaacaccgaatggttcatgtatcccggcgtctggaccacatatatactcatcttattcttcgcttggcttcttgttctcgctgttactggctgttctcctggcatggcttggaccactgtcaatctctctcacgctctcattacatatcacttctttcactggaagaagggaacaccttttgctgatgaccagggaatctacaacaggttgacttggtgggagcaaattgatagtggcaagcagctcactcgcaataggaagtttcttactgttgttcctgtagtgctgtacttgatagcatcccatacaactgactatgagaacccgatgttgttcttaaacacagtggcagtttttgtgctagtgattgccaagtttcctcacatgcataaggttcgaattttcggaatcaatgctgaagagtgaaaagtatgctgtttacatacaggtgctacttcactttgctgaatatatgtgcatcgataattttgacatatcatgacagttaaaacagttaaaagtgtatattt

SEQ ID NO: 2602 - DNA, 1085 bp, Amorphophallus konjac
tcgtcttcctcttctcttcttctacctcaccggttggctcgttccctccaattcctgctctgctctcgtcagcggtgtcggctgctgctggtgtggtccgaggaggggagtcctgatttcgtggctcttgccgggttctgtgtgtgtgtgtgtgggtgatggcgaagctgtacgtacagacggcgccgccgccggatctgaacaagaacacggagtggttcatgtaccccggggtgtggaccacctacatcctcatcctcttcttctcctggctgatggtgctctccatcttcgggtgcacacccggcatggcctggacgatcgtcaacctcttccacttcgtggtgacatatcactttttccactggaagaagggaactccattcgctgaagaccagggtatttataacactttgacatggtgggaacagatggacaacggcaagcagctgacacggaataggaagtttctgactgttgttccagttgtgctgtatctgatcgcttcgcacacaactgactacaaacagccaatgctcttcctaaacactctggccgacattgtgctggtggtcgccaagttcccaaacatgcacaaggtccgcatctttggaatcaatgcagataactgacaggcagctgtttatgaaagattcctctggtgatatcttttgtttgatatctatctgatccatactactaaggataggaaggtgtgcgggcaagtgaattgcagtagactctctatggtccttcctaccagacggatttctgcatatcagtgtacagggaagttgggaaaaactcggagaactggaaagggtggtgttgttttttggtagacggaaatgtctgtagactacttatcagcttgttcctttttgttaataagaatgtggaaatatgacttattttgcgttattggttatttttatgtttcatgcttatgaagagtttaggtatgcacggacatttattcgctgggtatgcataaaacatggacagttctgatggtattcacgacaattgctcatttctattgtgaatttgttcggggtgttgctttgtggtgggcatcttgagtc

SEQ ID NO: 2603 - DNA, 788 bp, Antirrhinum majus
aatacatttgaggtgttttaaaaaaaagaaaaaaagtaattgagagaaggggaaatagaaggaaattgtgttggtgtagtggcgatggcgaatttgtacgtgcgagcggttccgccgacggatctgaatcggaatacggaatggttcacgtaccctggtgtatggaccacctacatcctaatattattcttctcttggctggttgtcctctccgtcttcgcctgctcccccggcatggcctggaccatcgttcatctctctcattttcttgtcacttatcattgctttcactggaagaagggaacaccattttcagatgatcaaggtatttacaatagattgacgtggtgggagcaaatagacagtggaaatcagctaactcgcaataggaagtttttgacagttgtacctgtggtgttgtacttgatagcctcacatacaacagattatcagcatcctatgctctttctcaacacactcgctgtttttgtcctggtggtggctaagttccctcatatgcacaaggttcgtatcttcggaattaatgccgaccaatgaccgaagttccactgataccacaatgcagagttcacctttagctgcagtattttggtctatacagcacttccctgtcttgctgtagcgcaaaatgcaaagtgggaaggatagtggtacctctctaaatattagcgctacccttgaaatctggctattctctgtatgatctctttgtacaactcaatccctgaactttgcataagttataaaattttcttttatttatcacg

SEQ ID NO: 2604 - DNA, 1187 bp, Cirsium arvense
cgggggtatttatttataagtaataagataagtattgaatataattgtggttggttatgcgtttcaattatgtctaaatttgcgtgctaataatgaccaccaccaccatcgccgttaccaattgccatcatcatcatcgtcatcaccaacaagcatctctttttctcttgtctacaagtccacacacccaccatctacaaccaccacgaaccaccttcctacctgcctcataatcatctatacaccattctgattctccttttacaactataatggctaacttgtatgtccaagcggttccgcccacggatctcaaccggaatacggagtggttcatgtatccaggcgtctggaccacctacatactcatcctattcttcgcttggctcgtcgttctctccgtcaccggttgttctcctggcatggcctggaccaccgtcaatctcggtcacgctctcgttacatatcacttctttcactggaaaaagggaacaccctttgctgatgaccagggcatctacaacaggctgacttggtgggagcaaattgatagtggcaaacagctcactcgcaacaggaaatttctaactgttgtacctgtggtgctgtacttgatagcatctcatacaaccgactatcagaacccaatgctgctgttgaacacggtggcggtttttgtgctggtgattgccaagttcccacacatgcataaggtccggattttcggaataaatgcagaagagtgagggagagagagagagagtatttacagttccatcccatcccatggatatatgtgcatccttgttaattttgacatataaacagacatttcaaaaagggtatattaactttctttctttctttcatgtgtttggtggatgatcctcaaactagaagaagaaaaaaaggaatcttgtgattggtgatgtgtgaaatgatttatgtgggtaaaaattcattataaaaccatacagacataaacaatgtaatatagaacatggagaaaaacagtgctgattatatttagggtaagatgtctgagaaattactgtttatcaattgttttgtatttataaagtaacagtctctgtgaattaatttgtaatctatatctgtgttggatgattgaagattttgaaaggaacttgatgtcttttatcaaaaagaaaaaagtaccgactgcg

SEQ ID NO: 2605 - DNA, 1041 bp, Cynara scolymus
cggggcatatcatcaccaacaccaacaccaacaatcatcgcttttctcttcttctcttctcttctcttcagtccacacacccaccatctacaaccaccttcccacctgcttcaaaatcatccttacaccattctgattctccttttacactataatggctaacttgtatgtccaagcggttccgcccacggatctcaaccggaataccgagtggttcatgtatccaggtgtctggaccacctacatactcatcctattcttcgcttggctcgtcgttctatccgtctccggttgttctcctggcatggcctggaccaccgtcaatctcggtcacgctctggttacatatcacttctttcactggaagaagggaacaccctttgctgatgaccagggaatctacaacaggttgacttggtgggagcaaattgatagtggcaaacagctcactcgcaacaggaagtttctaactgttgtacctgtggtgctgtacttgatagcatcccatacaaccgactatcagaacccgatgctgttgttgaacacagtggcggtctttgtgctggtgattgccaagttcccacacatgcataaggtccggattttcggaatcaatgctgaagagtgagggaggaggtgtctgagtagtcgagttccagttccagttccagtaccatcccatggatatatgtgcatcctatccttgttaattttgacatataacagacatttcaaaaagggtatattagctttctttttgacatgtgtttggtggatgatcttgaaactagaaggaaaaaaaaggaatctttgtgaaatgatgtatgtgggtaaagagatcaaattcatcatataaaaccagcaaaacataacatgaaaggaagaaaacgagaaacccgttggggtagtgcgtgctgatacgtaagatcaatgtgtgtattagaggggttttgatcacactttgtaatctatatctgtgttggatgattgaatgttgaaaggaagttgaatgtcagtggatagtaagtaaagctctttatc

SEQ ID NO: 2606 - DNA, 849 bp, Cynara scolymus
cgggatgtatcaggagcataatccatcatcaccatagagcagaccagaccatcggcaacaactacacgaatcattccagcttacacacgacggagctaagcttccacaggaaacaacgattccaccactccttctatcaaagcttgaccgactgcgccgatacatggccaatttgtatgtgcaagcggagccgccgacggatctgaataggaatacggagtggttcacgtaccccggcgtctggaccacctacatactcatcctcttcttcgcttggcttgtagttctctctgttttcggttgttctcctggcatggcttggaccaccgtcaatctctctcatgctctgttgacataccacttcttccactggaaaaagggaacaccttttgctgatgaccagggtatctacaacaggttgacctggtgggagcaaattgatagtggcaagcagctcactcgcaacaggaagtttattactcttgtccctgtggtgctgtatttaatagcatctcacacgacagactaccagaacccgatgctgttgttaaacacacttgccgttttcgtgctagtcgttgccaagtttccacacatgcacaaggtcaggatatttggaatcaatgctgaagagtgaagctatctatacacatgcatctgtaattttaacatcttgaaagggtgggaacaggataaaatggtatattaattttttttttctatatttttttttgtgtcagattcttactggagttggtaaatcactgaggtgacagtgttttagagtttgtcccatttcctattccatttttatgttcccaggagaagtgatggtcactttgggtgcaa

SEQ ID NO: 2607 - DNA, 776 bp, Flaveria ramosissima
aaaaagaggtcgatttgtaaccctctctggtccctccttctcacttggtgtatgttggcaatcttcatcgtcaacgaccaataatcgatcaccatcaatactccgactaaaccaccggcaccaaccacacaggtcatcccgatcacacgacggagattccgccggagcaatcaggtatcaaaccttcacatggccaatttgtatgtgcaagcggagccacccacggatctgaacaaaaacaccgagtggttcacgtaccccggcgtctggaccacctacatactcatcctcttcttcgcttggctcgttgttctctctgttttcggttgttcacctggcatggcgtggaccatcgtcaatctctctcacgctctgctgacataccagttctttcactggaaaaagggcacaccttttgctgatgatcagggtatctacaacaggttgacgtggtgggagcaaatcgatagtggcaaacaactcactcgcaacaggaagtttctcacgcttgtccctgtggtcctgtacttgatagcatctcacacgacagactaccagaacccaatgctgtttttaaacacagttgcagtttttgtgctagttgttgccaagtttccaaacatgcacaaggtccgaatatttggaatcaatgccgaagagtgaagctttacgtgttcagttgcttcacacgtgtctgtaattctaacatcttaaatttggaactgaacaatggtacattaatttcaattttttcacgttggggtatacatatttca

SEQ ID NO: 2608 - DNA, 1354 bp, Panax ginseng
aagcagtggtatcaacgcagagtacatggggaagaataatccatctctcagcatatcaattagcattctctccctaaaatcataattgatacccccaactaattagcattgcctgttaatcaccatttaatttctcgtctttcattttgtccaattgatggattgatatatccagtatcaaccatcatcatcatcaagccaggcatcaaatacagatttaggaatttcacgacataataaagtgtatatattatacagcaaaagagctttgaattgaataaagggcaaatgaacagtgaatggcttgagattgtttcgttgttgtcatcaagtcatcgtttcgattgatacatatatatatatatatatagacacgacacgcacttggaagaagaagaagaagaaaaggggggggatttagaatggcgaaatattatgtaagagcggttccaccgacggatctgaacaagaatacggagtggttcacgtacccgggggtttggacgacctatatcctcatcctcttcttctcatggctcgttgttctctccgtcttcaattgctcccctggaatggcttggaccatcgttcatctctctcacgccctcgttacataccagtgctttcactggaagaaggggacaccgtttgccgacgaccagggcatctacaataggttgacttggtgggagcagatagataatggcaagcagctcactcggaatagaaagtttctgactgttgtacctgtggtgctgtacttgatagcctcgcacacaactgactaccaacacccgatgctctttttcaacacgctggcagtctttgttctagtagttgctaagttccctaatatgcacaaggtccggatatttggcatcaatgcagatcaataagctgatatccggtaaagaaaataattctggtctactcctagctataacaatattgttatataattttggcatttcagtatgactggtaataccccggacggatgttggaactgggaagggtatattattgttattattatcatttattatgatggaaatatcaaaaacacgtggaaatatcagttcccaattttgattctccttttttattttagagaaagagagaagaatctaacctccttagttagtaagtaggagggaagggaatatgatcctgaggagatctgtgctgtcactttagggtgagattattaaatcataaatgttggattcccttgttaagagtagtgtgattgtagattaaaccagggaatgtgagactgatcaaggctgagttttcttttctaatttttggacaaactcttgttattcaacatttgattgaattgagggtctgg

SEQ ID NO: 2609 - DNA, 790 bp, Liriodendron tulipifera
ccgctttctccttctttgcttctccatcacaaagcttcctatttcttctccgcaccctttcccctgcaaacgacagaaaaataaaaaaaaggaaatacaaaagagagagagagaagaaaagaaaaagaaatctatcatcatcgtcgtcgaatcggggtattggaaaattgaacggtggatgtgggccgttgatcaggggaaatggcgaaactgtatgtaaatactatgcccccgaccgatctgaacaagaacacggaatggttcatgtacccaggcgtgtggacgacatacatcctcattctcttcttctcatggctcatcgttctctccgtctttggctgcacccctggcatggcttggaccattgtccatctatctcatttctgcgtcacttatcacttttttcattggaagaaaggaactccatttgctgaagatcagggtatttataatggtttgacttggtgggagcagatagacaacggcaagcaactcactcgcaataggaagtttttgactgttgttcctgtggtgctgtacttgatagcctcacatacgactgactaccagcatccaatgctcttcctcaacactcttgctgtgtttgtgctggtggttgccaagttcccaaacatgcacaaggttcgtatttttggaatcaatgcagatcagtgagcagcagtgtaaccaaaagacacttagttttatctgtaaaagcctttgatccttttactaaactgttatccctgtacagaagccacaactgaaagggtgctgtctttgataaacg

SEQ ID NO: 2610 - DNA, 1116 bp, Plantago ovata
ggccgggggtgctataaactccgatctttagctaaacaatcttcctaaccttacccttcttcttcttcttcttcttcttcctcttcccctttctgaataaaaaaaatacatccaatccctttctcatcatcatttattcatactcaatcaaattcattaacaccattatttccgttaaccaattcgatcaaaatatccatcctcctaattccgtaccccaaattgcccatcgctaatcagagtttttggctctaagtaatcaatcgttgttggtgcaatcaatcgatggctaatctctacgtcacggccgagccgacgacggatctgaatcggaacaccgagtggtttacctaccctggcgtttggactacctacatccttatattgttcttctcctggctcgttgtcctttctgtctttggctgttctcctggcatggcttggacaatcgttcatctttctcattctctcgtaacttatcagtgctttcactggaagaagggaacaccattttcagatgatcaaggtatctacaataggttgacttggtgggagcagatagacaatggcaagcagcttactcgcaacaggaagtttttgacagttgtacctgtggtgctgtacttgatagcatcacataccacggattatcaaaacccgatgctcttcttcaacacgtttgcagttttcgtcttggtggttgccaagtttccacatatgcacaaggttcgcatctttggtatcaatgcagatcaatgaacataagacccatccatatggctcggtgcagggcctccttatctgcagtgtatctatctattcccaagcttatggtgaatccgtgtaagcaaaatgaaatgtttttgattggttgagattgttgctcgtgtgtatgaatacttgagagtgattagtcaaaaaatttcagaagtttagttgtattagtttttcccatgtttagagcaacacaatagaaactgctgctgtttgtatatcaaaccagatcttaatactacggcctgttcatctcattgaaatctgtttagttttggagaaagggatgataatcattggcttggatttcgattttcttatatcatcaatcttcaaggctag

SEQ ID NO: 2611 - DNA, 801 bp, Solanum tuberosum
ttttggcaggaatcccaattacaattgatagattttgattgaatcagtgtttgattgagctaaagaaaaattattatgcctaatttgtatgtaaaggcagtgcctccggcggatctgaaccggaacacagattggtttatgtaccctggagtatggaccacctatatactcatcctcttcttctcatggcttgttctcaccgcttttggctgctctcctggcatggcttggaccgtcgtcaatctctcgcactttattgtcacatatcacttcttccattggaagaaaggaactccatttgcagatgatcaggggatgtacaatcaattgacttggtgggagcaaatagacaatgggaagcagctcactcgtaacagaaaattcttaactgttgtgcctgttgtgctgtacttgatagcctcacatacaactgattaccaacaaccaatgctcttcttcaataccattgctgtgactgtgatggttgttgccaaattcccaaatatgcacaaggtccgaatattcggaattaatggggatccgtaaatggttcttgtttttttatttccagtttgtgtttctcaaaatctaagctttgtcattctcctgctgttctgcgtaaagctcgtctctgtatagaaggcaggacaggaaagcgtacttgctgcgttagtgcttatgtcttttacaagtgcttctctagatagtgaagcaataaaaatgtaacaagttttctgtacagtgtaattttccttgtaaactttatatgagtactataattagttcaatctctgtgaacta

SEQ ID NO: 2612 - DNA, 854 bp, Sesamum indicum
aaaatacaattaccttctaattctcattccttggttttttgagaggaacaaaaatataaaggatttcatcatttcattcttatcccttttaattaatatcgagaaatgcgcgagaaacaaacccacctcccccttgcaccccatttttgtcacccaccacactaatatccactcgccgacttccgatctgttttcagaatgatggggaagctgtatgtcaaaatggatccccccgcggatctaaaccgcaacaccgagtggttcacctatcccggggtttggactacctatattttgattctcttcttctcctggctcatcgttctctctctcaccaattgcacccccggcatggcctggaccatcctcaatctctcccatttcgcggtaacgtaccacttcttccattggaaaaaagggaccccttttggtgatgatcagggaatctataatgggctgacatggtgggagcagattgacaatggaaagcagcttactcgcaatagaaagttcctcacagttgttcctgtggttctgtacttgatagcttcacatacaactgactaccaacatccaatgttgtttttcaacacacttgcagtgcttgtgctggttattgcaaagttccctaatatgcacaaggtccggatctttggaattaatggggatcagtgaaggagcttctttgtgaatctgttggttttaacttaagtacgaacacttgatccttacaatatgtgtaaagacggttcatgccatgtatagaaaagctggaagtaatgagtatattttggccacacaatatatcatgctcaattagctgtttttacgagcctactccaaatcgaagcaaa

SEQ ID NO: 2613 - DNA, 784 bp, Silene vulgaris
aaaatggcgaatttatacgtgaaagcgatgccatcagcggatctaaatagaaatacggaatggtttacatatccaggtgtatggacgacgtatatattgttcttgtttatcgcatggcttgttgttctttctgtttttggttgttcttctggtatggcttggaccgtcgtcaatctcgcccatttcgctgtgacttatcattgtttccactggaaaaaaggaaccccattttctgaagatcaaggaatatacaatcgtttgacatggtgggagcaggttgacagtgggaagcagcttacacgtaacaggaaattcttgaccgttgtacctgtggttctgtacctgatagcctcacatacaactgactaccagcatcctatgcttttcctcaataccgttgctgtaaccatcttggttatcgcaaaatttccacacatgcacaaggtcaggatctttggtatcaatggtgatcagtgaagcggtcaaggcattggtttactttcaccgatactttctttatcctcgaagagcacatcactgtatagggaaactagaatgctaaagttatcgggtgatgtatcacttctgtattgctcgagaaaagactacggacttaataagttttttgagttatcttttgtacagcaagagctaccatgtttttagagtttcacaacaatcggtacaatcatgatggtgttactggttgctgagaagattgttttttcgtcttataattttatcccgagaaccttttttaatgaagtaatagaagagaattttc

SEQ ID NO: 2614 - DNA, 936 bp, Solanum phureja
agtgcagagtggataattatgaactgggctattacttccaaaatattagtccttcttcctataggagcagagcagagcagaaaacaagaagaaaaactgagcaaattttggcaggaatcccaattacaattgatagattttgattgaatcagtgtttgattgagctaaagaaaaattattatgcctaatttgtatgtaaaggcagtgcctccggcggatctgaaccggaacacagactggttcatgtaccctggagtatggaccacctatatactcatcctcttcttctcatggcttgttctcaccgcttttggctgctctcctggcatggcttggaccgtcgtcaatctctcgcactttattgtcacatatcacttcttccattggaagaaaggaactccatttgcagatgatcaggggatgtacaatcaattgacttggtgggagcaaatagacaatgggaagcagctcactcgtaacagaaaattcttaactgttgtgcctgttgtgctgtacttgatagcctcacatacaactgattaccaacaaccaatgctcttcttcaataccattgctgtgactgtgatggttgttgccaaattccccaatatgcacaaggtccgaatcttcggaattaatggggatccgtaaatggttcttgttttttttatttccagtttgtgtttctcaaaatctaagctttgtcattctcctgctgttctgcgtaaagctcgtctctgtatagaaggcaggacaggaaagcgtacttgctgcgttagtgcttatgtcttttacaagtgcttctctagatagtgaagcaataaaaatgtaacaagttttctgtacagtgtaattttccttgtaaactttatatgagtactataattagttcaatctctgtgaactatatatactaccatttcaagatcttttttg

SEQ ID NO: 2615 - DNA, 829 bp, Thalictrum flavum
cctctattcaatttttctctacttcaatcaatagaagaaacaaaaaaaaccctaaccctaatttctagcaaattttcgaatcgattgatttattttggatttggatggattgatattcttcttgttccgatcagagaaggtaggaataggaataagaagagcaagaaaaaataatggcgaaactatatgtacaaacagttccaccaccagatctgaataagaacacagagtggttcatgtacccaggtgtttggacaacttatatattgattctcttctttgcatggctcatggttttatctgtctttggttgcactcctggtatggcttggactatcgtcaacctttgccatttcgctgttacttatcatttctttcactggaagaagggaactccatttgctgaagaccagggtatatataatgggctgacttggtgggagcagattgacaatggaaaacaactcactcgcaacagaaagtttttgactgttgtacctgtggtcttgtatttgatagcttcccacacgacagactaccaacagccaatgctcttcctcaatacactggcagtgttcatactggtggttgccaagttcccaaacatgcacaaggttcgtatatttggaattaatgctgaccagtgagggttaatcgtgtataagcctagatgctttggtactatatctgtaaaacccttctatcctcttattttcatggatgtatcccctgtacagaagtcataactggaaagggtactgactctttgataaatgagtttttacatggactgctttgtacgaagctgcttttgttagatatgaaaaat

SEQ ID NO: 2616 - DNA, 775 bp, Flaveria ramosissima
ttctcacttgctgtatgttggcaaccttcatcatcaacgaccaataatcgatcaccatcaatactccgactaaaccaccggcaccgaccacacagatcacccaatcacacgacggagattccgccggagcaatctccgtatcacacattcacatggccaatttgtacgtgcaggcggagccacccacggatctgaacaaaaacaccgagtggttcacgtaccccggcgtctggaccacctacatactcatcctcttcttcgcttggctcgttgttctctccgttttcggttgttcacctggcatggcgtggactatcgtcaatctctctcacgctttgctgacataccagttctttcactggaaaagggcacaccttttgctgatgatcagggtatctacaacaggttgacctggtgggagcaaatcgatagtggcaaacagctcacgcgcaacaggaagtttctcacgcttgtgcctgtggtcctgtacttgatagcatctcacacaacagactaccagaacccgatgctgtttttaaacacaattgcagttttcgtgctagttgttgccaagtttccaaacatgcacaaggtgcgaatatttggaataaatgctgaagagtgaagctttacctgttcaattgcttcacacgtgtctgtaattctaacatcctaaatttggaaccgaacaatggtacattaatttcattttttcacgttggggtatacagatttcattttcttttcacatatccctatcaggtgttagtttcaa

SEQ ID NO: 2617 - DNA, 706 bp, Flaveria ramosissima
tttagggcaaaatatcgttcaatttctcaactcaatcgttcaatcaatttggggaaattgctcatcacaatcccaattccaattcatcaataacatcttggtgaagctgataacaatccgaaaagaacacccagatgatgtacgtgaaggcgactccgacaaccgatttgaatcgaaacaccgattggttcacgtaccccggcgtatggacaacatacattgcatcctgttcttttcatggcttcttgttctctccgtcttcggttgcacccctggcatggcttggaccatcgtcaatctctcccatttcatcgtgacttatcattttttccattggatgaaagggactccgtttgctgaagatcaggggatttacaataggttgacatggtgggagcagattgacaatggcaagcagctcaccagaaacagaaagtttttaactgttgtacctgtagttctgtacttgatagcttcacatactactgattaccagcaaccaatgttattcctcaacaccgttgctgtgatcgtgcttgttatcgccaagttccccaatatgcataaagttcgaatctttggaattaacggagatatgtgacagtcgaacacagttggtaagtttagatctttatgttgatctggcagtatcaatgtatagcaagtcagtgttgggatgggaggttatcttgttatgtacctattt

SEQ ID NO: 2618 - DNA, 779 bp, Flaveria ramosissima
tgcaacaattaaataataatactaacaaaaaaataatcttatgtaaatccagccttgaaaaaagaggttcgatttgtaaccttctctcgtccctctttctcacttgctgtatgttggtcaaccttcatcggtcaacaacctaataatcgatcaccatcaacaactccgactaaaccaccgtcaccgaccacacagatcacccactcacacgacggagattccgccggagcaatctccgtatcacaccttcacatggccaatttgtacgtgcaggcggagccacccacggatctgaacaaaaacaccgagtggttcacgtaccccggcgtctggaccacctacatactcatcctcttcttcgcttggctcgttgttctctccgttttcggttgttcacctggcatggcgtggactatcgtgaatctctctcacgctttgctgacataccagttctttcactggaagaagggcacaccttttgctgatgatcagggtatctacaacaggttgacctggtgggagcaaattgacagtggcaaacagctcactcgcaacaggaagtttctcacgcttgtacctgtcgtcctgtacttgatagcatctcacactacagactaccagaacccgatgctgttttaaacacagttgcaagtttcgtgctagtagttgccaagtttccaaacatgcacaaggtgcgaatatttggaatcaacgctgaagagtgaagctttacctgttcaattgcttcacacgtgtctgtaattctaacatcttaaatt

SEQ ID NO: 2619 - DNA, 756 bp, Fraxinus spp
aattccaattaattatcgattaatcaacaatattagttatcatacaaacaattttggaaggggataaggaaggaggagcgtgaaattagtaattggatttaaaagttgaaggttttagaggaacgtgatttgagatggcgaaattgtatgttcaggcggtgccgccgacggatctgaatcggaacacggagcggttcacgtaccccggtgtgtggaccacctacatcctaatattgttcttctcgtggctgattgtgctttccgttttcggctgttctcctggcatggcatggaccattgttcatatcacccattttcctcgttacttatcacttctttcactggaagaagggaacaccgttttcagaagaccagggtgtctacaataggttgacttggtgggagcaaatagaaaatggcaagcagctgactcgtaataggaagtttttgacagttgtacccgtggtgctgtacttaatagcctcacacacaacagattatcaacatcctatgctcttcttaaacacactagctgttttcattctggtagttgccaagttcccacgtatgcacaaggttcgcatctttggaataaatgccgatcaatgagctgagatccatcagcccccatgttactggcatttatatttgcagcattttggtgtatttgcaatactgcaaagttggaaaaggaccgaactatacatcactttgtgaaatactaagatctacatcagatgtcagaatccttgtatg

SEQ ID NO: 2620 - DNA, 866 bp, Chrysanthemum coronarium
gcggagtagtaataaaaagcaatcaaatcatcgttgtcaacgaaaggaagcgagagaaggagcactaataatcgatccatcatcgccaacaaccataaccataaacaacaactaatctgaatctaatctaatattcataatagaaaaaagaaaggttgttattgtatggcaaatctgtatgtacgggcggtaccaccaacagatctgaatcgaaacacggagtggtttacatacccaggcgtatggacgacttacattctcatcttgttcttttcttggctcgttgttttatccgtctttggctcttctcctggtatggcttggaccaccgtcaaccttcttcacgccttgttgacataccagttcttccactggaaaaagggaacaccttttgctgatgaccagggtatctacaacaggttgacatggtgggagcaaattgatagcggcaagcagctcactcgcaacaggaagtttcttacacttgtccctgtcgtgctgtacttgatagcttctcatacaaccgactaccagaacccaatgctgtttttcaacacagtggcagttttcgttcttgttgttgccaagtttccaaacatgcataaagtccgcatatttggaatcaatgctgaagaatgaagctttctaaattggatacgaactcaattgtgcccataactatacacgcgtctgtaatgttaacattttaaaagggtgcctgctgtcttttgaaccggaagaattgatatattaattttattttttcctgttgggctatgttcttaattcctttccctttgcaaattcatttaataccgttttcttttacaactttatgatacctttgtaacggattcgtagttatt

SEQ ID NO: 2621 - DNA, 1262 bp, Cichorium intybus
gggtaaatttttaattgttaagactaaaatatgattttggcacccctcatggaccgaaaacgtaatttactttttttttttggaaccggaaaacgtaatttccttttaatttgattaaacaagaagcagtgggtagcaaccaaaattaattgctattcgatgcattttgactttttgttagctttgtccttgttaatcgatcaccacattttgcaaaagcatcaccatcagccctcaccagccctgttccgtcacgagagagagtttttggttcgtaacgttctcttggttttctggggtacaactttcgtgggattttggattgaatcattcattcaatttgggaacaactgcttctcaacctctccatttcatcaaggaaacttggtgaactttataataatcacagaagaaagtcaagaagatgtacgtgaaggcgacgccgacgacggatctgaacagaaacaccgactggttcacgtacccaggagtctggacaacctacatcttgatcctcttcttttcatggcttctcattctctccgtttctggttgcacccctggcatggcctggaccatcgttaatctctcccacttcctggtcacttatcactttttccattggatgaaagggactccatttgctgaagaccaagggatttataacaggctgacatggtgggaacagatcgacaatggaaaacaactcactagaaacagaaagttcttaacagtcgtacctgttgttctgtacttgatagcttcacacactacagactaccagcatccaatgctatttctgaacacagttgctgtgactgtgcttgttattgccaagttcccaaatatgcataaagttcgaatctttggaatcaatggagatatgtgatgtgattggctgatttggctaatgctattggttggttattcatgatgtttggaaaagcttcaatcctttgtactgaaacgggtaatataagtgaagaagatttgaaattgaaaggtttgtcttgttatgtatcatttttgtttatgtgcctttggtgttctacaaatacactcgttcatattgaaaaaataaacatgaagaaagattcacctctgtatagtggaactttactgtatcatggggattcacatttcatgtttatattgttgtctttatatgatttgaaaggatttggaatatgtcaaaggatttgggatttgaaggaattgaatattaggacatttggttgacaaaagatggaacggaattcaat

SEQ ID NO: 2622 - DNA, 1077 bp, Cichorium intybus
gggtaaatttttaattgttaagactaaaatatgattttggcacccctcatggaccgaaaacgtaatttactttttttttttggaaccggaaaacgtaatttccttttaatttgattaaacaagaagcagtgggtagcaaccaaaattaattgctattcgatgcattttgactttttgttagctttgtccttgttaatcgatcaccacattttgcaaagcatcaccatcagccctcaccagccctgttccgtcacgagagagagtttttggttcgtaacgttctcttggttttctggggtacaactttcgtgggattttggattgaatcattcattcaatttgggaacaactgcttctcaacctctccatttcatcaaggaaacttggtgaactttataataatcacagaagaaagtcaagaagatgtacgtgaaggcgacgccgacgacggatctgaacagaaacaccgactggttcacgtacccaggagtctggacaacctacatcttgatcctcttcttttcatggcttctcattctctccgtttctggttgcacccctggcatggcctggaccatcgttaatctctcccacttcctggtcacttatcactttttccattggatgaaagggactccatttgctgaagaccaagggatttataacaggctgacatggtgggaacagatcgacaatggaaaacaactcactagaaacagaaagttcttaacagtcgtacctgttgttctgtacttgatagcttcacacactacagactaccagcatccaatgctatttctgaacacagttgctgtgactgtgcttgttattgccaagttcccaaatatgcataaagttcgaatctttggaatcaatggagatatgtgatgtgattggctgatttggctaatgctattggctggttattcatgatgtttggaaaagcttcaatcctttgtactgaaacgggtaatataagtgaagaagatttgaaattgaaaggtttgtcttgttgtgtatcatttttgtttatgtgcctttggtgttctacaaatacactcgttcatattgaaaaaa

SEQ ID NO: 2623 - DNA, 690 bp, Cirsium arvense
tcaccacagagcacaccacagcagaccagaccagaccatcggcaacaactacaccacgactcattccaactcacacacgacggacctaagtttccaccactctttccatcaaaagctcgacccactgcgccgattcatggccaatttgtatgtgcaagcggagccgccgacggatctgaacaggaatacggagtggttcacctaccccggcgtctggaccacctacatactcatcctcttcttcgcttggcttgttgttctctccgttttcggttgttctcctggcatggcttggaccaccgtcaatctatctcacgctctgttaacataccacttcttccactggaaaaagggaacaccttttgctgatgaccaaggtatctacaataggttgacctggtgggagcaaattgatagcggcaagcagctcactcgcaacaggaagtttattactcttgtccctgtggttctgtatttaatagcgtctcacacaacagactaccagaacccgatgctgctgttaaacacggtggcggttttcgtgctagtcgttgccaagttcccgcacatgcacaaggtgaggatatttggaatcaatgctgaagagtgaagctatctctatacacatgcagtctgtaattttaacatcttaaaagggtgggaacaggattaaatggtatattaattttt

SEQ ID NO: 2624 - DNA, 822 bp, Taraxacum officinale
accacattttgcaaatatcacaatcagccctcaccagccctgttccgtgacgagaaagtttttggaggcacatctttcgtgttcattcgatttgggaataactgctctccgtttcatcaaggaaatcttggtgaaattgataataatcacagaagatgtacgtgaaggcggcaccgacgaccgatctgaacagaaacaccgactggttcacgtacccaggagtatggacaacctacatcttgatcctcttcttttcatggcttctaattctctccgtttctggttgcactcctggaatggcctggaccatcgttaatctctcccacttcctcgtcacttatcactttttccattggatgaaaggaactccatttgctgaagaccaaggaatttacaacaggctgacatggtgggagcagatcgacaatggaaaacagctcactagaaacagaaagtttttaacagtcgtccctgttgttctgtacttgatagcttcacacacaacagactatgaacatccaatgttatttttaaacacagttgctgtgattgtgcttgttattgccaagtttcctaatatgcataaagtcagaatctttggaattaatggagatatgtgagtgatatggtatgaaatatgaataggttgttcatcatgtttgggagttcttcactcctttgtactgaaacgggttatataagtgaagattggaaaggttattattttttttatgtaacatttttgtttatgtgcctttctgttctacaaatgcactccttgatgttaaaaaaaaagaaataaacatgaaagattcacctcgc

SEQ ID NO: 2625 - DNA, 899 bp, Echinacea purpurea
ggccgggggaatttccacaatcacaagcaaattttcggtcgacaacgtttctttccgttttagggcaaaatcccatctcttttcgtaatctaatcgttcaatcaattcgggaaaaacccactgatcagaaccccaattcatcatcaattaagatcttggtaagaagctgattacagtcagaaaagatgatgtacgtgaaggcgacacccacaacggatctgaatcgaaacaccgattggttcacgtacccaggagtatggaccacatacatcttcatcattttcttttcatggcttctcattctctccgtcgtcggttgcacccctggaatggcctggaccatcgttaatctcgcacattttctcgtgacttatcactttttccattggatgaaagggactccatttgctgaagatcagggaatatataacaggctgacatggtgggagcagatagacaatggcaagcagctcaccagaaacagaaaatttttaactgtggtacctgtagtgctgtacttgatagcctcacacactaccgattatcagcatccaatgttattcttcaacacagttgctgtgattgtgcttgttatcgccaagtttcccaatatgcataaagttcgaatctttggaattaatggagacatgtgacagttgattacagttggtaagtttggacctttgtattgaaaccgggtagtatcaatgtatagtaagttaatgttagcatgtggaggttttcttgttatttaccatttttgtttgtgtgacttggggatcaacaagtgactgctgcatattgcaaataaagcttactgtatattgggcatttacatcacccttatatgttttgagcgttcatatcttgcttccatgttgaagggatatgggccggat

SEQ ID NO: 2626 - DNA, 792 bp, Vitis vinifera
cattcttccataaatacgtggcctgaagctgcttccagaaaacgacgccgtttcaacctctaatggcgaagctctacgttcaggccctgccgccaacggatctcaaccggaacaccgagtggttcacctaccccggcgtctggaccacctacatcctcatcctcttcttctcttggctcgtcgtcctctccctccttcgctgctcctccggcgccgcctggaccattctccacctctcccatttcctggttacttatcactgctttcactggaagaagggaacaccattcgcggatgaccagggtatctacaataggctaacctggtgggagcaaatagacagtgggaagcagctcactcgcaatagaaagtttctcactgttgtgcccttggtgctgtacttaatagcctcgcatacaaccgactaccaacaccccatgctgttctttaatacactggcagtttttgtgctagtggttgccaagttcccaaacatgcacaaggtcaggatatttggaatcaatgcagatcactgaaccagggtccagatgaaggatgcaatctcagatttactgaaacaaggttttgatcactttgggttaaaaatctaatgctaatatcctgtacagatgcctgatctggaaagggtattatatttttttccctttcaaagtgaagattttttatgtgtactgctctctggtagatcctggaaataacatgtgagttgttgattgtattccacctttgttactagttccaaatgatgaaatccatagctgttctttaatc

SEQ ID NO: 2627 - DNA, 751 bp, Guizotia abyssinica
atcatcaccaataccatcgccgttgccagttaccatcagcaacagcaacagcaacagcaagcctcttccagtccacaccttccgacctactttacaaatgcccagcttgtatgtccaagcggagcctccgacggatctcaacagaaacaccgagtggtttatgtatcccggcgtctggaccacctacatactcatcctcttcttctcttggctcctcgttctcgccgtcaccggctgttctcctggcatggcttggaccaccgtcaatctctctcacgctatcattacatatcacttctttcactggaagaagggaacaccttttgctgatgaccagggtatctacaacaggttgacatggtgggagcaaattgatagtggcaagcagctaactcgcaataggaagtttcttactgtcgtacctgtagttctgtacttgatagcatcccacacaaccgactatcaaaacccgatgctgttcttgaacacattggcggtttttgtgctagtgattgccaagttcccaaacatgcataaggtccggatttttggaatcaacgctgaagcgtgaaaaagcgtcctgtttagttcagtttcgtacatgaatatatgtaagtcgttaattttgatatatgtcgacagttaaaaggtacggaactggtacaagggtatatgaaagtttctttttttgtcgtctttttcccttgtgtatgtgggatgtccagaaatatatataaaaaagaattcttgg

SEQ ID NO: 2628 - DNA, 1086 bp, Lactuca sativa
tagcatttgaaatattaattgctattagatgcattttgacttttcataggctagtttaggtgttagctttgtccttgttaatcgatctccacattttgcaaaaaatatcacgatcaggatcagccctcatcagcccctgttccgtcacgagagagagtttttggttcgtaacgtctcttggtgtttttcgaggcacatcttccgtgggatttttgattttaatcattcatttgatttgggaataactgcttctcatcttctccatttcatcaaggaaatcttggtgaagttgataagaatcacagaagatgtacgtgaaggcgacaccgacgacggatctgaacagaaacaccgactggttcacgtacccaggagtatggacaacctacatcttcatcttgttcttttcatggcttctcattctctccgtttctggttgcacccctggcatggcttggaccatcgttaatctctcccacttcctcgtcacttatcactttttccattggatgaaagggactccatttgcagaagaccaagggatttacaacaggctgacatggtgggaacagatcgacaatggaaaacagctcactagaaacagaaagtttttaacagtcgttcctgttgttctgtatttgatagcttcacacacaacagattaccaacacccaatgctgtttttaaacacagttgctgtgattgtgcttgttattgccaagtttcctaatatgcataaagtcagaatctttgggattaatggagatatgtgagtggtattaataggttgttgttcaatgttcatcatgtttggaagttgttcactctcctttgtactgaaacgggtaatataaagtcaagattggaaaggttatcatttttgtttatgctgctgcattcctgttctacaaatgcactgattgatattgaaaataaaaatgaaagattcacctctgtatagtggaactttattgtatcttggagattcatttctgtgttttcttcatcttcaaaaagttgacttcatataattatgtttggctctttttttttttacaatgatcagtcacaggcaccattgcaaga

SEQ ID NO: 2629 - DNA, 896 bp, Olea europaea
ctcaaaagagccaaattaattggcttgagccgttgaatgatcaaatcccttattcaaccttctaccgccctagttgtattcccacaattgtcatttgcttttgctttgcatatgaatcaaattcctgctactcttctcagcgttaaacagtttcgattcataaattttgaggaaaagtaagacagttgaattataaggatcaaatttgaaatgccaaatttgtatgtacgagcggtgccgccgacggatctgaatcgaaacacggagtggttcacttaccccggcgtatggattacctacatcctaatactgttcttctcgtggctgatggtgctctctgttttcggttgttcttccggcatggcctggaccatcgtccacctctgccatttcatcgttacatatcagttctttcactggaagaagggaacaccatttgcggaagaccagggtgtctacaataggttgacttggtgggaacaaatagaaaatggcaagcagctcactcgcaataggaaattcttgactgtggtccctgttgtgctgtatttgatagcctcacatacaacagactatcaacatcctatgctcttcttcaacacgttagcagttttcattctggttgttgccaagttcccacatatgcataaagttcgtatatttggcatcaatgccgatcaatgatccatttgctattccagtgcagttttagcgtcatctacaatatttacatctttatggtatgctgaatagttttcgcatgaaccctccttgtacaagttgaatttgataattatgcataagcaacaaaaattttctcatttctgattgtatacgatatatgcagaaacttatgtagctatgtttttacaaacactggaactggatgtttatat

SEQ ID NO: 2630 - DNA, 942 bp, Lippia dulcis
attctcattttatattagaaaaaaaaaagcgaaagtttatctacaaaaccgcgagacagaaagcaaaaggagagtaacaaacacgccacaaagaggtttcgaggcgcagttaattcccaccaaattatccatctcaaaggagggggaaaaaaataaacaagaattcctgcaatcgcaatctgaaatctcgatcactgcgctcgatcagttggggtcggatcgcaatcgggttttcgagaatgatggggaagctgtatgtgcagatgcagccgccggcggatctgaacaagaacaccgagtggtttacctacccaggggtttggactacgtatattttgattctcttcttctcctggctcatcgttctcagtgtcaccaattgtacgcctggcatggcgtggacaatcgtcaatctctgtcatttcatggtaacttaccacttcttccattggaaaaaagggaccccttttggtgatgatcagggaatctataatggattgacatggtgggagcagatagacaatggaaagcagctcactcgcaacagaaagttcctcaccgttgtccctgtggttctctacttgatagcttcgcacacaacggactaccaacatccgatgttgttcttcaacacactcgcagtgctcgtgttggtcattgctaagttcccgaatatgcacaaggtccgcatctttggaatcaatggagatcagtgaactatgagctctttgtgcttttataacttaagtaccaaactgagaatccttacaaatttctgtaaagatgttgatgtcccttcggtgtatcgaagctagaactgatgagtatattttggtaatgcagtatgctttcacaagcctcatccaaattgtagcaataaatgtaatgagttgtatttgtacagtagaaactttatatacttccaagagactattgcctgcc

SEQ ID NO: 2631 - DNA, 898 bp, Helianthus annuus
atcgtcaacgagcaataatcaaaatccatcacgcccgatacacacaaaaaccagaccatcgtccccaacttcacagatcattcatacattctcactgcacatacacatacacatacacatggccaatttgtatgtgcaagccgagtcaccaacggatctgaacaaaaacaccgagtggttcacctaccccggcgtctggaccacctacatactcatcctcttcttctcttggctcgttgttctctccgttttcggctgttctcctggcatggcttggaccatcgtcaatctctctcacgctctgctgacataccagttcttccactggaaaaagggcacgccttttgctgatgatcagggtatctacaacaggttgacgtggtgggagcagatcgatagcggcaaacagctcactcgcaacaggaagtttctcactcttgtccccgtggtcttgtacttgatagcatctcacacgacagattaccagaacccgatgctgtttttcaacacagttgcagtttttgtgctagttgttgccaagtttccaaacatgcataaggttcgaatatttggtatcaatgctgaagagtgaagctttttctgttcaattgctttgcttcacacgtttctgtaattctaacatcttttatttggaaccggacaactggtatattaattttattttattttatttttaaagacaataactacaaaaacatgtgaacacaaacatgaagattagaaaaaaaaaagagaaagaattagaaatggtctaccgaaatccgcacgaccaacaaaaaaaaaaagttttccggggccccctgggcccatcgattttcaaactcgaccatttttttgttgggggcccaattcccacccctgggaatgggcccctttt

SEQ ID NO: 2632 - DNA, 831 bp, Helianthus annuus
acgagcaataatcaaatccatcacgcccgatacacacaaaaaccagaccatcgtccccaacttcacagatcattcatacattctcactgcacatacacgtacacatggccaatttgtatgtgcaagccgagtcaccaacggatctgaacaaaaacaccgagtggttcacctaccccggcgtctggaccacctacatactcatcctcttcttctcttggctcgttgttctctccgttttcggctgttctcctggcatggcttggaccatcgtcaatctctctcacgctctgctgacataccagttcttccactggaaaaagggcacgccttttgctgatgatcagggtatctacaacaggttgacgtggtgggagcagatcgatagcggcaaacagctcactcgcaacaggaagtttctcactcttgtccccgtggtcttgtacttgatagcatctcacacgacagattaccagaacccgatgctgtttttcaacacagttgcagtttttgtgctagttgttgccaagtttccaaacatgcataaggttcgaatatttggtatcaatgctgaagagtgaagctttttctgttcaattgctttgcttcacacgtttctgtaattctaacatcttttatttggaaccggacaactggtatattaattttattttttcttgctcggctatataatttttttttcttttcttttctgctgcatatccgaattgttgttttctgtataatattacaatgtattaggtgatctgacccagttacttgaaattgttaccaaacctgtttactcacacatgagttaaatatataaatatc

SEQ ID NO: 2633 - DNA, 821 bp, Artemisia annua
tactccaacggggacagataccatcgccaacaacaataataaccataacaactaataataaaaaaaagatattgaaaagagttgtatggcaaataattatctatatgtgcgagcggtaccaccaacagatctgaatcgaaacacggaatggttcacatatccaggcgtatggaccacttacattctcatcttgttcttttcttggctcgttgttctttccgtctttggttgctctcctggtatggcttggaccaccgttaacctcgttcacgctttgttgacataccagttcttccactggaaaaagggaacaccttttgctgatgaccagggtatctacaacaggttgacatggtgggagcaaatcgatagcggcaagcagctcactcgcaacaggaagtttcttacacttgtccctgtcgtgctgtacttgatagcttctcatacaaccgactaccagaacccgatgctgtttttaaacacattggcagttttcgttcttgttgttgccaagtttcctaacatgcacaaagtccgcatatttggaatcaatgctgaagaatgaagctttctaagaatggatacatgttcaattgtgcccataactatacacgcgtctgtaatgttaacatcttaaaagggtaccctgctgtctttgaaaccggataaattggtatattaattttattttttcctgttgggctatattcttttttccttttcctgcatatccatttggtaatgtttttgttacaactttatgaaaaacccttgtaacggattcatagatatctgaggtgacaatctatttagactttgct

SEQ ID NO: 2634 - DNA, 1016 bp, Chrysanthemum coronarium
tcatcaattgatcatcatcgtcaacgaaaggaagcggggggcagaaataaaaatcaatcagagaacaataccatcgccaacaaccataaccataaacaactagctaataataatttgataattggggaaagttggttgtatggcaaattatatgtatgtgcgagcggtaccaccaacagatctgaatcggaacacggaatggttcacatatccaggcgtatggaccacttacattctcatcttgttcttttcttggctcgtttttctctctgtctttggttgctctcctggtatggcttggaccaccgtcaacctccttcacgctctgttgacataccagttcttccactggaaaaagggaacaccttttgctgatgaccagggtatctacaacaggttgacttggtgggagcaaattgatagtggcaagcagctcacccgcaacaggaagtttcttactgtcgtacctgtagtgctgtacttgatagcatctcacacaactgattatcaaaatccgatgctcttcttaaacacacttgcggtttttgtgctagtgattgccaaattcccacatatgcataaggtccggatttttggaatcaacgctgaagaataagtgaccagtcatgaagcagatactagttcagttccatccatgaatatatgtgcatccttaattttgacatatcataacaattaaaggcagggaactggtaaaacggtaaattatctttttctgtcttcgtcccttttcccgttgtgtattgtgaatgatccaagaaatatgaaaaaggaatcgacttgactcacctggacagtaaaaaggaatcttatgtttggtgcttgagctttgcatgtagacatgctacaaagcattaaatgtttaattttggtgtcggtaagctatgaatgttatctaaagaaccacaacgtgagtaggaacttgggtatgtacgaagtctatgctatatactttggtaatttagatgtaatcaatggtgaagcatataatcgct

SEQ ID NO: 2635 - DNA, 646 bp, Cyclamen graecum
atataatctcccccataaccaaatcaaatacctagaaccgaaaatcagagtaatagaatggcgaaattgtatgtgaatgcggtgcagccggtggatatgaaccggaacacggagtggtttacgtaccccggcgtgtggaccacatacatactgatcctcttcttcgcgtggctcatcttcctctcgctcttcgcttgctcccccggaatcgcctggtccattgtcaatctctcccatttcgccgttacttatcactttttccactggaagaaaggaactccctttgctgacgaccaggggatgtataatgcattaacttggtgggagcagatcgacaatggaaagcagctcactcggaatagaaagttcttaaccgttgttcccgtggtgttatacttgatagcctcacacacgactgattaccagcacccgatgctcttcttcaacactctggcagtgattgtcttggtgattgctaagtttccaaatatgcacaaggtccggatctttgggatcaatggagaagatcagtgatctgaatgcaacgccaatgattccgttgtactgctgtaaaaccttctgatcattcctttgttaatgcttattcgaaatgttatatccgtatatagaagtcggaagtaccaga

SEQ ID NO: 2636 - DNA, 771 bp, Antirrhinum majus
agtgagaaaaaagacgagatccagcccaggcttccatcgttagcaacaattaatcagctcaagcaatcaagatgatggggaagcagctgtacgtgaaaatggcgcctccagcggatctgaatcggaacacggagtggttcacataccctggtgtctggactacctacatattgatcctcttcttctcctggctcgtcgttctctctgtttccaattgtacccctggaatggcctggaccatcgtcaatctctctcatttcctcgtaacctatatcttcttccattggaaaaagggaactccttttggtgatgatcagggtatttacaatgggctgacatggtgggagcagatggataatggaaagcagcttactcgcaacagaaaattcattacagttgttcctgtggttctctacttgatagcctcacatacaactgactaccaacacccgatgctgttcttcaacacgcttgctgtgattgtgttagttatcgctaaattccctaatatgcacaaggtcagaatctttggaatcaacggcgagcagtgaatccagtaactccattgggattcagttggtttttttagcttaaagagcctctgtatttgctatatttagagataagtctatacccctgtatagaagttggaacttgttgagtgagtatatttggttgcttggtgcactcctccgtatgttttgtggccccgtataatcatacataaccgcaagcgctgtctcagccaaacttcccccctctcccccaccc

SEQ ID NO: 2637 - DNA, 956 bp, Olea europaea
catcgaaacttacgatgctgactcattgaatcatttgcatttgatcaattctaggtttattgtcagagaaaaggaattgaataattagcagtgcagtgcaaaatgatcggcaagctgtacgtgcagacggtgccgccggcgaatctgaaccggaacacggagtggttcatgtatccaggagtatggaccacatacatattcatactcttcttctgctggttgctcgttctctccgtttttaattgcacgccgggcatggcatggaccgttgttaacctctgccactttgtcgtaacttatcacttcttccattggaaaaagggaactccgtttgctgatgatcagggaatatataataggttgacatggtgggagcagattgatgatggaaagcagctcacccgcaatagaaagttcctaacagttgtacccgtggtgctctacttgatagcctcacatacaactgactaccaacacccaatgctcttcttcaacacacttgcagttcttgttctagttgttgccaagttcccgaatatgcataaggtccgaatctttggaattaatggggatcagtgacttgatcccttttgtatcaagggcctgtttgattttctgtatgggacggcgctttataggactagagacaatattaactccttttcgtcctaaatcctatccagtgctatttgtccgacatatcaaacacggctgtacaaaaatatgtctggtccccattatactgcaaaaagggtaatgcctgtatagaagttgaaactgaaacttacatctggtttgtaatagaatgtggtttgctctacagacttattagcttgtgtatttatgattattttgattttaccggctggcgtatttgagcatactgcgttgctcattatgttcggaaactagacttgcctaggaagatcaagtcgatatgtatgaacttccttttt

SEQ ID NO: 2638 - DNA, 898 bp, Musa acuminata
cttccgttctatttattgttttctggtcgccgacggagaagagcgaacgaaatcaacgccctaaaagtccaattccaacgcctttgacccgaatcgctcatcgtcctcgatctatattagtccccactcccccttcgcttcttgatcgctcgcgctttctacctctgccttggcttggagtcgggagcagagctcgagaggggaacctcagggcgacagcgatggcgaagctctacgtgcacacggtgccgccgccggatctgaacaagaacacggagtggttcatgtaccccggcgtctggaccacctacatactcattctcttcttttcctggctccttgtgctctccgttttcggatgcaccgccggcatggcctggaccgtcgtcaacctcttccacttcgcggttacctattacttcttccattggaaaaagggtactccctttgctgaagaccagggtatctacaataacttgacctggtgggaacagatggataacgggaaacaactaacacgtaacaggaagtttttgactgttgttcctgttgtcctgtacttgatagcctcgcacacaaccgactaccaacaccctatgcttttcctgaatacagtttcagtagctgttttggtgattgccaagttcccaaacatgcacaaggttcgcattttcggaatcaacgggtaagcagcacctcacatgaaagattacttggtcgtgatcttttttcatcgatcgctggatcgataagtagaccttatacacctagtagataaaacctaatcctgcatcgatgcatggtgccaaagtcatggtttgtgattgtgtacagaactactaaagaatgtagaagcggttgttgtgttgctttttgctatctgtattctatctatgaa

SEQ ID NO: 2639 - DNA, 896 bp, Chrysanthemum coronarium
gaaagaaagtaataaaaataaattaatcaaagcatcgttgtcaacgaaaggaaggaagcgagagagagaggaaaaccaataaccgatccatcatcgccaaccataaccatcataaacaacaactaatctgaatctaatctaataaattaaaaaagagaaagaaagttgttaattgtatggcaaatctgtatgtgcgggcggtaccaccaacagatctgaatcgaaacacggagtggttcacctacccaggcgtatggacgacttacatcctcatcctcttcttttcttggctcgttgttctctccgtcttcggctgctctcctggtgtcgcttggaccaccgtccaccttcttcacgccttgttgacataccagttcttccactggaaaaagggaacaccttttgctgatgaccagggtatctacaacaggttgacatggtgggagcaaattgatagcggcaagcagctcactcgcaacaggaagtttcttacacttgtccctgtcgtgctgtacttgatagcttctcatacaaccgactaccagaacccaatgctgtttttcaacacagtggcagttttcgttcttgttgttgccaagtttccaaacatgcataaagtccgcatatttggaatcaatgctgaagaatgaagcttttctaaaatggatacaagctcaattgtgcccataactatacacgcgtctgtaatgttaacattttaaaagggtacctgctgtcttttgaaccagaagaattgatatattaattttattttttcctgttgggctatgttcttaattcctttccctttgcaaatccattgaataccgttttcttttacaactttatgatacctttgtaacggattcgtagttatttgaggcggcaatctgttt

SEQ ID NO: 2640 - DNA, 1205 bp, Cocos nucifera
gggtaccgagccaacgcaccgctgaagtacctccaaccgcgtctcctagacggcccaagagatgcctgttcgtctggacagtcgtcaacctgattccattcagacggcacgctggatttttgactttaaaccaaaagttagaagtcaaccttttgaccattccccgtctcccgatctccacgctttcctcttctcctctctgaattattctcttcttctcccctcgcattaaatcctacacctctcttctcttcttctccacacgcaccgtctctcagttgttatatagaagaaagattggagctttttggatagagagagctagagagaaaagaggaggaatggcgaagctctacgtgcaggcggtgccgccggcggatctgaacaagaacacggagtggttcatgtaccccggggtctggaccacctacatccttatcctcttcttctcctggctcatggtactctctgtcttcggttgtacccctggaatggcgtggaccgccgtcaacctcttccatttcgctgttacttatctcttcttccactggaagaagggaactccctttgccgaagaccagggtatgtacaattctttgacttggtgggagcagatggacaatggccagcaactgacacgtaataggaaatttttgaccattgtgcctgtgatcctgtatttgatagcttcccacacaactgattaccaaaatccaatgcttttcctcaacacacttgcagtattagtgctggtagttgccaaattcccaaacatgcacaaagtccgcatctttggaatcaatgcagatcattgaacagcattgcacatgaaataagatatcttacccgatatctcttttggttgataaagcgatccttacacaatatattgtccgacggcatccagttccgcatcaagtcatcgaaagtctcagtagatgttcttgttatccctttacaaaacagtcagaaagtaagaaattgtatttgtgctactcatgatatatttaagctatttgtagactctatgttatgtttcatccgtctgattatgagaatcatttgaactattcctcttctttgtaggcaactttctttgtcccccttggatgattctatttgttgtctcgcaatgataggatgttgcttttcctcagccactaaaatatttctgattgttgaatgatgttaaacatttaaaccag

SEQ ID NO: 2641 - DNA, 487 bp, Aquilegia formosa
caatcaaatggcgaaactatatgtacaaacagttccaccaccagatctgaacaagaacacagagtggttcatgtacccaggtgtttggacaacatatatattgattgtcttctttgcatggctcatggttttatctgtcttgggttgcactcctggtatggcttggactatcgtcaatctttgtcatttcgctgttacttatcatttctttcactggaagaagggaactccatttgctgaagaccagggtatatataatgggttgacttggtgggagcagattgacaatggaaaacaactcactcgtaatagaaagtttttgactgttgtacctgtggtcttgtatttgatagcttctcacacgacagactaccaacagccaatgctcttcctcaatacactagcagtgttcatactggtcgttgccaagttcccaaacatgcacaaggttcgtatatttggaattaatgcagaccagtgaggatta

SEQ ID NO: 2642 - DNA, 732 bp, Musa acuminata
atggatgaaggggttggcctttgccgtctgatctcttccgttctatttattgttttctggtcgccgacggagaagagcgaacgaaatcaacgccataaaagtccaattccaacgcctttgacccgaatcgctcatcgtcctcgatctatattagtccccactccccctacgcttcttgatcgctcgcgctttctacctctgccttggcttggagtcgggagcagagctcgagaggggaacctcagggcgacagcgatggcgaagctctacgtgcacacggtgccgccgccggatctgaacaagaacacggagtggttcatgtaccccggcgtctggaccacctacatactcattctcttcttttcctggctccttgtgctctccgttttcggatgcaccgccggcatggcctggaccgtcgtcaacctcttccacttcgcggttacctattacttcttccattggaaaaagggtactccctttgctgaagaccagggtatctacaataacttgacctggtgggaacagatggataacgggaaacaactaactcgtaacaggaagtttttgactgttgttcctgttgtcctgtacttgatagcctcgcacacaaccgactaccaacaccctatgcttttcctgaatacagtttcagtagctgttttggtgattgccaagttcccaaacatgcacaaggttcgcattttcggaatcaacgggtaagcagcacct

SEQ ID NO: 2643 - DNA, 985 bp, Cirsium arvense
attttctgatatatataaatcttggatactgattttaattatcagttgagattggtaaagagaagacaacgatttgatataatatcaagttgtggatttctattcggtgcctcgatagaaattgttcctatttgaattatctcaatctgaatttcgtgtaacccgggtatagggtcgaaatattagattcgaaaagtgaccttacacgatccaaatatttattccgatcaaatttctgatttcagaaacatcacccccctcccaaattccccaacaacatctattcgactcttgtcaaattctcatctgccagatgatattcgggaaaaagaaaataaaaaatttagagagaagggttcatttgaatttttgggtggcacatccttcccaatcgatcacaacatttttgcaaattttccaccgtcaaccctgatcataatccgatttcatcaagaacatcttggtgaagttaatagtgatttaatcacggaagatgatgtacgtgaaggcgacaccgacgacggatctgaatcgaaacacggactggttcacgtatccaggagtatggacaacctacatcttgatcttattcttttcatggcttctgattctatcggttattggttgtacccctggtatggcatggaccatcgttaatctctcccatttcctggtcacatatcactttttccattggatgaaaggcactccttttgctgaggaccaggggatgtataacaggctgacctggtgggagcagatagacaatgggaaacagcttactagaaacagaaagttcttaaccgtcgtacctgtcgtgctgtacttaatagcctcacacacgactgattaccagcatccgatgctattcctcaacacagttgctgtacttgtgctggttatagccaagtttcccaatatgcataaggtccgtatcttcggaattaatggagatatgtgaccgttgattgatgctgattactca

SEQ ID NO: 2644 - DNA, 877 bp, Cynara scolymus
aattcttatatggtggatgatatttaggaaaaccaaaagaaaattgagagagaagggtcatttgaaattttgggtggcacatccttcccgatcgatcaaaacatttttgcaaaatttccaccgtcaaccctgatcataatcccatttcatcaagaaaatcttggtgaagttgatagtaatcacggaagatgatgtacgtgaaggcgacaccgacgacggatctgaatcgaaacacggactggttcacgtatccaggagtatggacaacgtacatcttgatcctgttcttttcatggcttctgattctttcggttattggttgcacccctggcatggcatggaccatcgttaatctctcccacttcctggttacatatcactttttccattggatgaaaggaactccgtttgctgaagaccaggggatgtataacaggctgacctggtgggagcagatagacaatgggaagcagcttactagaaacagaaagtttttaaccgtcgtacctgtggtgctgtacttaatagcctcacacacaactgattaccagcatccaatgctgttcctcaacacagttgctgtacttgtgctggttattgccaagttccccaatatgcataaggtccgtatcttcggaattaatggagatatgtgaccactgactgatgctgatcactcatcaagtttggaacccctccccccttctctagttcttaactctttttgttctgaaatgggtaatatcactgtatagtaagtcaagatgggaaaaagggtatctgctgtgtaccattttgtttctctgccttcctgtctacgagataccaaaaatacatgatgagtcatcttgtatagtggaagttactgcatttcagg

SEQ ID NO: 2645 - DNA, 954 bp, Solanum melongena
tcaaaaagaagcagagatgaaagccccctctacggcacggcggtcccaccatccttaccaatagcaggcgccaggcagctattcgtcctggttttgttgatcaaatgcgacattaatcgccatattcacctgattcacaaagtttttcttcaaattttatttgtatcgatttgttctttgtcttatttatatacatagattttgttgaagtatttttggatggcgaatttgtatgtgagggctgctccaacgacggatctgaatcggaatactgaatggttcacgtatcctggagtctggactatttacatattcattctcttattctcctggctcgttgtgttgtctgtttttggctcttcatatggcatggcctggactatcgtcaatctttcgcatttcattgtcacatatcactgttttcactggaagaagggaacaccattcgctgacgaccaaggtatatacaacagattgacatggtgggaacaaatggacaatggcaagcagcttactcccaataggaagtttctgacagttgttcctgtggtgctgtacttgatagcttcccatacaactgattatcaacaccccatgctgttcttcaacacattagctgttttcgtactggtggttgccaaatttcccaacatgcacaaggttcgaattttcgggatcaatgcagatcaatgaacttcaaaacatttagttcagctatagtatttgattgattttacaaaaaaattttgagtaaactgggaattcttgtacaaatgcaagaactgcaaatggtgaaactatatatagtataaaatcaagaaccaatgttggatttgcttagctacattctttatttcgcttttgattatgatttaaaatcaaattgatttgaaattggaattttgtttagatgtatgatttgcatcttaaaaattatatatgtcttctcataac

SEQ ID NO: 2646 - DNA, 1106 bp, Eucalyptus grandis
gggtttcgtccatctctatcttcccaccgatgcccggtctcctccgctgaccattgcccccctcccttcttcctcacgaatctcacccgtcctctccaaaattcgcgattctcctcgatcgattccggcagctcccccgccgatcgcgaatcctccgccgccgcctggagttccttccgtctgcaatccgcggtaagcttggatcgatttccggggaatcggatcggattgaaaggaggcgtaagcgcgagcgaggtagagaatgtacgtgaaggctgtgcctccgacggatctgaaccggaacacggagtggttcacgtaccccggggtgtggacgacgtacatcctcatcctgttcatctcgtggctgatcgtcctctccctcttcaactgctcccccgggatggcctggaccatcgtcaatctctcccacttcctcgtaacttatcatttctttcattggaagaagggcacgccattttctgatgaccagggaatttacaatgctttgacttggtgggaacagatagacagcggcaagcaactcactcgaaataggaagtttttgactgtcgttcctgtggtgctgtatctcatagcctcacacacaacagactataagaacccgatgctcttcctcaacacattggcagtatttgtattggtggtagcaaagtttcccaatatgcacaaggtacgcatatttggaataaatgctgatcactaactggaggcttccaaggtggattattttgggatgtatgagccaatggtgacgtttctgtgctgtgtcagagctgagaactggaagatgtatttttttccctttgcttttaaggatttaatgtacgatgctcctagttacacatcaaacagaaaaagtatattcttattagcccgggtccctaggatgaatgtcttctttctgttaaagacagatatcgggtgaagcttactgctttgctattttgctcccctatcttggggatatttttatcttcatatagcttaatgatgatttttgctttatgatttacttgtcaatgctatgtgctactattatttggaggcgaggaaggttatgatgtacttgctgttaatgggtg

SEQ ID NO: 2647 - DNA, 666 bp, Capsicum annuum
tacaacatatatattacttagatcttattattgttattgaattaattgaatttggatggcgaatttgtatgtaagggctgttccgacgacggatttgaatcggaatacggagtggtttacgtatcccggtgtatggacgacctatatactcatattgttcttttcatggcttattgttctctccttattcggttgctctcctggattggcttggaccactgttcatctttctcattttatcgtcacatatcaatgttttcactggaagaagggaacaccgtttgctgatgaccaaggtatctacaataggttgacttggtgggagcagatagatagtgggaagcagcttacacgcaataggaagtttcttactgttgtccctgtggtgctgtacttgatagcctcgcatacaactgattatcaacacccaatgttgttcttcaacacaatcgcggtttttatactggtggttgccaagtttcctcatatgcacaaggttcgtattttcgggataaatgcagatcaatgagctttgggttccaactgaatacataccacagtaaaagaaaaagtagtactagttgatttgctttatttaagcatcatgactaaaactgggatgcccctctacagatgccaaaactggaaagggtcatcattattttg

SEQ ID NO: 2648 - DNA, 820 bp, Phalaenopsis aphrodite
gagagagagagagagagagagtctccattttttcttcctttttccatctattttcattaggtataagcggttggtcgggaatcgaactgcgattagatggcgaaactctacgcgcagacggtaccaccgccggatctgaacaagaacacggagtggttcatgtatccgggagtgtggactacctacatcctcatcatcttcttcttctggctcgttgtcctctccgttttcggctgcacgcctggcatggcgtggacaatcgttaaccttactcacttcgccgtcacgtaccacttcttccattggaagaagggaactccctttgctgaagaccagggtatctacaacagattgacttggtgggaacaagtagacaatggaaagcaacttactgataacagaaaatttttgacggttgcacccgtggtcttgtacttaattgcctcccatactactgattaccaacacccgatgcttttcttgaatacgatcgccgtgatcgtgctagtcatcgccaagtttccaaacatgcataaagttcgcatatttggaattaattcagaccattagggaagctggaagctggaaactggaaactggaatcatgatctccatatacagcaaaagcaatggaagtggtcagctggtgaagccgagagtagaaagtaaatctggtaagtggtcagtagatgcttgttttgtacaggtagaactactatattatgtactaactatgtttgaactgtgtctagttttgccatggagtttttttttatatttggattttcagattcatgttgctgctttgttttaatatcaa

SEQ ID NO: 2649 - DNA, 504 bp, Platanus occidentalis
tacacgcagtgcctcctcctgatctgaacaaaaacacagagtggttcatgtaccctggtgtctggactacatacatcttgatccttttcttcgcatggcttatggtgctttctgtcttcgggtgcacccctggcatggcttggaccatcgtcaatctttgccatttcgtcgtcacttatcacttctttcactggaagaagggaactccatttgctgaagatcagggtatctataatggattgacttggtgggagcagatggacaatggcaagcagcttacacgcaacagaaagtttttgactgtcgtacctgtggtgctgtacttgatagcctcacacacaacggactaccaacacccaatgctctttttcaacactcttgcagtgtttgtactggtggtggccaagtttccaaacatgcacaaggtccgtatctttggaatcaatgcagaccaatgagttggtgcatgtatgaatattgaatagacgccatggttttccttgt

SEQ ID NO: 2650 - DNA, 1063 bp, Populus trichocarpa
ggcgactcctattggttcgaaccctgcccattcacacctctctctctctcgctctctcaatctttcaaagtcaccatcttgaaaccaaaaaaagaggaaaagccatcatcaaaatctcctcttttttttgactgagtcaccgatactttatattttctaatctgggtctcgtttttccctttgttaaactcattctctaaccttctccaacaacaaagaaaaccaaagaaatgtacgttaaagctgagccaacgacagatgtgaataggaacacggagtggttcacatatcctggagtttggaccacttatatgctcatcgttttcatgtcatggctccttgttctttccatctttggttgttctcctgggatggcttggactattgtccatttctgtcatttcgctgttacatatcacttttttcactggaagaagggaactccctttgctgatgaccagggtatctacaatggattgacttggtgggagcaaatagaaaatggcaagcaactcacacgcaacaggaagtttctgaccgttgtgcctgtagtgctgtatttgatagcctcgcacacaacagactatcaaaatccaatgctcttcttcaacacattggctgtatttgtgctggttgttgctaagttcccaaacatgcacaaggttcgcatattcggaatcaatgctgatcattgaaatgcaaaggaattcatgcttggtttactccggtcattaggattgattttttcacgttccaatgtaatggtaatgtccctgtacagatactgaaactggaagggttattattatatctttctttcttcttttttttcttaaaaaattatggagtgaatatatatatacgtcactaggttacatgcttgaagaaaagtgtatcaacacatttcttcttcgtaccagcagatatatatcatcttattttttactgtttcccctgtatggttagtggttactcaagccatttaataaaatacttcccaagagggatcaaagtgaaactgagcattgatcatggagctgagtctctgggtttgaaagcttaa

SEQ ID NO: 2651 - DNA, 741 bp, Solanum tuberosum
gcacaggggtccaccacccctacccatagcagccagctatcctcctgttcgtgagtctctgttcgtgatcaaatactcagactatgcgatataatcgccatatccattcattcaaagctttttcttcaaatttgtattgattttttttttctaacggttgggttgaaagtattgttcgatccatttggatggcgaatttgtatgtgagggctgctccaacgacggatctgaatcggaatactgagtggttcacgtatcctggagtttggactatttacattttcattctgttgttctcatggctagttgtgctgtctgtttttgggtcctcatcaggcatggcctggactattgtcaatcttgctcatttccttgtcacatatcactgttttcactggaagaagggaacaccatttgctgaagaccagggtatctacaacagattgacatggtgggagcaaatggataatggcaagcagcttactcccaataggaagtttctgacagttgttcctgtggtgctgtacttgatagcttcccatacaactgactatcaacacccaatgctgttcttcaacacattcgcagttttcatactggtggttgccaaatttcccaacatgcacaaggttcgaatttttgggatcaatgcagatcaatgaacttctacattcaatttgaaaaatttagttcaactttactctcagctgtagtatttgagtggtttaacattttgagtaa

SEQ ID NO: 2652 - DNA, 1098 bp, Glycine max
aaaaaccagaatttaacagaaactatgctggcaatgagagagaaaaagaaaaagaagaagagagagagagagaaagagagaagagaggagggtgtgtttctggtttttggaaatttcagcccccatcgaaaaacaagaagccccaacgatagtaatcatcgaaggaatttgaaaggtcgaaacttgagcatctgggatcgcgaaattggggattttggttaaaagggtataatcttcggaactgattgatggcaaaactgtacgtgaaggcggtgccaccggcggatctgaacaggaacacggattggttcacgtaccctggcgtttggaccagttacatcctcatccttttcttttcttggatcctcgtactctctgtcttcggttgttctcctggcatcgcttggaccatcgttaatctcgcacactttgctgtaacatatgacttttttcactggaagaaaggaactccgtttgcagaggaccaagggatctacaatagattgacttggtgggagcaggtagacaatggaaagcagcttactcgtaacaggaagtttctcacagttgttcctttggtgctgtacttgatagcctcacacacaacagactatcagaatccaatgttcttattcaacactgttgcagtgattgtgctggttgttgcaaagttcccccacatgcacaaggtcaggatatttagaatcaatgctgataagtgaaatgttgctgtggccatgacacttggttaccactccttacctgctcaagagcctcttcttgtccttttgttctggaaaaaaaggtcacacatttgtatagaaggcagaattggaaggatactcaagtaatgttttgttgccaactgctttttaagctgcttctaaaagtattattaaacaaataaatatgttgagttatttctgtacagtagagaagtatatgtatctgacatatcggtgcttttaaaatgtacatttcttttctagtcttttttcctttatttgatgacttagaactgtgagatgtacaatgatgatcctttccgttggtattaactttttcttttggaaataatagtccttcttttttataact

SEQ ID NO: 2653 - DNA, 724 bp, Helianthus annuus
cttcacaatcacgcgattcatggccaacttgtatgtgcaagcagagccaccgacggatctcaaccgaaacaccgagtggttcatgtatcccggcgtctggaccacctacatactcatcttattcttcgcttggcttcttgttctcgccgtcaccgcctgctctcctggcatcgcttggaccaccgttaatctctctcacgctctcattacgtatcacttctttcactggaaaaagggaacaccttttgccgatgatcaggggatatacaacaggttgacttggtgggagcaaattgatagtggcaagcagctcactcgcaacaggaagtttcttactgttgtacctgtagtcctgtacttgatagcatcccatacaacggactatgagaacccgatgctgttcctcaacacagtggccgtttttgtgctagtcattgccaagtttcctcacatgcataaggttcgaattttcggaatcaatgctgaagagtgaaaagtatgctgtttacatacaggtgctacttcactttgctgaatatatgtgcattgataattttgacatatcatgacaattaaaagtgtatattaacttttgtttttcatatttatttttccgacgataaaaaacataaagaaattaccttgtaacatgcatataagatagaccattgtacggtttgagaccctttggtatagaagcaacaactaatcttcgagcagtagt

SEQ ID NO: 2654 - DNA, 917 bp, Camellia sinensis
gggggagattggtatggcattgaatgatcagagcttcctcttctccttcccccaaaacctaatccaatccaatccaagccaagccaggccaagccaatccaagcaccacaatcgccgccgccgccgccgccgccatacgaaaagatcaaacagaggaggaggggttcagggaaattgggggattgaaaaatgatgtacgtaaaggcatcgcatccacctgatatgaatcgtaatacggagtggttcacgtatccaggggtttggaccacctacatcttgatcctcttcttctcttggctcatcgttctctccctattcggctgctctcccggcatggcctggaccatcgtcaatctctcccacttcgccgtcacttatcactttttccattggaagaaaggaactccgtttgctgacgaccaggggatctataatgggctgacttggtgggaacagattgaccatggaaagcagctcacccgcaacagaaagttcctcactgttgtacctgtggtgctgtacttgatagcctcacacacaactgactaccaacacccgatgctcttcttcaacactcttgcagtgtttgtgctcgttgttgccaaattccccaatatgcacaaggtccgtatcttcggcattaatggagagcagtgagttgggtctgcactatgaacccttttgttctacttgtgtaaaagcgtcactctttgttcgactaaaatgttatatctctgtatagaactcagagctcgaaaggatatttggatatgtaatgtgtttttcactaacttttttcacaagctgtttttcctagatattgaaggaataattgtatcaagtttttttttgtgtacagtatgatttttgtgtatcaagaggatcacactgctgttatcagcttatctaatatttta

SEQ ID NO: 2655 - DNA, 875 bp, Eutrema halophilum
gtcgtctttcacgggcacacaaaaataaaccaacccatctcatctggaaaaatccttcctcaccgaaagagagaattttgtgaatctgggtttacaattcaggtgaaaactagaaagattttcgtgcggtacccatcacagaaacacgacgatcaatcgatttcttctagattcgatccggtcgaacagaaaaaatggcgaatctgtatgtgaaagcggttccaccgccggatatgaacaggaatacggagtggttcatgtatccaggagtgtggacaacttatatactcattctcttcttcggttggctcgttgttctctccgtctctggttgttcccctggaatggcctggactgttgttaatctcgctcacttcgttgtaacttatcactgctttcactggatgaaaggaaccccttttgcagaagaccaaggaatctacaatggtttgacttggtgggaacaaatggacaacggtcagcaacttacacgcaaccgcaagtttcttaccgttgttcctgttgtcctgtatttgatagcatcacatacaacagattacaggcatccatggctgttcctcaacacgcttgctgtgatggttctagttgttgccaagttccctaatatgcacaaggtacgcatcttcggcatcaatggtgataaataagctttctttaagcttatttccatttcttttatggtaagagaggagaaagaaagaggaagaaaaggggatataagcaaacacatatttgtataaatgttcatatgaattggtttaattcgagagttatgtttgttgggaatttgtaagtaactaattttgaagccttatcttcttcttttctattatggcacgaaattcataatcttt

SEQ ID NO: 2656 - DNA, 914 bp, Solanum lycopersicum
gatgaatttcccctctacggctcagcggtcccaccacccctacccatagcagctacctatcccctcttcgttttcgtgagtctctgttttttcgttgatcaaatactcatactaatgcgatattaatcgccatatccaattgtttcttcttcaagttttgtattgataacttttttcgattgggttgaaagtattgttcgatccatttggatggcgaatttgtatgtgagggctgctccaaccacggatctgaatcggaatactgagtggttcacctatcctggagtttggactatttacatattcattctgctcttctcatggctcgttgtgctatctgtttttgggtcctcatccggcatggcatggactattgtcaatctcgctcatttccttgtcacatatcactgttttcactggaagaagggaacaccatttgctgaagaccagggtatctacaacagattgacatggtgggagcaaatggataatggcaagcagcttactcccaataggaagtttctgacagttgttcctgtggtgctgtacttgatagcttcccatacaactgactatcaacacccaatgctgttcttcaacacattcgcagttttcatactggtggttgctaaatttcccaacatgcacaaggttcgaatatttgggatcaatgcagatcaatgaagtacttcattcaatttgaaattttagttccaactttactctcagctatatagtaagtatttgattggttttaacaattttgagtaaacagggaactcctgtacaaatgcaacaacttcaaagggtgaaattatatatatagtaaaaagattaagagccgatgttgggtttgcttagctacgctcttttttataacctgttgataacaatattcttgatgacttgaacta

SEQ ID NO: 2657 - DNA, 862 bp, Tragopogon dubius
ctcaatcgatcaccacatttttcgcaaaattttcaattccccctcaggcctgttccgtcacaagagagagctttcggttcgtgacatttcttgatctttttggggtgtaactttcgtgggattttggatttataatctttcattcgatttgggaatagttgcttctcttatcttcatttcatcaagaaaatcttggtgaagttgatattaatcacagaagaatatcaagaagatgtacgtgaaggcgacaccgacaacggatctgaacagaaacaccgactggttcacctaccccggagtttggacagcctacatcttgatcctattcttttcatggcttctcattctctccgtttccggttgcacccctggcatggcttggaccatcgttaatctctgccacttcctcgtaacttatcactttttccattggatgaaaggaactccatttgctgaagatcaggggatatataacaggctgacatggtgggagcagattgacaatgggaagcagctcactagaaacagaaagtttttaactgtcgtacctgttgtgctgtacttgatagcctcacacacaaccgactatcagcatccaatgctattcctcaacacggttgctgtgactgttcttgttatcgccaagttcccgaatatgcataaagtccgtattttcggaattaatggagatatgtgaagtgtctcaagattggaaaaaggttatcttgttatgtatcatttttgtttatgttcttcaaatgatttaaaatcactctttgatattcagaaaaataaacatgatgagtttgtctttgtatagtggaagattcacatttctcttaacaaaaaaaaaaaaaaaaaa

SEQ ID NO: 2658 - DNA, 901 bp, Triphysaria pusilla
gaagaaatacaggaaaacgtatacaccgaagaaattggaacaaggaatctgccggaaatggcgaatttgtacgttcgtgcgtcgccgccgacggatcttaatcggaatacagagtggttcacgtaccccggtgtatggaccacgtacatcctgatattattcttctcatggctgatggtactctctgttttcggctgctccccaggcaccgcgtggaccatcgttaatctctctcatttcattgtcacgtatcactgctttcactggaagaaagggacaccattttcagatgatcagggtatctacaatagattgacttggtgggagcaaatcgacaatggcaagcaacttactcctaaccgaaagtttttgacagtcgtacctgtagtgctgtacttgatagccgcacacacaactgactatcaatatccgatgctcatctttaacacactagcagtttttgttctggtggtcgccaagttcccacacatgcacaaagttcgtatctttggaatcaatgcagaacaatgagtttaaggtcctttaaaatatgccaatttcttcaaaatatgccactagagcatttacctttatctccaatttcttcgtcaatgcagcagaagccggatattgtctttaagtcctctcaaagtcaatttgcataaagctatacaattttcctttccgttttttatatgaactttattttcatagattcagaaatttaagtagagcataaagtggattggtggtgggagtgtgattgatgtgcccataaaatatagaaataggggacactcttcattttatcattataaattgtggttctatagacttggaatttattcattttggttacagttcttgcactgttactccaagaggccctacttgtctgctg

SEQ ID NO: 2659 - DNA, 851 bp, Cichorium intybus
ggggggtcgggttatgtactgaatcaaaagtgtttggttcagttttgggaataatttcacatcacaatctcaatctcaattcttgaagaaattggtttctgaattgggaaataattaaggaggatttggaggatgtacgtgaaggcgacaccgacgaccgatctgaataagaacacggagtggttcacgtacccaggagtctggaccacatacatcctgatcctcttcttcgcatggcttctcattctctccgtctctgcttgcacccccggcatggcctggaccatcgttaatctctcccacttcctcgtgacttatcacttttttcattggatgaaaggaactccatttgctgatgatcaggggatatataacagactcacatggtgggagcaaattgacaatgggaaacagctgactcgcaacagaaagtttctaactgttgtacctgttgtgctgtacttgatagcctcacacacaactgattacagacatccgatgcttttcttgaacacagttgctgttattgtgctagttattgccaagttccccaatatgcataaagtccgaatctttggaattaatggagacatgtgatcaccaacttctctcctttatagtgaattccaaccatatagggtatgtactagtgttcttattgtgccttgttggaaataaacaatgacattatctttgtatagtggaattttgctatatatatcatggaggagattcgcttcttaataaccttcattttgttcttaaccttgatggaaattgactaaacttattttattattactaatgcaaaaaccctgttccaaaagcgtaaaaattaaaaacaacacaaa

SEQ ID NO: 2660 - DNA, 1856 bp, Centaurea maculosa
cgcagcacggtggccggagaggtttcatggacttcccttacgtttcgtctccacacaaggatcttatggtggatctagtatccaccgtcgaaactcgcctcgattccttccttaatccttgcactctaccgcctgatgtacagtcttatcagaacgaaccggaacggctcgtgctgctatccatctcagatccggccttcactcatcgctgattgatttcgtactcggaagttggcttcattgtgagttaccatcaggaggagctctgaacattacaagcctgtcagcctatctaaactcatcaacggatgcacccaacttcttggtagagctcatccaaagcagtccaacatctatggttctaattcttgatctgcctccaagaaaggatcttgtactcgatcctgattatctcaagacgttttacgaggacacacatttggagcaacacaggcaacatcttgagaagctatccgaggtacgaccctacttctcgtcgtctctttacattcgttcggttgtctctcccactgcaatcctggtgcgaatagaaactgaacaactcgaggaaatgatccaaacccatgttgccccaattgccaaggaagtgatgaaaacttggttggatgtttgtgcttttggggaaaggacagtggatgaatctgaaaaagcttatttgaaaaagagggatgaaatgagtaagagcaaaaccattgaaattgatctgggttcgaatctgccaaggttgtttgggcaagagactgctaaccgcgtactagaagctctgcgggaggttttctgaaacgcattgtgtttgatggagagttgtattttctgcattaaagcttgtaccacatatcgacggtcgtgcattagagaacacatatgtggtttgaacttcagttttacaacacaccgatgtaatgaaaccatcaaacaaacatcgttatccttgtctttatggctatattagttgtaacttttgatataactatcaaagtttattgaagtacttcagcagaattaatgaaaaacatgacttatttttctgctttcaaaaaagaaatgggaacaaactctaaaagcacttgtcaccttagtgatttaccaactccaataaggatctgccacaaaaaggaaaaactgatataggaaaaaataaaaaaattaatataccatttaatcctgttcccacccttttaagatgttaaagttacagacgcatgtgtatagatgatagcttcactcttcagcattgattccaaatatcctcaccttgtgcatgtgcgggaacttggcaacgactagcacaaaaaccgccaccgtgtttaacagcagcatcgggttctggtagtctgttgtgtgagacgctatcaaatacagcaccacagggacaagagtaataaactttctgttgcgagtgagctgcttgccactatcaatttgctcccaccaggtcaacctgttgtagataccctggtcatcagcaaaaggtgttccctttttccagtggaagaagtggtatgtcaacagagcgtgagagagattgacggtggtccaagccatgccaggagagcaaccgaagactgagatgactacaagccaagcgaagaagaggatgagtatgtaggtagtccaaacgccggggtaggtgaaccactcggtattccggttcagatccgtcggcggctccgcctgcacgtacagattggccatggaatcaagcaatcggtgaagctaatggcggaaatcgtgtggaaaaagctttagctccgtcgtgtttgtagcttcgaaaatggagtcgtgtggttgttggctatggcggtctggtctctgatgaatggagatttgatgga

SEQ ID NO: 2661 - DNA, 712 bp, Fraxinus spp
aattgtatgttcaggcggttccgccgacggatatgaatcggaatacggagtggttcacgtaccccggtgtgtggaccacatacatcctaatattgttcttctcgtggctggttgtgctctccgttttcggttgttcccctggcatggcatggacaattgttcatctttcccatttcctcgttacttatcactgctttcactggaagaagggaacactttttcagatgaccagggtatctacaataggttgacttggtgggagcaaatagacaacggcaagcagctcactcgcaattaggaagtttttgacagttgtccccgtggtgctgtacttgatagcctcgcacacaacagattatcaacatcctatgctcttcttcaacacactagctgtttttattctggtagttgccaagttcccacatatgcacaaggttcgcatcttcggaattaatgccgatcaatgagctgagatccattagtgcaggtttaccactggtattggcaataatttacagcattttggtctattggcaatactgcaacgttggaacaggcaactaaaccatacatcactttgtgaaatactaagatctaaagatgtttgaagtccttgtatgaactctgtacaagttgaatttataactttttcatgagctgttattttttccttgcttaaatttggaagtttcagaaagtaaaaagtatttca

SEQ ID NO: 2662 - DNA, 713 bp, Salvia sclarea
gacacgattactcccatcatttcgatcactccgaacccgtccggccaccttctacgacgccgttccatcgattaaccgggtcggatctatatatcgaattcggacccaaacgcgatcggcgattatgggaaaactctacgtgcagatggcgccaccggcggatctgaaccggaacaccgagtggttcacctatcccggtgtatggactacctacatattgattctcttcttctcatggcttgtcgttctgtccgtcaccaattgcacccccggcatggcgtggacgatcgtcaatgtctgccatttcctcgtaacttaccacttcttccactggaaaaaaggaactccttttggtgatgatcagggaatctataatagcgtttgacatggtgggagcagattgacaatggaaagcaactcactcgcaatagaaagttcctcacagttgttcctgtggttctttacttgatagcctctcacacaacggattaccaatacccaatgctgctcttcaacacagtggcagtgcttgtgttggttattgccaagttccctaatatgcacaaggtccgaatcttcggaatcaatggggatctgtgaagtgccacttcttgcaacagtccatcttaacttagtatgcttgatcatcacaatatctgtaaagaaggttatgcatctttggtgtatagaactgcgtctcgaacagagttaag

SEQ ID NO: 2663 - DNA, 694 bp, Castanea mollissima
agaaaatcaaaagaaagatgtatgtgaaggcggtgcgacccacggatctgaaccggaacacagaatggttcacgtacccgggcgtgtggaccacctacattctcatcctcttcttctcgtggctcatcgttctctccgttctcaattgctcttctggcttggcttggaccatagtccacctcgctcattttctcgttacttatcacttctttcattggaagaagggaacaccatttgccgatgaccaaggtatctacaacaggttgacctggtgggagcagatagacagtggcaagcagctcactcgcaacagaaagtttttgactgtggtgcctgttgtgctgtatttgatagcctcacatacaacggactatcagcaccctatgctcttcttcaacacgttagcagtttttgtgctggtggttgcaaagttcccgcacatgcacaaggtccgtatatttggaatcaatgctgatcaatgaactgtgaagaaattcaagtttggtttacctccagttcctaggctgatcattttgatattccaattgatatccctgtacagacgttaaaactggaaagggtgtaatatttttcctgttagtgaaaattttacatatattgcttttcattatattttcaagagaaatactttcgttgtattctctgtgtacctgctaacattggtgaactctcg

SEQ ID NO: 2664 - DNA, 855 bp, Chrysanthemum coronarium
atcatcaattgatcatcatcgtcaacgaaaggaagcggggggcagaaataaaaatcaatcagagaacaataccatcgccaacaaccataaccataaacaactagctaataataatttgataattggggaaagttggttgtatggcaaattatatgtatgtgcgagcggtaccaccaacagatctgaatcggaacacggaatggttcacatatccaggcgtatggaccacttacattctcatcttgttcttttcttggctcgtttttctttccgtctttggttgctctcctggtatggcttggaccaccgtcaacctccttcacgctctgttgacataccaattcttccactggaaaaagggaacaccttttgctgatgaccagggtatctacaacaggttgacatggtgggagcaaatcgatagcggcaagcagctcactcgcaacaggaagtttcttacacttgtccctgtcgtgctgtacttgatagcttctcatacaaccgactaccagaacccgatgctgtttttaaacacattggcagttttcgttcttgttgttgccaagtttcctaacatgcacaaagtccgcatatttggaatcaatgctgaagaatgaagctttctaagaatggatacatgttcaattgtgcccataactatacacgcgtctgtaatgttaacatcttaaaagggtacctgctgtctttgaaaccggataaattggtatattaattttattttttcttgttgggctatattcttttttcctttccctgcgtatccatttggtaatgtttttcttacaactttatgaaaaacctttgtaacggattcatagatatctgaggtgacaa

SEQ ID NO: 2665 - DNA, 814 bp, Ambrosia trifida
ctagacgagacggccgaagacagtggtagtcaacgacagaggtacgacgggaggttaagaataataaaaagaataaaacagaaataataagcactaagatatttttttttgaatccagccttcatcgtcaacaaacaataatccttccatcaggctcgatacacagaggagaccatcggcagcaactacacacacagatcatccataaattcattcaaagctgcacatacaacaacaacaagagataggaccaatcttttcgattggatagatggcgaatctgtatgtgcaagcggagtcgtcgacggatctgaacaaaaacacggagtggttcacgtacccaggcgtctggaccacctacatactcatcctcttcttctcttggctcgtcgttctctccgtctttggttgctctcctggcatggcttggaccaccgtcaatctctctcacgctctcctgacataccagttcttccactggaaaaagggcacaccttttgctgatgatcagggtatctacaacaggttgacgtggtgggagcagatcgatagcggtaaacagctcactcgcaaccggaagtttctcactcttgtccccgtcgtcttgtacttgatagcatctcacacaacagactaccagaacccgatgctgtttttaaacacagttgcagtttttgtgttagttgtggccaagtttccaaacatgcataaggtccgaatatttggaatcaatgccgaagagtgaagctttatctgttcaattgctttgcttgacacgtttctgtaattctaacattcttttatttggaaccag

SEQ ID NO: 2666 - DNA, 734 bp, Brassica juncea
aatgattccacagtagatgcgaaaaagcagtcgtcgctcacgggcacaccagattaaaccaaaccagaaatctggagaatccttcttcctcttcctccccgaaagaaagagttaattttgtgaatctgggtgaaacagtagaagatttgatctcgtaaacagggttaaacaatcaatcaatcgtcattcttgtggaatagaatagatcggatcgatggcgaatctgtatgtgaaagcggctccaccgccggatatgaacaggaacacggagtggttcatgtatccaggggtgtggacgacttatatactcatcctcttcttcggttggctcgttgttctctccgtctctggctgttcccctgggatggcttggaccgttgttaatctctctcacttccttgtaacatatcacagcttccactggatgaaaggaacgccttttgcagacgaccagggagtctacaatggtctcacctggtgggaacagatggacaatggtcagcaacttacccgcaaccgcaagttccttaccgttgttcctgttgtcctgtacttgatagcatcgcatacaacagattacagacatccatggctattcctcaacacactcgctgtgatggttttagttgttgccaagttccccaatatgcacaaggtccgcatctttgggatcaatggtgataagtaagcttctcttaacaaaactcacatccatttcttttacggtatgagaa

SEQ ID NO: 2667 - DNA, 812 bp, Fagus grandifolia
agcttagctccctccatcatttcctttcctttcctcccaaaaactcgtagtgcaaaatctcctggtttggggaagggacaaattcgtcaatttggaaatattacgagagaaaggaaaacaaggataaaaaaggcacagaaaggaaggaaagagaaagaaaggaaaatgtacgtgaaggcgtaccgacccacggatctgaaccggaacacagagtggttcacgtatccgggcgtgtggaccacgtacattctcatactcttcttctcgtggctcatcgttctctccgttctcaattgctcacctggcttggcctggaccatcgttcacatcgctcattttctcgttacttatcacttctttcattggaagaagggaacaccatttgccgatgaccaaggtatctacaacaggttgacctggtgggagcagatagacagtggcaagcagctcactcgcaatagaaagtttttgactgttgtacctgttgtgctgtatttgatagcctcacacacaacagactatcagcaccctatgctcttcttcaacacgttggcagtttttgtgctggtggttgcaaagttcccacacatgcacaaggtccgtatatttggaatcaatgctgatcaataaactgtgaagaaattcaagtttggtttactccagtttctaggctgatcattttgatattccaattgatatccctgtacagacgttaaaactggaaagggtgtaatatttttccctagtgaaaattttacatatattgcttttcattatattctcaagaaatactttcattgtattttctctgt

SEQ ID NO: 2668 - DNA, 885 bp, Bupleurum chinense
ttttgggaattgatctatataggtgtcaacaacagttgcgcaaacaatcacagctgaatcaatacaagagaaagagagttgtatacatacatacatagatatatatatatatataatagattgttggatggcgaattattacgtaaaggcgacaccaccgccggatctgaaacaaaacaccgagtggtttacatatccaggcgtatggactacttatattctcatcctcttcttcgcctggctcgttgttctctccatccttaattgttctcctggaatggcttggaccatcgttcatctctcccacttcctcgttacctatctactttttcactggaagaaaggaactccatttgcttatgaccaagggatctataatgggcttacttggtgggagcaagtcgacaatgggaagcaactcacacgtaacagaaagtttttgaccgttgtacctgtcgtgctgtacttgatagcttcacacacaacagactatcagcacccaatgttgctcttaaatacaatagcagtggccgtgctagttattgccaagtttccaaatatgcacaaggtccgtatctttgggattaatggggagcagtgagatggtttattagcttgcatgcatgacttatgcaagaaggaaaagtaaaaaagaataaatctatgtatagtaatcagaactgaaaacgaatttgggagtgtaatatttagtgactttgtttcttttcacaagctcctgctggataatgagggaataaaagtttactagtttgtttatgtatagcaaatatcttatatattcaggagattttatttgactttaagttaagcaggttacatgatgcaatacttccgagggaaatgttatgtccagagcaatgctct

SEQ ID NO: 2669 - DNA, 862 bp, Castanea mollissima
ggacaacttcgtcattttgggaaaaagaagaagaaaggaaaggaccaaatatacaaggaaaggaaaagagaaagaaaggaaaagagagaaagagagagaagaaaatcaaaagaaagatgtatgtgaaggcggtgcgacccacggatctgaaccggaacacagaatggttcacgtacccgggcgtgtggaccacctacattctcatcctcttcttctcgtggctcatcgttctctccgttctcaattgctcttctggcttggcttggaccatagtccacctcgctcattttctcgttacttatcacttctttcattggaagaagggaacaccatttgccgatgaccaaggtatctacaacaggttgacctggtgggagcagatagacagtggcaagcagctcactcgcaacagaaagtttttgactgtggtgcctgttgtgctgtatttgatagcctcacatacaacggactatcagcaccctatgctcttcttcaacacgttagcagtttttgtgctggtggttgcaaagttcccgcacatgcacaaggtccgtatatttggaatcaatgctgatcaatgaactgtgaagaaattcaagtttggtttacctccagttcctaggctgatcattttgatattccaattgatatccctgtacagacgttaaaactggaaagggtgtaatatttttcctgttagtaaaaattttacatatattgcttttcattatatttcaagagaaatactttcgttgtattctctgtgtacctgctaacattggtgaactctcgtgctatgctattctagtccattgtcacctggcgcaaatggcttttagtttgtttctaatgtaaaaataga

SEQ ID NO: 2670 - DNA, 767 bp, Cichorium intybus
gagagagagagattgggggtaggggtgtcgggttatgtactgaatcaaagtgtttggttcagttttgggaataatttcacatcacaatctcaatctcaattcttgaagaaattggtttctgaattgggaaataattaaggaggatttggaggatgtacgtgaaggcgacaccgacgaccgatctgaataagaacacggagtggttcacgtacccaggagtctggaccacatacatcctgatcctcttcttcgcatggcttctcattctctccgtctctgcttgcacccccggcatggcctggaccatcgttaatatctcccacttcctcgtgacttatcacttttttcattggatgaaaggaactccatttgctgatgatcaggggatatataacagactcacatggtgggagcaaattgacaatgggaaacagctgactcgcaacagaaagtttctaactgttgtacctgttgtgctgtacttgatagcctcacacacaactgattaccgacatccgatgcttttcttgaacacagttgctgttattgtgctagttattgccaagttccccaatatgcataaagtccgaatctttggaattaatggagacatgtgatcacaaacttctctcctttatagtgaattccaaccatatagggtatgtactagtgttcttactgtgccttgttggaaataaacaatgacattatctttgtatagtggaattttgctatatatatatatatcatggaggagattcgcttct

SEQ ID NO: 2671 - DNA, 1078 bp, Coffea canephora
cggccggggggctaacaaaccagaatatgcctttttgcctcccaaacgcattgatgattttatcaaccggcttctttcctttcctgcttttccttctccgtcccttttatccttcttcatcggtacagatttaaccaccaaatagccttaatcctttccttgggtatcgtcattattatatctgttctacgcagcagcaaaatctgggctcataaacatatactccctactgggttcttatcatatagccccacaaatttatgcatattgaagaaaacagtttttcatttgtcgtcattgataaaagattatagaggggagctcaggaggaaaaggttgtttgaaaattaaattgaagggttgctcaataagtcggactactggcacagaggaatagtactgggagaagatggcaaatttgtacgtgaaagctgtgcccccgacggatctgaacaggaatacggagtggttcacgtatccaggggtgtggaccacttatatattgatcctattcttctcttggttgatggttctctccgtcttcggctgttctcccggcatcgcctggtctgttgtccacctttcccattccctcattacatatcactgctttcattggaagaaaggaacaccattttctgatgatcagggtatctacaacaggttgacatggtgggagcaaatagacagtggcaagcaactgactcgcaataggaaattcctaactgttgttcccgttgtattgtacttaatagcttcgcacaccacagattaccaacatccaatgctcttattgaacacggtggcagttttcgttctggttgttgccaagttcccccatatgcacagggttcgcatttttgggatcaatgctgatcagtgacaatgaaagaatgccgtgcaagttcttgtttcagccgcaacgttcttgattttcgcattcatttagcagtagtatatgtataatgaacttgtacagctcaagtacggggaatgctatcatacttggtgaaagttgggacttcttcctgggggatatttgatagtagtgttttgatattgatttttttaacaagcc

SEQ ID NO: 2672 - DNA, 908 bp, Conyza canadensis
ggagggggagatagtaaatggcgaatttgtatgtgcaagctgaacaaccaacggatctgaatcggaatacggaatggttcacgtacccaggcgtatggaccatctacatcttcattctcttcttcgcttggcttgttgttctttctctttttggttgctcccctggcatggcttggaccatcgttaacctttctcacgccgtgttgacataccagttctttcactggaaaaaggggacaccttttgctgatgaccagggtatctacaacaggttgacgtggtgggagcaaatcgatagtggcaagcagcttactcgcaataggaagtttcttactctcgtccctgtcgtgctgtacttgatagcatctcacacaacagactaccagaacccgatgctgttcctaaacaccgtggcagttttcgtgctagttgttgccaagtttccaaacatgcacaaggtccgaatatttggaattaatgcggaagagtgaagtctatgaatagacttctgtttagttgcaccgataactatacacgcatttgtaatttcaacctcttaaagggtaactgctgtctttggaaccggatcaaatggtaaattaatttattttttacgtgtagctatattttatttatcatttatgtggcagatcgggattcatgatgtctcgttaagaccttgtaacgagtcagtggatgtctgaggtgacaaaactgtttagactatgtttctcttacaatagactcaaaataggatccaattgtataatgggatcgaaaaaccatgtgtcatacagtcatacctcactcttgccttacgcaaactaaattgtgcacttcaggggactcacttaaaatctaattgtttagtgagttctatgagacaattatagcttcttttgttgccc

SEQ ID NO: 2673 - DNA, 818 bp, Echinacea purpurea
ccgggtcggatctctatcgaattcggatctaatcgcgatcggcgacgatgggaaaactctacgtgcagatgtcgccaccggcggatctgaaccggaatacggagtggttcacctatcccggcgtatggactacctacatattgattctcttcttctcgtggctagtcgttctttccgtcaccaattgcacccccggcatggcctggacgatcgtcaatgtctgccatttcctcgtaacttaccacttcttccactggaaaaaaggaaccccttttggtgatgatcaaggaatctataatggcttgacatggtgggagcagattgacaatggaaagcagctcactcgcaatagaaagttcctcactgttgttccagtggttctttacttgatagcctcgcacacaacggattatcaatacccaatgctgctcttcaacacagtggcagtgcttgtgttggttatagccaagtttcctaatatgcacaaggtccgaatcttcggaatcaatggggatctttgaactgccacttcttccaacagttcatcttaacttagtatgcttgatcctcaaatatctgtaaagaaggttatgcatctttggtgtatagaatctgcatctcgaactgatgatgagtacgttttggtcaatgtagcatattttgctctactgtttttacgggaacccctcaaaactgagaagcaaaaatgtaaacaaattgtttattcacactagaaattttgtatacctgaaagatcactcatgttatcagtatcttgctccggcttataatcattttcgtatcttcgactgttcttt

SEQ ID NO: 2674 - DNA, 864 bp, Linum usitatissimum
gaaccagaagaaacgaattcttctcccgattgccggatttcttacaaaggtttgattgaggaatagagagagagagagaggtagcagagagatggcgaatctatacgtcaaggcggtgcctccggcggatatgaacaagaacacggagtggttcatgtaccctggcgtctggacttcctacatgctcatcttgttcttcgcttggctcgtcgttctctccgtatctggttgctctcctggcatggcttggaccgtcgttaatctcggtcacttcgctatgacttaccatttctttcactggaagaagggaactccatttggtgatgatcaggggatctataatggactaacctggtgggagcaaatggacaacggaaagcagcttacacgcaacagaaagttcctaactgtggttcctgtcgtcctgtacttgatagcttcacacacaactgactacgaacatccgatgctgtttctgaacacgattgcggtgctagttcttgttgtggccaagttcccgaatatgcacaaagtacgtatcttcggaatcaacggggacatctgagattgagcttctgaatctgcctgggtgtaatagtaaacagttgtatagaaaccgagaaaatggggacgacgccaagatcggaaaacgttaattccggtttgttttgtgattgtcaagtaatgtttctgctgtatattgaaaatgtttcccctacttgtacaagagttgcgagagaccaactgttcaaagtttagaaagaaactgtatgaagaatcttttgatgaacactactgtactcaatcagcctaggcaaaatctggcctcgttgatgttatttatcaggtaaaaagcattttcag

SEQ ID NO: 2675 - DNA, 953 bp, Ipomoea nil
gatccgtctatatactcgcctgtctctttcattctgcgattcgctttttccattttcgtttacgtttcactttcactttttacttctctctttctttgttgagattgcgggttgggttgggttgggttgggttgggttggtaggtagaaacgcccaatcccttccaaattccaagcaaggccttcaatcgtcggatcttccagttcttgttgtttgaattggatggcgaatttgtatgtcagggcggcgccgacgacggatctgaataaaaacaccgagtggttcacgtatccaggggtatggtccacctacatccttatcctcttcttctcatggctcgtttttctctccgtcttcggctgctctcccggcaccgcctggacaatcgtcaacctctctcatttcatgattacatatcacttctttcactggaagaaaggaacaccttttgcagatgaccagggtatttacaataggttgacttggtgggaacaaatagataatggcaagcagcttacacgcaatagaaagtttctgacagttgtccctgttgtactgtatttaatagcctctcacacaactgattatcaacacccaatgctgttcctgaacacagtggcggtttttatattggttgttgccaagtttcctcatatgcacaaagttcgcatcttcgggatcaatgcagatcagtgagagagctgagtgttggttccactcactataaagtatgaatccattttgacgtcctctcccgagtaaattgagaatgccccccgcccctgtacagatgatgcatgtttgaactggaaagggtctctatatattgtgtaaaaacgaagggctcgatctctcttgtgggggatgttcgttcgttccttatatgaactgaactcatatctttgtaccagccccatctgtgaaaacttgaaactcccaacaattaagaaatt

SEQ ID NO: 2676 - DNA, 989 bp, Lactuca sativa
ttttaattctggacataaatattattatttctgaaataggtaatttctattaaatgcttttgtcatggtagtaaattttgttaattgaaatcgatttatgttagatttacttgcgcattctccatgtttgaaagcaccgaataaattgttaccttttgttttactagatttatgctgtcaataatctgcatcgtcaacgaacaatcatcccatcaccctcaacacgcagagcagaccgtcaacaactacacatacgatggagcatccacaagtcacaacgatttcaccattctttgtatcaaaacttgacctaattccctatagatggcgaatttgtatgtacaagcggcgccgccgacggatctcaacaggaatacggagtggttcacgtaccccggcgtctggatcacctacatactcatcctcttctttgcttggctagccgttctctccgttttcggttgttctcctggcatggcttggaccatcgtcaatctctctcacgctgtgatgacataccatttcttccactggaaaaagggaacaccttttgctgatgaccagggcatctacaacaggctgacatggtgggagcagattgatagtggcaaacagctcacacgcaacaggaaatttcttactcttgtccctttggtcctgtacttgatagcatctcacacaacagactaccagaacccaatgctgctcttaaacacccttgcagttttcgtgttagttcttgccaaatttccacacatgcacaaggttcgcatatttggaatcaatgctgaagagtgaattttttttcctcctttctaaaaatggctacacctctttgttttcaattgcacacgtaacatttcaaacattaacccatttgttttacaattgacttgatgaattttgattgcaagcttttatcaaatgttacattcattatagtccaaagatttagtttcagggatgaaagacctttaactccattttcc

SEQ ID NO: 2677 - DNA, 1177 bp, Mimulus guttatus
atttccaattaattaataagagaatagacggttttatctatctacaaaaccgcgacagaaaaccaaaaaaaaaaaaaaaaaagaaattttatcaaagaaacaaacaaacacgccacaaagcctttttgagacccctcccccttgaacacgctactcctcctatttcgaattttcgatcacactctgaaaaatcgagctttctggagtcgatcaggatcagaatctgaatctgaaggattcgttatttcgtaatcggatcaaaatcgggtttggaaacgatggggaagctgtacgtgaaaatggtgccgccggcagatctaaaccggaacaccgagtggttcacctatcctggggtttggactacctatatattgattctcttcttcgcctggctcatcgttctttctgttaccaattgtacccccggcatggcctggacaatcgtcaatctctctcatttcctggtgacttaccacttcttccattggaaaaaaggaaccccttttggtgaagatcaaggaatctataatgggttgacatggtgggagcagatggacaatggaaagcagctcactcgcaatagaaaattcctgacagttgttcctgtggttctctacttgatagcctcgcatacaaccgactaccaatacccgttgctgtacttcaacacatttgcagtgcttgtgttagttgtggctaagttcccaaatatgcacaaggtccgaatctttggaatcaacggagagtactgaatttggaagaactattaaaccagttcgtcccttttaatttaagtatgagacttcgatccgtactacatctgtaaaaaaaggaaaacaaaaaacaaaaaaggtttatgcctcttctgtgtatagaagctggaactcgtgagtgcatctggtaaacgtactatatcgtgcttagttatttttacgagcctcctccaaactgaagcagtatatgtaatgagttgtatttgtaccttagaaatcttttatatacttttttggagattattgttcttgccttcactatatatctcaatctattaatacttttgaatctagtttgcagggttttgtatttgacgtgagtgattacggtgttttgattttcaacattaaatcattcgacaagtcctaggtttatgtaagaacggattttttatttatttatt

SEQ ID NO: 2678 - DNA, 894 bp, Quercus alba
gaaaggaaaagagagaaagagagagaagaaaatcaaaagaaagatgtatgtgaaggcgcaccgacccacggatctgaaccggaacacagaatggttcacgtacccgggcgtgtggaccacctacattctcatcctcttcttctcgtggctcatcgttctctccgttctcaattgctcgtctggcttggcttggaccatagtccacctctctcattttctcgttacttatcacttctttcattggaagaagggaacaccatttgccgatgaccaaggtatctacaacaggttgacctggtgggagcagatagacagtggcaagcagctcactcgcaatagaaagtttttgactgtggtgcctgttgtgctgtatttgatagcctcacacacgacggactatcagcaccctatgctcttcttcaacacgttagcagtttttgtgctggtggttgcaaagttcccgcacatgcacaaggtccgtatatttggaatcaatgctgatcaatgaactgtgaagaaattcaagtttggtttatcccagttcctaggctgatcattttgatattctaattgatatccctgtacagacgttaaaactggaaagggtgtaatatttttcctgttagtgaaaattttacatatattgcttttcattatattttcaagagaaatactttcgttgtattttctctctgtacctgctaatattggtgaactcgtgctatgctattctagtccattgtcacctggcgcaaatggcttttagtatatttcatgtaaaatgaagagaaattttttttgttgtaaagattgcttttgcttcctagactcattgtccctcaatgataatgctcattggtaggtgaataaaagtgaggtgccggatccagtctc

SEQ ID NO: 2679 - DNA, 1023 bp, Oryza sativa
ctcaccgtcgcgttattttttcgccccccatctttgaaccaaacagccaacctcctcctcctcctcctcctcctcctcctcggcctcggcctcggttcctcctccccgccgatcccgccgctataaatccctcccagccgcgcggctcggagacgcgctcgccgctcgctcgctcgtcgctgctctgttccacaaccgccggcggccggagagggagggaaaggagagggagggaggggggaggcgggggcgatggcgaagctgtacgtgcaggctgtgccgccgccggatctgaacaggaacacggagtggttcatgtacccgggcgtctggacgacctacatctgcatcctcttcttctcctggctcctcgtcctctccgtcttcggctgcacgcccggcatggcctggaccgtcgtcaatctcttccacttcgcgatcacataccactttttccattggaagaagggaacaccttttgctgatgaccagggaatgtacaacacattgacttggtgggagcaaatggacaatggcaaacagcttactcgcaacaggaagttccttgttgtagttcctgttgtcctgtatttgatagcttcacacactacagactaccaacatcctatgctcttcctcaacacccttgcagccgcagtgctcgtggtcgctaaactaccgaacatgcacaaggtccggatttttggaattaatgctgggaactaggcagcaggatccttcagcagacatctacctatcttcctttccagttcatctggctcatcagagtatcaaggagtagagcttaaatgttgttagctgatgggttgtgatcgttgtatagagagatgctcagaggctgaaaacgatgctgctgtatatctgatgtacacgaattctgtagactcttaacgctgctatatgctttgatacaaatatctgtcagttgctgcatgtagagtcttgttttcagaacaataccttcatatacttgttttcagaaccatacttgtatggttctcc

SEQ ID NO: 2680 - DNA, 844 bp, Solanum phureja
aacaatcatttgtcaaaaagaagctgagatgaatttctcctctacggctcagcggtcccaccacccctgcccatagcagccagctatcctcctgttttcgtgagtctctgttttcgttgatcaaatactcagactaatgcgatattaatcgccatatccatctcattcaagcttttttcttcaaatttgtattgattttttttttctaaaaagtattgttcgatccatttggatggcgaatttgtatgtgagggctgctccaacgacggatctgaatcggaatactgagtggttcacgtatcctggagtttggactatttacatattcattctgttgttctcatggctcgttgtgatgtctgtttttgggtcctcatcaggcatggcctggactattgtcaatcttgctcatttccttgtcacatatcactgttttcactggaagaagggaacaccatttgctgaagaccagggtatctacaacagattgacatggtgggagcaaatggataatggcaagcagcttactcccaataggaagtttctgacagttgttcctgtggtgctgtacttgatagcttcccatacaactgactatcaacacccaatgctgttcttcaacacatttgcagttttcattctggtggttgccaaatttcccaacatgcacaaggttcgaattttcgggatcaatgcagatcaatgaacttctacattcaatttgaattttttttactctcagctgtagtatttgattggtttaacaattttgagtaaacagggaactcctgtacaaatgcaacaacttcaaagggtgaaattatatatagtaaaaaattaagag

SEQ ID NO: 2681 - DNA, 816 bp, Eutrema parvulum
gaaagagagaattttgtgaatctgggtttacaattcaggtgaaaatagaaagaatttcgtgcggtacccatcacataaagacggagaatcaatcgatttcttgtagattcgatccggtcgaacagaaaaaatggcgaatctgtatgtgaaagcggttccaccgccggatatgaacaggaatacggagtggttcatgtatccaggagtgtggacaacttatatactcattctcttcttcggttggctcgttgttctctccgtctctggttgttcccctggaatggcttggactgttgttaatctcgctcacttcgttgtaacttatcactgctttcactggatgaaaggaaccccttttgcggaagaccaaggaatctacaatggtcttacctggtgggaacaaatggacaacggtcaacagcttacccgcaaccgcaagtttcttactgttgttcctgttgtcctgtatttgatagcatcacatacaacagattacagacatccatggctgttcctcaacacacttgctgtgatggttctagttgttgccaagttccctaatatgcacaaggtacgcatcttcgggataaatggtgaaaaataaggctcttttagaaactcaaatcctttgatggtaagagaagaggagaagaaaaaggggatataagcaaacatatatatgtataaatgttcatatgaattggtttaattcgagagctatgtttgttggatatatgtaagtaactaattttgaagctttgatctttgtttttttcttctgttttatgtatggacacgaaactcatcatctttttt

SEQ ID NO: 2682 - DNA, 943 bp, Triphysaria pusilla
gtcgacactttgacccagacctaatatttccattttctaataatatcgggacctgaagaagtacaggaaaacgtgttcataaaaatataggtcgaagaaattggaacaagcaatctgccggaaatggcgaatttgtatgttcgtgcctcgccgacgacggatctaaatcggaatacagagtggttcacataccccggtgtatggaccacgtacatcctaatattattcttctcatggctgatggtactatctgttttcggctgctcctcaggcacggcgtggaccgtcgttaatctctctcatttcattgtaacatatcaatgctttcactggaaaaaagggactccatttgcagatgatcagggtatctacaatagattgacttggtgggagcaaatcgacaatggcaagcaacttactcctaaccgaaagtttttgacagtcgtacctgtagtgctgtacttgatagccgcacacacaactgactatcaatatccgatgctcatctttaacacactagcagtttttgttctggtggtcgccaagttcccacacatgcacaaagttcgtatctttggaatcaatgcagaacaatgagtttcaggtcctttaaaatatgccactagagcatttacctttatctccaacttcttcgtcaatgcagcagaagccggatattgtctttaagtcctctcaaagtcaatttgcataaagctatacaattttcctttccgttttttatatgaactttattttcatagattcagaaatttaagtagagcataaagtggattggtggtgggagtgattgatgtgcccataaaatatagaaataggggacactcttcattttatcattataaattgtggttatatagactttgaatttattcattttggttacagttcttgcactgttactccaagaggccctacttgtctg

SEQ ID NO: 2683 - DNA, 540 bp, Ambrosia trifida
caccacaatcatcatctcttccagtccacacaaccaccgtcgtcaccgtaaaccacccaaacaaacaaacaaactattaaccaatggctaacttatacgtgcaagcggtccaaccaacagatctcaacagaaacacggagtggttcatgtatcccggcgtctggaccacctacatactcatcctcttcttctcttggctcgttgttctctccgtcactggttgctctcctggcatggcttggaccaccgtcaatctctgtcacgctctcattacatatcacttctttcactggaagaagggaacgccttttgctgatgaccagggtatctacaacaggttgacttggtgggagcaaatagatagtggcaagcagctaactcgcaataggaagtttcttaccgttgttcctgtagtgctgtacttgatagcatcccacacaaccgactatcaaaacccaatgctattcttcaacacattggcggttttttgtgctagtgatcgccaagttcccacacatgcataaagtccggatatttggg

SEQ ID NO: 2684 - DNA, 860 bp, Bupleurum chinense
gtgtcaacaacagttgcgcaaacgatcacagctgaatcaatacaagagaaagagagttgtatacatacatacacacacatatatatatatatataaaatagattgttggatggcgaattattacgtaaaggcgacaccaccggcggatctgaacaaaaacaccgagtggtttacatacccaggcgtatggactacttatattctcatcctcttcttcgcctggctcgttgctctctccatccttaattgttctcctggatggcttggaccatcgttcatctctcccacttcctcgttacctatctacttttttcactggaagaaaggaactccatttgctgatgaccaagggatctataatgggcttacttggtgggagcaagttgacaatgggaagcaactcacacgcaacagaaagttttgactgttgtacctgtcgtgctgtacttgatagcttcacacacaacagactatcagcacccaatgctgctcttaaatacaatagcagtggccgtgctggttattgccaagtttccaaatatgcacaaggtccgtatctttgggattaatggggagcagtgagatggtttattagcttggaagcatgacttatgcaagaaggaaaagtaaaaaaagataaatctttgtatagtaatcagaactgaaaacgatttttgaagtgtaatgtttagtgactttgttcttttcacaaaggctccttgctggataatgagagaataaaagtttactagttgtttatgtatagcaaatatcttatatattcaggagattttatttgactttaagtttaagcaggttacatgatgcgatacttcccgggaaatgttatgtccagagca

SEQ ID NO: 2685 - DNA, 706 bp, Cyclamen graecum
atataatctcccccataaccaaatcaaatacctagaaccgaaaatcagagtaatagaatggcgaaattgtatgtgaatgcggtgcagccggtggatatgaaccggaacacggagtggttcacgtaccccggcgtgtggaccacctacatgctcatcctcttcttcgcttggatcgtcgttctttcgatcttcggatgctcccccggcatcgcttggtccatcgtcaatctctcccatttcgctgtcacttatcacttttttcactggaagaaaggaactccttttgctgatgaccaggggatgtataatgcattgacttggtgggaacagattgagaacggaaaacagctcacacgtaacagaaaattcttaactgttgttcctatggtgttgtacttgatagcctcgcacacgaccgattaccagcacccaatgctcttctttaacaccgtggcagtgattgtgttggttattgccaagttcccgaatatgcacaaggtccggatctttgggatcaatggagaagatcagtgatttgaacacaaagctaatcatttcattgcaatggtgtaaaaacttgggatcgtatcttagtttatgcttatttaaagtgatatcgtaaagaaaagttgataatgtcggaacggattgttgaatttgtaagttttttgtgcccgacttttctcattagtgagttttttgggga

SEQ ID NO: 2686 - DNA, 631 bp, Bupleurum chinense
ttttgggaattgatctatataggtgtcaacagcagttgcgcaaaccatcacagctgaatcaatacaagagaaagagagttgtatacatatacatacatatatatatatatataatagattgttggatggcgaattattacgtaaaggcgacaccaccgccggatctgaacaaaaacaccgagtggtttacatatccaggcgtatggaccacttatattctcatcctcttcttcgcctggctcgttgttctctccatccttaattgttctcctggaatggcttggaccatcgttcatctctctcacttcatcgttacctatcactttttcactggaagaaggaaccccatttgctgatgaccaagggatctataatgggcttacttggtgggagcaagtcgacaatgggaagcaactcacacgtaacagtaaagtttttgaccgttgtacctgtcgtgctgtacttgatagcttcacacacgacagactatcagcacccaatgttgctcttaaatacaatagcagtggccgtgctagttattgccaagtttccaaatatgcacaaggtccgtatctttgggattaatgggggagcagtgagatggtttattagcttgcatgcatgacttatg

SEQ ID NO: 2687 - DNA, 605 bp, Brassica oleracea
attattgtggaatagatcggatcgatggcgaatctgtacgtgaaagcggctccaccgccggatatgaacaggaacacggagtggttcatgtacccaggggtgtggacgacttatatactcatcctcttcttcggatggctcgttgtgctctccgtctctggctgttcccctgggatggcttggactgttgttaatctcgctcacttcgttgtaacgtatcactcctttcactggatgaaaggaacgccttttgcagacgaccagggagtctacaatggtctcacctggtgggaacagatggacaacggtcagcaacttacccgcaaccgcaagttccttaccgttgttcctgttgtcctgtacttgatagcatcacatacaacagattacaggcatccatggctattcctcaacacactcgctgtgatggttctagttgtggccaagttccctaacatgcacaaggtgcgcatcttcgggatcaacggtgataagtaacgttctttagcaaaactcagatccatttcttttctggcaagagaaaagtggatataaccaaacacatgtatgtataaaatgttgatatgagttggtttggagttgtc

SEQ ID NO: 2688 - DNA, 838 bp, Musa acuminata
gccttctctggtacgttcttctgtcgaatccatccgttgttgtggtttcgatccaatcccatctcttcactcgctggaacggaatcccccgaacctgagagatcggaaagagggcgagggaggcggacagcgtcgtggatggcgaaactctacgtgcaggcggtgccaccggtggacatgaacaagaacacggagtggttcatgtaccctggggtttggaccacctacatcctcatccttttcttctcctggcttgtcttcctctccatcttcggctgcaacccgggcacggcctggaccatcgtcaatctcgtccactttgccataacctaccactttttccattggaagaagggaacaccattctctgatgaccagggaatctacaatagcttgacttggtgggagcagatagacaatggcaaacagcttacacgtaatcggaagttcttgactgttgtccctgttgttctgtacttgatagcctcacacacaactgattaccggcatccgatgcttttcctgaatacagttgcagtgattgtgctggtcattgccaaattgcctaacatgcacaaagtacggatatttggcatcaatgcaggccactgagtggcagttcatgataacttcctgagaaaagatgttctttgtagattgcaggttccttttctggtactaaatggggcctagtgctaatgaatggcctacaacaagccagtaaggtgtttacataatccttgtacagagtacataagttgaaagggagtttcggtgtttatgttaattgccaagtttgtaactaagaacagagaacagaatgaagaagtcgattgca

SEQ ID NO: 2689 - DNA, 721 bp, Cichorium intybus
atacgatggagcatccacaggaaacaacgattcaaccagtctctgtaccaaaacttgacctagttctcgatagatggcgaatttgtatgtacaagcggcgccgccgacggatctgaacaggaatacagagtggttcacgtaccccggcgtctggatcacctacatactcatcctcttctttgcttggctcaccgttctctccgtcttcggttcttctcctgggatggcttggaccatcgtcaatctctctcacgctgtgatgacataccacttctttcactggaaaaagggaacaccgtttgctgatgaccagggtgtctacaacaggttgacctggtgggaacagatcgatggtggcaagcagctcacacgtaacagaaagtttcttactcttgtccctttggtgctgtacttgatagcatctcacacaacagattaccagaaccccatgctacttttcaacaccctggcagttttcgtgttagtccttgccaaatttccacatatgcacaaggtccgcatttttggaatcaatgccgaagagtgaaatttctccctcctttctaaaaattgttacactatcattttcagttgcatacattacattgcaaacgtaaactcagttttttagcaaatgacttgaggaattttgattgcaagctgcatatttttctgtctttcttttcatgaaaaagttaacatgctacaaaaggtacttccg

SEQ ID NO: 2690 - DNA, 906 bp, Cichorium intybus
tccaattaaattaaatcactaaatattacttgcacatcgtccacgtttgaaagcacacaagaattttgttacctttgttttacttgatgtatgctgtcaataatctgcagcgtcaacgaacaatccatcaccctcaacacgcagaacgggccgtcaacaactacacatacgatggagcatccacaggaaacaacgattcaaccagtctctgtaccaaaacttgacctagttctcgatagatggcgaatttgtatgtacaagcggcgccgccgacggatctgaacaggaatacagagtggttcacgtaccccggcgtctggatcacctacatactcatcctcttctttgcttggctcaccgttctctccgtcttcggttcttctcctgggatggcttggaccatcgtcaatctctctcacgctgtgatgacataccacttctttcactggaaaaagggaacaccttttgctgatgaccagggtgtctacaacaggctgacctggtgggaacagattgatggtggcaagcagctcacacgcaacagaaagtttcttactcttgtccctttggtgctgtacttgatagcatctcacacaacagattaccagaaccctatgctacttttcaacaccctggcagttttcgtgctagtccttgccaaatttccacatatgcacaaggtccgcatttttggaatcaatgctgaagagtgaaaatttttctccctcctttctaaaaattgttacactatcattttctgttgcgtacattacattgcaaacgtaaactcagttgtttagcaaatgacttgaagaattttgattgcaagctgcatatttttctttgtctttcttttcatgaaaaaagttaacatgctagaaaaaggtacttcctaatttgctacct

SEQ ID NO: 2691 - DNA, 1084 bp, Echinochloa colona
ccccgtcggtcgcccgcccgccaccacccccaatcgcaatactttttcgccaccatctttgaaccttcctcctccgctctgaccagcgcgcgccccccgtcccatccatccttataaatcgagcccgaggccggcgggctccctccctccctcctctcccagaccgcagcagcagagcagcacgcagccgacgagggagccgagccggcggagtgggaggagagggtgcggctggtcggtcgattcgatggcgaagctgtacgtgcaggcggtgccgccgccggatctgaacaggaacacggagtggttcatgtaccccggggtctggaccacctacatcctcatcctcttcttctcctggctcctcgtgctctccgtcttcggctgcacccccggcacggcgtggaccgtcgtcaacctcttccacttcgcgatcacataccactttttccattggaagaaaggaacaccttttgctgatgaccagggaatgtacaatgcattgacttggtgggaacaaatggacaatggcaaacagcttactcgtaacaggaagttcctaattgttgttcctgtagtcctgtatctgatagctttgcacaccacggactaccaacagcctatgctcttcctcaatacccttgccgttagcgtgcttgttgtcgctaaactcccaaatatgcacaaggtccggatttttggaataaatgcggaggactaatcagcaacaaccttcagcagacatctacctatatgttttccagagtggtctgtatgttccccttctagtgcttagttgggctcatgggagtaccagtgagtagtgtttaaaagttgttagcagatgggccttggtcgttgtatagagaaatgctcagaggctggaaatgtcgatgctgtacatctggtgtgcacggattctgtagacttttaatgttgttatgtgctttgttgcaagcatcttgtcagttgctacatgtacagtatcattcttgcagagcaatattttctcatctaccataattccaagatagcaatacagtactggctgtgtctatggacaggtgatgatggataaaggggc

SEQ ID NO: 2692 - DNA, 859 bp, Malus domestica
gtcgccaaccccaaaaatcccccgaatctcaatccgtcctgcaacgcaacttccccaaatcgtcttttcgtttttgacgtcggtgatgatgagcagctgctccttattaacactcccatcatcgtcgtcatcaatcttaatcttcatctcgtagtctcttccggttaattgatttcgtttcatcatcccaaaaaattcagaaaatcctgaaaaaaaaaaggatcggaaaatgtacgtaacggcggtgcgaccgacggatctgaatcggaacacggagtggttcacgtaccccggagtctggaccacctacattcttatggtgtttttctcgtggctcaccgttctctgcctcttctcttgctctcccggcatggcctggaccgtcgtccacctctcccacttcctcgttacttatcacttttttcactggaagaaaggaacaccatttgcagatgatcagggtatctacaatgcactgacatggtgggagcaaatagacaatggcaaccaactcactcgaaacagaaagtttctaactgttgtgcctgttgtgttgtacttgatagcctcacacacgacggactatcaaaatccaatgctcatctttaacacgctagcagtttttgtgttggtagttgcaaagttcccaaacatgcacaaggttcgtatattcggaatcaacgctgatcactgatctctctaaacgatcaagcttgactatagttttcttggtctagtcatatgagttttcttggtctaatcatattggcattcggacataatggtagaatccctgttgaaatgttgaaactggaaacagtgtattgttttttggatgaagtgaaattttttacccctc

SEQ ID NO: 2693 - DNA, 869 bp, Arabidopsis lyrata
gtcgtctttcacgggcacacaatattaaaccaaacaaacaaacaatccttcttctcgccgaaagagagaattttgtgaatctgggttttcaatttaggtgtttaatttaagattttgatcaatacccatttcaaaagaagacgagattcgatccgatcgatcagatttgtacaaggagaaatggcgaatctgtatgtgaaagctgttccaccaccggatatgaataggaatacggaatggttcatgtatccaggagtttggactacttacatgctcattctcttcttcggttggctcgttgttctctctgtctctggttgttcccctggaatggcttggactgttgttaatctcgctcacttcgttgtgacgtatcacagcttccactggatgaaaggaactccttttgcagatgaccaaggaatctacaatggtttaacttggtgggaacaaatggacaatggtcaacaacttacccgcaaccgcaaatttcttaccgtagttcctgttgtcctgtacttgatagcatcgcatacaacagattacagacatccatggctgttcctcaacacactcgctgtgatggttctcgttgttgccaagttccccaacatgcacaaggtacgcatctttggtatcaatggtgataaataagttttcttttgcggtaagagaacacctcaaagaagaaggaaaagggggatataagcaaacatatatatatatatatgtgtaaatgttcatatgagttggtttaattctcgagtcgtcatgtttttgttggatatttgtaagtaaactaattttgaagctttgaactatctcctttttctatataaatagacacgaaattcataaagctttctctt

SEQ ID NO: 2694 - DNA, 1111 bp, Aristolochia fimbriata
cgcatccgacgcgggggatcggctcgctgtctctctgccctctttgcttcgatcgctgccctttctctcgcgttctttttccttcctccgcctgcaactcggtccgtcaaggttcggtcgggactcgctcggcggataagggcgaaatcaccggactggttacgctgctccttggaactactcacctttgattttgtcggtgcatggcttgagctccttctcgggaatggcattactctacgtgcagactgtgcctcctccggatatgaataagaacacggaatggttcatgtacccgggcgtttggaccacttatattttgattctgttcttctcgtggctgatagttttgtccgtcttcggctgtactcccggcatggcgtggaccattgtaaatctctgccattttgtggtaacttatcacttttttcattggaagaaaggaactccctttgctgaagaccaaggtatctataatggtttaacatggtgggagcagatggacaatggcaagcagcttactcgaaataggaagtttttgacagtggtacctgtagtcctgtacttgatagcctctcatacgactgactaccaacaaccaatgctctttctcaacactctcgcggtgtttgtgctggtggtagccaagttcccgaacatgcacagggtccgcatctttggcattaatgcagaaaattgagagagagcagcgcatctttggcattaatgcagaaaattgagagagcagcgcatctttggcattaatgcagaaaattgagagaggagcagtctttgtataagtagcctatgaagatcctttcagtaaaatgggtaccactgtacagcagcttcagctaatggactaaaaggaacccttttttctcttctgtgacaagtgagaattttatgaggattgttgttacaggtttttgatgcttgttcttagatatcataataaatgtatttgaatatcttctgtacagttgtcctcggtttacacttttgttggaattgtgttgttattatgttttccagtgaccatctctctctcaaaaaggaatcgaacataatttttgggaagacatcaaagaaatgcaatgagtattattga

SEQ ID NO: 2695 - DNA, 793 bp, Brassica oleracea
gcgaaaaagcagtcgtctcctccagattaaaccaaaccagaccacaaatctgaagagacccctttctccttcttcctccccacccccaaaaagagagccgagagttttgtgtgaatctgggttttcgatttcatctggtaaacagagggagaatcgaatcgtcattattgtggaatagatcggatcgatggcgaatctgtacgtgaaagcggctccaccgccggatatgaacaggaacacggagtggttcatgtacccaggggtgtggacgacttatatactcatcctcttcttcggatggctcgttgtgctctccgtctcgggctgttcccctgggatggcttggactgttgttaatctcgctcacttcgttgtaacgtatcactcctttcactggatgaaaggaacgccttttgcagacgaccaaggagtctacaatggtctcacctggtgggaacagatggacaacggtcagcaacttacccgcaaccgcaagttccttaccgttgttcctgttgtcctgtacttgatagcatcacatacaacagattacaggcatccatggctattcctcaacacactcgctgtgatggttctagttgtggccaagttccctaacatgcacaaggtacgcatcttcgggatcaacggtgataagtaacgttctttagcaaactcagatccatttcttttctggcaagagaaaagtggatacacatatatgtataaaatgttcatatgagttggtttggagttgtcggatattttgtaagtaactttgaagctttgaatt

SEQ ID NO: 2696 - DNA, 852 bp, Brassica rapa
aattaaaaatgattccacagtagatgcgaaaaagcagtcgtctcctctcaccggcattaaaccaaaccaaaccaaaccagaaatctagagactccttcctttctccttcttcctccccaaatcgaatcgtgatattgttgtggaatagatcggatcgatggcgaatctgtacgtgaaagcggctccaccgccggatatgaacaggaacacggagtggttcatgtacccaggggtgtggaccacttatatactcatcctcttcttcggatggctcgttgttctctccctctctggctgttcccctgggatggcttggactgttgttaatctcgctcacttcgttgtaacgtatcactcctttcactggatgaaaggaacgccttttgcagacgaccagggagtctacaatggtctcacctggtgggaacagatggacaacggtcagcaacttacccgcaaccgcaagttccttaccgttgttcctgttgtcctgtacttgatagcatcacatacaacagattacaggcatccatggctattcctcaacacactcgctgtgatggttctagttgtggccaagttccctaacatgcacaaggtgcgcatcttcgggatcaacggtgataagtaacgttctttagcaaaactcagatccatttcttttctggcaagagaaaagtggatataagcaaaacacatgtatgtataaaatgttgatatgagctggtttggagttgtcggatattttgtaagtaactttgaagctttgaatttcttcttttttatgttttcttttttaatatatagacacgaaattcataacaaatttttcttagtcaaattaatttgggc

SEQ ID NO: 2697 - DNA, 861 bp, Musa acuminata
ccttttcctgccttctctggtacgttcttctgtcgaatccatccgttgttgtggtttcgatccaatcccatctcttcactcgctggaacggaatcccccgaacctgagagatcggaaagagggcgagggaggcggacagcgtcgtggatggcgaaactctacgtgcaggcggtgcctccggtggacatgaacaagaacacggagtggttcatgtaccctggggtttggaccacctacatcctcatccttttcttctcctggcttgtcttcctctccatcttcggctgcaacccgggcacggcctggaccatcgtcaatctcgtccactttgccataacctaccactttttccattggaagaagggaacaccattctctgatgaccagggaatctacaatagcttgacttggtgggagcagatagacaatggcaaacagcttacacgtaatcggaagttcttgactgttgtccctgttgttctgtacttgatagcctcacacacaactgattaccggcatcctatgcttttcctgaatacagttgcagtgattgtgctggtcattgccaaattgcctaacatgcacaaagtacggatatttggcatcaatgcaggtcactgagtggcagttcatgataacttcctgagaaaagatgttctttgtagattgcaggttccttttctggtactaaatggggcctagtggtaatgaatggcctacaacaagccagtaaggtgtttacataatccttgtacagagtacataagttgaaagggagtttcggtgtttatgttaattgccaagtttgtaactaagaacagagaacagaatgaagaagtcgattgcagatcggctttcatt

SEQ ID NO: 2698 - DNA, 905 bp, Brassica napus
gatacaattaattaattaaaaatgattccacagtagatgcgaaaaagcagtcgtctcctccagattaaaccaaaccagaccacaaatctgaagagacccctttctccttcttcctccccacccccaaaaagagagccgagagttttgtgtgaatctgggttttcgatttcatctggtaaacagagggagaatcgaatcgaatcgaatcgtcattattgtggaatagatcggatcgatggcgaatctgtacgtgaaagcggctccaccaccggatatgaacaggaacacggagtggttcatgtacccaggggtgtggacgacttatatactcatcctcttcttcggatggctcgttgtgctctccgtctcgggctgttcccctgggatggcttggactgttgttaatctcgctcacttcgttgtaacgtatcactcctttcactggatgaaaggaacgccttttgcagacgaccaaggagtctacaatggtctcacctggtgggaacagatggacaacggtcagcaacttacccgcaaccgcaagttccttaccgttgttcctgttgtcctgtacttgatagcatcacatacaacagattacaggcatccatggctattcctcaacacactcgctgtgatggttctagttgtggccaagttccctaacatgcacaaggtacgcatcttcgggatcaacggtgataagtaacgttctttagcaaactcagatccatttcttttctggcaagagaaaagtggatacacatatatgtataaaatgtttatatgagttggtttggagttgtcggatattttgtaagtaactttgaagctttgaatttcttcttttttatgttttctttttaatatattagacacgaaattcataacaaaattttctagtc

SEQ ID NO: 2699 - DNA, 1045 bp, Manihot esculenta
tcgctattctattcggcgacgattgatgagctcgaacccctgcctattgtgcccactttgaaaatatcttctctttctttacctatttctcgttctgtgtcgtcacggcctaagaaactaaaccgagaaatcgaaaatcgtcggacccgatctttgattgggttgtcatccccatttctgggcaatcgtaatttctttgtctgcaaaaagttggtgtttttatcgtcacccatacagagaatgtacgtgaaagcggtaccaccgacggatttgaataggaacaccgagtggttcacgtatcccggggtttggactacctatatcctcatggttttcatgtcttggcttattgttctttccatctttggctgctctcctggcatggcctggaccattgtccacctttctcatttccttattacctatcatttctttcactggaagaaaggaactccatttgctgatgaccagggcatttacaatgggttaacttggtgggagcaaatagaaaatggcaagcaactgactcgcaataggaagtttttgactgttgtacctgtagtgctgtacttaatagcctcgcacacaacagactatcaaaacccaatgctgttctgcaacacattggcagtattcattttggtggtagctaagttccctcacatgcacaaggttcgcatattcggaatcaatgctgatcactaaactgctaaaagttttcatgctcaacttaaacatagatagatccaacttttgttttgcattctgtgatgatgatgatatcatccttccacagatactgaaccgtgagggatcatcattatttgtttacaatcaagctaagatatgtgtacgtccctcggctacatgtagggagaaaaatggtcactataatttcccttttacctgtttgttatttattttctttttcccattgccttcttctgcattcttgttgagcctagaacttctgttttattatttatctttctcaactctaaaattctctagtcctgaactaatattatccaaatatttcgcttgg

SEQ ID NO: 2700 - DNA, 991 bp, Cenchrus ciliaris
ctcaccagtccctctcaccgcctcgttagtttttcgcccccatctttgaacgccgcggcggcctccacctcaatccctccctcctcgtcccccctccgatcccgcgcgtataaatcccgccgcagcggaccgccaagcacgcgccaacacagctcgctgctgctgctgctcccccccttccttcctgccgtttccccccgtcggcccgggcggaaggggttctcgcgaggcgaggcggctggggattgctcgggagcacacccccgcgatggcgaagctgtacgtgcaggcgttcccgcccgcggatctgaacaagaacaccgagtggttcatgtacccgggcgtctggacgacctacatcctcatcctcttcttctcctggctcctcgtgctctccgtcttcggctgcacacccggcaccgcctggaccgtcgtcaacctcttccacttcgcgatcacataccattttttccattggaagaaaggaacaccttttgctgatgatcagggaatgtacaatgcattgacttggtgggaacagatggacaatggcaagcagcttactcgtaacaggaagttcctcattgtcgttcctgtagtcctgtatttgatagctttgcacaccacggactaccaacaacctatgctcttcctcaatacccttgctgttagcgtgcttgtggtcgccaaactaccgaatatgcacaaggtccggattttcggaataaatgctgagaactaagcagcggcatcctttcagccgacatctacctatatgcttttccagagtggtctgtatgttccccttctagtgcttagttgggctcgcgggagtaccagtgagtagtgttcaaaagttgttaacagatgggccgtggtcgttgtatagagaaatgctcagaggctggaaatgtcgctgctgtgcatctgatgtgtgcacggattctgtagactctttaatgttgctatatgcttccttgcaagcatctgt

SEQ ID NO: 2701 - DNA, 798 bp, Centaurea maculosa
tattttctttttacgaagaacatggattaacgggtaaacaccatgtgaaattgtcatctggcggatgatgatgatatgatatttggggaaaaagaaaaagaaaatcgagagagaagggctcatttgcaaaatttccaccgtcaaccctggtaggagatcataatataacaatataatcccatttccatttcatcaagaaagaaaggaaatcctttgatcttggtgaagttgttgttgatagggaattaattaagatgatgtacgtgaatgcgagaccgacgacggatgtgaaccgaaacaccgagtggttcacgtacccgggagtatggaccacatacatcttcatcctcttcttttcatggcttctcatcttatccattcttggttgcacccctggcatggcttggaccattgttaatctctcccatttcctggtgacctataactttttccattggatgaaaggaactccctttgccgaggaccaggggatgtacaacaggctcacctggtgggagcagatagacaacgggaaacagcttactagaaacagaaagtttttaaccgtcgtacctgtggtgctgtacttaatagcctcgcacacaactgattaccagcatccgatgctattcctgaacacagttgctgtacttgtgctggttattgccaagttccccaatatgcataaagtccgtatctttggaattaacggagatatgtgagcgtttttgttctaatatcagtgtatagaaaggaaaaggaaaaggttatgttgctgagtaacatttttgttttgac

SEQ ID NO: 2702 - DNA, 901 bp, Centaurea maculosa
tattttcttttaaagaagaacatggattaatgggtaaacaccatgtgaaattgtcatctggcggatgatgatgatatgatatttggggaaaaagaaaaagaaaatcgagagagaagggctcatttgcaaaatttccaccgtcaaccctgatcataatataacaatataatcccattttccatttcatttccatttcatcaagaaagaaaggaaatcctttgatcttggtgaagttgttgttgatagggaattaattaagatgatgtacgtgaatgcgagaccgacgacggatgtgaatcgaaacaccgagtggttcacgtacccgggagtatggaccacatacatcttcatcctcttcttttcatggcttctcatcttatccattcttggttgcacccctggcatggcctggaccattgttaatctctcccatttcctggtgacctataactttttccattggatgaaaggaactccctttgccgaggaccaggggatgtacaacaggctcacctggtgggagcagatagacaacgggaaacagcttactagaaacagaaagtttttaaccgtcgtacctgtggtgctgtacttaatagcctcgcacacaactgattaccagcatccaatgctattcctaaacacagttgctgtacttgtgctggttattgccaagttccccaatatgcataaagtccgtatctttggaattaacggagatatgtgagcgtttttgttctaatatcagtgtatagtaaggaaaaggaaaaaggttatgttgctgagtaacatttttgttttgacttcctgttctacaagataccaaaaataacatcatctttgtataccggaattatgctatatatatgtctaacatgttctcctcaaaaaaaaaaaaaag

SEQ ID NO: 2703 - DNA, 1071 bp, Citrus clementina
ccaaaggagcaccacggggcgcgggcgcacactgcgcacggcacacggaaagggcaggaaggactattaattaaaaaataatgactaatgacaaacaaaacaagggatatctgaaattttcgggttatctgacgactgatccatctcttctcttccaccctttagtttaatcaatcatccaactcacccgtctcttagtccctatctatagttctatataaataaataaagaaacaacaaatacttttgtttttattttttctttttcctctgaaatctgaaatctgaaacgcatacatcatcatcgtcatcagattaaagaaggaaagaaagaaagaaagaaagaaaaaagcaaaaaggtataaatagtgagtaagtaaagaagacgaagagagattgagttgattgttagtgaggaaaggagaagagaagatgtacgtaaggacagtgccaccgacggatctgaacaggaacacggagtggttcacgtatccaggcgtatggacgacatacttatccattctattcatatcatggcttctcgttctttctctcttcaattgctcttccggcatggcttggaccctcgttcatctctctcattttttcgttacttatcacttctttcactggaagaaggggacaccctttgccgatgaccaggggatttacaacggcttgacctggtgggagcagattgataatggaaagcaactcacccgcaataggaagtttttgactgttgtacctgttgtgctgtatttgattgcctcacacacaacagactatcaaaatccgatgctcttcttcaatacactggcagtttttgtactggtggttgcaaagttcccaaacatgcacaaggtccgaatattcgggatcaacgcggatcattgaactgctgagggatttatgtttctttaatttagttgataggtttgatcattttgttgttccaatctaatggtgaatggtgatttcgcagtagagaatcaaaactgtgaaggccgcggtactttttacatgtgtagtgaatacattatacgaatacgtccctccattaccaagtgg

SEQ ID NO: 2704 - DNA, 974 bp, Cleome spinosa
aagcccaacctcaaacccaaaacacgcagagagagagagagcacgtctctctccttcgaatagaaagagagagagagagagagatcggcgatcagacaagaagaaaacgaaaggattatcaaaacgatcctcgcgttcgtcaaaatccggctgcgattctcatcgatcaccggtctcgcgaatcgatttggtccccggcgaataagaacttcgtaggaggaagaagaagaagaagaagcggagggaaatcggcggcggagaatgatgtacgtgagggcggtgccgcctacagatgtgaatcggaatacggagtggttcacgtacccaggtgtttggaccacttacatcctcatcctcttcttttcgtggctcatcgtcctctccgtcttcggctgctctccgggcatggcctggaccatcgttcatctcgctcatttcgtcgtgacatatcattcctttcactggaggaagggcacaccttttgccgatgaccaggggatctacaataggttaacctggtgggaacagatagacaacggcaagcagctcacacgcaacaggaagttcctgaccgttgttcctgttgtcctgtacttgatagcctcgcacacgacggactatcaacatccgatgctattcctcaacacactggctgtatttatactggtggttgcgaaattcccgcacatgcacaaggtccgtatatttggaatcaacgccgaccaatgaggaaggcgcagtgcctttgtttggtaaaaggtaatttgtaagtcttaatcaacgtatctatctatctatatgtacagacattgggaccagaaatggatatacccaccacatatgagatatatacccttttagattcttatgtaaaagtaagcaatatatactcaatctcgaaagttgtaaggctccatagaacaatagctcttcctcctcacttgtttattattgttattatcatgctataaaga

SEQ ID NO: 2705 - DNA, 558 bp, Eschscholzia californica
atctctctcattctcatagaagaagaagaagaagaagaaggggggagatggcaaagttatacgtacaaacggtaccaccaccagatctgaacaagaacacggaatggttcatgtacccaggtgtttggactacttatatgttgatcctctttttctcatggctcatggttttatctatcttcggttgtaaccctggcatggcttggactatcgtcaatctctctcattttgttgtaacttatcagttcttccactggaagaaaggtactccatttgctgaagaccagggtatttatagaggattgacgtggtgggagcaaattgacaatgggaagcagcttacacgcaatcgaaagttcctcactgttgtgcctgtggtattgtacttgatagcttcccacacgactgactaccaaaatccgatgttgtttctcaacacattggcagtgtttgtgttggttgttgccaagtttccaaacatgcacaaggtccgaatatttggaatcaatggagaacagtgatcgacgatgattttcagtttcacttctgtaaaatgca

SEQ ID NO: 2706 - DNA, 815 bp, Ipomoea batatas
cggggatcttcatccatctatatactcgcctgtctctttcattctgcgattcgctttcgattttcgtctacgtttcacttattcacttttacttctcctctttgtttgagattgcgggttgggttgggttggtaggtagaagacgcccaattctttccattttttttccaagcaagggcttccaatcgtcggatcttccaattttgcgagcctctggtgtttgaattggatggcgaatttgtatgtcagggcggcgccgtccacggatctgaataaaaacaccgagtggttcacgtatccaggggtgtggtccacctacatccttatcctcttcttctcatggctcgttgttctctccgtcttctgcagctctcccggcaccgcctggacaatcgtcaacctctctcatttcatgattacatatcacttctttcactggaagaaaggaacaccttttgcagatgaccagggtatttacaataggttgacttggtgggaacaaatagataatggcaagcagcttacacgcaatagaaagtttctgacagttgtccctgttgtactgtatttaatagcctctcacacaactgattatcaacacccaatgctgttcctgaacacagtggcagttttcatattggttgttgccaagtttcctcatatgcacaaagttcgcatcttcgggatcaatgcagatcagtgagccgagtgttggttccactataaagtatgaatcccaagtgatccattatattttgacgtcctctcgcgagtaaattgagattgcccctgtacagaacaaatgatgaatgttt

SEQ ID NO: 2707 - DNA, 1022 bp, Pennisetum glaucum
ccatctcacccgtccctctcaccgcctcgttaatttttcgcccccatctttgaacgccgcggcggcctccatctccacccctccctccgatcccgccgcgcctataaatcccgccgccgcagcggacccgccaagcacgcgcccacacagctcgctgctgctccctcccttccttccagccgttctcccccgtcggccagcgggcggaaggggttctcgcgaggtgaccgaccgggcgggcgggcgggcgactggggattgcttgggagcaaccccgcgatggcgaagctgtacgtacaggcgttcccgcccgcggatctgaacaagaacaccgagtggttcatgtacccgggcgtctggacgacctacatcctcatcctcttcttctcctggctcctcgtcctctccgtcttcggctgcaccccaggcaccgcctggaccgtcgtcaacctcttccacttcgtgatcacataccattttttccattggaagaaaggaacaccttttgctgatgatcagggaatgtacaatgcattgacttggtgggaacagatggacaatggcaagcagcttactcgtaacaggaagttcctcattgtcgttcctgtagtcctgtatttgatagctttgcacaccacggactatcaacaacctatgctcttcctgaatacccttgctgttagcgtgcttgtggtcgccaaactaccgaatatgcacaaggtccggattttcggaataaatgctgagaactaagcagcggcatcctttcagccgacatctacctatatgcttttccagagtggtctgtattttccccttctagtgcttagttgggctcgcgggagtaccagtgagtagtgttcaaaagttgttaacagatgggccgtggtcgttgtatagagaaatgctcagaggctggaaatgtcgctgctgtgcatctgatgtgtgcacggattctgtagactctttaatgttgctatatgcttccttgcaagcatctgtcagttgctacaggtacagta

SEQ ID NO: 2708 - DNA, 724 bp, Nicotiana benthamiana
ttccgatccatttggatggcgaattattatgtgagggctgctcctacgacggatctgaatcggaacactgagtggttcacctaccctggtgtttggaccatttacatattcattcttttcttctcgtggatggctgtgcaatctgtccttggtgtctctcccggcatagcttggaccatcgtcaatctctctcatttccttgtcacgtatcacttttttcactggaagaagggaacaccatttgctgaagatcagggtatctacaacaggttgacttggtgggagcaaatggataatggaaagcagcttactcccaataggaagtttctgacagttgttcctgtggtgctgtacttgattgcttcacatacaactgattatcagcacccgatgctgttcttcaatacattcgcagtttttatactggtggttgccaaatttccaaacatgcacaaggttcgaatttttgggattaatgctgatcaatgagctatattcaattcaaagcatacagttcagcgttactctcatctattatttgaagctttagcgttttttagtaaactgggaacccctgtacaaatgcaagaactgtaaaaggtaaaattacatagttcaagatcaagagcctctgtttagctatgcaattttctattaacctgttgaaggcaagatgctgcaactttgcctctgtattcctttgaattatgtctttctatgcttg

SEQ ID NO: 2709 - DNA, 931 bp, Nicotiana benthamiana
ttgaacccatcccattaccttatacttggactttgtgcgataattatcgccatttccatctgactttggcgattgcttatataaaaaggtttcttcttcaaattcatatttgtctttgcttatttatatatacacactaacgtttcactacagacggtggggatagaaagtatttttcgatccatttggatggcgaattattatgtgagggctgctcctacgacggatctgaatcggaacactgagtggttcacctaccctggggtttggaccatttacatattcattcttttcttctcgtggatggctgttctctctgtccttggcgtctcacccggcatagcttggaccatcgtcaatctctctcatttccttgtcacttatcacttttttcactggaagaagggaacaccatttgctgaagaccagggtatctacaacaggttgacttggtgggagcaaatggataatggaaagcagcttactcccaataggaagtttctgacagttgttcctgtggtgctgtacttgatcgcttcacatacaactgactatcagcatccgatgctgttctccaacacatttgcagtttttatactggtggttgccaaatttccaaacatgcacaaggttcgaatttttgggataaatgcagatcaatgagctatattcaattcaaagcatacagttaaactttactcttttattatttgaagctttagcatttttctgtaaactgggaacccctgtacaaatgcaagaactgtaaagggtaaagtaaaattttatagtacaagataaagagcctctttttagctatacaattttctatcaacctgttgaaggcaagatgctgcaactttgcctctgtattcctatgaattatgtctttctatacttgattaccagctaaagatgcctctttcttacc

SEQ ID NO: 2710 - DNA, 1000 bp, Citrus sinensis
tgatcaatcatccaactcacccgtctcttagtccctatctatagttctatataaataaataaataaagaaacaacaaatacttttattttttctttttcctctgaaatctgaaatctgaaacgcatacatcatcatcgtcattagattaaagaaggaaagaaagaaagaaagaaaaagcaaaaaggtataaatagtgagtaagtaaagaagacgaagagattgagttgattgttagtgaggaaaggagaagagaagatgtacgtaaggacagtgccaccgacggatctgaacaggaacacggagtggttcacgtatccaggcgtatggacgacatacttatccattctattcatatcatggcttctcgttctttctctcttcaattgctcttccggcatggcttggaccctcgttcatctctctcattttttcgttacttatcacttctttcactggaagaaggggacaccctttgccgatgaccaggggatttacaacggcttgacctggtgggagcagattgataatggaaagcaactcacccgcaataggaagtttttgactgttgtacctgttgtgctgtatttgattgcctcacacacaacagactatcaaaatccgatgctcttcttcaatacactggcagtttttgtactggtggttgcaaagttcccaaacatgcacaaggtccgaatattcgggatcaacgcggatcattgaactgctgagggatttatgtttctttaatttagttgataggtttgatcattttgttgttccaatctaatggtgaatggtgatttcccagtagagagtcaaaactgtgaaggccacattactttttacatgtgtagtgaatacattatacgaatacgtccctccattaccaagtggaaaatttggtatactcgtctttatttctctttgcaactgattcatatagatggattttggcgttaaatgattgtcatctattatgaagtggttttatcctcaaaa

SEQ ID NO: 2711 - DNA, 667 bp, Orobanche aegyptiaca
ccaccgctcagaattcgagccactggcactcgcgcactataaccaaagttatctcacgctgataccaatttcggatcgggtcgaaatcggattcgagaatcatggggaagctgtacgtgacaatggcgccgccggcagatctgaaccggaacaccgagtggttcacctatccgggggtttggactacgtacatactgatcctattcttctcctggctcatcgttctttcgattaccaattgtacacccggcacggcatggacaatcgtcaatctctgtcatttcctggtaacttaccacttcttccactggaaaaaggggaccccttttggtgatgatcagggaatatataatgcattgacatggtgggagcagatggacagtggaaagcagctcactcgcaatagaaagttcctcacagttgttcctgtggttctctacttgatagcgtcacacacaacagactaccagcaccccatgctattcctcaacacactcgcggtgcttatcttagtcgtcgctaagttcccaaatatgcacaaggttcggatctttgggattaatggggatcagtgattttttaacctatctgcaaacaagtaggttttaaagtaaaaaatttgaactgcacaatatttgtaatggttaattatactagcataattacc

SEQ ID NO: 2712 - DNA, 700 bp, Petunia hybrida
aattacttatatatacacaattttccaattacaaatattttcatttctatttacacatataattaaaatggcgaaattatatgtaacggcggtaccgccgacggatctgaatcggaatacggagtggtttacatatccaggtgtatggactagttatattttaatattatttttctcatggcttattgttctctctttatttggttgttcttctggcatggcttggactattgttcatctttctcattttctcgtcacatatcaatgttttcactggatgaagggaacaccattttctgatgaccagggtatctacaataggttgacttggtgggagcagatagataatgggaagcagcttactcgcaataggaagtttctaacagttgttcctgtggtgctgtacttgatagcctcgcacacaactgattatcaacatccaatgctgttcctcaacacagtcgcagtatttatactggttgttgctaaatttccacatatgcacaaagttcgtatttttgggatcaatgcagatcaatgagttaaacacataccacaggaagggaaaagacatagtatttgattgctttagcatcttgggatgcccctgtacagatgcaagaactggaaaggtatcattattttgtaaaggaatcgtcggctctctcttctcgatattcattgtatgaactggttggat

SEQ ID NO: 2713 - DNA, 992 bp, Phalaenopsis aphrodite
agaaaactcccaaagggataaaagtccaggcattgaccgactgagcggccgatctttcgcttcccacttctcccctaatcgcacgactatcggttctcccttcaccttcacgaattttgccgtttgcaattgatattttatcaaattatctcttacttcggtgctcgcttggtgtgatccgaggtccgggttggagaacgagagcgcaatagatggcgaagctgtacgtggagacgacgccaccaccggatctgaacaagaacaccgagtggttcatgtaccctggagtgtggacgacctacatcctcatcctattcttctcctggcttctcgtcctttcggtcttcggatgcacccctggtacagcgtggaccatcgttaatctcttccattttgcgattacttaccagtttttccattggagaaagggaactccctttgctgaagaccagggtatatacaataatttgacgtggtgggagcaaattgataatggcaagcaacttactcgtaacaggaaatttttgactgtcgttcctgtggtcctatatttgatagcttcacacacaacagactatcagcagcccatgctatttctgaatacagttgcagtgattattttggtggtagccaagtttccatacatgcacaaggtccgtatcttcggaatcaacgccgatcgttaaccagtggttgagcccggaagttcccattttggtcctttatacagaagctcctgacatgggggtttaatatgtgggttttagaattgtgcgactaatttcatggctggctgtcaatgtacagtacttcatgtcgatgcaactagtactgttgatgttatgtaggagacttcccaaaccgttattttaggtatttgagtgctttttcttcttgtattgttattaggactttttggcgaggcttcatgtcactcatagttgctcttcatgccaagaaagcagagcacgcgaaattattgatagattttt

SEQ ID NO: 2714 - DNA, 529 bp, Platanus occidentalis
ttcgatttggtattttgatgatggatggactgagcatctcgtcggggagaatggggaaattgtacgtaaacgcagtgcttcctcccgatatgaacaagaacactgagtggttcatgtaccctggtgtctggaccacttacatcttcatcctcttcttctcctggctcatggtgctttctgtcttcggatgcacccctggcatggcttggaccatcgtcaatctctgccatttcgtcgtcacttatcacttctttcactggaagaagggaactccatttgctgaggatcagggtatttataacggattgacttggtgggagcaggtagacaacggaaagcagctcactcaaaatagaaagtttttgactgttgtacctgtggtgctgtacttgatagcctcacacacaactgattaccaacacccgatgctctttctcaatactcttgcagtactcgtgttggtggtagccaagttcccaaacatgcataaggtccgtatctttggaatcaatgcagaccagtgagttcg

SEQ ID NO: 2715 - DNA, 1082 bp, Populus trichocarpa
gatgactccgtgggattcgaaccctgcccattcccacccgcaccaaaacaccaccccccccccccctcaattcttcgaagtcacaatcttgaaaccaagaggaaaatcccatcttcaaaatctgataattttttttttctcgtcaccaattcttgatcttttcttttctgggtttcctcaattctctttattaacctcattctctatcgatttccaacaacaaagaagaccaaagaaatgtacgtgaaagctgagccagcgacagatgtgaataggaacacggagtggttcacatatccaggagtttggaccacttatatgctcattgttttcatgtctttgcttcttgttctttccatctttggttgttctgctgggatggcctggactattgtccatctttgtcattttgctgttacatatcacttttttcactggaagaagggaacaccttttgctgacgaccagggtatctacaatggattgacttggtgggagcaaatagaaaatggcaagcaactcacacgcaacaggaagtttctgacagttgtacctgtagtgctgtatttgatagcctcgcatacaacagactatcaaaacccaatgctcttcttcaacacattggctgtatttgtgctggttgttgctaagttcccacacatgcacaaggttcgcatatttggaatcaatgctgatcattgaacttgcgaagaattcatgcttggtttgctctagccattaggattgaccttttttgcattccaatgtaacggtaatatccctgtacagatactgaaactggaagggttattatttctttttctattttaatggagtgaatatgtatacatcactaggtcacatgctggaagaatagtgtcctcttgtgccagcttatgcgttttatgtatgcttgatagaagatagaaaatcttcgtaatactgtttccgtttccccctgtatggttgctcactcaagccatttaataaataccgcccaagaggggtgaaagtgaagctgagctttgatcttggatctgtgtgtgtttgcaagcttaactggtcactgttttttttttttt

SEQ ID NO: 2716 - DNA, 873 bp, Raphanus sativus
ggacagtagatgcgaaaaagcagtcgtctctctctctctctctcaggagacacaccagattaaaccaaaccagaaatctggagaatcctcccttccttcttcccccgaaaagagagagttttgcgaatcaggcgaaagtagtagaagaagaagggagaaacgaataaggatcggatcggatcgggatagatggcgaatctgtatgtgaaagcggcaccaccgccggacatgaacaggaacacggagtggttcatgtatccaggggtgtggacgacttatatactaatcctcttcttcgggtggctcgttgttctctccctctctggctgttcccctggaatggcttggactgttgttaatctcgctcacttcgttgtaacgtatcactcctttcactggatgaaaggaactccttttgcagacgaccaaggtgtctacaatgctctcacctggtgggaacagatggacaatggtcagcaacttacccgcaaccgcaagttccttaccgttgttcctgtcgtcctgtacttgatagcatcacatacaacagattacagacatccatggctattcctcaacacactcgctgtgatggttctagttgtggccaagttccctaacatgcacaaggtacgcatcttcgggatcaacggtgataagtaaggcttctttagcatactctcagatccatttctttttatggcaacagaaaaagtggatatgaagcaaaacatatttgtataaaatgttgatatgagttggttttgagttgtcggatattttgtaagtaactttgaagctttgaatttcttctctctttttaaaaaaacatagacacgaaattgataatttctagtaaaattaatttgcgca

SEQ ID NO: 2717 - DNA, 1187 bp, Oryza sativa
gcgccgtgcggtgtgacggcattggtggcgcggtgtgcgtcgcggcacacagccgcacaggcgcacagccaggcagccagcccgtcggtctcctctcctctccccctcgcgttttttcttttcgcctccatctttgaaccttctcctcgccttcttcttcctcctcctccctccgctccgcttctctctgaccaataatctgggcaaacccctcgctcgcgccttctccctcccacctctataaatccccctccattccaatcccacgggctcaggccgcgccaccagcagcagcacacagggcgcgccagctttagcgagagggagagagggggattttgggcgggggagcgatcgatggcgaagctgtacgtgcaggcggtgcagccggcggatctgaacaagaacacggagtggttcatgtaccccggggtgtggacgacctacatcctcatcctcttcttctcctggctgctcgtcctctccgtcttcggctgcacccccggcatggcgtggacgttcgtcaacctcgcccacttcgcgatgacataccatttttttcactggaagaagggaactccgtttgctgatgaccaggggatgtataatagattgacttggtgggagcaaatggacaatgggaagcagcttactcgcaacagaaaatttctgaccgtggttcctttggtcctatacttgatagcctcgcacacgacagattatcaacatcctatgctcttcctcaacaccattgcagttgttgtgctggttgttgcaaaactaccgaacatgcacaaggtccggatctttggaatcaatgctggcaactaggcggcagcatcccacggtttgttatcactaccatgcttcatttgagtggcaggaaacagtatacctagttctgaatggataaccagagtgagtaatttttaagagctgttagtagatgacatgtaatcattgtacagagctaaaggcatggaaatgatgttgttcagcatctagtgaacacacttctttaggctcttatcccaccaaaaagaaactttattttgctgttaatgttgttatatatgtgctcttgttcaagtgtatgtcacatgtgtgtcttatggagaataattttttgtgtacgtaatgtgaggcaggaaagacaatatgcctactcatatcgctatatctcgggg

SEQ ID NO: 2718 - DNA, 1019 bp, Sesamum indicum
ttcctcctcccttcctctcccaaactctatttctatacccacaaaatatcttttgcgtcaagcagttgcagagggtcggaagatttctcagaagatttttgtgattaattgaaggaatagagacgggagtttttttgtgaatggcgaatttgtatgtgcaagcgacgccgacgacggatctgaataagaacacggagtggttcacgtaccccgctgcgtggaccacatacatcctaatattgttcttctcgtggctggtcgtactctctgtgttcggatgctctgctggcatggcttggaccgttgttcatctttctcattttgtcgtgacatatcaattctttcactggaagaagggaacgccattttcagatgatcagggtgtttacaatagattgacttggtgggagcaaattgacaatggcaagcagctcactcgcaataggaagtttttgactgttgtaccagtagtgctgtacttgatagcctcacacaccacaaattaccaacatcctatgctcttcttcaacacaatagcagtttttattcttgtggttgccaagttccccaacatgcacaaagtccgtatattcggaatcaatgccgaccaatgagcttagattcattgatacataccacctgcaggttcacctttagcgctccaatgtttttctgtacagcatctcagtatgttgtggtacctacagctgtggaactggaaagaatatataataccattttgtcaaatatgggtgctgcttactctctgcacgaactctttgtataagttgatttctgaaattcgcataagctataagattccttttaccattgcggaaacttgagttgcctgttttcttgtggactactactgctagttgaaccctgttgagttgattgatgtccccattatggtttagagaatgtaaagatgcgcttacaaacaatttttctttgtcaatttttggggtctagacttggatttctttccattaataattgcaaagatgctcctaatc

SEQ ID NO: 2719 - DNA, 1224 bp, Sorghum bicolor
tctccctcctgcagcggccaaccgtctcgctctcgcctcccctcctccggccttccccgtccgctcaccctccctcgccccgtcggtcgcccgcccgcccgcccgcctcgcaatactttttcgccaccatcgttgaaccttcctcctccaccgctctgaccagggcggcacggccgaggcgcccgtcatcatccttataaatcggcgccgaggcgggccgtcgtctccctcccagaccgcagcagcacagcacgcagccgacggggagagttgagccctgagaagcagagagggcggtagggtgattcgatggcgaagctgtacgtgcaggcggtgccgcccccggatctgaacaggaacacggagtggttcatgtaccccggggtctggaccacctacatcctcatcctcttcttctgctggatcctcgtcctctccgtcttcggctgcgcccccggcacggcgtggacgctcgtcaacctcggccacttcgcgatcacatatcattttttccactggaagaaggggactccatttgctgatgaccaggggatgtataacacattgacatggtgggaacaaatggacaatggcaaacagcttacacgcaaccgaaagtttctgactgcagttcctgtcgttctgtacctcatagcttcccacacgacagattatcagcatcctatgctcttcctcaacaccctagcagtcattgtgctggttgttgccaaactaccaaacatgcacaaggttcggatttttggtatcaatgctggaagctaagcagcagggtcccacggtagaatggtatacacggtatgtttcatacggatcacgggatgtgtttcacctagctctaaactgcttttgccagagtaccagtgtttgagatctgtttgtagatgaaatgtaatcattgtacagttgacatgtttagattcgtaatgttgctatatgttggcaagcaagaatttggcaattgatacatgtacagatctgctctttgccaagaggcaataacgcagcgtgacatgacagaatcatggctggtagaggtaacacaaaatattctcttacatgatacgtgaagtcaggtaacacaatactcctatgctcccaagtttgggttacctgagttcacgtatcaaatttggaattttgtgtattctcttacacaaaatattcactggtaagttgaggttgtaaaacactaccgtacttgaa

SEQ ID NO: 2720 - DNA, 966 bp, Saccharum officinarum
atctttgaacgccgcggctccaacctccatcgctccctccctgcctccctccctcctcgtcccctccgatcccgcctctataaatcgcgccagccgccgcagccgccacagcggaccgcaagcacgaaaccaaacagctcgctgctgctcccgtctgtccccccgtgtcctgtcgttctcccgtcgccgggggcggaagggttcgcgaggccggccggccggcgattagggattgctcgggaaccccgcgatggcgaagctgtacgtgcaggcgttcccgcccgcggatctgaacaagaacaccgagtggttcatgtacccgggcgtctggacgacctacatcctcatcgtcttcttctcctggctcctcgtcctctccgtcttcggctgcacccctggcaccgcgtggaccgtcgtcaacctcttccacttcgcgatcacataccactttttccattggaagaaaggaacaccttttgctgatgaccagggaatgtacaacagattgacttggtgggaacaaatggacaacggcaaacagcttactcgtaataggaagttcctcattgttgttcctgtagtcctgtatctgatagctttgcacaccacagactaccaacaacctatgctcttcctcaatacccttgccgttagtgtgcttgtggtcgccaaactaccgaatatgcacaaggtccggatttttggaataaatgctgagaactaaacagcgtcatccttcaccagacatttacctatatatatatatatatgcttttcagaacggtctgtatgttaccctctagtgcttagttgggctcatcagagtaccagtgtttaaaagttgttagcagatgggccttggtcgttgtatagagaaatgctcagaggctggaaatgtcgctgctgtacatctgatgtgcacagactctgtacactcttaatgttgctatatggtttgttgtgagc

SEQ ID NO: 2721 - DNA, 785 bp, Helianthus annuus
aaacaatttttgggcgacaacaattcgcaaaattccatcccattttcaaacataatcgttgaatcaatttggtaaaaatcaaccgatctttatcccaattcattcatcaatcaacaatctcggtgaagctaagaataataatcagaaaagatgatgtacgtgaaggcaacaccgacaacggatctgaatcgaaacaccgattggttcacgtacccaggagtatggacgacatacatcttcatcatattcttttcatggcttcttattctctctgtttctggttgctcccctggcatggcctggaccatcgttcatttctcacattttctggtgacttatcactttttccattggatgaaagggactccatttgctgacgatcaagggatatataacaggctgacatggtgggagcagatcgacaatggcaagcagctcaccagaaaccgaaagtttctaaccgtcgtacctgtagtgctgtacttgatagcctcgcacactactgattatcaacatccaatgatattcttcaatacagttgctgtaatcgtgcttgttatcgcaaagtttccaaatatgcataaagttagaatttttggaattaacggcgatatgtgagagttgattacagttggtatgtttggatctttgtattgaacccgggtggtatcaatgtatagtaagtcaattttgggatggggaggttatcttattgtctaaccaatttttgtttgtgtaacatggtgattgacaagtgactgctgcatattacaaataaagcttac

SEQ ID NO: 2722 - DNA, 898 bp, Triphysaria pusilla
cgaaaaataagaacagatcaaagaaacaaacaaacacgccataagtctttgagccctccgcttcgacacgctactccaccattttcgatcgctctaaaatcgagccactgccaaaactaacttcagacgttcgtatcgtttttcggatcaggtcaataatcagatcgagtcggtttccagaatcatgggcaagctgtacgtgcaaatgacgcccccggcggatctgaaccggaacaccgagtggttcacctatcctggggtttggactacttatatattaattctgttcttctcctggctcatcgttctctcgattaccaattgtacccccggcatggcgtggacagtcgtcaatctctgccattttctggtaacttatcacttcttccattggaaaaaaggaaccccatttggtgatgatcagggaatatataatgcattgacgtggtgggagcagatggacagtggaaatcagctcacccgcaatagaaagttcctcacagttgttcctgtggttctctacttgatagcctcacatactacagactaccagcacccgatgctgttcttgaacacacttgccgtgcttatcttagtcgttgctaagttcccaaatatgcacaaggtccgaatcttcggaattaatggggaacagtgatttgggctacttatttacaaatcagtcggtttaacttaagtatgaattttgatttgcttaatatccgtaaagaaagttatgcctctccatgtatagaagttagttggtacgtacaatttggtcctcaagtgttttgtgcttacctgttattacgagcttcctagtaataaatgtaatgatttgtacttgtacagtataaattttgtatacttttgaatttacgattgtctttattatcta

SEQ ID NO: 2723 - DNA, 500 bp, Utricularia gibba
gcgctctccggttcctttcgcgatcaggctttcagaatgatgggaaaactctatgtcaagatggtgccgccaccggatctgaaccggaacacagagtggttcacgtatcctggggtttggaccacttacatattgattgtctttttctcttggctcattgttctctccgtcaccaactgtacccccgggatggcctggacgatcgtcaatctctcacattttttggtcacataccatttcttccactggaagaaaggaaccccgtttggcgatgatcagggaatctataatgggttgacatggtgggaacagatagacaatggaaagcagcttactcgaaacaggaagtttctcacggttgttcctgttgtactatatctgatagcttcacatacaactgattaccaacaccccatgctcttactcaacaccctcgctgtgcttgtgttggtcattgccaaattcccaaacatgcacaaagtccgtatcttcggcatcaa

SEQ ID NO: 2724 - DNA, 827 bp, Curcuma longa
aagctctacgtgcacacggtgcctcctccggatctgaacaagaacactgagtggttcatgtaccccggcgtctggaccacctacatattcatcctcttcttctcctggctcctcgtcctctccttcttcggctgctccgctggcatggcttggaccgtcgtcaatctcttccacttctcggtcacattacttcttccactggaaaaagggtactcccttcgccgaagatcagggtatatataataacttgacctggtgggagcagatagataatggcaagcaactaacacgtaacaggaaatttttgactgtggtacctgttgtcctgtatcttatagcctcacacacaactgactaccgacacccaatgctattcctgaatactcttgcagtggcggtattggtgattgctaagttccccaacatgcacaaggtccggatcttcggaatcaatggttaactgatgctgcagcatatcaatgatgtcggatcttatttgtcgatcgccaatcaactgaagtcatcgtttatgtttgtccacggtactaaagttgcagcaatgttttttcttgtgtctctgatttagatatctgtaaggtgctgactgagttagtcgaatacgaccatacctatgtttccttggatataaatcttgctctcgaactcaatcaggattatgtatctgtttctagtttctttccctgaagaaacggaaagagattgattgaataaaatgccaaaagcatgcagctctgttaaattctcattatggttggattcgttatggttggattgcaacaaaggcaaacttttgctaaggttgactg

SEQ ID NO: 2725 - DNA, 671 bp, Musa acuminata
cttctctctttgcctttgccttggactcgaaggcagagttcgaaaggggaacacactcggcgaggacgatggcgaagctctacgtgcagacggtgcctccaccggatctgaacaagaacacggagtggttcatgtaccccggcgtctggagcacctacatactcatccttttcttctcctggctcctcgtgctctccgtcttcggctgcacccccggcatggcctggaccgtcgtcaacctcttccacttcgcgattacctattacttctttcattggaaaaaggggactccctttgctgaagaccagggcatctacaataacttgacctggtgggagcagatggataatgggaagcaactaacacggaacaggaaatttttgactgttgtacctgttgtcctgtacctgatggctctgcacacgaccgactaccaacatctgatgcttttcctgaatacacttgcagtggccattttggtgattgcgaaattcccaaacatgcacaaggttcgtattttcgggatcaatgaatgagcagtgacgcacacgaaagataacttggcggttgtccttttaattcgatagctagatcttataggcctagttggtaacactgaatactgaatgaagtgcataatgccaaagtcgtggtttgttgttcatatacag

SEQ ID NO: 2726 - DNA, 889 bp, Avena sativa
gccaatactctcccgtcccccatctttgaaccttcctcctcctccgcgctgacctacccctacccggcaacgaaccaacccggcccctcctacatagccagccacaatccattccgacctcccgtcagcccgcagcagcgcacagcctacagcccccgccacgccgagccggccagacggacggaaccaccgcgagcgcgcgcggggcgaggaacgggagggcagagatttgggggcggatcgatggcgaagctgtacgtgcaggcggtgcccccgccggatctgaacaagaacacggagtggttcatgtaccccggggtgtggaccacctacatcatcatcctgttcgtctcctggctcctcgtcctctccatcttcggatgcaccccaggcatggcctggacaatcgtcaacctcggccacttcgcgatgacataccacttcttccactggaagaagggaacaccatttgctgatgaccaagggatgtataacagattgacttggtgggagcaaatggacaatggcaagcagcttactcgcaacagaaaatttcttgttgtggttcctgttgtcctgtacttgatagcttcacacaccacagactatcaacatcctatgctctttttcaacaccatcgctgtcactatactggttgtcgccaaactaccgaacatgcacaaggtccggattttcggaatcaatgccggtaactaagcggcggcagcgtgtctcagggaagacagcactctcagtatcatgttccattcgaatggctggatgtgttgcacctaagttctgaatttgctcatgggagtaccagcatatgtagtgtttgagctgttagtagatgacatgtgatcattgtacagagtaacgctaaaggcca

SEQ ID NO: 2727 - DNA, 1014 bp, Malus domestica
cgaatctcaaactgtcctgcaacgcaacttccccaaatccaccaaaatatcgtctcattttcttttcgttttcgacgtcggtgatgatgagcagctgttccttattaacactcccatcatcgtcgtcgtcgttaatcttaatcttcatctcgtagtctcttccgatcaattaatttcgtttcttaatcccaaaaaaatcagcaaaaaaaaaaatgtacgtaacggcggtgcgaccgacggatctgaatcggaacacggagtggttcacgtaccccggagtctggacgacctacattctggtggtgttcttctcgtggctcaccgtcctctgcctcttctcttgctctcctggcatggcctggaccgtcgtccacctctcccactttttcgttacttatcacttttttcactggaagaagggaacaccatttgcagatgaccagggtatttacaacgcactgacgtggtgggagcaaatagacaatggcaaccagctcactcgaaacagaaagtttctaactgtcgtgcctgttgtgttgtacttgatagcctctcacacgacggactatcaaaatccaatgctcatctttaacacactagcagtttttgtattggtagttgcaaagttcccaaacatgcacaaggttcgtatattcggaatcaatgctgatcactgatatctctaagagatcaagcatgactgtagttctcttggtctaatcgtattggcattcggacataacggtaaagtccctgttgaaatgttgaaactggaaagagtgtattattttttttgaaggaagtgaattttcttacccctccactgctctctgttacgttcattcataccagacggatagaaaagcactatcattgctgagtttcagatttcagtgcacttatttatttccggataccccgtatttatactctcccaaaatccttgggtgtatttttactaattatggccggttccggtccccggtgacgaataatactgtagaaacataattg

SEQ ID NO: 2728 - DNA, 773 bp, Arabidopsis thaliana
cacaaaattaaaccaaagaaacaaacaatccttgttctcgccgaaatagagaattttgtgaatctgggtttttagttcaggtgttaatataagattttgatcaaaagaagacgagattcgatccgatccgatctgattgaagaagaaatggcgaatctgtatgtgaaagcggttccaccaccggatatgaataggaatacggaatggttcatgtatccaggagtttggacgacttacatgcttattctcttcttcggttggctcgttgttctctctgtctctggttgttcccctggaatggcttggactgttgttaatctcgctcacttcgttgtaacgtatcacagcttccactggatgaaaggaactccttttgcagatgaccaaggaatctacaatggtttaacttggtgggaacaaatggacaatggtcaacagcttacccgcaaccgcaaatttcttaccctagttcctgttgttctgtacttgattgcatcgcatacaacagattacagacatccatggctgttcctcaacacactcgctgtgatggttctcgttgttgccaagttccccaacatgcacaaggtacgcatctttggtatcaatggtgataaataagtttcctttacggcaagagaacacctgaaagaaggaaaaggggatataagcgaacatatatatgtgtaaatgttcatatgagttggtttaattctcgagtcatgttttttgttggatatttgtaagtaaactctctaattttgaagctttca

SEQ ID NO: 2729 - DNA, 961 bp, Vaccinium corymbosum
aacaaccaaattgtcccccgttgatttgatacaactctctcaacgaatccctcgtctgtacaagacgacgacttttctcctctgcatatatatcgaaacttcttccctttcgattttccattcccgatacagtaagatacacaatctgtcttcaacgaacgcatccatacatacacacagagagagatcttcaagcggaggaatcgcggtggtggtggatgtgaagaagaaggagagagatatatacaggaatatatagaaaatgtatgtgaaagcggaggcgacgacggatctgaatcggaatacggaatggttcacgtatccaggtgtttggaccatctacatcctcatcctcttcatctcctggctcgtcgttctctctctcttcggttgctcccctggcatggcatggaccatcgtccacctatctcatttcgtcgtgacttatcagtgctttcattggaagaaggggacgccatttgctgaggaccagggtatctacaacaggttgacttggtgggagcaaatggataatggcaagcagcttactcgcaataggaagtttatcactgttgtacccgtcgtcctgtatttgatagcctcccacacaactgactatcaacagccaatgctcttcttcaataccctggcagtgttcgtgttagttgttgccaagttcccgcacatgcacaaggtgcggatttttggaatcaatgcagatcagtgaacaatcacggtatccttaagtatgcaaattccatgccatcctctagatacactatttttggccaaatgaggcaatttcactgtgtaacgtaatatccctgtacagatgttgatactgcaaagggcatattgtttttcgttcttataatattttttctctctcggtactatgcttgaaacaatatactggtcttgtgctctctctgtagaagccattgtaattgatcgaagctgg

SEQ ID NO: 2730 - DNA, 1029 bp, Brachypodium distachyon
acccgttcttcgtccatcccctcggcctcctcccgcaatactcttgcgcccccatctttgaaccttcctcctcctccgcgctgacctaccggcaaccagccccccctccctcctatatagccacaatccattccgaccgagcccctcagagcccgcccgccgcagcagcatacggggctgcagcttcccgcgacgccgacccggacggacggagccagccagccccacgcagcgcgcgcgcgcgagcgaggggggttcgggggggaattcctgggatcgatcgatggcgaagctgtacgtgcaggcggtgccgccgccggatctgaacaagaacacggagtggttcatgtacccgggggtctggaccacctacatcttcatcctcttcgtctcctggctcctcgtcctctccgtcttcgggtgcacgcccggcatggcctggacgctcgtcaacctcggccacttcgcgattacataccacttttttcactggaagaagggaactccatttgctgatgaccaagggatgtataacagattgacttggtgggagcaaatggacaacggcaagcaacttactcgcaaccgaaaatttctggctgtggttcctgtggtcctgtacttgatagcttcccacactacggactatcaacatccaatgctctttttcaacacaattgcagtcactgtactggttgtcgccaaactaccgaacatgcacaaggtccggatttttggaatcaatgccggtaactaagcggcagcattccagggtagagagcaaccaatatcatgtttcatttgaatggctggatgtgttgcacctagttctggactcactcatcggagtaccagcgtgtagtgtttgagagcttttagtagatgacatgtgatcattgtacagagaaacgcttaaaggcctggaaatgatgctgttttggaacttacgaacacaactactgtagactcttgatgctgctatatgttctgttgcaagtatttgtcaatcgatacgtgtacagtttattt

SEQ ID NO: 2731 - DNA, 1041 bp, Brachypodium distachyon
ccgttcttcgtccatcccctcggcctcctcccgcaatactcttgcgcccccatctttgaaccttcctcctcctccgcgctgacctaccggcaaccagccccccctccctcctatatagccacaatccattccgaccgagcccctcagagcccgcccgccgcagcagcatacggggctgcagcttcccgcgacgccgacccggacggacggagccagccagccccacgcagcgcgcgcgcgcgagcgaggggggttcgggggggaattcctgggatcgatcgatggcgaagctgtacgtgcaggcggtgccgccgccggatctgaacaagaacacggagtggttcatgtacccgggggtctggaccacctacatcttcatcctcttcgtctcctggctcctcgtcctctccgtcttcgggtgcacgcccggcatggcctggacgctcgtcaacctcggccacttcgcgattacataccacttttttcactggaagaagggaactccatttgctgatgaccaagggatgtataacagattgacttggtgggagcaaatggacaacggcaagcaacttactcgcaaccgaaaatttctggctgtggttcctgtggtcctgtacttgatagcttcccacactacggactatcaacatccaatgctctttttcaacacaattgcagtcactgtactggttgtcgccaaactaccgaacatgcacaaggtccggatttttggaatcaatgccggtaactaagcggcagcattccagggtagagagcaaccaatatcatgtttcatttgaatggctggatgtgttgcacctagttctggactcactcatcggagtaccagcgtgtagtgtttgagagcttttagtagatgacatgtgatcattgtacagagaaacgcttaaaggcctggaaatgatgctgttttggaacttacgaacacaactactgtagactcttgatgctgctatatgttctgttgcaagtatttgtcaatcgatacgtgtacagtttatttctggagctttcttt

SEQ ID NO: 2732 - DNA, 690 bp, Chelidonium majus
aaaaaaagaatggcgaaattgtatgtacaagcagtgcacccaccggatctgaataagaatacagagtggtttatgtaccctggtgtttggaccacttacatcttgatccttttcttctcatggcttatggttttgtccatcttcggttgcacccctggcatggcttggacaattgtcaatctctgtcatttcattgtcacttatcacttcttccactggaagaagggaactccattttctgaagaccagggtatatataaccatatgacttggtgggaacagatcgatagtgggaagcagcttacacggaacagaaagtttttgactgttgtacctgtggtattgtatttgatagcctctcacacaactgactaccaacaaccggtgcttttcctcaacactcttgctgtatttgttcttgtggttgctaagttcccaaacatgcacaaggtccgtatcttcggaataaatggagagtagtaagttcgcctcatataagaccagacgtggttttacttctgtaaaagccttttatctttcttctcttgttcatggcctatatccatcccctgtacagaactggaaaatggtacttaaatgcttttgaatgagttcggttatctttctacgtggaccctttttttcagaaaaagaaaagcttataataagcaataaactaagtgtatgcac

SEQ ID NO: 2733 - DNA, 808 bp, Cleome gynandra
gagagagagagagtcggaaggctgaagagcgagagacgtgctctcccctttgaatagagagagagagagagagagagagatcggagatcagaattatctcaatcaatcctcgttttcgtcaacatcatctaccggcgatctttctaatcgatttgatctcctgagaattagaatttaggaagactaaggcgactaatcaatcggagggaaatcggcggcggagaatgatgtacgtgagagcggttccgccgacggatgtgaatcggaatacggagtggttcacatatccaggagtatggactacttacatcctcatcctcttcttctcctggcttatcgtcctctccatcttcggctgctctccaggcatggcctggaccatcgttcacctctctcatttcatcgttacatatcattcctttcattggaagaaggggacaccatttggtgatgatcagggaatctacaatagactgacctggtgggaacagatagataacggcaagcagctcactcgcaacaggaagtttctgactgttgttcccgttgtcttgtacttgatagcttcgcacacgacggattatcaacaaccgatgatattcctaaacacactggctgtatttatacttgtggtggcaaaattcccacacatgcacaaggtgcgtatatttgggatcaacgcggaccaatgaaatgaaagagggtggatttggtatggtaacttgtaatggcgaagaagatgagagcaacatgtctgtacagacattggaaccagaagaagcatatgtatatatatatatatataggt

SEQ ID NO: 2734 - DNA, 983 bp, Euonymus alatus
aggcggattttttattttattataattggcttagaactctctgcttcctccatctcgttcctatcacgcgcgaaccgatccagatacagcaaacagcacgtttcatccaattcaatcccttccttctcttgctttgcgattcggattattttctgcaagaaacgaacagcaaagtagaggggtttaggcttagttttaattggattgctaaccgtttgagatagagcgagggaagggaaacatgtatgtaagggcggtgcgaacgacggatcttaataggaacacggagtggttcacgtaccctggtgtctggaccacctacatctttattctcttcctatcttggctcatcgttctatccgtatttggctgcttgcccggcactgcatggaccgtcgtccacctcgcacattttctagttacgtaccatttctttcactggaagaaaggaactccatttgctgatgaccaaggtatctacaatgggttgacttggtgggagcaaatagaaaacggcaagcaactcacacgtaataggaagtttttgacagttgtgcctgttgtcctgtatttgatagcctcacacacaacagattatcaacaacccatgctcatctttaacacactggcagtatttgtgctggtggttgccaagttcccaaacatgcacaaggtccggatattcggaataaatgcagatcactgaactgcgaaaaggatcttctgttcagtttacagcaatctatacgttttgataatctttgccttccaatccactgggttaatctctgtacttctcttgaaacggagaaaggaatttctttttcgcgttttatgttgtggatacatatacctgtcttcgttttgtactgagaaatatacttccattgaatttcagtaggcaaatatttctgggactttacgactgtcctttctcacgactcatagtagatctctcaacgtggtttaagcttgaaaaaaaa

SEQ ID NO: 2735 - DNA, 673 bp, Euphorbia peplus
gataagcgaagcagaggtaccaatttccatcaaagtccgatctttgactcggtcaccatctctgatcttcttcttcttcttcttcttctacttccttttccgctaatttttttcttctgggtaaatcttataatttgaaaagtttcaatctttatcatcgcccccattactaatctcattaagagagaagaggagagggaagagagagaatgtacgttaaagcggtaccgccgacggatttgaacaggaacaccgagtggttcacatatccaggggtttggactacctatatgcttatcgttttcatctcttggcttattgttctttccgtttttggctgctctcccggcatggcttggacaattgtccatctcgcccatttcgttattacctatcacttctttcactggaagaagggaactccttttggcgacgaccagggtatctacaacgggttgacttggtgggagcaaatcgagaatggcaagcaactgactcgcaatagaaagtttttgaccgttgtacctgtagtgctgtatctaatagcctctcacacaacggactaccaaaatccgatgctcttcttcaacacattggcagtattcgtgttggtggtagctaaattcccccacatgcacaaggttcgcatattcggtatcaatgctgatcactg

SEQ ID NO: 2736 - DNA, 736 bp, Flaveria ramosissima
gtactgaattcattagtggttacctatacactacacgtctaaacttgctttctaattattaccaccaccgtcgccgtcaccgtcacccatcgccaccaccatccaccaagcagcaaccatatcttcaccaccaccaccaccaccaccgtccgacctacagacacctacttcacaaccatacacacaccgaaccttcaccggagaactcaacacacgaaacctctaaacgaactcccaacaatggtcaacttgtacgtacaagcggtgcttccgacggatctcaacaggaacaccgagtggttcatgtatcccggcgtctggaccatctacataacaatattattcttcgcttggctcgtcgttctctccgtcaccggttgttctaccggcatggcttggaccaccgttaatctctctcacgctctgattacatatcacttctttcactggaagaagggaacaccttttgctgatgaccagggcatctacaacaggttgacttggtgggagcaaattgatagtggcaagcagctcactcgcaacaggaagtttcttactgttgtacctgtagtcctgtacttgatagcatcccatacaacggactatgagaacccgatgctgttcttgaacacactggcggtttttgtgctagtgatcgccaagttcccccacatgcataaggtccgaatttttggaatcaatgctgaagagtgaaaagtatcctgctaaaacgggt

SEQ ID NO: 2737 - DNA, 1134 bp, Setaria italica
cccagttccatcccatgcgcccgctcctcctccatctcacccgtccctctcaccgcctcgttaatttttcgcccccatctttgaaccccgcggcggcctccatctccatccctccctctcctcgtccccctccgatcccgcgcctataaatcccgccaccgcggccgcagccgccgcagcggaccgccaagcacgctcccacacagctcgctgctgctccccccttcctgccgttctccccgtcggcccgggcggaaggggttctcgcgaggcgagcgaccgggcaggcaggccggcggctggggattgctcgggagcacccccgcgatggcgaagctgtacgtgcagacgttcccgcccgcggatctgaacaagaacaccgagtggttcatgtacccgggcgtctggacgacctacatcctcatcctcttcttctcctggctcctcgtcctctccgtcttcggctgcacccccggcacggcctggaccgtcgtcaacctcttccacttcgcgatcacataccattttttccattggaagaaaggaacaccttttgctgatgaccagggaatgtacaatgcattgacttggtgggaacaaatggacaatggcaagcagcttactcgtaacaggaagttcctcattgtcgttcctgtagtcctgtatttgatagctttgcacaccacggactaccaacaacctatgctcttcctcaatacccttgcggttagcgtgcttgtggtcgccaaactaccgaatatgcacaaggtccggattttcggaataaatgctgagaactaagcagcggcatccttcagccgacatctacctatatgcttttccagagtggtctgtatgttccccttctagtgcttagttgggctcatgggagtaccagtgagtagtgtttaaaagttgttaacagatgggccgtggtcgttgtatagagaaatgctcagaggctggaaatgtcgctgctgtacatctgctgtgtgcacggattctgtagactcttaatgttgctatatgcttcgttgcaagcatctgtcagttgccacatgtacagtatcattcttgcagagcaatacttttctcagctaccataattccaagatagcaatacagtggtggccg

SEQ ID NO: 2738 - DNA, 1091 bp, Setaria italica
cccatgcgcccgctcctcctccatctcacccgtccctctcaccgcctcgttaatttttcgcccccatctttgaaccccgcggcggcctccatctccatccctccctctcctcgtccccctccgatcccgcgcctataaatcccgccaccgcggccgcagccgccgcagcggaccgccaagcacgctcccacacagctcgctgctgctccccccttcctgccgttctccccgtcggcccgggcggaaggggttctcgcgaggcgagcgaccgggcaggcaggccggcggctggggattgctcgggagcacccccgcgatggcgaagctgtacgtgcagacgttcccgcccgcggatctgaacaagaacaccgagtggttcatgtacccgggcgtctggacgacctacatcctcatcctcttcttctcctggctcctcgtcctctccgtcttcggctgcacccccggcacggcctggaccgtcgtcaacctcttccacttcgcgatcacataccattttttccattggaagaaaggaacaccttttgctgatgaccagggaatgtacaatgcattgacttggtgggaacaaatggacaatggcaagcagcttactcgtaacaggaagttcctcattgtcgttcctgtagtcctgtatttgatagctttgcacaccacggactaccaacaacctatgctcttcctcaatacccttgcggttagcgtgcttgtggtcgccaaactaccgaatatgcacaaggtccggattttcggaataaatgctgagaactaagcagcggcatccttcagccgacatctacctatatgcttttccagagtggtctgtatgttccccttctagtgcttagttgggctcatgggagtaccagtgagtagtgtttaaaagttgttaacagatgggccgtggtcgttgtatagagaaatgctcagaggctggaaatgtcgctgctgtacatctgctgtgtgcacggattctgtagactcttaatgttgctatatgcttcgttgcaagcatctgtcagttgccacatgtacagtatcattcttgcagagcaatacttttctcagctacc

SEQ ID NO: 2739 - DNA, 971 bp, Setaria italica
tcggtcgcccgcccgcccgcccgccaccccacatcgcaatactttttcgccaccatctttgaaccttcctcctcctcctcctccgctctgaccagcgcggcgagggcgaggcggcccccaccccatccttataaatcgagcccgaggcggactgtccccctccctcccgccctccctcccagaccgcagcagcagcagcacgcagccgacgagggagccgagccggcgaagtgggaggagaaggggcggttggctgatttcgatggcgaagctgtacgtgcaggcggtgccgcccccggatctgaacaggaacacggagtggttcatgtaccccggtgtctggaccacctacatcctcatcctcttcttctcctggatcctcgtcctctccgtcttcgggtgcgcccccggcacggcgtggacgctcgtcaacctcggccatttcgcgatcacgtaccactttttccactggaagaaggggactccatttgctgatgaccaagggatgtataacacattgacttggtgggaacaaatggacaatggcaaacagcttacccgcaacagaaagtttttgacagcggttcctgtcgttctgtacttgatagcttcccacaccacggactatcaacatcctatgctcttcctcaacaccctagcagtcaccgtgctagttgttgccaaattaccaaacatgcacaaggttcggatttttgggatcaatgccggcagctaaggagcagcatctcacagtagacacctatacatgtcgcgtttcatttggattacaggaggtgttgagcctagttctgaattgaatcaccagagtaccggtagcagtgtttgagagctgttcgtagatgacatgtaatcattgtacagagaaatgctaagaaggctggaacgatgatgctttctgcaactagtgaacaaaaggttctgtagactcgtaatgttgttatacgttctct

SEQ ID NO: 2740 - DNA, 1023 bp, Setaria italica
tcgcaatactttttcgccaccatctttgaaccttcctcctcctcctcctccgctctgaccagcgcggcgagggcgaggcggcccccaccccatccttataaatcgagcccgaggcggactgtccccctccctcccgccctccctcccagaccgcagcagcagcagcacgcagccgacgagggagccgagccggcgaagtgggaggagaaggggcggttggctgatttcgatggcgaagctgtacgtgcaggcggtgccgcccccggatctgaacaggaacacggagtggttcatgtaccccggtgtctggaccacctacatcctcatcctcttcttctcctggatcctcgtcctctccgtcttcgggtgcgcccccggcacggcgtggacgctcgtcaacctcggccatttcgcgatcacgtaccactttttccactggaagaaggggactccatttgctgatgaccaagggatgtataacacattgacttggtgggaacaaatggacaatggcaaacagcttacccgcaacagaaagtttttgacagcggttcctgtcgttctgtacttgatagcttcccacaccacggactatcaacatcctatgctcttcctcaacaccctagcagtcaccgtgctagttgttgccaaattaccaaacatgcacaaggttcggatttttgggatcaatgccggcagctaaggagcagcatctcacagtagacacctatacatgtcgcgtttcatttggattacaggaggtgttgagcctagttctgaattgaatcaccagagtaccggtagcagtgtttgagagctgttcgtagatgacatgtaatcattgtacagagaaatgctaagaaggctggaacgatgatgctttctgcaactagtgaacaaaaggttctgtagactcgtaatgttgttatacgttctctagcaagaatttggcaattgatacatgtacaggtctgctcttttgtcaagaggaaataatcaatcatgatatgacaaaatcatgac

SEQ ID NO: 2741 - DNA, 644 bp, Guizotia abyssinica
gatttgttaccttctctcgctccgcttccttttcagttgatgtacgttggcaatcttcatcgtcaacgaccaataatcaatcaatcaccgtcactagaccatcgccacaactacacacatcattcaaacctccatacgacggatcaatcttcatatccaagcttcgcgatcgatacatggccaatctgtatgtgcaggcggagccgcccacggatctgaacaaaaacaccgagtggttcacgtatcccggcgtctggacaacctacatactcatcctcttcttcgctcggagtgtagatctctccgtcttcggttgctcccctggcatggcttggaccaccgtcaatctctctcacgctctgctgacataccagttcttccactggaaaaagggcacaccttttgctgatgatcagggtatctacaacaggttgacatggtgggagcaaatcgatagtggtaaacagctcactcgcaacaggaagtttctaactcttgtccctgtggtcttgtacttgatagcatctcacacaacagactaccagaatccaatgctgttcctaaacacagttgcagttttcgtgctaattgttgccaagtttcggaacatgcacaaggtccgaatatttggaatcaatgctgaa

SEQ ID NO: 2742 - DNA, 1003 bp, Zea mays
gccctcgtcttcctccatcccacggtcccacctgtccctctcaccgcctcgttattttttcgcccccatctttgaacgccgggactccaactccaccgttcctccctcttcgttccctccgatcccgcccctataaatccagtcgcctcagccgccacagcgggccgcaagcacgtaaccacacagctcactgctgctcccgtcttcccgtgtcctgtcgtgctcccgtcgccgggggcggaagggttcgcgaggccggcgggcggttagggatttctccggagtcccgcgatggcgaagctgtacgtgcaggcgttcccgcccgcggatctgaacaagaacaccgagtggttcatgtatccgggcgtctggacgacctacatcctcattgtcttcttctcctggctcctcgtcctctccgtcttcggctgcacccctggcaccgcgtggaccgtcgtcaacctcttccacttcgcgatcacataccactttttccattggaagaaaggaacaccttttgctgatgaccagggaatgtacaacgcattgacttggtgggagcaaatggataatggcaaacagcttactcgtaataggaagttcctcattgttgttcctgttgtcctgtatctgatagctctgcacaccacagactaccaacaacctatgctcttcctcaatacccttgccgtcagtgtgcttgtggtcgcgaaactaccgaatatgcacaaggtccggattttcggaataaatgccgagaactgagcaacgtcatccttcgccagacatttaccctatatgcgcttttcagaacggttttgtgtgttcccccccccttctagtgcctttagttgggctcatcagagcaccagtgttgaaaaagttgttagcaggatgggccttggtcgctgtatagagagatgctcggaggcgtgctgtacatctgatgtgcacggattctgtacactcttaatgttgctatatatacggtttgttgcaagca

SEQ ID NO: 2743 - DNA, 1054 bp, Mimulus guttatus
tcaaaatcccttttgaccgttttacccttcccccaccacccccaacccccccatttgcgaatccttataccaacaacaaagaaatatcaattgtgtcgaacaattccctttttattaattttttttttcaaaaaaatcaattcatcgagaaattaagaaaagctgaacgtgtgatcgatacaagtcgaagaaatttgggaatcggagaaatggcgaatttgtatgtgcaggcggtgccgacgacggatctgaatcggaatacggagtggttcacttaccccggcgtatggactatttacatccttatactcatgttttcatggctggtcttcgtctccgttttcggctgctctgcagggatggcgtggaccgtcgttcatctcgcccattctatcgtcacatatcacttctttcactggaagaaggggacaccattctcagatgatcagggtatctacaataggttgacatggtgggagcaaatagaaaatggcaagcaactcacacgtaataggaagtttttgacgctcgtgcctatagtgctatacttgatagcctcacacacaaccgactatcaacatcccatgctattcttcaatacactagcagttttcattctggtggttgccaaatttccaaatatgcataaagtccgcatatttggaattaatgccgatcaatgattttctaggttcgttttagcaattccgtttgcagattcatcttttatctccaattgtatcttcttcatcaatgcagctagctgttcaaaatattgcgatttttttttaatttgatgtggaaactaatagaggatatataataccactgtcgaaagtatttagtgccaaaacctctcagaagctcgatattctctgttttgaagttcattatttcaaatttgtgaagttctgcgtgatcaatgcaatattcttttgtttcatttttttccggcccagatgttcgggacaatataatcttgatttgattatgattaaatttgtggccctgcttttgtcggagaatatttgtggttgcaaatgttatgttaaac

SEQ ID NO: 2744 - DNA, 918 bp, Avena sativa
gcgctgacctacccggcaacgaaccaaccaggcccctcctacatagccagccacaatccattccgacctcccgtcagcccgcagcagcgcacagcctacagcccccgccacgccgagccgtaccttcggacggacggaaccaccgcgagcgcgcgcgggcgaggaacgggagggcagggatttgggggcggatcgatggccaagctgtacgtgcaggcggtgcccccgccggatctgaacaagaacacggagtggttcatgtaccccggggtgtggaccacctacatcatcatcctgttcgtctcctggctcctcgtcctctccatcttcggatgcaccccaggcatggcctggacaatcgtcaacctcggccacttcgcgatgacataccacttcttccactggaagaagggaacaccatttgctgatgaccaagggatgtataacagattgacttggtgggagcaaatggacaatggcaagcagcttactcgcaacagaaaatttcttgttgtggttcctgttgtcctgtacttgatagcttcacacaccacagactatcaacatcctatgctctttttcaacaccatcgctgtcactatactggttgtcgccaaactaccgaacatgcacaaggtccgtattttcggaatcaatgccggtaactaagcggcagcgtgtctcagggaagacagcactctcagtatcgtgttccattcgaatggctggatgtgttgcacctaagttctgaatttgctcatgggagtaccagcatatgtagtgtttgagctgttagtagatgacatgtgatcattgtacagagtaacgctaaaggcctggaaatgatatactgttttgcgacttgccaacacacgattctgtggactcttttttgctggtatatgttctgttgcaagt

SEQ ID NO: 2745 - DNA, 684 bp, Arachis hypogaea
atactgtatgtgaaggcggtgccaccggcggatctgaacaggaacacggagtggttcatgtatccaggggtgtggaccagctacatcctcatcatcttcttcgcatggcttctcgtcctctccatcctccactgcacccccggcatcgcctggaccatcatcaacctcgcccatttcgccattacgtatcactacttccactggaagaaaggaaccccgttcgcggaggaccaagggatctacaaccagctgacgtggtgggagcagattgacagcggcaaacagctcactcggaaccgcaagttcctcactgttgtccccgtcgttctgtacctcattgcgtcgcacacaactgactaccgacaccccatgctgttgttcaacaccctcgctgtcattgtcctcctcattgccaagtcccccaatatgcacaaggtcaggattttcggaatcaattctgacaactgactctcttcttctttttctttttcccattaattacttgtaatgttttgctgccttttagctataaaatcgaataaatcttttcactttttcattttttttcctctactactcactctgcctgcctctcttttcatttaagcctggcccagtcaactagatcaaactaattgtatttcgatcacaaaactatgtatgtgtatgttgtcatttgaattt

SEQ ID NO: 2746 - DNA, 1061 bp, Phalaenopsis aphrodite
aatgaaagttccacctttgaccggaaggccgtcgatcctcgggcaactctccttgacctaatctttgcgccatctaccttcgcgttcttattcgaactttccacattgccttcatcccggctgttggtatttaatcgaaccagctccttgtgagattcgagctcggggtttgaactttggaggaggaggagaaacttgggttggagagggaaaggaggcgattcagatggccaagctttatgtggagacaacgccacccccggatctgaacaagaacacggagtggttcatgtatccgggggtgtggacgacctacatactcatactgttcttcttgtggctcctcgttctttctgtcttcggatgcacagccggcatagcctggacaatcgtcaatctagcccactttgctattacttatcaattttttcattggaggaagggaacaccctttgctgaagatcagggtatatacaataatttgacatggtgggaacagatagataatggcaagcaacttacacgtaataggaagtttttgactgtcgtgcctgttgtcctgtacttgatagcttcgcacacgaccgactaccaacaaccgatgctctttctgaataccgttgcagtgttcgtattggtcgtcgccaaattcccaaacatgcacaaagttcgcatcttcggaatcaatgcagatcgttgatcggtggatctgtctacttccagaaaccctaagagagaggaggttagtgtgatgttctaaacattatggcgacgttacatggtttccattgtacaggactgcatgtcgtagaaactaataatgttggtgtgatgctgtgttgtagcttttagagcaaaataatgtgtagacaatttaaagtgtttcgggtcttgttatatcctgcgttgtgtatagttgttagggttttgtttgaggcttgtggtgtataatcttgtactgtccttaactatggtttgtgtgtccaagtctcagttatatatctcagtaagtagtgtttgtagcaacttacatgatatcagcatgcttatcttattatatt

SEQ ID NO: 2747 - DNA, 802 bp, Papaver somniferum
agaagaagaagaatggggaaattatatgtagaaacagtaccaccaccagatctaaacaagaacacagaatggtttatgtatccaggtgtatggacaacatacatcttgattgtcttcttcgcatggcttatggttttatctgtttttggttgtaatcctggcatggcttggactattgtgaatctcgcccatttcgtgataacatatcagttcttccactggaagaagggaacaccatttgctgaagatcaaggtatctataatggattgacttggtgggagcagattgataatggcaagcagcttacgcgtaatagaaagtttctcacttgtgtacctgtcgtcttgtatttgatagcatcgcacacgactgactatcaaaatccaatgctcttcctcaacactttggcggtgtttgtgttggttgttgccaaattcccgaacatgcacaaagtccgcatctttggaatcaacgcagaacagtgagagacggagcacgttgtataagcagtaagccctacagatgcttttcggttttatatctgtaaaagtcatttcgacccgttttccttttccttttgttctttctctatggttatatatcccttgtacagaagtcggaactggaaagggagcttacgttattggttaatcagggttcttttttccccatttcttgggactgcatttgttttgtttttcttaatcttttacatgattatgatgtcagatatatgcgaaaatagttgtatgataaaaatgttccttgttattgtaaaaagaaaaagaaggatattatgct

SEQ ID NO: 2748 - DNA, 962 bp, Papaver somniferum
ttttttttttactttaatactttaactttaaaataggtagtaattagaaattcaaaactcttttgctgaaagaagaaatcaagaagaagaagattataggaggaagagaagaagaatggggaaattatatgtagaaacagtaccaccaccagatctaaacaagaacacagaatggtttatgtatccaggtgtatggacaacatacatcttgattgtcttcttcgcatggcttatggttttatctgtttttggttgtaatcctggcatggcttggactattgtcaatctcgctcatttcgtgataacatatcagttcttccactggaagaaaggaacaccatttgctgaagatcaaggtatctataatggattgacttggtgggagcagattgataatggcaagcagcttacgcgtaatagaaagtttctcacttgtgtacctgtcgtcttgtatttgatagcttcacacactactgattatcaaaatccaatgctcttcctcaacactttggcggtgtttgtattggtagttgccaaatttccgaacatgcacaaagtccgtatctttggaattaatgcagaacagtgagagatgaagcacgttgtataagcagtaagccctatagatgcttttcggttttctatctgtaaaagtcatttcgacccgttttccttttccttttgttctttctctatggttatatatcccttgtacagcagtcggaactggaaagggtgcttacgttatttgttaatcagggttctttttcccctttctcgggactccatttgttttgtttttctttcttaatcttttacatgatcatgatgtcagatatatgcgaaaatagttgtatgataaaaatcttccttattactgtaaaaagaaaaagaaggatattatgctgttataatcattatcattatatataggcgacagacttcaacttagttttcaaaaa

SEQ ID NO: 2749 - DNA, 642 bp, Papaver somniferum
ataggagaagaagaatggggaaattatatgtagaaacagtaccaccaccagatctaaacaagaacacggaatggtttatgtatccaggtgtatggacaacatacatcttgattgtcttctttgcgtggcttatggttttatctgtttttggttgtaatcctggcatggcttggactattgttaatctcgcccatttcgtgataacatatcagtttttccactggaagaagggaacaccatttgctgaagatcaaggtatctataatggattgacttggtgggagcagattgataatggcaagcagcttacgcggaatagaaagtttctcacttgtgtacctgtcgtcttgtatttgatagcttcacacacaactgactatcaaaatccaatgctctttctcaacactttggcggtgtttgtgttggtcgttgccaaattcccgaacatgcacaaagtccgcatctttggaatcaatgcagaacagtgagagatggagcacgttgtataagcagtaagccctatagatgcttttcggtttcatatctgtaaaagtcatttcgacccgtttttcttttccttctgttatttctctatggttatatatcccttgtacagaagtcggaactggaaagggtgcttac

SEQ ID NO: 2750 - DNA, 747 bp, Rosa hybrid cultivar
ggactagactttctggttggtgatgatgagcatctcctcctcattaccttcttcatcgtcgccgctcttcatcttcatctccatctcctagctctctctctctctctctttcttttccgttcaatctccgccgcacatatccaaatccggaaatccaacggtgtgggaggaggaggaggagatgtacgtgacggcggtgcgaccgacggatctgaatcggaacacggaatggtttacgtaccccggcgtttggaccacctacattctcatcgtcttcttttcatggctcatcgttctctgcctcttctcttgctctcccggcatggcctggaccatcgtccacctcgctcattttctcgttacgtaccatttctttcactggaagaagggaacaccatttgctgatgaccaaggtatctacaatgcgcttacttggtgggagcagatagacaatggcaatcagctcactcgaaacagaaagtttctaactgtcgtgcctgttgtgttgtatttgatagcatctcatacaacagactatcaaaatccaatgctcttcttcaacacactagcagtttttgtgctggtagtggcaaagttcccaaacatgcacaaggttcgcatatttggaatcaatggtgatctctgatctctaaaagaacaaggttgacttcagttttcttggtctagtttatattggcaatcaaatctaatggtatatccctgttgatgttgaaactggaaacagta

SEQ ID NO: 2751 - DNA, 513 bp, Sequoia sempervirens
agatagtgttacttctgtcagaggcgaaagattaaagattgatccgtagcatggggaatctgtacgtgcaggcggtgccaccaccagatttgaacaagaacacatcatggtttatgtatccgggcgtgtggacgacgtacattctcatcctcttctttgcttggctcatcgtcctttctgtctttggatgcactcctgggacagcttggaccgtcgttaatctctgccattttgcggtcacttaccatttctttcactggaagaagggtacccctttttcggaagatcaggggatatataataagctgacatggtgggaacagatagataatggaaagcagctaacacggaacagaaagtttttgactgtagtccctgtagtcctatacttgatggcatctcataccactgactaccaaaatccgtgcctcttgctgaacacaattgctgtattggtgctggttattgctaaatttcccaacatgcacaaagtaagaattttcggaattaatg

SEQ ID NO: 2752 - DNA, 899 bp, Silene vulgaris
taatatctgggtttcgcataaattagggtttaactcaaaaataatcggggattaatggcgaatttatacgtgaaagcgatgccgtcatcagatacaaacagaaatacagattggtttacatatccaggagtatggacgacgtatatattgttcatattatttacatggcttgttgttctttctatctttcggtgtacttctggtatggcttggactatcgtcaatcttgctcactttgctttgacgtatcactttttccactggacgaaaggaaccccatttcctgaagatcaaggaatatataatcgcttgacctggtgggagcagattgacaatggcaagcagcttactcggaacagaaaattcctgactgttgtacctgtagtgctgtacctgatagcctctcatacaaccgactacgagcatcctatgctgttcttaaacactcttgcagtaatcatcttggtcatcgccaaattcccacacatgcacaaggttagaattttcggtatcaatggagatcaatgaggtgctcaagacatcatgtcgacttttcacagggactgcttccaaacctttctttatcttcaggtaagcacattactgtatagggaaaccagaacacaaaacggtgttcgatgatgtaatgcttttacatatatagcccgaacttatgcctagtcgataacagattatatggacatggtaaggttttattgagcttttccttctgtacagcaagggctaccgtgtttcgggagcttcacatctggtttccgatgagctataatattatcaccgataacttccttataagttgttttgattatttattttccttttatagtgtttgttagaggtattttaatcaatggtaaacaaatgatcgatactcgtgt

SEQ ID NO: 2753 - DNA, 955 bp, Sorghum bicolor
ctttgaacgccgcggctccaacctccctccctccctcctcgtcccctccgatcccgcacctataaatcccgccaccgcagccgccacagcggaccgcaagcacgcaaccacacagctcgttgctgctcccgtctgtccccccaccgtgtcctgccgttctcccgtcgccgggggcggaagggttcgtcgaggccggcgggccggcgattagggattgctcgggagccccgggatggcgaagctgtacgtgcaggcgttcccgcccgcggatctgaacaagaacaccgagtggttcatgtacccgggcgtctggacgacctacatcctcatcgtcttcttctcctggctcctcgtcctctccgtcttcggctgcacccctggcaccgcgtggaccgtcgtcaacctcttccacttcgcgatcacataccactttttccattggaagaaaggaacaccttttgctgatgaccagggaatgtacaacggattgacttggtgggaacaaatggataatggcaaacagcttactcgcaataggaagttcctcattgttgttcctgtagtcctgtatctgatagctttgcacaccacagactaccaacaacctatgctcttcctcaatacccttgccgttagtgtgcttgtggtcgccaaactaccgaatatgcacaaggtccggatttttggaataaatgctgagaactaaacagcgtcatctgtcaccagacatttacctatatatatgcttttcagaacggtctgtatgttccctctagtgctttagttgggctcatcagagtaccagtgtttaaaagttgttagcagatgggccttggtcgttgtatagagaaatgctcagaggctggaaatgtcgctgctgtacatctgatgtgcacagacgctgtacactcttaatgttgctatatggtttgttgtgagcatctgtcagttgcta

SEQ ID NO: 2754 - DNA, 879 bp, Fragaria vesca
aaacgcgattcggaaaaatccgcattacaaattagaaatacaaagtcttcgactgagtttgtcgtcggtgatgatgagcatctcctcctcattaccatcatcgtcgtcgtagctcgctcctcctcctttgttttatatccaatctccgccgcagaaaccgaatcagagccaccggaggagatgtacgtcacggcggtgcgcccgacggatctgaatcggaacacggaatggttcacgtaccctggcgtatggaccacctacattctcatcgtcttcttctcttggctcatcgtcctctgcctcttctcttgctctcccggcatggcctggaccgtcgtccacctcgctcattttctggttacgtaccaattctttcactggaagaagggaacaccatttgctgatgaccaaggtatctacaacgcacttacttggtgggagcagatagacaatggcaaccagctcactcgaaaccggaagtttctaactgttgtacctgttgtgttgtatttgatagcatctcatacaacagactatcaaaatccgatgctcttcttcaacacactagcagtttttgtgctggtagtggcaaagttcccaaacatgcacaaggttcgtatatttggaatcaatggtgacctctgatttctaaaagaacaaggttgacttcagttttcttggtctagtttatattggcaatcaaatctaatggtatatccctgttgatgttgacactggaaacagtattattttttgaatgaattgaaactttcaactgccctccactctctcggttgcatactaaactgactgggatattgtccaatacattattttcttgttatatatttgaattccagtgttgcattcattgttctc

SEQ ID NO: 2755 - DNA, 871 bp, Eutrema halophilum
ggggaaggaaggcaggaaggaaggaagggggaaataaaatagaaatcgagaagaagaaaaggatcaataatcatcatcatcatcatcatcatcatcgtcaaaatcggagggcgatcgaaatttggagaagaaaggaaaggaaactaggaaagagaagatccaatcgaaggtgaatgatgtacgtacgggcggttccgacgacggatgtgaatcggaacacggagtggttcacgtatccaggtgtgtggacgacttacatcctcatcctcttcttcggctggctcctcgttctctccatcttcaactgctcccctggcatggcctggaccatcgtccacctcgctcatttctccgttacatatcatttctttcactggaagaagggaacaccgtttggggatgaccagggaatctacaacaggttgacttggtgggaacagattgacaacggcaagcagctcactcgcaatcgcaagttcctcactcttgttcctgttgtcttgtacttgatagcatctcacacgacagactatcaacatccgatgctctttctgaacacgcttgctgtatttataatggtggttgcaaagttcccacacatgcacaaggttcgcatctttggaatcaatgcagaccaatgaaaccaccaccatatgcgttataatgaactcagatatatatatatatatatatatgtctgaccatcatcatggatggatggagccttgaaatgacacatacatatatgccacttttgtcttcttcttcttagattttcctcgttattaatgtaaaagccaaagaagtcagagagaagggtttgtaagtctcaacccgcggtttagtaaattttaaaattttacgttataca

SEQ ID NO: 2756 - DNA, 873 bp, Juglans hindsii x Juglans regia
ggggattgtatccctgtgaaattgtgaatccccttcccttctttccggaacatcaacacgacagctcgacgatcgagttctatcgtaataaactttctggttttgtagtaatatcgtcattctcttaagtattctgctgtgcgagaaggccggcgaacaatgtacgtaagggctgtgccaccgacggatctgaaccggaacacggagtggttcacgtaccctggggtgtggaccacctacattctcatcgtcttcttctcttggcttgtcgtcctttccgtcttcaattgctcccctggcatggcctggaccatcgtccacctctcacatttcctcgtcacctaccattcctttcattggaaaaagggaacaccatttcctgatgaccaaggcatatacaacaggttgacttggtgggagcagatagacaatggcaagcacctcactcgcaacagaaagtttttgactgtcgtacctgttgtcctgtacttgatagcctcccacaccaccgactaccagcatccaatgctcttccttaacacggtggcagtttttgtgctggtggttgcaaagttcccacacatgcacaaagttcgtatatttggaattaatgctgatcaataaactgtgaagaaattcaagtttggttccctccggtttttaggttgatcattttgacatttgaattgatatccctgctgcccctatgttaaaactggaaagggtataatattcttcttttgcaaactgaattttacatatttagctgctagtcctcccaatattctggagaagtagttcgttgtaatctctctttgtaccagctaatcttcatgacccccggtggagctatgctgtttttatccattagca

SEQ ID NO: 2757 - DNA, 678 bp, Triticum aestivum
gctcgggagcccgggatggcgaagctgtacgtgcaggcgttcccgcccgcggatctgaacaagaacaccgagtggttcatgtacccgggcgtctggacgacctacatcctcatcgtcttcttctcctggctcctcgtcctctccgtcttcggctgcacccctggcaccgcgtggaccgtcgtcaacctcttccacttcgcgatcacataccactttttccattggaagaaaggaacaccttttgctgatgaccagggaatgtacaacggattgacttggtgggaacaaatggacaatggcaaacagcttactcgcaataggaagttcctcattgttgttcctgtagtcctgtatctgatagctttgcacaccacagactaccaacaacctatgctcttcctcaatacccttgccgttagtgtgcttgtggtcgccaaactaccgaatatgcacaaggtccggatttttggaataaatgctgagaactaaacagcgtcatctgtcaccagacatttacctatatatatgcttttcagaacggtctgtatgttccctctagtgctttagttgggctcatcagagtaccagtgtttaaaagttgttagcagatgggccttggtcgttgtatagagaaatgctcagaggctggaaatgtcgctgctgtacatctgatgtgca

SEQ ID NO: 2758 - DNA, 642 bp, Fagopyrum esculentum
gggtatacaattaattagaaaattttcgcacagttcgtttcccaagttcgtggatcgagctgtcgcaatttgataaaggacccacagaggttagataggaggcgaatttaggatcgggagagagggagttgaaaggtttcgtagtcaattcgaggaaggaagaaaggggaaatgccgaattgtttacgttagggcggagccgtctgccgatttgaacaagaacactgaatggttcgcgtatcctggtgtttggacaacctacattctaatcgtcttcttctcttggcttctggtgctctctattctcggttgctcccctggcatggcatggaccgtcgttaacctcggtcacttcttggttacttatgagttcttccactggaagaaaggtacaccttttgctgatgaccagggaatatacaatggactcacttggtgggagcaatttgacaatggcaaacaactcactcggaatagaaagtttctgactattgtcccagtcgtgttgtacttgatagcgtcccatacaacggactatcagaatccaatgctcttcttgaacacaattgctgtatttgtgctggtggttgccaagttcccccacatgcataaagttcgcctatttggaatcaacggagaaca

SEQ ID NO: 2759 - DNA, 818 bp, Carpinus betulus
taccatctccatcatcaccacgctccccatttccctccgcgcgacatcaagacccgacgacccgagctctcgtggctgccaattctaataaaatcttcgggtttcgggataaatccgtcatttgcgagtattgtgagggagagaaaggccaaagaacatgtacgtccgagcggtgcctccgacggatctgaaccggaacaccgagtggttcacgtacccgggcgtgtggacgacctacatcctcatcctcttcttctctggatcatcgtactctccgtcctcaactgctcctccggcatggcctggaccatcgtccacctcctccatttctgcgttacttatcatttcttccactgagaaggaacaccatttgctgaagaccaaggtatctacaatcggttgacttggtgggagcagatagacaatggcaagcagctcactcgcaacagaaagtttttgactgttgtacctgttgtcctgtatttgatagcctcacacacaacagactatcaacatccgatgctcctttttaacacattggcagtgtttgtgctggtggttgcaaagttcccaaatatgcacaaggtccgaatatttggaatcaatgctgaaatgtgaagacgaagacactcaaggttggttaactcctgttcttaggatgatcattttgatattccatttgatatccctgtacagatgttgagactggaaagggtgtaatatttttccttatcgaagcaaaaattttacgtatatcattgttcatcacattccggagaaatagtcccactgtattttctcttttataccagctaata

SEQ ID NO: 2760 - DNA, 950 bp, Phalaenopsis aphrodite
ccggctgttagtatttaatcgaaccagctccttgtgagattcgagctcggggtttggaagcttggaggaggaggagaaacttgggtgtgtttgtcttggagagggaaaggaggcgattcagatggccaagctttatgtggagacaacgccacccccggatctgaacaagaacacggagtggttcatgtatccgggggtgtggacgacctacatactcatactgttcttcttgtggctcctcgttctttctgtcttcggatgcacagccggcatagcctggacaatcgtcaatctagcccactttgctattacttatcaatttttcattggaggaagggaacaccctttgctgaagatcagggtatatacaataatttgacatggtgggaacagatagataatggcaagcaacttacacgtaataggaagtttttgactgtcgtgcctgttgtcctgtacttgatagcttcgcacacgactgactaccaacaaccgatgctctttctgaataccgttgcagtgatcgtattggtcgtcgccaaattcccaaacatgcacaaagttcgcatcttcggaatcaatgcagatcgttgatcggtggatctttctacttccagaaaccctaagagagaggaggttagtgtgatgttctaaacattatggcgacgttacatggtttccattgtacaggactgcatgtcgtagaaactaataatgttggtgtgatgctgtgttgtagcttttagagcaaaagaatgtgtagacttcttaaagtgtttcgggtcttgttatattctgcgtcgtgtatagttcttagggttttgtttgaggcttgtggtgtataatcttttactgtccttaactatggtttgtgtgtctaagtctcagttatatatctcagtaagtagtgtttgtagcaacttacatgatatcagcatacttatcttatt

SEQ ID NO: 2761 - DNA, 911 bp, Distylium racemosum
gtgactcgcaggagaggcggtatatatataaggtaaatatatgcatccgtgacaaaggggaattgctcttgctattgcagaccaaggatttgaaggtcgagagattgatccatggcggatgggctgagcttcccgagcatgggaaatctgtacgtgcaggcggtgccgccgccagatttgaacaagaatacatcgtggtttacgtacccgggcgtgtggacgacctacattttaatcctctttttcacctggcttatcgtcctcgcactctttggatgcacccccggcaccgcctggaccatcgttaatctctgccattttgcggtaacttaccatttctttcactggaagaagggtactcccttttcggaagaccaggggatatataataagctgacatggtgggaacaaatagataatggcaaacagctgacacgtaacaggaagtttttgacggtcgtccctgtagttctgtacttgattgcatctcataccactgactaccaaaatccgtggctcttcttgaatacaattgctgtcttggtgctggttattgccaaatttcccaacatgcacaaagtgcgtatttttggaataaattcagattatccaatttgaaaggctaggacaatagttctgctgtctgttgttgaatggtttcttttaatgcattatgaaaaatttgtgaaagcattatggatcacctcaatgtacagaacaaatgcattatgaaaaatttgtgaaagcattgcagaaatttgggaggagcatggtatagaggagctgtcatgtattgccttttcttgactgtcttcctctatacaggtctttgtttattagactttgtatgaaagtttctcacaatgtagattctgctgtaacataaatattttttcgattgtgtagatttc

SEQ ID NO: 2762 - DNA, 977 bp, Podocarpus macrophillus
gggatcgaaacgcgtacggcttcgagcaacagaaacgtatacattcagaaaaattttctatttaccataaaagttactgtgagagcagaaattgaaggtcgagggatcgatcgatcaatggcggatgggctaagcttcccgagcatggggaatttgtacgtacaggctgtgccgcctccagatttgaacaaaaatacgtcatggtttatgtatccaggcgtttggacgacctatatattaatacttttctttacatggctgaccgtgctctcagtatttggatgcaaggctggcactgcttggaccatcgttaatctctgccattttgcggtaacttatcatttctttcactggaagaagggtactccgttttctgaggaccaagggatatacaataagctgacatggtgggaacagatcgataatggcaagcagctgacacgtaacaggaagtttctgactgttgtccctgtagtcctatacttgattgcatctcataccactgactaccaaaatccatggctgttcttgaataccattgctgtcttggtgctggttatcgccaagtttccgaacatgcacaaagtgcgcatttttggaattaatgcagattatgctatttgagtgtgattcaaatacaataattccagagtctgttgtttgatgctttcttttatttcaaaattgcgatcaacatagatcacttcaatgtacagaactccgctatgaaaaatgcttgaaagaattgcagaaatttgagtggagcattgtatacaggagctgtcatgtattgctttctttcctgaccgacttctcctgtacaggccttgtttgttagattctgtacggaggtttcccataatgtagatcatgctgtaatataattattttttggttgtgtagatttccagataaaggtgttatacatgttatgtattagtaaatactccttttgtgtaatttaaggtgtttatttc

SEQ ID NO: 2763 - DNA, 564 bp, Bupleurum chinense
gcgacaccaccgacggatctgaacagaacaccgagtggtttacatatccaggtgtatggactacttatattctcatcctcttcttcgcctggcttgttgttctctctctcctcaattgttctcctggaatggcttggaccattgttaatctctcccacttcctcgttacgtatcacttcttccactggaagaaaggaactccatttgctgatgaccaagggatctataatgggcttacttggtgggagcaggtcgacaatgggaagcaactcacccgtaacagaaagtttttgactgttgtgcccgtagtgctgtacttgatagcttcacacacaacagactatcagcacccaatgttgctcttgaatactattgcagtgactgtacttgttattgccaagttcccaaatatgcacaaggtccgtatcttcgggattaatggagagcagtgagatgctttgttaacctgcaattatgccttatgcaaaaagaaaaagtaaaacgggataaatcttgtatagttgtatagtaatcggaactgaaaacgatgttggaagtgtaatg

SEQ ID NO: 2764 - DNA, 2419 bp, Cocos nucifera
gccggcgattccaaagtcaaagtcaacactttgaccgatctcttccttccacccaccccgctctcctctttgaacacttctccccttcttcttccgccacccattaaatcctccaccgctgttctcttcttctccacgctctcgctctgtctcatagagagaaaaattggagctttttggatacagagaaagagggggagagagaagaggagggatggcgaagctctacgtgcagacggtgtcgccggtggatctgaacaagaacactgagtggttcatgtaccctggggtctggaccacctacatccttatcctcttcttctcctggctcctcgtgctctctatcttcggttgcacccccgggatggcctggactgtcgtcaacctcttccatttcgccgttacttatcactttttccattggaagaagggaactccatttgccgaagatcagggtatttacaataatttgacttggtgggagcagatggacaatggcaagcaactgacacggaataggaagtttttgaccattttacctgttgtcctgtacttgatatcttcccacacaactgattaccaaaatccaatgcttttactcaatacattcgcagtgttggtgctggtagttgccaagttaccaaacatgcacagagtccgcatcttgggaattaatgcagatcgttgagcagcgttgcacatgaaagatatcttaattgatatctctttttgttggaaatgttgtcagatggtgtccggttctcatcgattcatagtaagtctttggtggatgttcctgttatccctgtacagaactgtcaggaagttatagttgtgtttgtgctacttttgatgcatttaagctatttatagaccgtatgttatgtttcatctatcagcgtacaagaataagtgaactcagttcctcttctttgtggactactttctttgttgcccttggaggattaattctacttgtcgtatgacaatgatacatgatcattgctgaatgatcttagatgttcaaaccaaagcactgaaagaacttctcaacatctgcatcagaaacaaactagtttgtttctaacaggtcaaaatttcttagaatgtccgaaagagtcagcattttctctctcattggtttggcaagcaatgttctttctgcctgggtgcttgttgactgattggatggtaattgctacaaatgatggggtgcataaatgcagcattttgacaaagtgtggtcacattagatggattcaaggcttatgaggcaggacaaatccttgcaaatcataagccagatgataaaataagtcacaagttcaaggtgttatccactattgcatcttttaatgtttgacaggtataagttatgattatttttacccagagcaacttatgaaaaacatgagttgcactcatctttgaagccaaaaaaggtacctgctgcatggtggacctaactagggcctatcttaagtaatcaaatggattgggatgcaaaagctgaggtaagtaagattccatgcaataaatttagcagcaggcattagaattttgttctttcattcagtaaagacttccaggtagggctactgtggaaaccatcctctggacacggtttgctgactatgaccaagattcaactaagacacagtcaagaggacatggcctaagggccttttaattaatatctagatactctcaaggtttaaatattgttattgtagactaggtagattaagcacggcagagatcaccatcaacttcttccagcagagtactcagcttggcagggttcaatgggtggacttcaaagttatcaatctcagcatccatgaactctttcttgtccatatcagtcaaattggcagggagtcttggtagtctatcatgtaagaagaaatctcaactaagttaaaactggtaattactgccgagaaaatgtcaaattggtagcaagtgaatcagtataaaattaatccaaccatcatggtggcacgtttgattaatacaagatctagggccaagcaataaagctcaagtctggcacaataccaatggagcatgccgatggaagtgaaaagccatcatagctctcaatggcctcagcatataacggtctaccctcatgttcgaccttgccaaatgagttaaaaggcaaacttaaaggaagagcatgaccgctcatccttagcatgtccctgtccatcaaacaacgtcaaatgacaaccatgaaagaaaaaatctcgaggaccttgagggactgtgccttcttggatgcccggcacaagtttcgaaaggcgaataggattatggactaggttccctcttatatgaaggagccctgtggactgatctatcttttatcttttggatgtattcatatccgacggatatggtcctttcattttat

SEQ ID NO: 2765 - DNA, 881 bp, Echinochloa colona
acacgacgactaggcaggcaggcacgcgcccccacacagctcgcagctgctcgcctcccgccgtgtccgccctgtccttctcccgtcgtcggcccgggcgggaaagggagggggcgttctcgcgactcgggcggctggggattgctcgggagccccgcgatggcgaagctgtacgtgcaggcgttcccgccgccggatctgaacaagaacaccgagtggttcatgtacccgggagtgtggacgacctacatcctcaccctcttcttctcctggctcctcgtgctctccgtcttcggctgcacccccggcacggcgtggaccgtcgtcaacctcttccacttcgcgatcacataccactttttccattggaagaaaggaacaccttttgctgatgaccagggaatgtacaatgcattgacttggtgggaacaaatggacaatggcaaacagcttactcgtaacaggaagttcctaattgttgttcctgtagtcctgtatctgatagctttgcacaccacggactaccaacagcctatgctcttcctcaacacccttgccgttagcgtgcttgtggtcgctaaactcccaaatatgcacaaggtcaggatttttggaataaatgcagaggactaatcagcagcaaccttcagcagacatctacctatatgttttccagagtggtctgtatgttccccttctagtgcttagttgggctcatgggagtaccagtgagtagtgttaaaagttgttagcagatgggccttggtcgttgtatagagaaatgctcagaggctggaaatgtcgatgctgtacatctggtgtgcacggattctgtagacttttaatgttgttatatgctttgttgcaagcatcttgtcagt

SEQ ID NO: 2766 - DNA, 930 bp, Musa acuminata
ctttgccgtctaatctcctctgctagatgtgttcttttctggacgccgacggagaagaacgaaatcaaccgacccaaaagtccaattacaacgccttgaccaaaagccattctcctattgatctatattaatcctaactcgacttcgcttctccgtcgctcgcgcttctctctttgcctttgccttggactcgaaggcagagttcgaaaggggaacacactcggcgaggacgatggcgaagctctacgtgcagacggtgcctccaccggatctgaacaagaacacggagtggttcatgtaccccggcgtctggagcacctacatactcatccttttcttctcctggctcctcgtgctctccgtcttccgctgcacccccggcatggcctggaccgtcgtcaacctcttccacttcgcgattacctattacttctttcattggaaaaaggggactccctttgctgaagaccagggcatctacaataacttgacctggtgggagcagatggataatgggaagcaactaacacggaacaggaaatttttgactgttgtacctgttgtcctgtacctgatggctctgcacacgaccgactaccaacatctgatgcttttcctgaatacacttgcagtggccattttggtgattgcgaaattcccaaacatgcacaaggttcgtattttcgggatcaatgaatgagcagtgacgcacacgaaagataacttggcggttgtccttttaattcgatagctagatcttataggcctagttggtaacactgaatactgaatgaagtgcataatgccaaagtcgtggtttgttgttcatatacagaacatattgaagaatataggagtggatgctgttttgcttttgtactttcatctatcgattttatatgaatataagaaaagtggtgtgcttttgac

SEQ ID NO: 2767 - DNA, 719 bp, Bupleurum chinense
aggaagagaagaaaaatcgatggcgaattattacgtgagagcggtgccaccgccggatctaaacaaaaacacggaatggtttacatatccaggtgtatggacaacatatatattgattctcttcttctcctggcttgttgttctctctgttctcaattgttctcctggaattgcctggactattgttcatctcactcacgcctttattacatatcaatgttttcactggaagaagggaacgccattttctgaagaccagggcatctacaataggttgacatggtgggagcaaattgataatggaaatcagctaactcggaataggaagtttttgacagtggttcctgtagtcctgtacctgatagcctcacatacaaccgactaccaaaaccctatgctcttcttcaacacagtggcagtctttgtgctcgtagttgccaagttccccaacatgcacaaagtccggatatttggtatcaatgcagatcaataaaccagtattgttataaaagaaaacctgcttcactcaaacaattgcaatagccacatctttatatcaacattttgggatttcattattactgtaatacccttgtaaggattttttataatgataaggttatattactctatattttctctgttccatggtgggagtagtatcactctagctagatgttctgtattcattgtatgacttgattaatcattgaacttat

SEQ ID NO: 2768 - DNA, 688 bp, Taraxacum officinale
ctctcttctatcaaatttgacctaatccccgattcatggcgaatctgtatgtacaagcggcgccgccgacggatctcaacaggaatacagagtggttcacataccccggcgtctggatcacctacatactcaccctcttcttcgcttggctcgccgttctctccgttttcggctgttctcctggcgttgcttggaccatcgtcaatctcgctcacgccgtgatgacataccacttcttccactggaaaaaaggaacaccatttgccgatgaccagggcatctacaacagactaacctggtgggaacagatcgatagtggcaagcaactcacacgcaacagaaagtttcttactctcgtccctcttgtcctgtacttgatagcgtctcacacaacagattaccagaaccctatgctgatcttaaacaccgtggctgttttcgtgctagttgttgctaaatttccacacatgcacaaggttcgcatatttggtatcaatgctgaagagtgagagtgaaattgaaattgaaatttcaatcttctttttaaaaatgaaaacacttcttaatttttagttgcaaatgtaacaccggttgtttcaccccatgacttgaacgatttcgattgtaaccttgcatattattatttttcttgttcttttatttcattaaaagtatatgtattcatcac

SEQ ID NO: 2769 - DNA, 696 bp, Guizotia abyssinica
gatccatcaataacatctcggtgaagctgataacaatcagaaaagaacatcaagacgatgtacgtgaaggcgacaccgacgacggatctgaatcggaacaccgattggttcacataccccggagtatggacgacctacatcttcattatattattttcatggtttctcatcctctccgtctccggatgcacccctggcatggcttggacgatcgtcaatctctcccattttcttgtgacttatcacttcttccattggatgaaagggactccatttgctgaagatcaggggatatataacaggctgacatggtgggaacagattgacaatggcaagcagctaaccagaaacagaaagtttttaactgttgtacctgtagttctgtacttgatagctttacacactactgattatcagcatccaatgctgttcctcaacacgattgctgtgatcgtgctggttatcgtgaagtttcctaatatgcataaagttcgaatctttggaattaatggagatatgtgacacgatggcggttgattgcaagtggtaagtttggatctttgtatcagaaatgggttggatgaatgtatagtaagttaatgttggggtggggaggtagcttggtaattaccattttttatgtgacttggtgtttgacaagtggtctgctggaaattagaaataagcttcctttct

SEQ ID NO: 2770 - DNA, 981 bp, Lolium multiflorum
accgacggacggagccgccccacagcccgcaggccacagcgaccgcggcggaggaaggggagggtcgggcggatcgatggcgaagctgtacgtgcaggcggtgccgccgccggatctgaacaagaacaccgagtggttcatgtaccccggggtctggaccacctacatcttcatcctcttcgtctcctggctcctcgtcctctccgtcttcggatgcacccctggcatggcatggaccatcgtcaacctaggacacttcgcgattacgtaccacttcttccactggaagaagggaactccatttgctgatgaccaggggatgtacaatagattgacttggtgggagcaaatggacaacggcaagcagcttactcgcaacagaaagtttcttgttgtggttcctgtggtcctgtacttgatagcttcacacaccaccgactatcaacatcctatgctctttttaaacaccattgctgtcactgtactggttgttgccaagctgcccaacatgcacaaagtccggattttcggaatcaatgccgggaactaagctgcaccgtctcagggtagacagcactcagtatcatgtttcatccgaatggctggatgtgttgcacctagttctgaattcgctcatcagagcaccagcgtgtagtgtttgagctgttagtagatcatgacatgtgatcattgtacagagaaacgccaaaaggccttgaaatgatactgttttgcaacttaccaacacacgtttctgtagactctttttgctgctatatgtttctgttgcgggaatttgttatttgatacgtgtgcagtttatatgtctgttaaattgtcctaatttcacaaatgtgaggtgtagcaacacagttacacagagggcatgcgcgtgagtgcattggtcttgtccacaggcagttgacaagtaatgtggtaaaactaaacatgtttggtcagtatcgctttgtgcaatcagac

SEQ ID NO: 2771 - DNA, 1018 bp, Zea mays
cccacgcgcccgctcctcgtcgccgtcctcttcctccatctcacccgtccctcagcctcgttaatttttcgcccccatctttgaacgcagcggctcaacctccatcgttctctccctcctcctccccccgatcccgtccctataaattgcgcccccgccgccacagcggaccgcaagcacgcaatcacacagctcgctgctgctgccgtctccccgtgtcctgtcgttctcccgtcgccgggggcggaagagttcggcgggcggttggggattgctcgggagccccgtgatggcgaagctgtacgtgcaagcgttcccgcccgcggatctgaacaagaacaccgagtggtttatgtacccgggcgtctggacgacctacatcatcatcgtcttcttctcctggctcctcgtcctctccgtctttggctgcacccctggcaccgcgtggaccgtcgtcaacctcttccacttcgcgatcacataccactttttccattggaagaaaggaacaccttttgctgatgaccagggaatgtacaacacattgacttggtgggaacaaatggacaatggcaaacagcttactcgtaataggaagttcctcattgttgttcctgttgtcctgtatctgatagctttgcacaccacagactaccaacaacctatgctcttcctcaatacccttgccgtcagcgtgcttgtggtcgccaaactaccgaatatgcacaaggtcaggatttttggaataaatgctgagagctaaacagcgtcatccttcaccagacattttacctatatgctttttcagaacggtctgtatgttccccttctagtgctttagttgggctcattcatcagagtaccatagtttaaaagttgttagcagatgggccttggtcgttgtatagagagatgctcagaggctggactggacatgtcgctgctgtacatctgatgtgcacagattctgtacacccttaatgttgctatatggtttgttgcgagcatctgtcagttg

SEQ ID NO: 2772 - DNA, 823 bp, Pennisetum glaucum
gacgagggagagccgagccggcggcggagtgggaggagaggattcgatggtgaagctgtacgtgcaggcggtgccgccgccggatctgaacaggaacacggagtggttcatgtaccccggggtctggaccacctacatcctcatcctcttcttctcctggatcctcgtcctctccgtcttcgggtgcgcccccggcaccgcgtggacgctcgtccacctcggtcacttcgcgatcacgtaccactttttccactggaagaagggaactccatttgctgatgaccaagggatgtataacacattgacttggtgggaacagatggacaatggcaaacagcttacccgcaaccggaagtttttgaccgcagttcctgtcgttctgtacttgatagcttcccacaccacggactatcaacatcctatgctcttcctgaacaccctagcagtcatcgtgctagttgttgccaaattaccaaacatgcacaaggttcggatttttgggatcaatgctggcagctaaggaacagcatctcgcagttgccacctatacatgtcatgtttcatctggattacaggtgctgagcccagttctgaattgaatcaccatagtaccagtagtagcgtttgagagctgttcgtagatgatatgtaatcattgtacagagaaatgctaagaaggctggaacaatgatgctttctgcaactagtgaacataacgttctgtagattcgaaatgtttctatacgttccctagcaagaatttggccattgatacatgtacagttctgctgttttgcctggaggaaatccatcatgatattac

SEQ ID NO: 2773 - DNA, 935 bp, Pseudoroegneria spicata
cctcctccgcgctgacctaccctacccggcaacaaaccaggccctccaatatagcagcaatccattccggcctctcagcccgcagcagcacacaggccacagctcccgcgacgccgagccgcacggacggacggagccaccgccccgcagcacgcgcgcgccggtagggcgagggaggggaggggatcgatggcgaagctgtacgtgcaggcggtgcccccgccggatctgaacaagaacaccgagtggttcatgtacccgggggtctggaccacctacatcttcatcctcttcgtctcctggctcctcatcctctccatcttcggctgcacccccggcatggcctggacgctcgtcaacctcggccactttgcgattacataccacttcttccactggaagaaaggaactccatttgctgatgaccaggggatgtataatagattgacttggtgggagcaaatggacaacggcaagcagcttactcgcaacagaaaatttcttgttgtggttcctgtagtcctgtacttgatagcttcgcacaccacagactatcaacatcctatgctctttttgaacaccatcgcagtcactgtactggttgttgcgaaactaccgaacatgcacaaggtccggatttttggaatcaatgccggtaactaagcggcggcagcgtcccagggtagacaccactcaatatcatgtttcatttgaatggctggatggtgttgcacctagttctgaattcgctcgtcagagtaccagtgtgtagtgtttgagagctgttagtaaatgacatgtgatcattgtacagagaaacgctaaaaggcctggaaaatgatgccgttttgcaactttgcccgacacacgttctgtactctttatgctgctatatgttttgttgcaagtatttgtcaattgatacatgcataaca

SEQ ID NO: 2774 - DNA, 1051 bp, Secale cereale
ccaccctcacctctcctcctccccctcttcctcccgcagggaatactcttccgtcccccatctttgaaccttcctcctcctccgcgctgacctaccctcacccgaccctacccctgccccggcaacagaccaggccctcctacatagcgacaatccattccggcctcgcagcccgcagcagcacgcaggccgcagctcccgcgacgccgagccggaccgacgggaggagccaccgccccgcagcacgcgcgcgccggcagggcgagggaggggatcgatggcgaagctgtacgtgcaggcggtgcccccgccggatctgaacaagaacaccgagtggttcatgtacccgggggtctggaccacctacatcttcatcctcttcgtctcctggctcctcatcctctccatcttcggctgcacccccggcatggcctggacgctcgtcaacctcggccacttcgcgattacataccacttcttccactggaagaagggaactccatttgctgatgaccaggggatgtataatagattgacttggtgggagcaaatggacaacggcaagcagcttactcgcaacagaaaatttcttgttgtggttcctgtagtcctgtacttgattgcttcgcacaccacagactatcaacatcctatgctctttttgaacaccattgcagtcacagtactggttgttgcgaaactaccgaacatgcacaaggtccggatttttggaatcaatgcgggtaactaagcggcagcgtcccagggtagacagcactcaatatcatgtttcattcgaatggctggatggtgttgcacctagttctgaattcgctcgtcagagtaccagtgtgtagtgtttgagagctgttagtagatgacatgtgatcattgtacagagaaacgctaaaaggcctggaaaatgatgctgttttgcaactttgcccgacacacgttctgtagactctttatgctgctatatgttttgttgcaagtatttgtcacttgatacatgtacagtttctccgtgcctgaagttttccgttcttaa

SEQ ID NO: 2775 - DNA, 1691 bp, Panicum virgatum
ctaattaattatgatgctataacaattatgacgaagacaaaaaataaataaatagcagcgacaatgatgggctctcagcgcgcgcggcccgctggcagcccaagagctgctcagcgcgcacggcccgccgcccgtccgtcgcgtttgacccgatcgctgccggcggtcgcggtcgcgtttccaccgtctcctgccagcggccaaccgtctcgtcgcctccctccccgtccgctcaccccaccctctccccgtcggtcgcccgccgcccgccaccccatcgctatactttttcgccaccatctttgaaccttcctcctcccccgctctgaccatcgcggcgaggcgcttcctcgtcccagccttataaatcagccggaggcgagctgtctccctcccagaccgcagcagcacgcagccgacgagagacccgagccgtgccggcgacgtggaaggggaggggcgattggttcgatggcgaagctgtacatgcaggcggtgccgcccccggatctgaacaggaacaccgagtggttcatgtaccccggggtctggaccacctacatcctcatcctcttcttctcctggatcctcgttctctccgtcttcgggtgcgcccccggcacggcgtggacgctcgtcaacctcggccacttcgcgatcacataccactttttccactggaagaaggggactccgtttgctgatgaccaagggatgtataacacattgacatggtgggaacaaatggataatggcaaacagcttactcgcaacagaaaatttttgactgcggttcctgttgttctgtacttgatagcttcccacaccacggactatcaacatcctatgctcttcctcaacaccctagcagtcactgtgctggttgttgccaagctaccaaacatgcacaaagttcggatttttggaatcaatgccggcagctaaggagcagtgtctctcggttgatacatgtacatgtcatgtttgatttggattacgggatgtgttgagcctagttctttattgaatcaccggagtacgtgagtagtgcttgagagctgttcgtagatgacatgtaatcattgtacagagaaatgctatgaaggctggaacgatgatgcttttctgcaactagtgaacaaaggttctgtagactcgtaatatcgctatacgttctctagcaagaatttggcaattgatacatgtacagttttgctcttttgtcaagaggcaataatcaatcgttatctgacaaaataatggcaaatagttcttctaggggtagctctgtgttttattaaagagtcatgtatgatgaaagtagttatgaatctagtagaaacaactttatgttacaaaactatttagactttagctgctgattgatacaaataaaaaagatgacgtcggacaagcataaaaaagatttgcttttgtgattgaaggggtcgaggggccggggtgtgaaattgctggttaccctttgaggattaattgaaggttgcttcgtacacatgctgattaggagaaaagaatctcgatcgcaatataatgtttgaattttgaaacgaaccagcacgaggatatgtcaatataatgtctgaatctgatgcctcagtctctcaattgaattccgatacaaatgcagctaccacagggtgacaggatgtttcttatgccccgcaagataa

SEQ ID NO: 2776 - DNA, 1414 bp, Panicum virgatum
tgtttgctgtgctttcatcatcagcattcagaaatcagaaatgaacaaccagaattttcacctcagctcgaaggtaaaaaaaaaggaaaaaagaaaacggagaaaccaaagggaggaaacagcgcagagcaaagcgacgacgggctcgcagcgcgctcggcccgctagcagcccatgagctgctctaagcgcgcacggcccaccgccccgtccgtcgcgtttgatccgatcggcgatcgctgccggcggtcgcggtcgcgtttccaccgtctcctcctgccagcggccaaccgtctcgtcgtcgcctccctccccgtccgctcaccccctgtccctccccgtcggtcgcccgccagccaccgcatcgcaatactttttccgccaccatctttgaaccttcctcctccctcgctctgaccagcgcggcgagggcggcgaggcgcttccccgtcccatccttataaatcgagccggaggcgggctgcctccctcccaggccgcagcagcacgcagccgacgaggggcccgagccgtgccggcgaagtggaaggggagggggcgattggctcgatggcgaagctgtacgtgcaggcggtgccgcccccggatctgaacaggaacacggagtggttcatgtaccccggggtctggaccacctacatcctcatcctcttcttctcctggatcctcgtcctctccgtcttcgggtgcgcccccggcacggcgtggacgctcgtcaacctcggccacttcgcgatcacataccactttttccactggaagaaggggacaccgtttgctgacgatcaagggatgtataacacattgacatggtgggaacaaatggacaatggcaaacagcttactcgcaacagaaagtttttgactgctgtccctgttgttctgtacttgatagcttcccataccacggactatcaacatcctatgctcttcctcaacaccctagcagtcactgtgctgtttgttgccaagctaccaaacatgcacaaggttcggatttttgggatcaatgccggcagctaaggagcagtgtcccatggtacacacctatacatgtcatgtttgatttggattacgggatgttttagctctgaattgaatcgcgggagtaccagtgagtagtgcttgagagctgttcgtagatgacatgtaatcattgtacagagaaatgctaaggctggaacgattatgctttctgcaactagtgaacaaaggttctgtagactcgtaatcttgctatatacgttctctagcaagaatttggcaattgatacatgtacagctttgctcttttgtcaagaggcaataatcattcgttatatgacaagataacgaagtgctagatttgtttcttccagtcaaatttcataaatatcgaccaccagttagttaa

SEQ ID NO: 2777 - DNA, 928 bp, Eutrema halophilum
gagcccaaaggttgttaaaacgaacgagagagaaaagaaagggatccatccttttgttcagacgatctccggcgagaaaaaggatgtacgtacgagcggttccgacgacggatgtgaatcggaacacggagtggttcacgtatccaggagtgtggacgacttacatcctcatcctcttcttctcatggctcctcgtcctctccgtcttccactgctcccctggcatcgcctggaccgtcgtccacctcgcccatttcaccgtcacgtatcattccttccactggaagaagggaacgccgtttggggatgatcagggaatctacaaccggctgacttggtgggagcagattgacaacggcaagcagctcactcgcaatcgcaagtttctcacccttgttcccgttgtcttgtacttgatagcatctcacacaacagactatcagcacccgatgctcttcctcaacacactggccgtttttgtaatggttgtcgccaaattccctcacatgcacaaggtccgcatctttggaatcaatgcagaccaatgaaaccctttagcaaagacaaaaaaaaaaaacaataccaggctaggctaggtatgtgtataaaaaatgcattcgatttttttagtattttggaatctggaatccaatcaccaatgccaaccgctgaggaaatgcgttatatgggtcctcccagtcccatccctttctcttttgtggtatcttaactttctttttatttgtattatatatcccaaaaagctgctgggtaaaaagagctagcaatctaggatttgaatgaatagtttgggcatgctggttctatgtatacaacacttcttttggttttttagatcattcattatattaagaattatatgattattcattgttaagatgtgaaatccagagaattaattcttgag

SEQ ID NO: 2778 - DNA, 715 bp, Utricularia gibba
ccgccgccggatctcaaccggaacaccgagtggttcacgtaccccggtgtctggactacctacatattgattctctttttttcctggctcgtcgttctgtccgtcaccaattgtacccctggcatggccttgacgatcgtcaatctctcccatttcctgatcacttaccatttctttcactggaagaaaggaaccccttttggtgatgatcagggaatctataatcgtttgacatggtgggaacagatagacaatggaaagcagctaactcgaaaccggaagttcctcacagtcgttccggttgttttgtatctgatagcttcacatacaacagattaccaacaccccatgcttttgttcaacacactcgcagtcctcgttttggtcatcgccaagttccccaacatgcacaaagttcgaatcttcggcattaatggagaccagtgaaagggtaaacaaaccctgtgtggtgatgcagttctgttgctggtaaagaaggtgatcacccccaccacccgctccatatctaggagctgaaagcgttgatatcctcagtagctgtactatgcaatgacacaaataaaggccatgagccgggttttctctgtacagaagaacagttattgtcgaatgcgcttgggctatatataccagtgcataaactggaggactgttcaaatacctgcttctgaaaatggggaaaagaaaacaaaag

SEQ ID NO: 2779 - DNA, 624 bp, Utricularia gibba
tgccgccgccggatctcaaccggaacactgagtggttcacttacccgggtgtttggactacctacatattgattctctttttcgcctggctcgtcgttctctccgtcaccaattgtacccctggcatggcctggacgatcgtcaatctctcccacttcttgatcacttaccatttctttcactggaagaaaggaaccccatttggtgatgatcagggcatctacaattctttgacgtggtgggagcagatagacaacggcaagcagctaactcgaaaccggaagtttctcacagtcgtgccagttgtattgtatctgatagcatcgcatacaactgattaccagcaccccatgcttttgttcaacaccctggcagtgctggttttggtgatcgctaagttcccgaacatgcacagggtccgtatcttcggcatcaacggagaccagtgagtgtgtggtgttgctgacaaagaaggtgactctccccgccccactccatgcgtcagggcttctatctgcacagaagaaatgataaaatacatttggatattacatacagcacgttacctctcctacgattagtgtcaatagttacttaatttttaatcagtgattcggatttcat

SEQ ID NO: 2780 - DNA, 1277 bp, Triticum aestivum
gcaggaaatactcttccgtcccccatctttgaaccttcctcctcctccgcgctgacctacccctcaccctcccctcccctcccctccccggcaacaaaccaggcccctcctacatagcggcaatccattccggcctctcagcccgcagcagcaccccggccgcagctcccgcgacgccgagccggacggacgggaggagccaccgccccgcagcacgcgcgcgccggtagggcgagggaggggaggggatcgatggcgaagctgtacgtgcaggcggtgcccccgccggatctgaacaagaacaccgagtggttcatgtacccgggggtctggaccacctacatcttcatcctcttcgtctcctggctcctcatcctctccatcttcggctgcacccccggcatggcctggacgctcgtcaacctcggccacttcgcgattacataccacttcttccactggaagaagggaactccatttgctgatgaccaggggatgtataatagattgacttggtgggagcaaatggacaacggcaagcagcttactcgcaacagaaaatttcttgttgtggttcctgtagtcctgtacttgatcgcttcgcacaccacagactatcaacatcctatgctctttttgaacaccattgcagtcacagtactggttgttgcgaaactaccgaacatgcacaaggtccggatttttggaatcaatgccggtaactaagcggcagcgtcccagggtagacagcactcaatatcatgtttcatttgaatggctggatggtgttgcacctagttctgaattcgctcgtcagagtaccagtgtgtagtgtttgagagctgttagtagatgacatgtgatcattgtacagagaaacgctaaaaggcctggaaaatgatgctgttttgcaactttgcccgacacacgttctgtagactctttatgctgctatatgttttgttgcaagtatttgtcacttgatacatgtacagtttccccgtgcctgaaattttccgtcctattcccctcagtttgaggtaagatcaaaaggaattgcgtgtgcatccgtgcttgtccataggccatcaggtcgtgtgcaaacctactagcaaactgttctggtcgatagtgttttgtgcagtgagacccagaagtacagtaatctggatgagatgcccttctctcctgaaatttgtatgggaaatggttgtgtatgccaacacttcaccttaggattgggaacctggtttgatcattctatagtgtttttgtta

SEQ ID NO: 2781 - DNA, 864 bp, Malus domestica
gtcgccaaccccaaaaatcccccgaatctcaatccgtcctgcaacgcaacttccccaaatcgtcttttcgtttttgacgtcggtgatgatgagcagctgctccttattaacactcccatcatcgtcgtcatcaatcttaatcttcatctcgtagtctcttccggttaattgatttcgtttcatcatcccaaaaaattcagaaaatcctgaaaaaaaaaaggatcggaaaatgtacgtaacggcggtgcgaccgacggatctgaatcggaacacggagtggttcacgtaccccggagtctggaccacctacattcttatggtgtttttctcgtggctcaccgttctctgcctcttctcttgctctcccggcatggcctggaccgtcgtccacctctcccacttcctcgtatttgttatcacttttttcactggaagaaaggaacaccatttgcagatgatcagggtatctacaatgcactgacatggtgggagcaaatagacaatggcaaccaactcactcgaaacagaaagtttctaactgttgtgcctgttgtgttgtaagcattgatagcctcacacacgacggactatcaaaatccaatgctcatctttaacacgctagcagtttttgtgttggtagttgcaaagttcccaaacatgcacaaggttcgtatattcggaatcaacgctgatcactgatctctctaaacgatcaagcttgactatagttttcttggtctagtcatatgagttttcttggtctaatcatattggcattcggacataatggtagaatccctgttgaaatgttgaaactggaaacagtgtattgttttttggatgaagtgaaattttttacccctc

SEQ ID NO: 2782 - DNA, 1809 bp, Panax ginseng
gatttcgcccaagtttatgagagttctactttgcaccagagaaatatagagctagtgaagagcttgagtattccacctccaggttcaaaagagttgtattttcccacgcgcttttcgcaaaatggttgggggcagtttaaatcctgcctatggaaacaacatttgtcttattggagaagcccttcatacaatttgatgcgctctatgcatatgattttcacgtctcttctttttggcctactcttttgggatcaagggcagaagatagataaccaacagagtttgttcagtatatttggttcaatgttttctgctactatatttgctggcattaacaatgcctcttcagttctaccatatgtctccacagaacgaaatgttctgtatcgagaaagatttgctgggatgtacgctccttgggcttatgcacttgcgcaggtgacaattgaggttccttatctgtttgcccaatcacttgtatacgtgattattacatatccaatgatcgggtattattggtcaccttataaagtgttctggttcttctactccatgttctgtacattgttgtacttcacttatatgggaatgatgattgtttcaatcacacctaccttcccagtagctgcaattctacaatcttccttttacaccatgttcaacctcttctctggatttataattcctcaaccgcaaattccaaagtggtggttatggttttactatctcataccaacatcttggacactaaatggcatgctctcctcccagtatggagacatagagaagaagattttggcatttggagaaagaaaaactgttgctgcctttttaaaagattactttggatttcaccatgatagattacctttagttggtgtgattatgatgttataccctattgtttttgcttctatatttgcttattgtattgggaagttaaattttcaaagaaggtgaatattgtaaagtcatttttattactgttaataaaggtaacctaagggttcctacattcaacaaaaaataagcagtggtatcaacgcagagtacgcgggggagggggagggggatggcgaattattattacgtgaacgcgacgccgccgacggatctgaacaagaacacggagtggttcacttatccaggggtttggagcatctacatcttcatcctattcttcgcctggatcgtgcttctctccctcttcaattgctctcctggaatggcttggaccatccttcatctctcccacttcctggtaacatatcacttcttccactggaagaaaggaactccgtttgctgatgaccaggggatctataatgggttgacgtggtgggagcagatcgataatggaaagcaactcacccttaacagaaagtttttaacagttgtacctgtggtgctgttcttgatagcttcgcatacaacggattaccaaagcccagttttgttcttgaatactcttgccgtcatcgtacttgttatcgccaagttcccaaatatgcacaaggtccgtatcttcgggattaatggagatcagtgagatggtttatggatttgtaattgtgcagaaaaagttgtattactgtatagtaatcccaatggaaaaggattttggatatgtaatgcttttatgttttctttggttttcttttgacaagctctctcacgaatattgaaggaataaaggttctgagttaatcgtttcacaacagaatttttatgcaaccgggtttctttagaatctaatgttaaaacaatgtcaatatatgtgggtcaattcttatgcctttggatcaaaaa

SEQ ID NO: 2783 - DNA, 734 bp, Musa acuminata
caactcccccctttggtcttccttcgatcttgcatgaatacccctccccggcctccccaagcttgatatcggaatacagagagcgaaaggagaaggcgacgcgatggtgaagctctacgtgaagacggtgccgcccacggatctgaacaaaaacaccgaatggttcatgtaccccggcgtctggaccacctacatactcatcctcttcttctgctggctcctcgtgctctccgtcgtcggctgcacccccggcatggcatggaccgctgtcaatctcttgcactttgcggttacctattacttcttccattggaaaaagggcactccctttgctgaagaccaaggtatctataacaacttgacctggtgggagcagatggatgatggcaggcaactaacccgtaacaggaaattcttgattgttgtacctgttgtcctgtatctgatagcctcgcacacaacggactaccgacatccaatgctgttcctgaatacacttgcggtagccatactggtaattgccaagttcccaaacatgcacaaggtccgcatatttgggatcaatggatgacttgtgctgcatcaccaccccatatataacttgattgttatctttttcattgataactaggccagtaggtaatacctaacattagtccaaggccacagtcatagtttgtgttagtgtacagtactagtgttctgtattctctttatgaattttccatatcaac

SEQ ID NO: 2784 - DNA, 898 bp, Daucus carota
attcaaagtaatcgaagcagagcaaacgctgaggatcatttcgttgttgacgtcgtgaaaaacaagacaaatacatacgcatatagatacaagaagagagaaaagagagagaatcgatggcaaattattatgtgcgagcggtacccccgccggatctaaacaagaacacagaatggtttacatatccaggtgtatggacaacatatattttgattctcttcttttcttggcttgttgttctctctgttctcaattgttctcctgggattgcttggactgttgttcatctcgctcatgcctttattacatatcagtgctttcactggaagaagggaacacctttttctgacgaccagggtatctacaataggttgacatggtgggagcaaatagataacgggaatcagctaactcggaataggaagtttttgactgttgttcctgttgtgctgtacctgatagcctcccatacaactgattatcaaaacccgatgctctttctcaacacagtggccgtctttgtgctagtagttgctaagttccccaacatgcacaaggttcggatatttggtatcaatgcggatcaataagctggtatcctatcgaagaaatacaaccctggtcgactccaagctatatctatattttgaaaccaacattttggaacttgattgttactgtaatacccttgtaaggatctgttaaaatgataaggttatattacgtcatattttctctgttctatggtgggagtcatgttatctaagctagacgttctttattcattgtatgaatttatgcaacactcaacacaatgtaattattcatagctagagatttttctgggcttgcttaaaaaattgggattttctatggtgtgcccaagggcacacaatag

SEQ ID NO: 2785 - DNA, 885 bp, Avena sativa
ctcctacatagccagccacaatccattccgacctcccgtcagccctcgcagcagcgcgcagcctacagccccccgccacgccgagccggacctaaggacggacggagccacagcgagcgcgcgcgggcgggcgaggaacgggagggcggagattcggggggcggatcgatggcgaagctgtacgtgcaggcggtgcccccgccggatctgaacaagaacacggagtggttcatgtaccccggggtgtggaccacctacatcttcatcctattcgtctcatggctcctcgtcctctccgtcttcggatgcaccccaggcatggcctggacaatcgtcaacctcggccacttcgcgatgacataccacttcttccactggaagaagggaacaccatttgctgatgaccaagggatgtataacagattgacttggtgggagcaaatggacaatggcaagcagcttactcgcaacagaaaatttcttgttgtggttcctgttgtcctgtacttgatagcttcacacaccacagactatcaacatcctatgctctttttcaacaccatcgctgtcactatactggttgtcgccaaactaccgaacacgcacaaggtccggattttcggaatcaatgccggaaactaagcggcagcgtgtctcagggaagacagcactctcagtatcatgttccattcgaatggctggatgtgttgcacctaagttctgaatttgctcatgggagtaccagcatatgtagtgtttgagctgttagtagatgacatgtgatcattgtacagagtaacgctaaaggcctggaaatgatatactgttttgcgacttgccaacacacgattctgtggactcttttttgctggtatatgttctgtt

SEQ ID NO: 2786 - DNA, 697 bp, Avena sativa
cccccatctttgaaccttcctcctcctcctccgcgctgacctacccggcaacgaaccaaccaggcccctcctacatagccagccacaatccattccgacctcccgtcagcccgcagcagcgcacagcctacagcccccgccacgccgagccggccagacggacggaaccaccgcgagcgcgcgcggggcgaggaacgggagggcagggatttgggggcggatcgatggccaagctgtacgtgcaggcggtgcccccgccggatctgaacaagaacacggagtggttcatgtaccccggggtgtggaccacctacatcatcatcctgttcgtctcctggctcctcgtcctctccatcttcggatgcaccccaggcatggcctggacaatcgtcaacctcggccacttcgcgatgacataccacttcttccactggaagaagggaacaccatttgctgatgaccaagggatgtataacagattgacttggtgggagcaaatggacaatggcaagcagcttactcgcaacagaaaatttcttgttgtggttcctgttgtcctgtacttgatagcttcacacaccacagactatcaacatcctatgctcttttcaacaccatcgctgtcactatactggttgtcgccaaactaccgaacatgcacaaggtccgtatttcggaatcaatgccggtaactaag

SEQ ID NO: 2787 - DNA, 861 bp, Allium cepa
tcaatcaaattgaacttttacgataatatacaaacatctctctcattagaaaacaattagcaatctctagatccttccgcgatggcgaaactatacgtagagacgatgccgccggcagacatgaacaagaacacagagtggttcatgtatccaggcgtatggaccacctatattctcattcttttcctttcatggctcatcgtgctatccgtatttaggtgcacccctggcatggcatggactgttgtcaatctgactcatttcgctataacctaccatttctttcactggaagaaaggaactccatttgctgaagatcagggaatatatcgtgcactgacctggtgggaacaaatggacagtggcaagcagcttactcgtaatagaaagtttctaacagttgttcctatcgtcctgtatttgatagcttcacacacgactgactaccaaaacccgatgcttttcctcaacacgcttgcagtattcatcctcgtgatcgccaaacttcctaatatgcacaaagttcgcatccttggaataaatgctgaccattgagaaatcatatattcacgaaagcatgaatcctccatctgtatctttggtttatatctcttgctttctctctatgtatgaatgttctacaacaacagcataaatgggatgcgattaatacataagacacttggtaattcctgtacaggcactgttttgaagtaactagaattcttatctacttgtaagtgggcagtgtgtatgttactcttgtttagctgtgtatatgttactgttgatctgtagtttctgtaattgggaaaaataataagtgaatggttacgttcagctactatgtgatatgctttt

SEQ ID NO: 2788 - DNA, 1017 bp, Allium cepa
tagttacgggggaaaatgaacgcattcggtacgaacctaccatatttaatccagttagaaaagtcaaactcggacatccatttctcgtgaaaatccataaaataatacccattattctcttccccaaattatcataaatcaatcaaattgaacttttgcaattatataacttctctcgtcagaaaacaattcgcaatctctagatccttccgcaatggcgaaactatacgtggagacgatgccgccggcagatatgaacaagaacacagagtggttcatgtatccaggcgtatggaccacctatattctcattcttttcctttcatggctcatcgtgctatctgtatttagatgcacccccggcatggcatggaccgttgtcaatctgactcatttcgctataacctaccatttctttcattggaagaaaggaactccatttgctgaagatcagggcatatatcgtgcactgacctggtgggaacaaatggacagtggcaagcagcttacacgtaatagaaagtttctgacggttgttcctattgtcctgtatttgatagcttcacacaccaccgactaccaaaacccgatgcttttccttaacacgcttgcagtattcatcctcgtgatcgccaaactccctaacatgcacaaagttcgcatccttggaataaatgctgaccattaagaaatcatatttgcatgaaagcatgaatcctccatccatatctttggtttatatctcttgatccctctccctatatatataaatgttctacaacagcagcattaatgggatgtgattaatagataaatgcttggtaatccttgtacagacactgtttgaagtaactagagttcttatcttccttatgagtggacagtatgtatgttactcctgttttgttgtgtatttgtttactgctgatctgtagtttctgtaattggaaaaataattgtaagcgagtgattatgtttagctaccatgtgatatgggtaatttggtgttgaaacttg

SEQ ID NO: 2789 - DNA, 1255 bp, Petroselinum crispum
tgaaaacataatacagaaatatgtaacaaaacaaaaagaggaagaaattgaaatcaaagtagccaagcagagcaattcgctgaggatcatttcattgttcacatcgtcctatacaaaccaatacacacacatatacatacaaagggagacgaaagaaaaatcagatggcaaattattatgtaagagcggtaccaccgccggatctaaacaaaaacacagaatggtttacatatcctggtgtttggacaacatatattttgattctcttcttttcttggcttgttgttctctctgttctcaattgttctcctgggattgcttggactgttgttcatcttactcatgcctttattacctatcaatgctttcactggaagaaaggaacacctttttctgacgaccagggcatctacaataggttgacatggtgggagcaaatagataatggaaatcagctaactcggaatagaaagtttttgactgttgttcctgttgtgctgtacctgatagcctcccatacaactgattatcaaaacccgatgctcttcctgaatacagtggcagtctttgtgctagtagttgccaagttccctaacatgcacaaggtccgtatctttgggatcaatgcagatcaataagctggtatcctatcgaaagaatacaaccgtggttgactccaagctatatctgtaatttcatatcaacattttggaacttcagtattatcgtaatgccgttgtaaggatctgaaaaaatgataaggttatgttacttcatattttctctgttcgctggtgggagtaatgttacctaagctagacgtgtttatattcattgtacgaatttatgcgacattaaacacaatgtaattattcatagctagagatttttccggacttgcttaaagaatttgctcagagacagagtacaggtacacacgctagtataaaaaccactgaaacgaggagagaagaatctactaggcatgccatctgccttccactatttgcaaaattgtatgtttttcttgtaatatttaattgctgttatgtttaatctaaagaagctactgtattcatttacatagatagatgaaataaatattacaaggattattgtcgtaagcaggacctaaaaacaattaaaaaagtttttatgatgtgaatagtgcacatataattatcactatttaggctatgattgcttgaagagtaataaatgataatcgaattttatatattaattttctttccta

SEQ ID NO: 2790 - DNA, 911 bp, Arabidopsis lyrata
gcagagagacaaaattaaagaaagaaaaaaaaacttgctcaatcatctccgatctcctccgatcttgttccaaatctctccggtgaaaagacgatgtacgtaagagcacttccgacgacggatgtgaatcggaacacagagtggttcacatatccaggtgtttggactacttatattctcatcctcttcttctcttggctccttgttctctccgtcttccattgttctcctggcatcgcttggaccattgttcatctcgctcatttcaccgtcacgtatcattcgtttcattggaagaagggaacaccgtttggtgatgatcaaggaatctataatagattgacttggtgggaacagattgataatggcaaacagcttacacgtaatcgcaaatttctcaccgttgttcctgttgtcttgtacttgattgcctctcacacaacagactatcagcacccgatgctctttctcaacacactggccgtatttgtcatggtggtcgcgaaattcccgcacatgcacaaggtccgcatatttggaatcaatggagaccaatgaaaaacttgagaaaacaaagaaaaaggtttgtgtataatgcgaatcaagtatttggaatgtggaatccaacaacaaatgccatcgtcattcaacatgtctgtactatacagacatcgaatcccaaccggagaaaaaaatgtgttatttggtcacatcccatcatcgcttattcaaacctttctactctttgtttggggcttctaatcaattcatatttgatatcttatatggttgtcttagtttcttatttgtataatcccaaaactggttacaacagaaagttgtttagcgagcaatctagggtttgaatgaatagttggggaagatttatttatatataccgttttggacat

SEQ ID NO: 2791 - DNA, 664 bp, Brassica juncea
aaattaaaaccgaagatctggaaagagagtccgtaagcttgcttctgatcggagaatcaatcaatcgccgtgtggaaatataatcgtagattggatcggatcgttttaaagggaagagaaaaaggagatggcgaaagtgtatgtgaaaacggtgccggcgccggatatgaataggaacacggagtggttcatgtatccaggggtgtggacgacttatatactgattatcttcttcgggtggctagctgtgctctcagtctctgggtgctcccctggaatggcttggaccgttgttaatctctctcacttccttgtaacatatcacagcttccactggatgaaaggaacgccttttggggaagaccaaggcatctacaatgctctcacctggtgggaacagatggacaatggtcagcaacttacccgcaaccgcaagttccttaccgttgttcctgttgtcctgtacttgatagcatcacatacaacagattacaggcatccatggctattcctcaacacactcgctgtgatggttctagttgtggccaagttccctaacatgcacaaggtgcgcatcttcgggatcaacggtgataagtaacgttctttagcaaaactcagatccatttcttttctggcaagagaaaagtggatataagcaaac

SEQ ID NO: 2792 - DNA, 993 bp, Brassica rapa
taaaaggtgcctaaaattaaatctaattattttctaaactaaattaaattgagcctaaaacttgttaaacgacacggaaacgatagagagagagagagagaggagaaaggagccatttgggttattccaattctcatcaactcctacggtgaaaaaggatgtacgtgagggcgcttccgacaacagatgtgaaccggaacacggagtggttcacgtatcctggcgtatggaccacttacatactaatcctcttcttctcgtggctcctcgttctctccgtcttccactgctcccctggcatggcctggaccatcgtccacctcgcccatttcaccgtgacgtatcattcgttccactggaagaagggaacaccgtttggggatgatcaagggatctacaacaggttgacttggtgggaacagattgacaacggcaagcagctcactcgcaaccgcaagttcctcaccgttgttcccatcgtcttgtacttgattgcttctcacacaacagactatcaacatccgatgctcttcctcaacacattggccgtctttgtaatggtcgttgcgaaattcccgcacatgcacaaggtccggatttttggaatcaatggagaccaatgaaggaagccttaacaagactaagccaaaaaagggtatgtgtataatgcgagacaagtagattttggaagcttggaatacaattacaaaagaaaaatgccattgtcactcacatttgattccgcatgtgttactctcatcccatggcatctatactgtttctttggggctgcttctaatcaaatttctttctttattttttggtttctctgtttcttattcggtttagcgaggaaatgtaggatttggatgattagtttgggtaagaaagggtctttgaaatgtatgcaactcttcgtcattttttttatatataaagattattcattattaatattggaatagagagattgtacagtttttcggttcaaag

SEQ ID NO: 2793 - DNA, 822 bp, Musa acuminata
ccaattcccccctttggtcttccttcgatcttgcatgaatacccctccccggcctccccaagcttgatatcggaatacagagagcgaaaggagaaggcgacgcgatggtgaagctctacgtgaagacggtgccgcccccggatctgaacaaaaacaccgaatggttcatgtaccccggcgtctggaccacctacatactcatcctcttcttctgctggctcctcgtgctctccgtcgtcggctgcacccccggcatggcatggaccgctgtcaatctcttgcactttgcggttacctattacttcttccattggaaaaagggcactccctttgctgaagaccaaggtatctataacaacttgacctggtgggagcagatggatgatggcaggcaactaacccgtaacaggaaattcttgattgttgtacctgttgtcctgtatctgatagcctcgcacacaacggactaccgacatccaatgctgttcctgaatacacttgcggtagccatactggtaattgccaagttcccaaacatgcacaaggtccgcatatttgggatcaatggatgacttgtgctgcatcaccaccccatatataacttgattgttatctttttcattgataactaggccagtaggtaatacctaacattagtccaaggccacagtcatagtttgtgttagtgtacagtactagtgttctgtattctctttatgaattttccatatcaacaaagtgttcattgggtataaatataaatttttcttcctctttgagtgtactcataagttgaataacatgctgagacatggactctcc

SEQ ID NO: 2794 - DNA, 1078 bp, Brachypodium distachyon
tccccgtccccttcccggctttccctcggttcctcctcccacccatcctgccgctcctagaaagcctgtcccgccgcggcagccacagcacgcgggacatacacgcggcgctgcttccctgttcccccctccctggcggacggaggggaagggccctagaggcggaggaggctccatggcgaagctgtacgtgcaggcggtgccgccggcggatctgaacaagaataccgagtggttcatgtaccctggcgtctggacgacctacatactcatcctcttcttctcctggctcctcgtcctctccgtattcggttgcaccgcaggcatggcatggaccgtcgtcaacctcttccacttcgcgatcacataccactttttccattggaagaagggaacaccttttgctgatgaccagggagtgtacaatacattgacttggtgggagcaaatggatagtggtcaacagcttactcgtaacaggaagtttctcgctgtggttcctgtagtcctatatttgattgcgttgcacaccacagactaccaacatcctatgctctccctcaatactctagcagtgaccgtgcttgtggttgccaagctaccaaacatgcataaggtccggatttttggaataaacggcgggatttaggcagtcattcttttgcagacaactacctctgccctttccagaatggcctgatgtttttcaacctgtgctacttaaatgggcttaaaagtcattagcagatgggttgtagtaattgtatagagatgctcaaagtctggaaatgatgctgctctacatctgatgtacacgaattctgtagactcttactgctgctatatgctttgatgcaagcatctgtcagttgctgcatgtacagcggtttccttgacatctataattcatggcaggaatctcagtgatgcgtgcgtctatcacaggtgttgatggacagtgtggcatattattgcaaacagttgtgctggatgtagctaagcacagtacagcagagattctatctctagacatcattagaagtgtcatcagattcagagttgtgacgtcggatccgga

SEQ ID NO: 2795 - DNA, 1178 bp, Brachypodium distachyon
ccatcttcctttctttccctgacgtcgttaatttttcgcccccatctttgaacgatcattcggtccccgtccccttcccggctttccctcggttcctcctcccacccatcctgccgctcctagaaagcctgtcccgccgcggcagccacagcacgcgggacatacacgcggcgctgcttccctgttcccccctccctggcggacggaggggaagggccctagaggcggaggaggctccatggcgaagctgtacgtgcaggcggtgccgccggcggatctgaacaagaataccgagtggttcatgtaccctggcgtctggacgacctacatactcatcctcttcttctcctggctcctcgtcctctccgtattcggttgcaccgcaggcatggcatggaccgtcgtcaacctcttccacttcgcgatcacataccactttttccattggaagaagggaacaccttttgctgatgaccagggagtgtacaatacattgacttggtgggagcaaatggatagtggtcaacagcttactcgtaacaggaagtttctcgctgtggttcctgtagtcctatatttgattgcgttgcacaccacagactaccaacatcctatgctctccctcaatactctagcagtgaccgtgcttgtggttgccaagctaccaaacatgcataaggtccggatttttggaataaacggcgggatttaggcagtcattcttttgcagacaactacctctgccctttccagaatggcctgatgtttttcaacctgtgctacttaaatgggcttaaaagtcattagcagatgggttgtagtaattgtatagagatgctcaaagtctggaaatgatgctgctctacatctgatgtacacgaattctgtagactcttactgctgctatatgctttgatgcaagcatctgtcagttgctgcatgtacagcggtttccttgacatctataattcatggcaggaatctcagtgatgcgtgcgtctatcacaggtgttgatggacagtgtggcatattattgcaaacagttgtgctggatgtagctaagcacagtacagcagagattctatctctagacatcattagaagtgtcatcagattcagagttgtgacgtcggatccggaatgtgtaacacgagtcttggatttgtttggtgacgga

SEQ ID NO: 2796 - DNA, 768 bp, Manihot esculenta
atacagagaatgtatgtaaaagcggttccaccgacggatttgaataggaacaccgagtggttcacgtacccaggtgtatggactacctatatcctcatggttttaatgtcttggcttatcgttctttccctctttggttgctctcatggcatggcctggaccattgtccacctcgctcatttccttattacctatcatttctttcactggaagaaaggaactccatttgctgatgaccagggcatctacaatgggttgacttggtgggagcagatagaaaatggcaagcaactgactcgcaataggaagtttttgactgttgcacctgtagtgttgtacttgatagcttcacacacaacagattatcaaaatccaatgttgttcttcaacacattggcagtattcgtattggtggtagctaagttccctcacatgcacaaggttcgaatattcggaatcaatgctgatcagtgaaatacaaaaatcttcatgtttgatctagtcgcgactagattcaactctttggcattctgatgcaacgacattatccctgtacagatactgaactgtgaagggttatcacttatcactatttgttcattatgaagcaaatatatatacgccctcaattacatgcggatggtcaatataatttctctttcacctcctgcttctgctgctccttcttctcttcccttgaacgcttttctgtgttgtatatctatttcttgtttcgaggcaatataatctattttactgctatttctt

SEQ ID NO: 2797 - DNA, 1248 bp, Gossypium hirsutum
caattctgtagcgacagcttcgcaacaacggaattggtaaaaccccaatacactaccaacgaggatatttcaccattagcaatccttgagtcacccatccgtttgtttgaggaagaaagagaagaaagagaaagcccagaagagaaataaccaaattaaaagatgtacgtgagagctgtgccacccacagatctgaacaagaacactgagtggttcacctatccaggggtttggaccgcttatatcttgatcgttttcttttcgtggctcatggttttatctgtatttggtacctctccgggaatcgcttggaccattgttcatctcacccatttctttgttacatatcacttctttcactggaaaaagggaacaccatttgctgatgaccaaggtatttacaatggtttgacttggtgggagcaaatagataacggcaagcaactcactccaaacaggaagtttttgactgttgtacccgttgtgctgtatcttattgcctcacacacaacaggttatcagaacccgctgctcttcttcaacacactagctgtttttgtgctggtggtcgcaaagttccctaacatgcacaaggtccgcatatttggaatcaatgctgatcactgaaatgcaaaggaatccaacacacttttctctggtactaggtttttattatttgtcactccaaagaagaatcattatagcactgtacagataatgaaactgaaaaggggatttatatttcacttcaatgaagtgatcgaatacttttacctccctcctatcctttatggcagggaaaagtacagtcatatagagtaatatctgtccttgtaagccattgagatcttgtcctgttatcagcttcagccaaaaatcacttctattgccctcgaactagtcgatatctagagatcaatgcactttcttttgcctttaggacgacccacatttacatgacgtgagttctggattgaatcatcagtatccagggttctctaatttttcctaccatgagcaaacccaagtacttgtactagtgcttgtgcacatggactatgtccttgatcaagatgacgttggacaagttctcaattgtgccctattatttttccttgcgcatctaaaaccgtacactttgacaattgtgttactcgccgatgagtattgtatgattgcaaaatcttatacagtggtttgaactttgaagtattctatcagatcatttatttattcatattccaaaaa

SEQ ID NO: 2798 - DNA, 817 bp, Curcuma longa
ttgatccttgtcctcgtctcctttccgtcgatcgctcgcgattactattcaaccgccgtgcctctaattggattcgataactagaggaggggaagtgcgaaaccgcgatggcgatgctctacgtgcagacggtgcagccgacggatctgaataagaacacggagtggttcatgtaccctggagtctggaccatctacatactcatcctcttcttctactggctcctagtgctctccgtcttcggctgctcgcccggcatggcctggaccgtcgtcaacctctcccactttgcggttacgtattacttcttccattgggaaaaggggactccattcgccgatgaccagggtatctacaataatttgacatggtgggagcaaatagataatgggaagcaactcacacgtaacaggaaatttatgattgttgtacctgttgtcctatacttgattgcctcgcatactactaattaccatcatccaatgcttttcttgaacacgctcgcggtggcaattttggtgattgccaagttccccaacatgcataaggtccgaatcttcggaatcaatggatgaaaggtttattgcgcagaaggtatcttggtctataattttcattcgcagtagtttatacaagtctttttgggtaatccttttaactctgcgacgatacatagagccttaaaaaagatgggcttgtgttcatgtatagaacatctgaagattgtagccgtggatgttttgctgcttttgtattttattttatctcaaacttaatttctttgattgttaatataaatattatttgctcctctggt

SEQ ID NO: 2799 - DNA, 821 bp, Euphorbia peplus
tttttcatccaccattacagtctgagaagcgaaaacagagataccaaaatatcatcaaacccccgatctttgactcagtcacacatctccgatcttctccttctttcccccaaattttgggcccaatcttacaattcttcttcggaacgtttcaatcctcatcgtcagcgccaatttactaatctaatcaggagagaagacgagataatgtatgtaaaagctgtgccgccgacggatttgaatcggaacaccgaatggttcacgtatcctggggtttggactacgtatatgcttatggttttcatctcttggttaattgtgctttctctctttggttgctctcctggcatggcttggaccattgttcatctcgctcattttgttattacctaccacttctttcactggaagaagggaactccttttggggatgatcagggtatctacaatgggttgacttggtgggagcaaattgaaaatggcaagcaactcactcgcaacagaaagtttttgactgttgtacctgtagtgctgtatctaatagcctcacacacaacagattatcaaaatccaatgctcttcttcaacacattagcagtattcgtgctagtggtagctaagttccccaatatgcacaaggttcgcatcttcggtatcaatggtgaacactaaacttcccggaaaaagaaaaaaaaaaacagtatcatgtttgatttactcttcttggttcaaccttttgccagtctaatacgctaaatattattactattatccattcctgtacagatactcagactgtcaagggtttaacaactcttctt

SEQ ID NO: 2800 - DNA, 682 bp, Gerbera hybrid cultivar
ttacgaagaatcttcatcgtcaacgaacaaacatcgatcaccctccagacggagatcagataatcggtaatcaccacacaaagacacacatacgacggagcctccgcaccaaacaacgattcgacagtccccaatcactcacttcgccacagatggcgaacttgtatgtgcaagcgatgccgccgacggatctgaataggaatacggagtggttcacgtatcccggcgtatggaccatctacatattcatcctcttcttctcttggctcgtcttcctctccgtcttcggttgttcccctggcgtggcttggaccatcgtcaatctctctcacgccctgttgacatatcacttcttccactggaaaaagggaacaccttttgctgatgatcagggtatctacaataggttgacctggtgggagcaaattgatagcggcaagcagctcactcgcaacaggaagtttcttactcttgtgcctttggtgctgtatttaatagcgtctcatacgacggactaccagaacccaatgctgttgttgaacacagtggcagttttcgtgctagtcgttgccaagtttccacacatgcacaaggtccgtatttttggaatcaatgccggagaatgaaaacagatactggtttaattgcattgcaccgatagctatatgtttacttggattaa

SEQ ID NO: 2801 - DNA, 1679 bp, Gossypium raimondii
atccacgcatactcccccaaatctgtagcgaccgcttcgcaacaacggaattggtgaaaccccaattcactaccaacgagcacatctttcaccattatcaatccttaagtcacccatccgtttgtttgaggaagaaagagaaagcccagaagagaaataaccaaagtaaaagatgtacgtgagagctgtgccacccacagatctgaacaagaacactgagtggttcacctatccaggggtttggaccgcttatatcttgatcgttttcttttcgtggctcatggttttatctgtatttggtacctctccgggaatcgcttggaccattgttcatctcacccatttctttgttacatatcacttctttcactggaaaaagggaacaccatttgctgatgaccaaggtatttacaatggtttgacttggtgggagcaaatagataacggcaagcaactcactccaaacaggaagtttttgactgttgtacccgttgtgctgtatcttattgcctcacacacaacaggttatcagaacccgctgctcttcttcaacacactagctgtttttgtgctggtggtcgcaaagttccctaacatgcacaaggtccgcatatttggaatcaatgctgatcactgaaatgcaaaggaatccaccacacgtttctctggtacttggtttttattatttgtcactccaaagaagaatcattatagcactgtacagataatgaaactgaaaaggggatttatatttcacttcaatgaagtgatcgaatacttatacctccctcctatcctttatggcagggaaaaatacagtcatatagagtaatatctgtccttgtaagccattgagatcttgtcctgttatcagcttcggccaaaaatctcttctattgccctcgaactagttgatatctagagatcaatgtactttcttttgcctttaggattgacccacatttacatgacgtgagttctggattgaatcatcagtgtccagggtatctctaattttccctatcatgagcaaacccaagtacttgtgctagtacttgtgcacatggactatgtccttgatcaaagatgacgttggacaagttctcaattgtgccctattatttttccttgcacatctaaaaccgtacactttgacaattgtgttacttgccgatgagtattgtatgattgcaaaatcttatacagtggtttgaactttgaagccttctatcagatcatttatttattcatataccaaaaaaaaaaaaaaaaaaaacaaagaaaaaaacggagatcctattgtagtttcgccattttcctgacaatgttcccagaaatagcttcattgggaaaaggaaaacatttgaatctatgcgcccttattgtttaaggaaaactggttttgccagacattcttgacttgtggagatgaggctaatgtactgtgaggtatgtacagagcatattttgattcgcttaaatgaagtagttattaaatggtaatggaataccagctttattagtattaagtaacttggttgatagaatagaataagttagcattaaatctatatgcaaattagtagaacagagtagttattaaatggtagtgttgtgatagcttgttatttctgctcacaaactgttttgagttttgcttgactgtgttattggtcgag

SEQ ID NO: 2802 - DNA, 595 bp, Heritiera littoralis
ggaggtttgaataggtaaaacccaaacacatcaccaacgaagacaacatcatcgtccatctgtcaccattatcaatctttgaatcaacatccgagagtttaataataagaggaagaagggaaaacagaagtaaaagaatgtacgtgagagcttcgccaacgacagatctgaacaagaacacagagtggttcacgtatccaggagtttggaccacttatatcttgatcgttttcttttcatggctcatcgtcttatctctctttggttcctctcctggaaccgcttggaccattgttcatctctcccatttctttgtcacgtatcacttctttcactggaaaaagggaacaccatttgctgatgaccaaggtatctacaacggtttgacatggtgggagcaaatagacaatggcaagcagctcactcgcaataggaagtttttgactgttgtacctgttgtgctgtatctcatcgcctcacacacaacagattatcaaaacccgatgcttttcttcaacacgctggctgtttttgtgctcgtggttgcaaagttccctgacatgcacaaggtccgtatatttggaatcaatgccga

SEQ ID NO: 2803 - DNA, 751 bp, Tropaeolum majus
tgaagagcttgtagttgtagccatcaccacccaatcaaccgtcctgatcagaatacggtgattatcaccattcgacattgctaaatcgtgaatcgaatcgtgttgcgtgtatagaggcaaagagaaggaagtaaaggaaggatgtatgtaagggcggtgccaccgacggatgttaatcggaatacggagtggttcacctacccaggcgtatggaccatctacatcttcattctctttttcgcgtggctcatcgtcctctctgtattcggttgtgctcctggaatggcctggaccatcgtccatctctctcattttcttgttacatatcaatttttccattggaagaagggcacaccatttgctgatgatcagggaatctacaatgggctgacttggtgggagcagatagaaaatgggaagcagctcactccaaataggaagtttttaactgttgtaccagttgttctgtacttaatatcctcacacacaacagattatcaacacccgatgctctttttgacacgctggcagtttttgtactggtggttgccaagttcccgcacatgcacaaggttcgtatatttggaatcaatgctgatcattgaatgacaaaagaaaatgtgtgttgttagtgtagttactgtggttgatggtcatattattgggatataacattatgtccctgtacagatgatgaaactggaaaagatatattatttttcttacataaatgaacacgtaataccttcca

SEQ ID NO: 2804 - DNA, 722 bp, Elaeis guineensis
agacggtgccgccggtggatctgaacaagaacacggagtggttcatgtaccccggggtctggaccacctacatccttatcctcttcttctcctggctcctcgtgctctctatcttcggttgcacccccgggatggcatggactgtcgtcaacctcttccatttcgccgttacctatcactttttccattggaagaagggaactccctttgctgaagatcagggtatttacaataatttgacttggtgggagcagatggacaatggcaagcaactgacacggaataggaagtttttgaccattgtacctgttgtcctgtacttgatatcttcccacacaactgattaccaaaatccaatgctttcactcaatacgcttgcagtgatagtgctggtagttgccaagttaccaaacatgcacagagtccgtatcttgggaattaatgcagatcgttgagcaacattgcacatgaaagatatcttaatcgatatctctttttgttggaaagatgatccttataccgtatgctgtcagatggtgtccaattccgcatcaagtcatattaagtctttagtggatgttcctgttatccctgtatagaactgtcaggaagttatagttgtgtttgtgctacttttgatacatttaagctatttatagaccgtatgttatgtttttcatctatcagtgcacaagaataagtgaactcggttcctcttcttt

SEQ ID NO: 2805 - DNA, 1026 bp, Allium cepa
cgtgaaaataccataaaataatacccattattctcttccccaaattatcataaatcaatcaaattgaacttttgcaattatataacttctctcgtcagaaaacaattcgcaatctctagatccttccgcaatggcgaaactatacgtggagacgatgccgccggcagatatgaacaagaacacagagtggttcatgtatccaggcgtatggaccacctatattctcattcttttcctttcatggctcatcgtgctatctgtatttagatgcacccccggcatggcatggaccgttgtcaatctgactcatttcgctataacctaccatttctttcattggaagaaaggaactccatttgctgaagatcagggcatatatcgtgcactgacctggtgggaacaaatggacagtggcaagcagcttacacgtaatagaaagtttctgacggttgttcctattgtcctgtatttgatagcttcacacaccaccgactaccaaaacccgatgcttttccttaacacgcttgcagtattcatcctcgtgatcgccaaactccctaacatgcacaaagttcgcatccttggaataaatgctgaccattaagaaatcatatttgcatgaaagcatgaatcctccatccatatctttggtttatatctcttgatccctctccctatatatataaatgttctacaacagcagcattaatgggatgtgattaatagataaatgcttggtaatccttgtacagacactgtttgaagtaactagagttcttatcttccttatgagtggacagtatgtatgttactcctgttttgttgtgtatttgtttactgctgatctgtagtttctgtaattggaaaaataattgtaagcgagtgattatgtttagctaccatgtgatatgggtaatttggtgttgaaacttggaaatatcatgcaatactacacgttataatgatactgtgaatgtcatattgatatggtatgagcttgtaagtgcatgctgttgactataaggt

SEQ ID NO: 2806 - DNA, 1014 bp, Carica papaya
gaagagaaaaagaggagtctagtttatacgtacgtacaatctaatccaataaaatcatcgttatcgttttcattgtcatagcaattataataatgaaaacacaagattatcatgaattctctgctatgatattctgatcatcgtcccgcgaaaatcgatttgtgtagcaggcaaagagaagaggagaaacgaattggaagggaaagaggaaagaaaagaagatgtacgttcaggcggtaccaacgacggatgtgaacaggaacacggagtggttcacgtatccaggcgtgtggaccacctacatcctcattctcttcttctcgtggcttattgtcctttgcatctttggttgctcccctggcatggcctggaccatcgttcacctctcccattttattgttacctatcagtgttttcattggaagaaggggacaccttttgctgatgatcaaggcatctacaatgggttgacttggtgggagcagattgacaatggcaagcagctgactcgtaacagaaagtttctgactgttgtaccagttgttctgtacttgatcgcatcacacacaacagactatgagaacccaatgctctttttgaacactttggcagtttttatactggtggttgcgaagttcccacacatgcacaaggtccgaatatttggaatcaatgctgatcactaaactgccaaggaagctgagtttggcttaatctagttcctagggttgattgataattttggcatttgttatgcccctgtacagaataattaaactggaaagggtgttattatatattttctttcttttattaagtgaatacaaatacctccctttgttgcatagagggaaaaatgtgcattttgttttcaatttccattggttatcaacgttgctggcttttgtttattaatatctttttcaatgagaaggtagaagaaccttttgtaagtgcttgtgatatttaaccatttgtaagtggcatttaaccaatttgatgggtttgggctcg

SEQ ID NO: 2807 - DNA, 851 bp, Papaver somniferum
tatcaagatacaagacccaacaccactttctctctctccctacctctgcaactacattttattggtgaatcaaactttgtgttgaaagaagaaacgaataatggcgaaattgtatgtacaagcagtacatccaccagatctgaataaaaatacagagtggtttttatatccaggtgtatggacaacttacatcttaatccttttcttctcatggcttatggttttatctctttttggttgtaaccctggtacggcttggactatcgttaatctctctcatttcgttatcacgtatcacttctttcactggatgaaaggaactccattctctgaagaccagggcatctataatggattgacttggtgggaacagatcgataacggaaagcagcttactcgcaacagaaagtttttgaccgttgtgcctgtggtattgtacctaattgcctcgcacacaactgactaccaacaaccaatactctttctcaacacgcttgctgtctttgttttggtggttgccaagtttccaaatatgcacaaggttcgtatctttggaatcaatggagaaaagtaagtacgcgtagacactttggtttcacttgtgtaaaagccctttgatctttcttttttgttaatggactatatccgtcacttgtacagaaccgcaaaaatggtacttactactttagtgcttttgaatgagttcacttctccatctattcctagtattaaaaactatttttgttataataaccagtattggcgactaaacatattccatcagttcatctctcttttgtaatgttcagatcctttccttatgtaaggagtttgactactttaaaaaaaaa

SEQ ID NO: 2808 - DNA, 564 bp, Papaver somniferum
ttttattggtgaatcaaactttgtgttgaaagaagaaacgaataatggcgaaattgtatgtacaagcagtacatccaccagatctgaataaaaatacagagtggtttctatatccaggtgtatggacaacttacatcttaatcctcttcttctcatggcttatggttttatctctttttggttgtaatcctggtacggcttggactatcgtaaatctctctcattttgttatcacgtatcacttctttcactggatgaaaggaactccattctctgaagaccagggcatctataatggattgacttggtgggaacagatcgataatggaaagcagcttactcgcaacagaaagtttttgaccgttgtgcctgttgtattgtaccttattgcctcgcacacaaccgactaccaacaaccaatactctttctcaacacgcttgctgtctttgttttggtggttgccaagtttccaaacatgcacaaggtccgtatttttggaatcaatggagaaaagtaagtacgcgtagacactttggtttcacttgtgtaaaagccctttgatc

SEQ ID NO: 2809 - DNA, 1201 bp, Prunus mume
tcattcgctccgattttataattttataatttcctaataaaaaaataaaaaacacgccaacccaaaatctccgaatctcaatctctcctgcaaggcaacttcgcgaaaataaaaaatcgggttgtttctgagattctctttggtgatgatgagcttctcctcctcctcattgtcgctcccatcatcatcgtcgttgatcttaatcttcatctcatagtctctgatcaatttcgtttcatccaaaaaaaaaatattcgaaaaaataaaaaaaaagaattcggaaaatgtatgtgacggcggttcgaacgacggatctgaatcggaacacagaatggttcacctaccctggggtttggacgacctacattctcacggtcttcttctcgtggctcgtcgtcctctgcctcttctcttgctcgcctggcatggcctggaccatcgttcacctctgccatttcctcgttacttatcacttttttcactggaagaagggaacgccatttgcagatgatcagggtatctacaatgcgcttacttggtgggagcagatagacaatggcaaccaactcactcgaaacagaaaatttctgactgtcgtgcctgttgtgctgtacttgatagcctctcacacaacagactatcaaaatccaaatctcatctttaacaccctagcagtttttgtgttggtagttgcaaagttcccaaacatgcacaaggttcgtatatttggtatcaatgctgatcactgatctctaaaagatcaagtttgactatagttttcttgatctttatcatattggccttcgaacataacgctaaaatccctgttgaaatgttgaaaatggaaacaatgtattatttttttgaatgaagtgaaatttttaccccctcctcctctctgttacataccagatgactggcaaaacgtctgcatttgattttctctttgtaagagctatttttgctggatttcagtgctcattcctcgttatttatttccagatggaagaatttcctttttatttccgcatgatttagattctcgcaaaattttatggtgtatttttactgtggtcattatgaagatggaaactcgacctgtctccatcttggttctgttctccgcaactccgtatggtgctattgggttgacccactcaattggtttgggccaaaatgggattattgaattgaaatttcc

SEQ ID NO: 2810 - DNA, 790 bp, Prunus persica
tccgaatctcaatctgtcctgcaaggcaacttcgcgaaaatcacaaatcgggttgtttctgatattctcttcggtgatgatgagcttctcctcctcctcattatcactcccatcatcatcgtcgttaatcttaatcttcatctcatagtctctgatcaattttgtttcatccaaaaaaaaaatattcgaaaaaaaaaaaagaaatcggaaaatgtatgtgacggcggttcgaacgacggatctgaatcggaacacagaatggttcacgtaccctggggtttggaccacctacattctcacggtcttcttctcgtggctcgtcgtcctctgcctcttctcttgctcgcctggcatggcctggaccatcgttcacctctgccatttcctcgttacttatcacttttttcactggaagaagggaacgccatttgcagatgatcagggcatctacaatgcgcttacttggtgggagcagatagacaatggcaaccaactcactcgaaacagaaaatttctgactgtcgtgcctgttgtgctgtacttgatagcctctcacacaacagactatcaaaatccaaatctcatctttaacaccctagcagtttttgtgttggtagttgcaaagttcccaaacatgcacaaggttcgtatatttggtatcaatgctgatcactgatctgtaaaagatcaagtttgactatagttttcttggtctttatcatattggccttcgaacgtaacgctaaaatccctgttgaaatgttgaaaatggaaacaatgtattattttt

SEQ ID NO: 2811 - DNA, 974 bp, Euphorbia esula
cgttgctgtcgaccccatcgacttcaaaaaacccaaaaaatcccatctttttcatccaccattacagtctgagaagcgaaaacagagataccaaaatatcatcaaacccccgatctttgactcagtcacacatctccgatcttctccttctttcccccaaattttgggcccaatcttacaattcttcttcggaacgtttcaatcctcatcgtcagcgccaatttactaatctaatcaggagagaagacgagataatgtatgtaaaagctgtgccgccgacggatttgaatcggaacaccgaatggttcacgtatcctggggtttggactacgtatatgcttatggttttcatctcttggttaattgtgctttctctctttggttgctctcctggcatggcttggaccattgttcatctcgctcattttgttattacctaccacttctttcactggaagaagggaactccttttggggatgatcagggtatctacaatgggttgacttggtgggagcaaattgaaaatggcaagcaactcactcgcaacagaaagtttttgactgttgtacctgtagtgctgtatctaatagcctcacacacaacagattatcaaaatccaatgctcttcttcaacacattagcagtattcgtgctagtggtagctaagttccccaatatgcacaaggttcgcatcttcggtatcaatggtgaacactaaacttcccggaaaaagcaaaaaaaaaacagtatcatgtttgatttcctcttcttggttcaaccttttgccagtctcatacgctaaatattattactattatccatccctgtacagacactcagactgtcaagggtttaacaactcttcttcttcttcttcttttccttgttttgatcttaagcaaatatgtatacatcccttagattacttgctggggaaaatatatatattctatatttttttcttacaaaaaaa

SEQ ID NO: 2812 - DNA, 1037 bp, Saccharum officinarum
ctttttcgcccccatctttgaaccttcctcctccaccgctctgaccagggcggcacggccgaggcgcccatcatccttataaatcggccccgaggcgggtcgtctccctcccagactgcagcagcacgcagctgacgggggagtcgaggccgagaagtagagagggaggcagggtgattcgatggcgaagctgtacgtgcaggcggtgccgcccccggatctgaacaggaacacggagtggttcatgtaccccggggtctggaccacctacatcctcatcctcttcttctgctggatcctcgtcctctccgtcttcgggtgcgccccaggcacggcgtggacgctcgtcaacctcggccacttcgcgatcacctatcattttttccactggaagaaggggactccatttgctgatgaccaggggatgtataacacattgacatggtgggaacagatggacaatggcaaacagcttacacgcaaccggaagtttctgactgcagttcctgtcgttctgtacctcatagcttcccacaccacagactatcaacgtcctatgctcttcctcaacaccatagcagtcaccgtgctggttgtcgccaaactaccaaacatgcacaaggttcggatttttgggatcaatgctggaagctgagcagcaggctcccatggtacacaggtatacacggtatgtttcatttggatcacgggatgtgttgcacctagctttaaactgctgtgccagagtaccagtgagtagtgtttgagatctgtttgtagatgaaatgtaatcattgtacagatgacatgtttagattcgttatgttgctatatgttggcaagcaagaatttggtccaaaataaaaaatacgggcggccgctctcaaaggatccaacttaatgtacgcgtgccttcgaagttctagcccctctaaatggcccctaaatcccactccctgggccggccattaaaaacgttgctaatggagaaaaccctcggggttacccaactccaatgccttagaaccccacacccc

SEQ ID NO: 2813 - DNA, 748 bp, Eutrema parvulum
ctccgatctccgatctccggtccaataggatgtacgttcgagcgcttccgacgacggatgtgaatcggaacacggaatggttcacgtatcctggtgtttggaccacttatatactcatcctcttcttctcgtggctcctcgttctctccgtcttccactgctcccctggcatcgcctggaccatcgtccacctcgcccatttcaccgtcacctatcattccttccactggaagaagggaacaccgtttggggatgatcagggaatctacaataggttgacttggtgggaacagattgacaacggcaagcagctcacgcgcaatcgaaagtttctcaccgttgttcccgttgtcttgtacttgatagcctctcacacaacagactatcagcatccgatgctcttcctcaacacactggccgtatttgtaatggtggtcgcgaaattcccgcacatgcacaaggtccgcatatttggaatcaatggagaccagtgaagctttgacaaagacaaagaaaaggtatgtgtataatgcgagagaagtagatttggaagctggaacccaattacaaaaagtgccatagtcattgaatcccaaccgcaaggcaatgtgttagatggtcctctcattccatcgcatatacaaagcttttatactgtttctttggggcttctaatcaaaatttctttttgtggtctctcagtttcttattttgtttagcgagcaaatctaggatttgaatgaatagt

SEQ ID NO: 2814 - DNA, 889 bp, Zostera marina
ccacttgcgatctacaaaaccctctcccattcaatccgtttctcaatttctaccaacaagcgaaatccatactctgccagatcgtcctctgtcgttttctgttacagacatacgggaaatttcgcgctgtgttgaaaatggcaaagctgtatgtgcagaccacgcagccaacagatctgaacaagaatacggagtggttcatgtatcccggcgtatggacaacttacatcctcatcctatttttctcctggcttcttgttctctccgttttcggttgcacgcccggcatggcatggactatcatcaacctctcccactttatcataacgtaccagtttttccattggaagaagggcaccccttttgctgaagatcagggcatctacaatgctttgacgtggtgggaacagatggacaatggcaaacagttgaccaaaaacaggaagttcttgactgttgttcctgttgtactgtacttaatagcttctcacacaactgactatcaacaacctatgcttctccttaacacccttgctgttattgtgctggttgtggcaaagtttccaaatatgcataaggttcgaatttttggaatcaatggttgaacgcaatgaaaccagataaaacatgccaagagaattctatagcaagctcaataccacctcagttgacagctatatgtgtgatgaatggaattttatacagaaaactagacttgtaacaactgatagggatgcatgctgtgaaaaaatagaatccgacaactggttataatattttttaattgttttcttctaaagattgtatgatacctatctatgtatgatgtatagaaccactgatttcatctttttcatagtgctgtcaattattatttcattaattacca

SEQ ID NO: 2815 - DNA, 738 bp, Panax ginseng
tggtatcaacgcagagtacatgggggagggggagggggatggcgaattattattacgtgaacgcgacgccgccgacggatctgaacaagaacacggagtggttcacttatccaggggtttggagcatctatatcttcatcctattcttcgcctggatcgtggttctctccctcttcaattgctctcctggaatggcttggaccatccttcatctctcccacttcctggtaacatatcacttcttccactggaagaaaggaactccgttttctgatgaccaggggatctataatgggttgacgtggtgggagcagatcgataatggaaagcaactcacccttaacagaaagtttttaacagttatacctgtggtgctgttcttgatagcttcgcatacaacagattaccaaaacccagttttgttcttgaatactcttgccgtcattgtacttgttatcgccaagttcccaaatatgcacaaggtccgtatcttcgggattaatggagatcagtgagatgatttatggatttgtaattgtgcaaaaaaagttgtattactgtatagtaatcccaatggaaaaggattttggatatgtaatgcttttatgttttctttggttttcttttgacaagctctctcacgaatattgaaggaataaaggttctgagttaatcgtttcacaacagaatttttatgcaaccgggtttctttagaatctaatgttaaaacaatgtcaa

SEQ ID NO: 2816 - DNA, 574 bp, Brassica oleracea
gagagatctgattgatctgtgtggtgtgggttggaatgatgtacgtgagagcgttgccgacgacggacgtgaaccggaacacggagtggttcacgtatccaggggtgtggacgacttacatcctcatcctcttcttctcatggctcctcgttctatccatcttcaattgctcccctggcatggcctggaccatcgtccacctcgcccatttcgccgcgacgtatcatttgtttcactggaagaagggaacgccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcagaatcccatgctgtttctgaacacgcttgctgtatttataatggtggttgcaaagttcccgcacatgcacaaggttcgcatctttggaatcaatgcagaccagtgaaaagcaccaaatgagatatgttgtggtaaatcaatctgatcatgaggccttgaaatggaaatacatatgcc

SEQ ID NO: 2817 - DNA, 665 bp, Brassica oleracea
atcatctcctacggtgaaaaaggatgtacgtgagggcgcttccgacaacagatgtgaaccggaacacggagtggttcacgtatcctggcgtttggaccacttacataataatcctcttcttctcgtggctcctcgttctctccgtcttccactgctcccctggcatggcctggaccatcgtccacctcgcccatttcaccgtgacgtatcattcgttccactggaagaagggaacaccgtttggggatgatcaagggatctacaacaggttgacttggtgggaacagattgacaacggcaagcagctcactcgcaaccgcaagttcctcaccgttgttcccatcgtcttgtacttgattgcttctcacacaacagactatcaacatccgatgctcttcctcaacacattggccgtctttgtaatggtggttgcgaaattcccgcacatgcacaaggtccgcatatttggaatcaatggagaccaatgaaggaagccttaacaagactaagccaaaaaagggtatgtgtataatgccagacaagtagattttggaagcttggaatacaattacaaaagaaaaatgccattgtcactcacatttgattccgcatgtgttactctcatcccatggcatctatactgtttctttggggctgcttctaat

SEQ ID NO: 2818 - DNA, 1714 bp, Amborella trichopoda
ctcgtaaactctccgccattaatctctctctttctataagtaagcgaaaagggaaagggtgggaattaggagaagaaggtaaaaggatcgccattaatggtggatgggttcagcttttcgggtatggggaacctgtatgtgcaggccgtgccccctccggatctcaataagaacacggagtggtttatgtaccctggtgtgtggaccatctacattctcatactcttcttcgcatggctcatagtcctttccgtctttgggtgctctgcaggcatggcctggaccatcgtcaatctctcccattttgctgttacataccgctgtttccactggcagaagggaactccttttgcagaagatcagggtatttataatgctttgacttggtgggagcagatggacaatgggaagcagcttactcggaataggaaatttctgatggtggttccggtggtgttgtacttgattgcttctcatacgacagattaccggaacccttggcttcttctcaacacaattgctgtctttgtgctggtcattgcaaaatttcctaacatgcataaagttcgcatatttggtatcaacgcagagtgagcaaaggctctctggtcatttcctttgaaatatgttgattccctgtacaggaaaagtggtatctgagaattgcctttttttcagtggggaaatgggctttggttccattgggagtgggggttgaatctgtgtttttgaaatgatttttgtaagaaatagtgcttgcttgtgcagggttggcaatctgttctgcctcataagaggacatgtacaagtattgatgttctctttcctccaggttactagacacataagaattgcgaagtaaagaaccgttatcttctgtctcgtggagttttgtagtttaattttctcttcttggcttattttgcatttatcaaaatattgagctcacctgggtttaggcaaatgcctgctatgatcttctgattacttgttagaatcagtgttgtcaattcgctttgcatcggctaaagaggcaagcctttggattttaggcttagatcgaagcgaaggttagtgctgccgcttaggtcagatttgggtgccacttcaagatgtttcggtcagattcgtgtatgcttgggggcgattcggccgaagcaaagaaatatctatataaaagtaaatttttttttttttgaaattttaaatatttatcattatttttaattattgcattcaatttttttaaaaaagtccgaggtctttgcctgaattggttgaagcatcaaattgcttcattttttttaccaaactgaaaaagacaacattgttagaatcctaaagcacccatttatgttattgtaattgttttaattaattaatttattttttaattttctattcattgacttagatcatcatggggcttgttaattataaccagattctgtattggtgaaacttgcagccctccatgtatttcctgaaaaaacatagaacccattggtaatcgtaccaattacacaaattaataaagctttcaagaggtgaggagcaactggtgtttcaaaccaaatgaatgaacaaggaatggtacttggttttggttgatggtttggttttcttcattccaagatcaagatttagcaggaccaacctggttcctaatcggactcgggaactggtctgattttgatacttagttactcaccta

SEQ ID NO: 2819 - DNA, 798 bp, Ambrosia trifida
ccaattgcaacgttatcattccgtcatattataaaagaaaaataccactgatcataattaaccccaattcatgcactaacaatctgggcgaagaagctaataacaacaataataatcagaaaagatgatgtacgtgaaggcgacacagacaacagatcttaatcgaaacaccgattggttcacgtacccaggtgtatggatcgcatacatcttcatcatcttcttttcttggcttcttatcctctctctttctggttgctctcctggcatggcctggaccatccttcatttctctcactttttggtgacttatcatttcttccattggatgaaagggactccatttgctgaagatcaggggatatataacaggctgacgtggtgggagcagatagacaatggcaagcagctcacccgaaaccgaaagtttttaaccgttgtacctgtagtgctgtacttgatagcctcacacactacggactatcagcacccgatgttattcctcaacactgttgctgtgaccgtgcttgttatcgcaaagtttcctaatatgcataaagttcgaatctttggaattaacggcgatatgtgacagttgattacttgattacggttggtaagtttggatctttatattgaaactgggtggtatcaatgtatagtatgtcaatgttgtgatgtggaggttatcttgttatttaccatttttgtttgtgtaacttggtgattgacaagtaaccatgcgtattacaaataacgcttactgtatattgggcatttacaattacatcagcctta

SEQ ID NO: 2820 - DNA, 735 bp, Ambrosia trifida
tgatcataattaaccccaattacgtgcactaacaatctgggcgaagaagactaacaacaataataatacagaaaagatgatgtacgtgaaggcgacacagacaacagatcttaatcgaaacaccgattggttcacgtacccaggtgtatggatcgcatacatcttcatcatcttcttttcttggcttcttatcctctctctttctggttgctctcctggcatggcctggaccatccttcatttctcacactttttggtgacttatcatttcttccattggatgaaagggactccatttgctgaagatcaggggatatataaccggctgacgtggtgggaacagatagacaatggcaagcagctcacccgaaaccgaaagttcttaaccgttgtacctgtagtgctatacttgatagcctcacacactaccgactatcagcatccgatgttattcctcaacactgttgctgtgaccgtgcttgttatcgcaaagtttcctaatatgcataaagttcgaatctttggaatcaacggcgatatgtgacagttgattacttgattacggttggtaagtttggatctttttattgaaactgggtggtatcaatgtatagtatgtcaatgttgggatgaagaggttatcttgttatttaccatttttggttgtgtaacttggtgattgacaagtaaccgctgcgtattacaaataagcttactgtatattgggcatttaca

SEQ ID NO: 2821 - DNA, 905 bp, Arabidopsis thaliana
agcagagaaaaaaaaaacaaagaagaaagaaaacttgctcaacgacgattcatcaatcatcatctccgatcttcttccaaatccctccggtgaaaaagacgatgtacgtaagagcacttccgacgacggatgtgaatcggaacacagagtggttcacatatcctggtgtttggactacttatattctcatcctcttcttctcttggctcctcgttctctccgtcttccattgttctcctggcatcgcttggaccattgttcatctcgctcatttcaccgtcacgtatcattccttccattggaagaagggaacaccatttggagatgatcaaggagtctataatagattgacttggtgggaacagattgataatggcaagcagcttacacgtaatcgcaaatttctcaccgttgttcctgttgtcttgtacttgatagcctctcacacaacagactatcagcacccgatgctctttctcaacacactggctgtatttgtcatggtggttgcgaaattcccgcacatgcacaaggtccgcatatttggaatcaatggagaccaatgaaaaaacttgagaaaacaaagaaaaaggtctgtgtataatgcgaatcagagtatttggaatgtggaatccaacaacaaatgccatcatcatcattcaacatgtctgtactatacagacattgaatcccttaaccggagaaaatgtgttatttggtcacatcccatcatcgcatattcaaacctttctactctttgtttggggcttctaatcaattcatatttgatctcttttgtggttctcttagtttcttatttgtataatcccaaaactggttacaacagaaagttgtttagcgagcaatctagggtttgaatgaatagttggggaagatttatttat

SEQ ID NO: 2822 - DNA, 912 bp, Brassica rapa
gtttccttcttcctcctccttccttctctgaatagagagagagagatcagagaacgaagggggaaaaattgattaaaaaaaaaccagaagaaaaggatcgtaaaaatcggagagagagagagagagagatctgattgatctgtgtgtgtgggggttggaatgatgtacgtgagagcgttgccgacgacggacgtgaaccggaacacggagtggttcacgtatccaggggtgtggacgacttacatcctcatcctcttcttctcatggctcctcgttctatccatcttcaattgctcccctggcatggcctggaccatcgtccacctcgcccatttcgccgcaacgtatcatttgtttcactggaagaagggaacgccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcagaatcccatgctgtttctgaacacgcttgctgtatttataatggtggttgcaaagttcccgcacatgcacaaggttcgcatctttggaatcaatgcagaccagtgaaaagcaccaaatgagatatgttgtggtaaatcaatatctgatcatgaggccttgaaatggaaatacatatgccacttttgtcttcttcttcttctctttagatttttttttcttttacttatttatgtaaaaaccaaataagtcattcaagagtgggtttgtaagtctgaacccgtggtttagtgattttttttcaaaaatcatatactaatactaatatacatgatatacagtcgacatagtcattttcgactttaaaattgcttatatgcatttcatctgaat

SEQ ID NO: 2823 - DNA, 798 bp, Brassica napus
gaaaactaaaccgaagatctggaaagagagagagagttgtgagtttccaaataagcttcctccttttgatcggagaatcaatcaatcaatcgtcgtctcgaaatatcttcttagatttggatccagagggggaaaaagaaaaaggagatggcgaaactgtatgtgaaagcggtggcgccgccggatatgaacaggaacacggagtggttcatgtatccaggggtgtggacgacttatatactgattatcttcttcgggtggctcgctgttctctccgtctctggctgttcccctgggatggcttggaccgttgttaatctctctcacttccttgtaacatatcacagcttccactggatgaaaggaacgccttttggggaagaccaaggcatctacaatgctctcacctggtgggaacagatggacaacggtcagcaacttaccagcaaccgcaagttcctcaccgtcgttcccattgtcctgtacttgatagcatcgcatacaacagattacagacatccatggctgttgctcaacacactcgctctcatggttcttgttgtcgccaagttccctaacatgcacaaggttcgcatcttcggcatcaatgctgacatgtaagtcagcttcttcttctcagcagatccatctctgttacggtcagagaacaggaaggaagaagaaaaaaggggatataaccaaaacatatgtatgcgtttaaatgttcatatgaattggtttatttatttattcgagagttatatgcttgctggatattttgtaaagtaactaattttg

SEQ ID NO: 2824 - DNA, 741 bp, Brassica napus
aaaaaaccaagaagaaaaggatcgtaaaaatcggagagagagagagagagatctgattgatctgtgtgtgagggggttggaatgatgtacgtgagagcgttgccgacgacggacgtgaaccggaacacggagtggttcacgtatccaggggtgtggacgacttacatcctcatcctcttcttctcatggctcctcgttctatccatcttcaattgctcccctggcatggcctggaccatcgtccacctcgcccatttcgccgcgacgtatcatttgtttcactggaagaagggaacgccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcagaatcccatgctgtttctgaacacgcttgctgtatttataatggtggttgcaaagttcccgcacatgcacaaggttcgcatctttggaatcaatgcagaccagtgaaaagcaccaaatgagatatgttgtggtaaatcaatatctgatcatgaggccttgaaatggaaatacatatgccacttttgtcttcttcttcttctccttagatttttttcgtttacttatttatgtaaaaaccaaataagtcattcaaaagtgggtttgtaagtctgaacccgtggtttagtgatttttttt

SEQ ID NO: 2825 - DNA, 795 bp, Brassica napus
agagagagagagagaggagaggagccatttgggttattccaatcctcatcatctcctacggtgaaaaaggatgtacgtgagggcgcttccgacaacagatgtgaaccggaacacggagtggttcacgtatcctggcgtttggaccacttacataataatcctcttcttctcgtggcttctcgttctctccgtcttccactgctcccctggcatggcctggaccatcgtccacctcgcccatttcaccgtgacgtatcattcgttccactggaagaagggaacaccgtttggggatgatcaagggatctacaacaggctgacttggtgggaacagattgacaacggcaagcagctcactcgcaaccgcaagttcctcaccgttgttcccatcgtcttgtacttgattgcttctcacacaacagactatcaacatccaatgctgttcctcaacacattggccgtctttgtaatggtggttgcgaaattcccgcacatgcacaaggtccgcatatttggaatcaatggagaccagtgaaggaagccttaacaagactaagcctaaaaagggtatgtgtataatgccagacaagtagattttggaagctggaatacaattacaaaagaaaaatgccattgtcactcgcatttgattggttcccaaccgcatgtgttactctcattccatggcatctatactgtttctttggggctgcttctaatcaaatttcttctttattttggtttctctgtttcttattcggtttagcgaggaaatgtaggatttggatgattagt

SEQ ID NO: 2826 - DNA, 685 bp, Ricinus communis
tgactcagtcacaatcttgaatctctttcttcccttggtttcttcatctgggtagtcgtaattctctttaaaaagctcatctttttatcatattattgttaatcttatcgatagagagaaagagaatgtatgtcaaagctgtgccgacgacagatgtgaacaggaatacggaatggttcacgtatccaggggtttggacaacctatattctcatggtttttatttcttggcttattgttctttctctctttggttgctctcctggcatggcctggaccatcgttcacctctctcattttgttattacttatcagttctttcactggaagaagggaaccccatttgctgatgaccaaggtatctacaatggtttgacttggtgggagcaaatagaaaatggcaagcaattgacccgcaataggaagtttttgactgttgtgcctgtagttctgtatttgatagcctcgcacacgacagactatcaaaatccaatgctcttcttcaacactttggcagtattcgtgctggtggtagctaagttcccacacatgcacaaggttcgcatattcgggatcaatgctggtcactgaaccacaaaatttttctcatgtttaatttactcctgtcaccagaactaactttttgttactgtaatatgcctggtattatccctgtacagatactg

SEQ ID NO: 2827 - DNA, 1244 bp, Gossypium hirsutum
cgaccgcttcgcaacaacggaattggtgaaaccccaattcactaccaacgagcacagctttcaccattatcaatccttgagtcacccatccgtttgtttgaggaagaaagagaaagcccagaagagatataaccaaagtaaaagatgtacgtgagagctgtgccacccacagatctgaacaagaacactgagtggttcacctatccaggggtttggaccgcttatatcttgatcgttttcttttcgtggctcatggttttatctgtatttggcacctctccgggaatcgcttggaccattgttcatctcacccatttctttgttacatatcacttctttcactggaaaaagggaacaccatttgctgttgaccaaggtatttacaatggtttgacttggtgggagcaaatagataacggcaagcaactcactccgaacaggaagtttttgactgttgtacctgttgtgctgtatcttattgcctcacacacaacaggttatcagaactcgctgctcttcttcaacacactagctgtttttgtgctggtggtcgcaaagttccctaacatgcacaaggtccgcatatttggaatcaatgctgatcactgaaatgcaaaggaatccaccacacgtttctctggtacttggtttttattatttgtcactccaaagaagaatcattatagcactgtacagataatgaaactgaaaaggggatttatatttcacttgaatgaagtgatcgaatacttatacctccctcctatcctttatggcagggaaaaatacagtcatatagagtaatatctgtccttgtaagccattgagatcttgtcctgttatcagcttcagccaaaaatctcttctattgccctcgaactagttgatatctagagatcaatgcactttcttttgcctttaggattgacccacatttacatgacgtgagttctggattgaatcatcagtgtccagggtatctctaattttccctatcatgagcaaacccaagtacttgtgctagtacttgtgcacatggactatgtccttgatcaaagatgacgttggacaagttctcagttgtgccctattatttttccttgcacatctaaaaccgtacactttgacaattgtgttacttgccgatgagtattgtatgattgcaaaatcttatacagtggtttgaactttgaagccttctatcagatcattattattcatataccaaaaaaaaaaaaaaactg

SEQ ID NO: 2828 - DNA, 920 bp, Gossypium hirsutum
ataaagacaatatcatcatcatcataatcatcatcctacgtctccctcgatcatcatccttggccttgaaattaagccttcctttgttcaacaacaaagaaaattcaaagttgtaacaataaacccttgaatcaacctctgcttgtttaagaaaagaaggaaaacttgtgaaacaagaagaagaagaagagaagagcaaaaaagtgaaatatgtacgtgagagcggtgccaacgacagatctgaacaagaatacggagtggttcacgtacccaggggtttggaccacttatatcttgatggttttcatttcatggctcctcgttttatctctctttggcacctctgctggaaccgcttggacaattgttcatctcgcgcatttctttgtcacatatcacttctttcactggaagaagggaacaccgtttgctgatgaccaaggtatctacaacggtttgacttggtgggagcaaatagacaatggcaagcaactgacacggaacaggaagtttttgactgttgtacctgttgtgctgtaccttatcgcctcacatacaacagattatcaaaacccgatgctcttcttcaatacgttggccgtatttgtgctggtggttgcaaagttccccaacatgcacaaggtccgtatattcggaatcaacggtgagcattgaacaactgccaaggaattcatgtctggtttttcaagtactaagtttcattattctggggtgatcccaatttccaaatataaatgtaatatccctgtacagataatgaaactgaaaagggcattctcatttctctttaatcaggttaagaaaatataccttcccttcctttaagccagggaaaaatacattcatatatactatttactttctctctttgcaagctatatatatcatcttcttgcctt

SEQ ID NO: 2829 - DNA, 826 bp, Eschscholzia californica
atactaaaattttgtcgattagaatagataaagaggatcgacgaacgataatggcgaaattgtatgtacaagcaataccaccaccagatctgaataagaacacggagtggtttatgtatcccggtgtttggactacttatatattgatccttttcttttcatggcttgtggttttatctctcttcaattgtacacctggcatggcttggactattgttaatctctctcatttcattgtcacttattacttcttccactggatgaaaggaactccattttctgaagaccaaggaatgtataatggtctgacctggtgggagcaaatcgacagcgggaagcagctaactcggaacagaaaatttttgactgtcgtaccagtggtactatacttgatggcctcacacacaactgactaccaacaacctatccttttcctcaacacacttgctgtattcgtcttggtcgttgccaagttccctaatatgcacaaggttcgtatcttcggaatcaatggtgacaagtaagttggactcgatcaagaactcggtgacaaatacgttggactcaatcaagaactcggacgtcccgttttttcttttgtttgtaaaagcctttgatatttcttcctttgttaatgacctatatcaatcctatgtacataactggaaagggtacttcaatgcttttcaatgagttggtttcccttctacgttaccttcttttgtcattttaaaagaatctctttttgttatcttgaagtatcaattataacatcgttacagttagaatggttaaaaaaaaagtaacgtagggaggcgaaggacga

SEQ ID NO: 2830 - DNA, 935 bp, Gossypium raimondii
aaaccggcaccgtcaataaagacaatatcatcatcatcataatcatcatcctacgtctccctcgatcatcatccttgaccttgaaattaagccttcctttgttcaacaacaaagaaaattcaaagttgtaacaatatacccttgaatcaacctctgcttgtttaagaaagaaggaaaacttgtgaaacaagaagaagaagaagagaagagcaaaaaagtgaaatatgtacgtgagagcggtgccaacgacagatctgaacaagaatacggagtggttcacgtacccaggggtttggaccacttatatcttgatggttttcatttcatggctcctcgttttatctctctttggcacctctgctggaaccgcttggacaattgttcatctcgcgcatttctttgtcacatatcacttctttcactggaagaagggaacaccgtttgctgatgaccaaggtatctacaacggtttgacttggtgggagcaaatagacaatggcaagcaactgacacggaacaggaagtttttgactgttgtacctgttgtgctgtaccttatcgcctcacatacaacagattatcaaaacccgatgctcttcttcaatacgttggccgtatttgtgctggtggttgcaaagttccccaacatgcacaaggtccgtatattcggaatcaacggtgagcattgaacaactgccaaggaattcatgtctggtttttcaagtactaagtttcattattctggggtgatcccaatttccaaatataattgtaatatccctgtacagataatgaaactgaaaagggcattctcatttctctttaatcaggttaagaaaatataccttcctcttcctttaagccagggaaaaatacattcatatatactatttactttctctctttgcaagctatatagataatcttcttgcctt

SEQ ID NO: 2831 - DNA, 941 bp, Raphanus sativus
atccaaccaaaccatattttatgggtttggcttgaatgagaagtagaataaaaggtaaatttttaaattatttctaaataaaattgaggaaaagcccagaaagaaagagccatttgttaatcatcaaactccggtgaaaaaaggatgtacgtgagggcgcttccgacgacagatgtgaatcggaacacggagtggttcacgtatcctggcgtatggaccacttatattctaatcctcttcttctcatggctcctcgttctctccgtcttccactgctcccctggcatcgcctggaccatcgtccacctcgcccatttcaccgtgacgtatcattcgttccactggaagaagggaacaccgtttggagatgatcaagggatctacaacaggttgacttggtgggaacagattgacaatggtaagcagctcactcgcaaccgcaagttcctcaccgttgttcccatcgtcttgtacttgatagcttctcacacaacagactatcaacatccgatgctgttcctcaacaccttggccgtatttgtaatggtcgttgctaaattcccgcacatgcacaaggtccgcatatttggaatcaatggagaccaatgatgccttgataagacaaagccaaaaaagctgttgtgcttaatgcgagacaagtagattttggaagctggaatccagttacaaaaaaaaaaaatgccattgtcactcacatttgattgcttcccaaccgcatgtgttactctcatcccatggcatatatactgtttctttggggctgcttctgatcaaatttcttttctttttttttgttggtctctcagtttcttatttggtttagcgaggaaatctaggatttgaatgattttggggaaggcagtatctttggaatgcatgcaactctttttccgatttttatagaagattattcactatca

SEQ ID NO: 2832 - DNA, 692 bp, Tragopogon dubius
taggaaacaacgattccaccaaatcttgacctaatttacgatagatggcgaatctgtatgtacaagcggcgccgccgacggatctcaacagaaatacggagtggttcacgtaccccggcgtctggatcacctacatactcatcctcttcttttcttggcttgtcgttctctccgttttcggttgctctcctggcatcgcttggactatcgtcaatctctcccacgccctgatgacataccatttctttcactggaaaaagggaacaccttttgctgatgaccagggtatctacaacagattgacctggtgggaacaaatcgatagtggcaagcagctcacacgcaacagaaagtttcttactcttgtccctcttgttctgtacttgatagcatctcacacaacagagtacaagaacccaatgctgctcttaaacaccatatcagttttcgttcttgttcttgctaagtttccacacatgcacaaggtccgaatatttggaatcaatgctgaagagtgaaggtttctacaacttttctaaaaacaggtacgcgtgtaactacacataggttggtaattttaacatcttaaaggggtatttctgtctttagaacccgatgaaatggtatattagtttatttatttttcttgttggactatctactgtggtgacgaatgaattctattttgattg

SEQ ID NO: 2833 - DNA, 758 bp, Tripterygium wilfordii
tacgtatcctcctccactctcgtccctctcacgcacgaaaccgtagcctacgatatctataaccgcaaacagcacgaaaccctacttcaatcccttcctttgtcttgctttgcgattccgattagtttctgcaacaaacgaacagcaaagcagaggggtttagggttagtttcgattggattgctaaccgtgtgacatagagcgagggaagggaaacatgtatgtgagggcggtgccaacgacggatctgaatcggaacacggagtggttcacgtacccgggtgtctggaccacatacatcttcattgtcttcatatcttggcttatcgttctatccgtctttggctgctcggctggcactgcgtggaccatcgtccacctcgcacattttttcgttacgtaccatttctttcactggaagaaaggaactccattttctgatgaccaaggtatctacaatgggttgacttggtgggagcaaatagaaaacggcaagcaactcacacgcaataggaagtttttgacagttgcgcctgttgtcttgtatttgatagcctcgcacacaacagattatcaacaccccatgctcttctttaacacactggcagtatttgtgatggtggttgccaagttcccaaacatgcacaaggtccggatatttggaataaatgctgatcactgaaccgcgaaaaggatcttctgttcagttaacaacaatctatagttgtgataatctctgtacatctcttgaaacggag

SEQ ID NO: 2834 - DNA, 8716 bp, Brassica oleracea
tccaaagaccaaaacaaagccggcgattacagaacacaccaatcccggaaacactagccggcggttaaaagattacgaccccagagccaaactataacaaagaactttaaggcaaaatacatagcctagacaaagcaaatacatctaaacagaacataaactagaaaccctagatgaaaaccaataccgatcaaaagaaaagaaaccagcttgttagccaaagcaaccgtcgctgtagcctgtcctccagatccaactaaaacttgccattggcctttgacgcgactccaacctccggcaaggccaaacgaagccttccgaacaccaacatcctcaatacagccggtaatagttgaccaaccaccactaatcacagatctgacgagatctgtgtcgatggagtccgatttcatcttctccgctcaatccatagaagtgaagctatagaccagatctgagtacatctatagaagaagaagaccttaaaccgtaaagaacataagcccaccttctcacagtgcaaacgacacagacgtcgtcgatcggagaaggagaacacctaatgtccttccctctcagccgttgcgcttgattagagaaatagcagacttttgttccagctagatggagttctgtccaacatgtgggaacttgctgcgttacggtcaatcacagttcttctgctcgacatgtccttacatcgcccgcatcgaaagacaggttgagataaagaagaagcaattgctggttaagaaatccattgacccggttgtgaagaaagatgatattccaaaaggacctgaaactgaagcaccatgcccaagatgcgggcacgacaaggcatacttcaaaacaatgcagattcgttcagcggatgagccagaatcgagattttatagatgcgtcaagtgcgagcaaacttggcgcgaggaatgatccctttatactcccctccccccacaacaataaaagaaagcaaatctatggctctttcagttttttttgttgttgttgtaacaatggcaattttcgatagctttcggagttatctgccttttttttttttttgtttttgggattgtttctgtgtgatttaagcagttttgatgttcgtttacagtttcttatcaaccacaataaaacgttcatctgaatggattttctttgtgaatcaactcttatgcaaagttttgttcggacaaagatcagtttggacacgtacataccttgtcttgtctgtttgacttttgaccagctgttaaataacttccctctccttcctctgtccactaaacctccagatttgattccgaaaaatgtcaggatcctcgagaaacaaccagcagaggaagaaggccgacctcgccacgatcctccgcaagtcgtggtaccatttgcgtctctcggttcgccatcccaccagggtccccacttgggatgcgatcctcctcactgccgccagtcccgagcaggccgagctctacgactggcagctccgtagagccaagcgtatggggaggatagctgactccaccgtcactttggccgttcctgatccagacggcaagcggatcggctccggcgctgccactcttaacgccatctacgctctcgctctgcattatcagaaattagggttcgatcccattgcttcagaggaggaagttgcaaatggtaggtgtgctcagtcctctcccatgtcttgggttagattcctctctgagaagcatgtgttgatgcttcatgctggaggtgactccaagagagtgccttgggctaatcccatgggcaaagtcttcctcccacttccttttcttgcttccgatgatcctgatggtcctgttcctctcctctttgatcacattcttgctctcgcttcatctgcaaggcacgccttcggtgatcaaggtggattgttcattatgaccggtgatgtccttccatgtttcgatgcttttaaaatgactctccctgaagactcggcctccattgttactgtgcccatcactcttgatattgcttccaaccacggtgtcatcgtcacatccaaatccgagtctcttgccgaagggtttactgtcagtttagtgaatgatcttctccagaagcctacagtagaggagcttgtcaagaaagatgcaattttgcatgacggacggacgctccttgacactgggatcatatctgcgaggggcagagcatggttggatctggtcgctcttggatgctcctgccaaccgatgatctcagagcttttaggcagtaaaaaagagatgagtttgtatgaagatctggtggctgcttgggttccctcaaggcatgattggctgcgaacccgacctttaggagatcaccttgtcaacagtctagggaggcaaaagatgtacagctattgcacgtatgatttgcagtttttacattttggaacatcaagtgaggtactggaccacttgagcggagatgcttcaggaatcgtaggtcgaaggcacttatgttccatccccgcaactacggtttccgatattgcagcctcttgtgtcatcttgtctagtgaaattgcgcctggtgtctccattggtgaagactcgcttatatatgattcaacagtctctggtgctgtacaaatcggttcccagtccgtagttgttggcattcacatcccaagtgaagctccagagagtttcaggttcatgcttccggacaggcattgtctctgggaggtcccgttggtgggacacaaggagagagtcattgtctactgtggtctccacgataatccaaagaactcgattcacaaagacgcaactttctgcggtaaaccgttagagaaagtactctgtgatcttggcatcgaggaaagtgacctctggaacttcaaagcatcatcacaagagagatgtttgtggaatgctaaaatgttccccattctcacatacagtgaaatgctgaagctagcgtcgtggctgatgggtttagatgatgggagaagcaaggagaagatagccttgtggagaagcgcaaaacgtgtgagcttagaagagctgcacggatcgataaacttccctgagatgtgcagtggctccagcaatcaccaagctgatctcgcggcgggaatcgctaaagcatgtgtgaactatggtatgcttgggagaaacttgtctcagctctgccatgagattttacagaaagagtcactaggattggagatatgcaagaagtttctggatcaatgtcccaaatttcaggaacagaactctagaattcttccaaagagtcgtgcatatcaggtggaagttgatcttctgagagcatgtggggatgaggcaaaggcgttagacttggagcatagagtatgggaagcagttgcggaagaaactgcttcagctgtgagatatggttttagagaacatctcttggaatcaagcggcaagcctccttctgagaagaatcatatttctctttctcaaccaagaaggacgaaagttgaactaccagttcgggtagactttgtaggaggttggagtgatacacctccatggagtttagagcgtgcgggttgcgtcctcaacatggcaataactttggaaggctcacttcccattggcacaatcatcgagacaacgaatgagaagagtggaatctcaatccaagacgacgctggaaacgctctacacatcgaagatccaagaaccatcaagacaccctttgaagttaacgatccgttcaggcttgttaaatctgctctgttagtaaccggcgttgttcaagaacactccacagggttagcaataaagacgtgggctaatgttcctcgtggcagcggtctaggaacctctagcatcctagctgcagctgttgtgaaaggacttttgcagatatctgatggagatgaaagcaatgagaatgttgcgaggctggtcttggttttggagcagctcatgggtactggaggtggctggcaagatcagataggtgggttatacccagggatcaaattcacttcaagctttccagggatccctctgcgtcttcaagttgttcctttactcgcatctccacagctgatctcagagttgcagcaacgcctcctcgttgttttcactggtcaagtcaggctagctcaccaagtcctacacaaggttgtaacaaggtatctacaaagagacaatctcttgatatcaagcataaagcgtttgaccgagctggcgaaatccgggagagaagcgttgatgaactgtgaagtggatgagcttggggagataatgtcagaggcttggagattgcatcaagagcttgatccgtattgcagcaatgagtttgtggacaggctatttgcgttttcgcagccttatagctcaggtttcaagcttgtgggtgcaggtgggggaggattctcgcttatactggctaaggacgcagagaaggctaaggagttgaggcagagattggaagagcatccggagtttgatgtcaaaatttatgattggagtatctctctctaatactactaatagcgtgtgatcttttgccttgtttttctacttttataaagcctttgtaattttatttttactggaactttggaaagaataaaagaaatgtaaacaaacatcctttgcttcacctactccaccaagtagttcttttctttgctttgttacggttacctacctatgcaccaacgccatgcacggtgaaaatactatattaccctcgcctgtaatcaaggtaaaaagggatcccggaaaatcagcgactttggacctcgttggtcgcatttgggatttggagataacgccgttagaagattccgtaacgggttagctcacccgctccaaaaatcaaaagggaaaagctttgtgtatcgagagagagagagaagaagaaggaagaatgggtttgctaacgaacaagatggagagagaggagctaaaggcaggagatcacatctacacttacagagcagttttcgcttattctcaccacggaatctttgtcggtggatccaaggttgttcatttcagacctgagcacaaccttaattcttcatcttcttcttctcccatggagtcattcacatcagcttcttcttccactgaagacatctgcccaacgtttccagattgtggtttcagacaaccaaacagcggagtggtcctttcttgcctggactgtttcctcaagaacggctcgctctactgcttcgaatacggagtcagcccatcagttttcctcaccaaagtccgcggaggcacctgcacaaccgcgcaatcagacccgactgattcagtcatccacagggcaatgtaccttctccaaaacggattcggaaactacgacattttcaagaacaactgcgaggatttcgcgctctactgcaagacagggttgcttataatggataagctgggtgtagggagaagcggtcaagcttcatcgattgtcggtgctcctttggcggcagtactttcttcacctttcagtctgctgattccaaaccccataggtgtggcgacggtgacagctggaatgtattgtatgagcaggtatgcgactgatattggagttagaagggatgtggtgaaggtgtccgttgaggatttggctctcaaccttgacgtgaagagcattgagcaagttgaagaagaagaagaagaagaagaagaagaggaagaagattctgataccgagtttgttaggtgactatatgatcatttgagtcaagtgttgatggcgtcgtgaatcatgttatggagtgtattgtgatggattatagtgtaacaaaactgcaagtccaataacttggaacactccataatccgtttagtttgtcgttaaaattccaaagtaggaactaaacgccaccgttttgtcaaatgctcaagtaggaactaaacgccaccgtttcatgcttaaaaggcagtagtcgtctttcacaaaattaaattaaactaaaccgaagatctggaaagagagagagagttgtgagtttccaaataagcttcctccttttgatcggagaatcaatcaatcaatcgccgtctcgaaatatcttcttagatttggatccgagggggaaaaagaaaaaggagatggcgaaactgtatgtgaaagcggtggcgccgccggatatgaacaggaacacggagtggttcatgtatccaggggtgtggacgacttatatactgataatcttcttcgggtggctcgctgtgctctccgtctctggctgttcccctgggatggcttggaccgttgttaatctctctcacttccttgtaacatatcacagcttccactggatgaaaggaacgccttttggggaagaccaaggcatctacaatgctctcacctggtgggaacagatggacaacggtcagcaacttaccagcaaccgcaagttcctcaccgtcgttcccattgtcctgtacttgatagcatcgcatacaacagattacagacatccatggctgttgctcaacacactcgctctcatggttcttgttgttgccaagttccctaacatgcacaaggttcgcatcttcggcatcaatgctgacaagtaagtcagcttcttcttctcagcagatccatctctgttacggtcagagaacaggaaggaagaagaaaaaaggggatataaccaaaacatatgtatgtgtgtaaatgttcatatgaattggtttatttatttattcgagagttatatgcttgctggatattttgtaaagtaactaattttgaagcttcgatcttcttattcataatcttttccggtcaaattagctggggctcacttactggacttaagatacaacaatagttaggtttaaggttggcacaagtatgctgcatgccgtgactcgagagttatccatactaactaacacgaggatgagtttgatttcagtgagaacacgtgggtgggtgactacaacatctctagtgacacgtatccgaccgaagtacacctggttattacatatgcaatatatgaacattatttcactcgtttaatcgtatagtaaagcacttgggaaaagatcaaattacagtgattcaagatggttaatttgataaaaatggtgttaggtgtaaactttaaagccgacagaaggaaaggaaaggaatgaatgattaatcaaagcttagaataagactaatgatatttttgtttttcccatcgtggtgggtccatgtaagaaaaaataaatacgtcttatcctttaaataaatgtgggggtctacactatgtgaaaccgtcgattctcccttcagaagacacgtgtagtcaatccagcggcttaccaagccaacaagttattgaaacggtcgcgttttggaactcgagaagctttacgaaactgtgaaaatgggttcgaatcaaaaacgggggacagagtgcgaaggaagaaagaagcagaaaagccaaaagcagagattcagtggaatcttcgaattaattaaaatgggtgtcttaacattgatgtgataaaatgggagcagctgaagtaagagcactctggcaaagaagagcaagccgttgctttcttgttcacgaagatgctacaatgcctccgaggttagcttgttgctgccaccaacaacaacaacaacatccttcttcttcttctggcaaaaacagcttttcttctactagttttggagattcctctgatttctcttctgataccaaatggtggctcaaaggaggatcatctggttttgatgaggagattgcaaactccttcctccaagataccaaattgcatcaattcgtcgacttaaccgggataagtaaagaagaagaagaagaagaagaactatagctttattagcaagaaagatacagctacaactccatggtggagaagcgctacggatcaagatgagctagctctcttggtgtccactagatccgttgatcatcatattcaaaactgtgatcttcctccgccccagaagctccacaagagcattcactgcactactaatggtgaaaaagggtttcagacagcagttattaaatcaccatggaaacaaggtgcttggagcgatcggtttgagagcagcagtaatagcacagatagcaagaacacgagtccaaagtcttctcctcagagcgatgatctaataagcaaagctcagcttttagaagcactaaggcattctcaaaccagagcaagggaagcagaggaagctgccaaagaagcttgcgctgagaaagaccgtttgataactgtcttgatgaggcaagcgaggcagattttagcttacaagcaatggattaagcttcttgagatggaatctctctatctgcatatgaaggaggaggaagaagaacaagggcaggtcgaaggaatgaatctgaagaagaggaagcaaagagggaagaagaagaataagaaaatgggggagattgggagatatatgatggcttttgcgttggggtttagtctcattggtgctggtctgctcttaggttggactgttggatggttgtttcccttctagagtcttgaaaaaaacgtcttttgtttgatctctgcaggagtttaggttttcactttgcctctaaaattgtgtgttatgtgtgttgtcttcatgtatatatgtgtgtgatatttccttccaatatataagtttaatagtattagtttagatcaaaagtttgaaaatgttaggaatcatttccatacttctaaacaatttcaag

SEQ ID NO: 2835 - DNA, 966 bp, Abies balsamea
agcggggattgtatatcactctgagacgacaacaggaggaggaaggagatcacctactcaaattcttcaatggcggaaggtgggctgagcttcccgaacatggggattgggaatctgtacgtgcaggcggtgcctccgccggatttgaacaagaacacatcatggtttatgtatcctggcgtgtggacgacctacattcttatactctttttcacatggatcattgtcctctgtctcttcggatgcaccgtaggcaccgcttggaccattgtcaatctcgcccatttcgcggtaacttaccatttctttcactggaaaaagggtacccccttttcagaagaccaggggatatataacaagttgacatggtgggaacagatagataatggcaaacagctgactcggaacagaaagttcttgactgttgtccctgtggtcctatacttgattgcatctcacaccactgattaccaaaatccgtgtctcttcttgaacacaattgctgttttggtgcttgttattgctaaatttcccaatatgcacaaagtgcgcatttttggaattaattcagattatcctaaataattccgacagatttaagtacaataattttgctcttttaactgcataaatgtaagctctcttggcttcaagatcgagtagcttcatgtccaagacgaaaggaccagtacagtttacaaaatgattaaaagcattgtagaaaattcggtggcatacactctacaggagctgtcatgtattggcactaattccaagtggttgtcacctatacaggtcttgtctgttgactttgtacagaagtttgttacactgaagatattgctgtaacatattattttggattgtttaagttgttccatgaacagttgttggcatgtaattagcagaaagaaatatggattttgtggaatataacgtatttgttttataaatattaagaaagtc

SEQ ID NO: 2836 - DNA, 959 bp, Pinus pinaster
attgtatatcattccgagacgacagaaagagggcaaaagaagagatcatttgtcatctgattaattcttcaatggcggaaggtgggttgagcttcccgaacatggggattgggaacctgtatgtgcaggcggtgcctccgccggatttgaacaagaacacatcatggtttatgtatcccggcgtgtggacgacctatattctcatactcttttttacatggattatcgtactctctctattcggatgcactgctggcaccgcctggaccatggtcaatctcgcccatttcgcggtaacttatcatttctttcactggaaaaagggtacccccttttcagaagaccaggggatatacaacaagctgacatggtgggaacagatagataatggcaagcagctgactcgcaacagaaaattcttgactgttgtccctgtagtcctatacttgattgcatctcacaccactgactaccgaaatccatggcttttcttgaacacaatcgctgttttggtgcttgttattgctaaatttcccaatatgcacaaagtgcgcatttttggaattaattcagattaccctatttaagggaggatgttagtataataattcgggcctttcaactgcataaatgtaagctctcgtggccccaagaccgagtacctcaatgtctttgagcaaaggaccaatatagtatgaaaaatggttaaaaacattgtagaaaattgggtagcatccactcgacaagagctgtcatgctttgttactaattcccagtggttgtcccctgtacaggtcttgtgtgttgactttgtacagaggtttgttgcaatgaagattttgctgtaacatattgctatggattgttttaagtcccatgaacatttcttggcatgtaatcaattttaaaggaaatatggattttgtggaatatgaggtatttgtttcatatgtattaag

SEQ ID NO: 2837 - DNA, 1168 bp, Pinus taeda
gatggtatatcaccatcggaaggagggattgtatatcattctgagacaacagaaagaggggaaagaggagatcatttgtcatctgattaattcttcaatggcggaaggtgggttgagcttcccgaacatggggattgggaacctgtatgtgcaggcggtgcctccgccggatttgaacaagaacacatcatggtttatgtatcccggcgtgtggacgacttacattctcatactcttcttcacatggatcatcgtactctctctattcggatgcactgctggcaccgcctggaccattgtcaatctcgcccatttcgcggtaacttatcatttctttcactggaaaaagggtacccccttttcagaagaccaggggatatacaacaagctgacatggtgggaacagatagataatggcaagcagctgactcgcaacagaaaattcttgactgttgtccctgtagtcctatacttgattgcatctcacaccactgactaccgaaatccgtggcttttcttgaacacaatcgctgttttggtgcttgttattgcaaaatttcccaatatgcacaaagtgcgcatttttggaattaattcagattaccctatttaagggaggatgttagtacaataattcgggcctttcaactgcataaatgtaagctctcttggacccaagatcgagtacctcaatgtctttgagcaaaggaccaatatagtatgaaaaatgcttaaaaacattgcagaaaattgggtagcatacagtcgacaagagctgtcatgctttgttactaattcccagtggtcgtcccctttacaggtcttgtctgttgactttgtacagaagtttgttgcaatgaagattttgctgtaacatattgctatggattgttttaagtcctatgaacattttttggcatgtaatcaatttttaaaggaaatatggattttgtggaatatgaggtatttgtttcatatgtattaagaaagtctggacagtggttaatagctggtaccaatgaggttttctgggttgccataatgagcaaagaggagtcatattttcgtttgatttattcttgctttaccggttcagtgaacaaaatttgaatgcaaatgtagggctgtggtcaatacccacattgaatatgtggaactaacattaaaa

SEQ ID NO: 2838 - DNA, 883 bp, Pseudotsuga menziesii
acacgacagaaggaggagatcgtttgtcatctaatcaattcttcaatggcggaaggtgggctgagcttcccaaacatcggaaacctctacgtgcaggcggtgcctccgccggatttgaacaagaacacatcatggtttatgtatcctggcgtctggacaacctacattctcatactctttttcacatggatcatcgtactttctctcttcggatgcaccgccggcactgcctggaccattgttcatcttgtccatttcgcggtaacttaccatttctttcactggaaaaagggcaccccattttcagaagatcaggggatatataacaagctgacatggtgggagcagatagataatggaaagcagctgactcgcaatagaaagttcttgactgttgtccctgtagtcctatacttgattgcatctcacaccactgactaccaaaatccgtggctcttcttgaacacaattgctgttttggtgcttgttattgctaaatttcccaatatgcacaaagtgcgcatttttggaattaattcagactaccctatttaagggaagatgttaatgcaataattgtgcacttttaattgcataaatataagctctcttggcctcaagatcgagtacctcaatgtccaagacaaaaggaccagtatagtatgaagaatggttaaaaacattgtagaaaattgtgtgacatatgctctacaagagctgtcatgtattgttactaatttccagtggttatcccctgtataggttttgtctgttgactttgtacagaagtttgttacaatgaagattttgctgtaacatattactttggattgtcaaagttgccccatgaacagtttttggcatgtaattaccagtgaggttt

SEQ ID NO: 2839 - DNA, 878 bp, Brassica juncea
gttggaatgatgtacgtgagagcgttgccgacgacggacgtgaatcggaacacggagtggttcacgtatccaggggtgtggacgacttacatcctcatcctcttcttctcgtggctcctcgttctatccatcttcaattgttcccctggcatggcctggaccatcgtccacctcgcccatttctccgttacgtatcatttgtttcactggaagaaaggaacaccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcaaaacccgatgctgtttctcaacacgcttgctgtatttataatggtggttgcaaagttcccgcacatgcacaaggttcgcatctttggaatcaatgcagaacgaagagggtcaggtcacggaactctacattcctaggaaatgctctgctactaaccggatgatcacatcaaaggatcatgcctctgtgcaactcaacattggtcatttagatgctgatggtatctacaccggacaattcactaccttggctctctgcggttttgttcgtgcccagggagacgctgacagtggtgtggacaggctgtggcagaagaagaaggtcgaagccaaacaaatctaaagagagcctttttaagctgtctttttgctttgttctgaatgttgttatttaattcagaaatgatcatcggacatacggaagtaacgatgtttgcttgactcttggttttaatgcttcttatgtacactggcttgttctgaatttccttatatcttcacaatttgttaaa

SEQ ID NO: 2840 - DNA, 1113 bp, Cephalotaxus harringtonia
atcacatgctttagggcatcggaatccccctcctaaatacgggagagcatatatacaatttatatttatctctctgtgcaacaaaaagggcagatacacaatatatattcatcggtatctgcaacaaaaagacagtgatatcagaggctaagactcaaagatcaatcgatctatccgtatcatgggggatttgtacgtgcatgcggtgccaccgccggatttgaacaagaacacatcgtggtttatgtatccgggcgtgtggacatcctacattctcatcctcttcttcgcctggctcatcgctctcgctgtctctggatgcactcccggcacagcttggtccgtcgtcaatctctgccactttgcggtaacttatcatttctttcactggaagaagggtacccccttttcagaagaccaggggatatacaataagctgacatggtgggagcagatagataatggcaagcagctgacgcgtaacagaaagtttttgactgtagtccctgtagtcttatacttgattgcatctcataccactgactaccaaaatccgtggctcttcttgaacacaattgctgtcttggtactggttattgctaaatttcccaacatgcacaaagtgcgaattttcggaattaatgcagattatcctatgtgagtgttggtgttagtgcaatagccctactgcctattcttgaatattttcttttattgcgaagttgtaagctgccttggcttcaagatagaacacctcaatgtaacagagcaacaagacaatcactcagaaaaatgcttgaaagcactgtagaaattctagtggagcatagcatacaggagctgtcatgtatttcttgtactcctgagtgacttccctgtaaaggtcttcattgttactttgtatgtaagtttctcgcaatgtagattctactgtaatatagttattttatggttcttagtttgctgcatgcacagacgcttacatatatgtattagtattttcgtggaatataaggtggtttattttccataggaaaaggaaatttggacactgtttggtagcacttgccagcaattctttttatttttgtgcattatgagagttgaatttga

SEQ ID NO: 2841 - DNA, 1143 bp, Sciadopitys verticillata
gccgaatcgaaaacccattgcacaatctgtggcctaattatatgtggcactcctacgatcgtatgccgctgagttcataatctttttcccattttgtctcgttggtttcacaattttgtgctataagattgagattgaggagggttgtaagaatgaagaatctgtacgtggatgcagtgccgccggtggatttgaacaaaaatacgtcgtggtttcaatacccgggggtgtggactacttatattctcattctctttttcacatggctcatcgttctctctctctttggctgcaacgcgggaatggcttggaccattgtgcatcttgctcatttcgccgtaacctatcacttcttccattggaagaagggcactcctttttcagaagaccaggggatatacaacaagttaacatggtgggaacagatggataatggcaagcagctaacccgtaacaggaaatttttgactgctgttcctgtagtactgtacttaattgcatctcacacaaccgattacaaaaacccttggcttttcttaaacacaattgctgtgattgtcctggttattgcaaagtttccaaatatgcacaaggttcgcattctagggatcaatgcagactacccgatttgattgggaacaactgtcaagcatctgatggataaggattatgtcaattcgtgctttgtttcagcatgcccgcagaagctatcatgtcttgaccaacaaattcatctgatgctatttttatctctgtaaggatctttctgtatatttatcatactttgtgtgggtctccaagccatggatttaattctgtaatataaattttgggctttaagatcagatttcttgtaaaggagttctgtcaatgccaggcttttatgttaagattttaaaatggaagcaataatttcagaaaatgtttttcttctggaagccgccatggtgtttatgtctgaaaatatgtggcaccttggcaaaatctttggtagaatcccgtggatatgtgacgagcagatgattgtttcatctttaaattttattatgtttgtacccttgagggcttggataaatacctaatgagggttttagcattttagagctaatgtattctttgatataatcaaaattttattttgcc

SEQ ID NO: 2842 - DNA, 810 bp, Sciadopitys verticillata
cggtgtctgaaacctaaagatcgatccacggtggatggtctgagcttctttagtatggggaatctatacgtgcaggcggtgccaccaccggatttgaacaagaacacagcatggtttatgtatccgggcgtgtggacgacctacattctcatcctcttcttcacatggcttatcgttatttcagtctctggatgcagccccggcactgcttggaccattgtcaatctctgccattttgcggtaacttatcatttctttcactggaagaaaggtacccccttttcagaagaccagggaatatataataagctgacatggtgggagcagatagataatggcaagcagttgacacgtaacagaaagtttttgactatagttcctgtagtactgtacttgattgcatcccataccactgactaccaaaatccatggctcttcttgaacacaatttctgtcttggtgctggttgttgctaagtttcccaacatgcacaaagtgcgaatttttggaattaatgcagattatgctatttgagtgttgatactagtacaacagttctgctgtctattgttgaatggtttcttttattgcaaaattgttagctgcctaaatcacctcaatgtacagaacaaaacgacaatcgagttatgtaggaaacacttgaaaacactataaattttagtggaggatatatacaggagctgtcatgtattgctttcattcctgagtgacttcccctgcacaggtcacgttgtgactttgtatggaagtttcttacactgtagattctactgtaatataattttattt

SEQ ID NO: 2843 - DNA, 699 bp, Fagopyrum esculentum
gataaaaatgttgaatctgttgtatgttagggcggatccgtcggcagatttgaacaagaataccgagtggtttacctatcctggtgtttggacgacctacattatccttgtgttcttctcatggctccttgttctgtctttacttggttgctctcctggaatggcgtggactatcgtccatctaattcacttcttcgttacattccacttctttcactggaagaaaggtacaccttttgctgaggaccagggaatatacaatgggctgacctggtgggaacagatagataatggcaaccagctcactcgcaatagaaagtttctgactgtagttccagtggtgttgtacttgatagcttcccacacaacagactatcaaaacccgatgctgttcttgaacacactggctgtgtttataatggtagttgctaagttcccccagatgcacaaggttcgaatatttggaatcaatggagaatattagccacaagggaacaaattcatctttgatcctggaaaagtcaagggtatatacaatccacatgacagagagaatactttgtactgtcgaagctcttcaaattggttcctgtgtttgtcttgacacattccttttacatcagctgaacttgaagagaactacatcattctatttgccattgttttacctgtctacctttctggataaatgaatgttcg

SEQ ID NO: 2844 - DNA, 1468 bp, Picea glauca
gggggtcacgtgtccgcccaacaatatgtattcctcatcctctaacgttagattctagcgtatgatttttctcataagatggtgtatcatcatcggaaggggggattgtgtatcattctgagacaacagaaagagggtagaggaggaggagatcgtttggcatctgatcaattcttcaatggcggaaggtgggctgagcttcccgaacatcgggattgggaacctgtacgtgcaggcggtgcctccgcctgatttgaacaagaacacatcatggtttatgtatcccggcgtgtggacgacctacattctcatactcttcttcacatggatcatcgtactctctctattcagatgcactgctggcaccgcttggaccattgtcaatctcttccatttcgcggtaacttaccatttctttcactggaaaaagggtacccccttttcagaagaccaggggatatataacaagctgacatggtgggaacaggtagataatggcaagcagctgactcgcaacagaaagttcttgactgttgtccctgtagtcctatacttgattgcatctcacaccactgactaccgaaatccgtggctcttcttgaacacaattgctgttttggtgcttgttattgctaaatttcccaatatgcacaaagtgcgcatttttggaattaattcagattaccctatttaagtgaagatgttagtacaataattcttcccttttaactgcataaatgtaagctttcttggcctcaggatcgagtacctcaatgcccatgactagaggaccattataatatgaaaaatgcttaaaaaaattgtagaaaattgggtggcatacactctactagagctgtcatgctttgttactaattcccagtggttgtcccctgtacaggtcttgtctgttgactttgtacagaagtttgttacaatgaagattgtgctgtaacatattactttggattgtttaagttgccccatgaacagttgttggcatgtaaacaaattattaaaagaaatgtggattttgtggaatataaggtatttgtttcatatgtattaagaaagtttggacagtggttaatgtctgataccagtgaggttttctaggttggcatattgttgacagtaggttattgctgagcaaacatgagtcatccattttccttcgatttattcttgctttgcggctgcagcgaacgaagtttcaatccacatgtggggttccgtggtcgatgcccacattggatatttgaaactaccattaaaagcacgaggggcctgatctgattagtttgttcattcaaaattgctgtaaaagatactctgaacatgtatgcccatgtcaatgggaaatacaataatccgagccataggatataaaggttaatttgttggatgatgtgtgtcatattgacttatcttctgaattaaccgttgaacttatctgctagtgttattc

SEQ ID NO: 2845 - DNA, 502 bp, Tripterygium wilfordii
ctgaattccatcagacctcgattggagaaaccagaacaaatcgattcaagaagaagacggaataggaggatttgaggagacataaatggcgaatttgtacgtgaaggcggtgccaccggcggatctgaaccggaacacggagtggttcatgtacccaggggtttggaccacatacatcctcatcctcttcttttcttggcttcttgttctctccatctttggctgctctcctggcatggcatggacaattgtcaatctcgctcacttcggcgtaacctatcagttcttccactggaagaaaggaactccgtttgctgaagaccgaggggatctacaacaggctgacttggtgggagcaaatagataacggaaaacagctgacacgtaacagaaaattcctaactgttgtacctatagttctgtacttgatagcttcacacacaactgattaccaacatccgatgctctttttcaacacacttgcagtgctagtgctagttat

SEQ ID NO: 2846 - DNA, 623 bp, Ambrosia trifida
attaaccccaattcatgcactaacaatctgggcaaagaagctaacaacaataataatcagaaaagatgatgtacgtgaaggcgacacagacaacagatcttaatcgaaacaccgattggttcacgtacccaggtgtatggatcgcatacatcttcatcatcttcttttcttggcttcttatcctctctctttctggttgctctcctggcatggcctggaccatccttcatttctcacactttttggtgacttatcatttcttccattggatgaaagggactccatttgctgacgatcaggggatatataaccggctgacgtggtgggagcagatagacaatggcaagcagctcacccgaaaccgaaaatttttaaccgttgtacctgtagtgctgtacttgatagcctcacacactaccgactatcagcatccaatgttattcctcaatactgttgctgtgaccgtgcttgttatcgcgaagtttcctaatatgcataaagttcgaatctttgggattaacggcgatatgtgacagttgattacatgattacggttggtaagtttggatctttttatgaaactgggtggtatcaatgtatagtatgtcaatgttgggatggaa

SEQ ID NO: 2847 - DNA, 714 bp, Brassica oleracea
gatcagagaacgaacgaagagggaaaaattgataaaaaaaaaaccagaaggaaaggatcgtaaaaatcggagagatctgattgatctgtgtggtgtgggttggaatgatgtacgtgagagcgttgccgacgacggacgtgaaccggaacacggagtggttcacgtatccaggggtgtggacgacttacatcctcatcctcttcttctcatggctcctcgttcaatccatcttcaattgttcccctggcatggcctggaccatcgtccacctcgcccatttcgccgttacgtatcatttgtttcactggaagaagggaacgccgtttggggatgatcaggggatctacaataggctgacttggtgggaacagattgacaacggcaagcaactcactcgcaatcgcaagttcctcactcttgttcccgttgtcttgtacttgatagcatcgcacacgacagactatcaaaatcccatgctgtttctgaacacgctttctgtatttataatggtggttgcaaagttcccgcacatgcacaaggttcgcatctttggaatcaatgcagaccagtgaaaagcaccaaatgagatatgttgtggtaaatcaatctgatcatgatgccttagaaatggaaatacatatgccacttttgtcttcttcttcttcttctccttagacttttttcttttacttatttatgtaaaaaccaaataag

SEQ ID NO: 2848 - DNA, 768 bp, Flaveria ramosissima
tttagggcaaaatttcattcaatttctcaactcaatcgttcaatcaatttggggaaattgctcatcataatcccaattcatcaacaacatcttggtgaagctgttaacaatccgaaaagagcatccagatgatgtacgtgaaggcgacaccgactaccgatctgaatcgaaacaccgattggttcacgtaccccggcgtatggactacatacattgtcatcctgttcttttcatggcttcttattctctcagtcttcggttgcacccctggcatggcttggaccatcgtcaatctctctcatttcatcgtgacttatcaatttttccattggatgaaagggactccgtttgctgaagatcaggggatttataataggttgacatggtgggagcagattgacaatggcaagcagctcaccagaaacagaaagtttttaactgttgtacctgtagttctatacttgatagcttcacatactactgattaccagcatccaatgttattcctcaacacagttgctgtgatcgtgcttgttattgccaggtttcccaatatgcataaagttcgaatctttggattaatggagatatgtgacagtcgatcacagtaggtaagtttggattctttgtgttcaatctggtagtatcaatatatagtagtcaatgttgggagtgggagttatcttgttattgtacctatttttgtttcagttgacttggtgtattgacaagtgtatattaacaaataagcttactagttatttgaac

SEQ ID NO: 2849 - DNA, 1002 bp, Linum usitatissimum
ggcccccgtcggcatcgccatagtttgatttctctgggtctcgatcactttcacagaagacgtaaagaaatcccaaatccaacacgaagaaaggaagaaactcctcctcctcttctgggaatctcttctgtgaatctgtgatctagtccccctcaattcttcttcagtaatccaaaaggaagaagaagaaacgaaggaaagcaaagatgtacgtgacagcagatccgccaacggatgtgaatcggaacaccgagtggttcacctatcccggcgtctggactacctacatcatcatcctcttcacctcctggttcatggtcctttgcctcttcggctgctcccccggcaccgcttggaccgtcgtccatctcgcccatttcctcgttacatatcattgttttcactggaagaaggggactcctttcgcggacgaccaaggtatctacaatgggttgacttggtgggaacaaattgagaacgggaagcaactcacacgcaataggaagtttctcactgttgtaccagttgtgctatatctaatagcctcacacacaacagactaccaaaatccaatgctgttcttcaacacggtggcggtattcgtgctggtagtggcgaagttccctcacatgcacaaagtccggatattcgggatcaacggcgatttctgatcgcagaattgaaaaggatgtccgtcatctggcatggaaaacaatatgtgggattttttcacttgggttagaaacttgaaccatcgttttgatagcagtcccccccaatatattcatataatgttgtgtgtgtggagggagtgtcgcttccttgtaaagagacgaaccagaaaaagaagtaatggaaaaagggttgaaattatgttgctgtgtataagaaatctgttggctttgttctaattttatgctgcctgtgaatgttcagtgtgcgggagaaacaccagaaaacaaaacacttgcactcattcaggaatttaaggcctttttttac

SEQ ID NO: 2850 - DNA, 892 bp, Raphanus sativus
gggctcctccttccttctctgaagagagagagagaaatcagacaacgaaggaaggaaggaacggggaaaattgatctaaaagataagaaggaaaggatcgtaaaaatcggagagagagagagagagagatcggatcagatctgtgggttggtgggttggaatgatgtacgtgagagcgttgccgacgacggacgtgaatcggaacacggagtggttcacgtatccaggggtgtggacgacttacatcctcatcctattcttctcatggctcctcgttctctccatcttcaattgttcccctggcatggcctggaccatcgtccacctcgcccatttcgccgttacgtatcatttgtttcactggaagaagggaacaccgtttggggatgaccagggggtctacaataggctgacttggtgggaacagattgacaacggcaagcaactcactcgcaatcgcaagttcctcactcttgttcccgttgtcttgtacttgatagcatcgcacactacagactatcaaaatcccatgctgtttctgaacacgcttgctgtatttataatggttgttgcaaagttcccgcacatgcacaaggttcgcatctttggaatcaatgccgaacagtgaaagcaccaaatgcggttgagctatgagatatgttgtggtaaatcaatctgatcatgaagccttgaagtagaaaatacatatgccacttttgtcttttcttcttcttttctccttagatttttcttttccttatttatgtaaaaaccaaataagtcattcaagagtgggtttgtaagtctgaacccgtggtttagtgatttttcttcaaaaatcatttactaatactaatatacataatatacaagcgacatagtcatttagacc

SEQ ID NO: 2851 - DNA, 622 bp, Brassica rapa
caactcctacggtgaaaaaggatgtacgtgagggcgcttccgacaacagatgtgaaccggaacacggagtggttcacgtatcctggcgtatggaccacttacatactaatcctcttcttctcgtggctcctcgttctctccgtcttccactgctcccctggcatggcctggaccatcgtccacctcgcccatttcaccgtacacttgtatcattcgttccactggaagaagggaacaccgtttggggatgatcaagggatctacaacaggttgacttggtgggaacagattgacaacggcaagcagctcactcgcaaccgcaagttcctcaccgttgttcccatcgtcttgtaagttgattgcttctcacacaacagactatcaacatccgatgctcttcctcaacacattggccgtctttgtaatggtcgttgcgaaattcccgcacatgcacaaggtccggatttttggaatcaatggagaccaatgaaggaagccttaacaagactaagccaaaaaagggtatgtgtataatgcgagacaagtagattttggaagcttggaatacaattacaaaagaaaaatgccattgtcactcacatttgattccgcatgtgttact

SEQ ID NO: 2852 - DNA, 886 bp, Brachypodium distachyon
atcacaaccacaccaaacaccatcactcctccaacgcccccaacctcctcgacctccacctgcagcaccggccacccgcgcgccagcgaaacccggcggccctatctaggatccgacgacgacgaggagccaccgcgccgcagagctgctaggatggggcggagagtggcgtcctactacgtggaggcggcgccgcccgtggacgtgaacaagaacaccgagtggttcatgtaccccggggtctggaccacctacatcctgctcctcttcttcgcctggctcctcgtcctctccgtctccgcctgctcccccggcgccgcctggaccgccgtcaacctcggccacttcgccatcacttaccacttcttccattggaagaagggaactccgtttgctgctgatgatcaaggaatctacaacagattgacttggtgggagcaaattgacaacgggcagcagcttactcgcaacaggaagttcttaactgtggtaccggtggttctgtatctgattgcttcacacttgaccgactacaatcagccgatgctcttcctcaacactgttgcagttttggtgctagttgtagccaaactaccaaacatgcacaaggtccggatatttggaatcaatgcagatatctgaggggcgccgcaagaacaccacagtactgttgcttgtaatcgttgtatatagatttagagagaactgtaaatgtcactctagcatacgtagtttgcctgaagtgtccccgacagatgaaaggcctgtagccctgtaggtgatcccagctggatgttgtttggtattgcatcatactccacgggattctttaagtgtagactgtcttcaataaagatgtcaatatttggatcgagatctagtaggc

SEQ ID NO: 2853 - DNA, 939 bp, Brachypodium distachyon
cacgggctccgctacgctcacaaccccaaacaaacaggaacaagatcacaaccacaccaaacaccatcactcctccaacgcccccaacctcctcgacctccacctgcagcaccggccacccgcgcgccagcgaaacccggcggccctatctaggatccgacgacgacgaggagccaccgcgccgcagagctgctaggatggggcggagagtggcgtcctactacgtggaggcggcgccgcccgtggacgtgaacaagaacaccgagtggttcatgtaccccggggtctggaccacctacatcctgctcctcttcttcgcctggctcctcgtcctctccgtctccgcctgctcccccggcgccgcctggaccgccgtcaacctcggccacttcgccatcacttaccacttcttccattggaagaagggaactccgtttgctgctgatgatcaaggaatctacaacagattgacttggtgggagcaaattgacaacgggcagcagcttactcgcaacaggaagttcttaactgtggtaccggtggttctgtatctgattgcttcacacttgaccgactacaatcagccgatgctcttcctcaacactgttgcagttttggtgctagttgtagccaaactaccaaacatgcacaaggtccggatatttggaatcaatgcagatatctgaggggcgccgcaagaacaccacagtactgttgcttgtaatcgttgtatatagatttagagagaactgtaaatgtcactctagcatacgtagtttgcctgaagtgtccccgacagatgaaaggcctgtagccctgtaggtgatcccagctggatgttgtttggtattgcatcatactccacgggattctttaagtgtagactgtcttcaataaagatgtcaatatttggatcgagatctagtaggcaaattaaca

SEQ ID NO: 2854 - DNA, 1128 bp, Oryza sativa
acacccacctagtccccggctcccagctgggtcgccggagagtgttccctgtaaaacgcagtctagtctactactgtgcgcccctccgcccacggaacaatccagaacgcaactcggacttctagatatttcaatcccccaccggatttagtacacccaccccgtacacaatagggtatcatcatcacaccatcacgagcaccaccaccactcaccacgcgccacccacccccgcaccgcacgccaagatccgaccgccgccgccgccgccgccggagtagggagagggagaggagatggggcggagggcggggtcctacccctactacgtggaggcggcgccgccggtggacgtgaacaagaacacggagtggttcatgtaccccggggtgtggaccacctacatcctcctcctcttcttcgcctggctgctcgtcctctccgtctccgcctgctcccccgggatcgcgtggaccgtcgtcaacctcgcccacttcgccatcacttatcacttcttccattggaagaagggaactccatttgctgctgatgaccaaggcatctacaacagactaacttggtgggaacaaattgataacgggcagcaacttactcgtaataggaagttcttgactgtggtacctgtggtgctgtacctgatcgcgtcacacttgaccgattacaaacagccaatgcttttcctcaacaccattgcagttctggtactagtggtagcaaagctgccaaacatgcacaaggtccgtatatttggaatcaatgcagatatctgaggaccatatgaagaacatcagggcacaagcttctgtgtgtttgcaacgagggacaagcgaactttgtgcaaacacggtatctaaagtagtgaaaaaactaaactttttcaccactgcaatctgtagtatgtgcataggtgtaggaagaacctgtaaatgttactgtagcttataatttgcctacaggttggaggctgctgcatgtttgctcatgccacttcctttaagaactctagtggagagtgtagactgtaacttaaataaacatgtaatcttgtggatatggaaagtttggtggttgttaaaatggtgaaccggagttcagttcctgcaaaaa

SEQ ID NO: 2855 - DNA, 715 bp, Allium cepa
tacggcctagttacggggctttaacgaaatgggaaaaatgtatgtgaaaacaatgccaccgccggacataaacaagaatacggaatggttcatgtatccaggcgtatggacaacctacattctcatattgttcttttcatggctaattgttctttctatttttcgttgcacgcctggcattgcttggactatagtcagtctctctcattttgtgataacgtatcactgtttccactggaaaaaaggaactccatttgctgaagatcaaggggtctacagtactttgacctggtgggaacagattgataatggcaaacaacttacacgcagccgcaagtttttgactgtcgtgcctgttgtgctgtatttgatagcttcgcatacaactgattatcaacatcccatgcttatcttcaatacaattgctgtgatagtgctggttattgctaaacttccgaacatgcataaagtccgcatctttggaatcaattcaggcatataagattttagcgaggaatgtgtattggtcacagaatatgagcaaagtcaagagtgggcagatatttgtcgctggcaagtgtttgtatcctatgaatggatggattcgaataattgtagaaaaccaaattactattttgtgataatcaacgtgaagaacacatttcatgtcaatgcctgaaatagtggtgggagtgtgacatttatttacaacccg

SEQ ID NO: 2856 - DNA, 451 bp, Arnica chamissonis
gatctgaatcggaacacagattggttcacgtatccaggtgtatggacgacatacatttccatcctattcttttcatggtttttcatcctctccgtctctggttgtacccctggcatggcctggacgatcctcaatctctcccacttcctcgtgacttatcacttttttcattggatgaaaggaactccatttgctgaagatcagggggtgtataacaggctgacatggtgggagcagattgacaatggcaagcagctcaccagaaacagaaagtttttaactgttgtacctgtagtgctgtacttaatagcctcacacactactgattaccagcatccaatgttattcctcaacacagtagctgtgatcgtgcttgttatcgccaaatttcccaatatgcataaagttcgaatctttggaattaatggagatatgtgacagttaattgcag

SEQ ID NO: 2857 - DNA, 882 bp, Brassica rapa
acgccaccgtttcatgctaaaagcagtcgtctttcacataatttaattaaaattaaaccaaaccgaggatctggaaaaatccgcaagagagagagaacttgtgagtttccaaataagcttccttttgatcggagaatcaatcaatcaatcgctgtctcgaaatatcttcttagatttggatccgatggcgaaacagtatgtgaaagcggtggcggcgccggatatgaacaggaacacggagtggttcatgtatccaggggtgtggacgacttatatactgattatcttcttcgggtggctcgctgttctctccgtctctggctgttcccctgggatggcttggaccgttgttaatctctctcacttccttgtaacatatcacagcttccactggatgaaaggaacgccttttggggaagaccaaggcatctacaatgctctcacctggtgggaacagatggacaacggtcagcaacttaccagcaaccgcaagttcctcaccgtcgttcccattgtcctgtacttgatagcatcgcatacaacagattacagacatccatggctgttgctcaacaccctcgctctcatggttcttgttgttgccaagttccccaacatgcacaaggttcgcatcttcggcatcaatgctgacaaataaagtaagtcagcttcttctcagttccatctctcttatggtcagagaacaggaaggaagaagaaaaaaaggggatacaaccaaaacatatgtatgtgtgtaaatgttcatatggattggtttatttattggagagttatgcttgctggatattttgtaaagtaacttaattttgaagcttcgatcttcttattcataatcttttccggtcaaattagctcggggct

SEQ ID NO: 2858 - DNA, 1608 bp, Lolium multiflorum
ccaagtcagctcgtggaacaatctagaatgattctggacatttccccatcagactgggcacgagaccaacatcacgggctccgctacgctcacagcccaaaacctcccacaaccgaaaccaaacagacacggaaccagatcacaaccacaccacaatcactgctccgacgcccccaaccccccgtccatctctccacacctgcaccggccaccgcgcttggagcacgccacctgagatccgacgaaccggccggagatgggacggcgaggggcgtcttactacgtggaggcggcgccgccggtggacgtgaacaagaacaccgagtggttcatgtaccccggggtctggaccacctacatcctgatcctcttcttcgcctggctcctcgtcctctccgtctccggctgctctcccggggccgcatggaccaccgtgaacctcggccacttcgccatcacttaccacttcttccattggaagaaaggaactccgtttgctgctgatgatcaaggcatttacaacagattgacttggtgggagcaaattgacaatgggcagcagcttactcgtaataggaagttcttaactgtggtacctgttgttctgtatctgattgcgtcacacttgactgactacaaccagccaatgctcttcctcaacactgtagcagttttagtgcttgtcatagctaagatgccaaacatgcacaaggtccgtatatttggtatcaatgcagatatctgaagaacgctgcaagcacaatctgaacttcagcagtgcacaataatagcaaggcaggatgatgcaaccgtagtactgttgtgtgtaacatctgtatataggttaagagaaaactgtaaatattaactagcacacgggattcggctacagattccagagaactcttggaagtgtagaatgtaacttcaataaagatgctaatatgtggatggaaacttgctcagtgcttggtatttcgtaaattgctaactagggattcacctataaatttcagggaatgcaaagatattatcatcaggccatatgtttcacagggtgacatagttcatataatcgtgactggtattgtttattgagatagacaaaataacatggtgtcattactcaaacaaaagttcccagtatatgttgaattccaggtacaaaacaacatgagcatatttacatcaacacaacgaatggattgcacaccaacaaaatgaaaggtctgcctcatcatgtagtggtgggaagtctgagatcggatgatgatccagttgcttctcccaattgaaagtgaaggtatccatggagccattgacagcacttaaaaagaaatgttgcaatgctcactcactaatgttgcagactgacataaatttctgaactgcattatggtactgagttccctcccagtatagttgattgcagtcggtgcacttccagaattccagatctcggttgaatatgcacgaggggatgacctggaaacctttggaggcttccatggcttcgtccagcgttaacggtttctgaatgaaacttccattgcactttgtacatctcgacattagtcggtcctcagaaatctttaactggaaggtgtc

SEQ ID NO: 2859 - DNA, 453 bp, Rhizophora mangle
cgactatgtacgtgagagcagtgccggcgacggacgtgaacaggaacacggagtggttcacgtacccaggtgtttggactacttacatcctcatccttttcgtttcctggctcatcgtcctctccctctttggctgctctgctggcatggcctggaccatcgtccacctctctcatttccttgttacttatcacttcttccactggaagaaaggaactccatttgctgatgaccaggggatctacaatgggttgacttggtgggaacaaatagaaaatggcaagcaactcacacgaaacaggaaatttttaactgttgtacctgtagtcctgtatttgatagcctctcacacaacagactaccagaatccagtgcttttcttcaacacattggcagtgtttgtactggtggtggccaagttcccacatatgcacaaggttcggatatttggaa

SEQ ID NO: 2860 - DNA, 1004 bp, Utricularia gibba
attagttgcttttccaagttttaatcgttctcgacgctaacctgttcgatcgaaatcggccaaggattgattcgtgttagaaacaagttcgtttgtgcgaagggatttcctttatggcgaatttgtacgtgcaggcggatccgccgacggatctgaatcggaatacggagtggttcatgtacccgggtgtgtggacggcctacgttctgatactgcttttcgcatggctcgtggtgctttccgtttttggatgctccgccggtgtggcgtggaccatcgttcatctattccattccgctgtgacttttcacttcttccactggaaaaaaggaacaccttttgcagaggatcaaggaatttacaataggctaacttggtgggagcaaatcgacaatggcaagcagcttactcataacaggaagtttctaacagtgatccctgtattactgttccttattgcttctcacacaaccagctatcgaagccccatgctcgtcatcaacactctcgctgtttgcgttctggttgttgcaaagttcccaaatatgcacaaggttcgtgtctttgggatcaatggagatcaatgagctctggccctaagaatccccatccacatcaaaacctagaggaatgccactttaaaagctagaggaatgccactgtccagcatgagcacttggaaatcttacatctcttagcaactagagccccaacgtcttggatttgaacctatgaatatatgtaccaggctcatgccggctacactatgatcttatttcatttcttagatgcgattcaactaccctgatattttttcattgccacatgctttgttacaacatttgtccatctaatggtacatgcatttgaatcaccaggttttgtctggcttctgattgggtttgaaagtgaaagtttctttacaggagatgtcctgcaggtggggcagctcggtcatgataactggaaaatgccccttttatgtttagagacattgaatgatt

SEQ ID NO: 2861 - DNA, 976 bp, Zostera marina
cccaccgtagtagtttcaatctccgcgcatcttcttctttccactttcttcttctgcaagttcgttcatagctaccggattcttctgttgctgtggaccgttatttcgtcaaaatggggaagatgtatgttcagacgacttcaccgacggatctgaacaagaatacggagtggttcatgtatccaggcgtgtggacgacatatattctaatcgtcttcttctcttggctactggtcctctctgtcttcggttgctcacctggcatggcttggaccatcatcaacctctctcactttcttgtgacttaccagtttttccactggaagaagggaactccctttgccgaagatcagggtatctacaatgctttgacatggtgggagcagatggacaatggcaagcaattgaccacaaacaggaaatttctgactgttgttcctgttgtactgtatttgattggatcgcacacaaccaactacgaacaacctatgctcttgttcaacacccttgcagtcgtaattcttgtgattgcaaagtttccctatatgcacaaagttcgtatctttggtatcaatgctgagagttgaatcgtagtaggaacaatttgtgtacaaccagattgatctcatcaacaaacacacttgctacttgctcctcctccctcagtcgatggcaatgacaaaaactctgacaacgatctatggaattagacagtcgaaattttaaaattttaccgagcccgtgctattcaaaatttcaaattgggtggtttaattttgtaattgttttgaagaatgtatatatagaaccacttgctctgtaatactcctgttttctttagtacctcatgctcttccggtagagttctttttccaacagtcttgtatcaaacaggcttcgtcacctccgattcctttggggaatttactcttgtatcaaacagtctttaactggttgttagttgttatagttggtt

SEQ ID NO: 2862 - DNA, 719 bp, Theobroma cacao
agagggcgcagagggagcgagctttgaataggtaaaacccaaacacgccatcaacaacgacaacggcatctttcatctgtcaccgttgtcgatcaatccttgaatcaacatccgtcagtttaagccaaaaaagaagaaaaaaaacagagttgtaatcgtaagaggaaggaagaggagaaaaactaaagcgaaagatgtacgtgagagctgtgccaccgacagatctgaacaggaacacggagtggttcacttatccaggagtttggaccacttatatcttgatccttttcttttcatggcttatcgttttatctctcttcggttcctctcctggaactgcttggaccattgttcatctctcccatttttttgtcacgtatcacttctttcattggaaaaagggaacaccatttggtgatgaccaaggaatctacaatggtttgacttggtgggagcagatagacaatggcaagcaactcactcgcaataggaagtttttgactgttgtacctgttgtgctgtatcttatcgcttcacatacaacagattatcaaaacccgatgcttttcttcaacacactggctgtctttgtgctggtggttgcaaagttccctaacatgcacaaggatcgaggtgtaacattcgaattcaaattctcagtccctttccttatgtggaaaaaagaaaactaatagcaagctggtcttgatgaatagcgg

SEQ ID NO: 2863 - DNA, 1163 bp, Gnetum gnemon
gaaaatatgataagaagcttcatgagattcatccacggacttcagccatagtaacagcagcagcagcagatgcaggccccgcctggccccaatttctgatcaccacaaatttctgtttctgataatttgtttctcttctgaatctatccacggactacttggtagcaggcagagcgacccagaatgaaaaatttgcgtgtggaggtgacaccgcctgcggatttgaacaaaaatactgcatggttccagtaccctggcgtttggacctcatacattctcatcattttctttgcatggcttattgtcctttccctcttcggatgctctgccggaatggcctggactattgttcatctcgttcacttcctggtgacctacagattctttcattggaaaaaaggcaccccattctccgaggaccagggggtgtataataagctgacatggtgggaacagatcgataatggcaagcagcttacacgcaacagaaaatttctgaccgtcgtccctgttgtgttgtacttaattacatctcatacaactgattacaagaatccatggcttttcctgaatactgtcgctgtccttgtgctggttgttgcaaaacttcccaacatgcacaaagttcgaattctgggaatcaatgcagaccatgctatctagttgcccaatgaaaagcattgttatcaggatttgtttgtacctgtacattgaaccatgttcagttttaaatatcctttggtgacaggatgatgaaagacattattactacaggaaatctgttcatgcttgtacattggataaggttaataactaaacgtgaattctcaaagtcaatctggagtggattgtattagtgaactcgaaatgtgttgcatcaggatttcaagaaatggtgggttgcaatgcagagtttgtttttaaaaaaaatatgtgaattagaggcattttgagttccaaatacacgtcctcattcaattcaatatcatgtatttgtttgcattgtttgggaacatgggttgtcaaagagaaatagcaaggagatattcatggtatgtttcccaacgggaacagttagcaagcctagaatttaattgatatttttcactgatgatatcagctctgtatttatcaaaaacaaaatctttatcttcaggctttcg

SEQ ID NO: 2864 - DNA, 987 bp, Taxus baccata
agcagataaacgatatatatgaatccgggtctgcaacaaaaaagagcagatacacaatatatatatgtatctgtatctgcaaaaaaagacagtgctactgccatcagaggttaaggttgaaagttcaatttgtcgatccgtaccatgggagatttgtacgtgcaagtggtgcccccgccagatttgaataagaacacatcatggtttatgtatccgggcgtgtggacaacctacattctcatcctcttcttcgcctggctcatcgctctctgtgtctctggatgcactcccggcacagcttggtcccttgttaatctatgccattttgcggtaacttatcatttctttcactggaagaagggtactcccttttcagaagaccaggggatatataataagctgacatggtgggagcagatagataatggtaaacagctgacgcgtaacagaaagtttttgactgtagtcccagtagttctatacttgattgcatctcataccactgactaccaaaatccatggctcttcttgaacacaattgctgtcttggtgctggttattgctaaatttcccaacatgcacaaagtgcggattttaggaattaatgcagattatcctatgtgagtgttggtgttagcagtagcacattagtactgccgtctattcttgaatattttcttttattgcaaagttattagctgccttggcttcaagatagatcaccttaatgtatggaagaaaaagacaatcacattatgaaaaatgctggaaagcactgtagaaattcgagtggaacatagcatacaggagctatcatgtattgctttttcttccaagtaacttccccttaaaggtgtttctggtgactttgtactgaagaacctcacaatgtagattctgctgtaatatacttttttttctggttcttagattgccgcatgcacagatatgctcacatgtatgtattagtaaaatttgtcatatttg

SEQ ID NO: 2865 - DNA, 832 bp, Avena sativa
ggcatgagaccaatatcacgggctccgctatgctcacaccccaatcccaacccaaacaaacccatacggcgaaccaaccagatcacagccacaccacaccaccgctccgctcgtcctgagatccgatgaaccggccgaggatggggcggcgaggggcgtactacgtggaggcggcgccgccggtggacgtgaacaagaacaccgagtggttcatgtaccccggggtctggaccacctacatcctgctcctcttcttcgcctggctcctcgtcctctccgtctccggctgctcccccggggccgcgtggaccgccgtcaacctcggacacttcgccatcacctaccactttttccattggaagaaaggaactctgtttgctgctgatgatcaaggcatctacaacagattgacttggtgggagcaaattgacaatgggcagcagcttactcgtaataggaagttcttaaccgtggtacctgttgtcctgtatctgattgcgtcacacttgaccgactacaatcagccaatgctcttcctcaacactgtagcagttttagtgcttgtcgtagctaagctgccaaacatgcataaggtccgtattttcggtatcaatgcagatatctgagacaccgctgcaagaacaatatgaacttcaccaatgcagaacaatgtcaagacagggtggtgcaaccgtagtactgtcatctgtaacctctgtatataggttttaagagatatgtgtaaatgttaactagcatacgggtgttcgcctatagattccagcgaactcttgaagtgtagaatgtaacttcaataaagatgccaatatgt

SEQ ID NO: 2866 - DNA, 1110 bp, Setaria italica
cagcggtatcacgacttcacgagcaagcggagcaccgcacccaacccaaaccaccaagccgaacgcagccgccatccatttccgcaccaccgcatcgtccgcgcacgccgccgccgtcagtcacacgcacgccgcacgcatccggcacagcacgcgcacgccccgcggaagccccgagatccgacgatccgccggccgccgtcgaccgaggtcggggagcgaagatgggccggagaggggagccctactacgtcgaggcggcgccgccggtggacgtcaacaagaacaccgagtggttcatgtacccgggcgtctggaccacctacatcctgcttctcttcttcgcttggctcctcgtcctctccgtctccggctgctccccgggggcggcctggaccgtcgtcaacctcgcgcacttcgccatcacttatcacttctttcattggaagaaaggaacaccgtttgctgctgatgaccagggcatctacagccgattgacatggtgggagcaaattgacaatggccagcagcttactcggaacagaaagtttttgactgtggttcctgtggttctgtacctgattgcatcacacttgaccgactacaagcagccaatgtttttcctcaacacagtggcagttttcgtgctggttgtggcaaagctgccaaatatgcacaaggtccgcatatttggaatcaatgcagacatctgagggccccttcaggaagtatgcggatgtttgcttgcgccaagctctgaaagagggacgtggaacaagtgaatgctttgcaaaggtgactcagtcgccgcctgtaatatctgtgtaggtgtagaaagaactgtaaatgttactctagcatacaaagtttgcctgcagactgatgtgtgtttgttgttgcagcttcttcctttagagttggttcactggaagtgtagtctgtcagtgcaatgaacacagcagtatgtggataagaaaagagtgtagcaaatgctgtttgctgtcttgtatagaatggaaccctgaaatcagtgaaatcatctttctgtgggtagccccatggaactgctacttcctctgttttttaagtagatttaagaaattgaaaagt

SEQ ID NO: 2867 - DNA, 1129 bp, Setaria italica
cccactggatcagacagcggtatcacgacttcacgagcaagcggagcaccgcacccaacccaaaccaccaagccgaacgcagccgccatccatttccgcaccaccgcatcgtccgcgcacgccgccgccgtcagtcacacgcacgccgcacgcatccggcacagcacgcgcacgccccgcggaagccccgagatccgacgatccgccggccgccgtcgaccgaggtcggggagcgaagatgggccggagaggggagccctactacgtcgaggcggcgccgccggtggacgtcaacaagaacaccgagtggttcatgtacccgggcgtctggaccacctacatcctgcttctcttcttcgcttggctcctcgtcctctccgtctccggctgctccccgggggcggcctggaccgtcgtcaacctcgcgcacttcgccatcacttatcacttctttcattggaagaaaggaacaccgtttgctgctgatgaccagggcatctacagccgattgacatggtgggagcaaattgacaatggccagcagcttactcggaacagaaagtttttgactgtggttcctgtggttctgtacctgattgcatcacacttgaccgactacaagcagccaatgtttttcctcaacacagtggcagttttcgtgctggttgtggcaaagctgccaaatatgcacaaggtccgcatatttggaatcaatgcagacatctgagggccccttcaggaagtatgcggatgtttgcttgcgccaagctctgaaagagggacgtggaacaagtgaatgctttgcaaaggtgactcagtcgccgcctgtaatatctgtgtaggtgtagaaagaactgtaaatgttactctagcatacaaagtttgcctgcagactgatgtgtgtttgttgttgcagcttcttcctttagagttggttcactggaagtgtagtctgtcagtgcaatgaacacagcagtatgtggataagaaaagagtgtagcaaatgctgtttgctgtcttgtatagaatggaaccctgaaatcagtgaaatcatctttctgtgggtagccccatggaactgctacttcctctgttttttaagtagatttaagaaattgaaaagtcgaac

SEQ ID NO: 2868 - DNA, 915 bp, Zea mays
acgagacagttgtcatctcactccaccgcaccgtccgcgcacggctcgccggccgtcagtcacagcacgacaccatccgttcctggccttcctcctgtgcaactaccactcgcgtcaccgcggaaattaaccccgaaatccagcgccttcggcacgagcacgatcaggcctgcgcaggagatggggcggagaggggagccctactacgtcgaggcggtgccgccggtggacgtgaacaagaacacagagtggttcatgtacccgggcgtctggaccacctacatcctcatgctcttcttcgcctggcttctcgtcctctccgtctctggttgctccccgggggcagcctggaccgtcgtcaacctcgcgcacttcgccatcacttaccacttcttccattggaagaaaggaaccccttttgctgctgatgaccaaggcatctacagcagattgacatggtgggagcaaattgacaatggtcagcagcttactcggaacaggaagtttttaactgtggtacctgtggtgctgtatctgattgcgtcgcacttgaccgactacaagcagccgatgttttttctcaacacgattgcagttttcgtgctggtcgtggcaaaattgccgaacatgcacaaggtccgcatatttggaatcaatgcagacatctgaggacagctgcaagaagtacatggatgcgatgccatgatgttatgaacaagcagtgtgtttctcaaactcgacacaactgcctgtaatatatgtacaggtttagaaagaactgtaaatgaatgatactctaggatacaaggtttgcctgcagactgctctgtgttgccgttgccgctgctttcttttgagtttcactgaaagtggaaaccataacttgggtaaatgtaacgttcggttttcagcttc

SEQ ID NO: 2869 - DNA, 942 bp, Pennisetum glaucum
agcaggcgcacccaaacggaacctcccccaagccgaacgcagcagccaaccatttcggcaccaccgcatcgtccgcacccgcccgcccgccgccgtcagtcccgcgcacgccgcacgcgtctgtcgcagcacacgcacgccgccacctcctccctgatcctccccctcccgactcccgtgaacccgacccaccgcggaaacaccgagatccgccgaccgccggactggggaggaagatgggccggagaggggagccctactacgtggaggcggcgccgccggtggacgtcaacaagaacaccgagtggttcatgtaccccggcgtctggaccacctatatcctgctgctcttcttcgcctggctcctcgtcctctccgtctccggctgctccccgggggccgcatggaccgtcgtcaacctcgcgcacttcgccatcacttatcacttctttcattggaagaaaggaaccccgtttgctgctgatgaccagggtatctacagccgattgacatggtgggagcaaattgacaatggccaacagcttactcggaacagaaagtttttgactgtggttcctgtggttctgtatctgattgcatcacacttgaccgactacaagcagccaatgtttttcctcaatacagtggcagttttcgtgctggttgttgcaaagcttccaaacatgcacaaggtccgcatatttggaatcaatgcagacatctgagggccccttcaggatgtatgcggatgtttgcttctgccaagctctgaaagagggatgtgtaagaagtgaatgctttgcaaaggtgactcagtcgcagcctgtaatatctgtgtaggtgtagaaacaactgtaaatgttactctagcatacaaagtttgcctgcagactgctgtgtgtttgtcgctgcagctttctcctttgagttgtttcacttgga

SEQ ID NO: 2870 - DNA, 685 bp, Avena sativa
gaacccaaacaaacccatacggcgaaccaaccagatcacagccacaccacaccaccgctccgctcgtcctgagatccgatgaaccggccgaggatggggcggcgaggggcgtactacgtggaggcggcgccgccggtggacgtgaacaagaacaccgagtggttcatgtaccccggggtctggaccacctacatcctgctcctcttcttcgcctggctcctcgtcctctccgtctccggctgctcccccggggccgcgtggaccgccgtcaacctcggacacttcgccatcacctaccactttttccattggaagaaaggaactctgtttgctgctgatgatcaaggcatctacaacagattgacttggtgggagcaaattgacaatgggcagcagcttactcgtaataggaagttcttaaccgtggtacctgttgtcctgtatctgattgcgtcacacttgaccgactacaatcagccaatgctcttcctcaacactgtagcagttttagtgcttgtcgtagctaagctgccaaacatgcataaggtccgtattttcggtatcaatgcagatatctgagacaccgctgcaagaacaatatgaatttcaccaatgcagaacaatgtcaagacagggtggtgcaaccgtagtactgtcatctgtaacctctgtatataggttttaa

SEQ ID NO: 2871 - DNA, 1073 bp, Saccharum officinarum
cagtccgcagtccgcaaccagagcaaaagcccaccacccaaccaaacccagacggcaaccggtgtcatctctcatcactccaccgcatcatcagcgcacggctcgccggccgtcactcacacacccagcacgacaccatcggcccctggccttcctcccgtgcacctaccgcacgcgccaccgcggaaagtaaccccgagatccagccccgtcggcacgaccaggcctgcgcagggatggggcggagaggagagccctactacgtcgaggcggcgccgccggtggacgtgaacaagaacacagagtggttcatgtacccgggcgtctggaccacctacatcctcctgctcttcttcgcctggctcctcgtcctctccgtctccgggtgctccccgggggctgcctggaccgtcgtcaacctcgcgcacttcgccatcacttaccacttcttccattggaagaaaggaaccccttttgctgccgatgaccaaggcatctacagcagactgacatggtgggagcaaattgacaatggtcagcagcttactcggaacagaaagtttttgactgtggttcctgtggtgctgtatctgattgcatcgcacttgaccgactacaagcagccgatgtttttcctcaatacgatggcagtttttgtgctggttgtggcaaaattgccgaacatgcacaaggtccgcatatttggaatcaatgcagacatctgaggaccactgcaagaagtgcatgggcgatgccatgatgttatgaagagctacacagaacaagcagtgtgtttatcaaactcggcacaactgcctgtaatatatgtacgggtttagaaagaactgtaaatgttactctagcatacaaggtttgcctgcagactgctgtgtgttgttgccgttgctgctttctttttagtttcactggaagtggaaacggtaacttacgtaaacaaccaccggcatgtggataagtgtgtaacagttggtaagatggaacactgtgtagcaaatgctggttggtatttggtcagatggaacccagaaatcagtaaatctccccccacaccc

SEQ ID NO: 2872 - DNA, 1091 bp, Panicum virgatum
cagaggcggtcgcggtatcacaagcgagcacccagccaaaccgaacgcagccggcaaaccatttccgcaccaccgcatcgccctccgccgccagtcgcgcgcccgcgtccgccaccggcaccggcaccggcacagcaagccacgcctcctccctgtccctgaccatcccgcgcgcccgaccccgccgcgaaagccccgagatccgccgcgccgccgtcgatcgaccgggggcctgagaaagaagaagatggggcggagaggggagccctactacgtggaggcggcgccgccggtggacgtcaacaagaacaccgagtggttcatgtacccgggcgtctggaccacctacatcctgctcctcttcttcgcctggctcctcgtcctctccgtctccggctgctccccgggggccgcctggaccgtcgtcaacctcgcgcacttcgccatcacttaccacttcttccattggaagaaaggaaccccatttgctgctgatgaccagggcatctacagccgattgacatggtgggagcaaattgacaatggccagcagcttactcggaacagaaagtttttaactgtggtacctgtggtcctgtacctgattgcatcacacttgaccgactacaagcagccgatgtttttcctcaacaccgtggcggttttcgtgctggttgtagcaaagctgccaaacatgcacaaggtccgcatatttggaatcaatgcagacttctgatggccaattcaggaagtacatggattcgcatgctccaagttctgaaagagggacgtggaacaagtgaagtcgccgcctgtaatatctgtgtaggtgtagaaagaactgtaaatgttactctagcatacaaggtttgcctgcagactgctgtgtgtttgttgtcgcagcttcttcctttagagttggttcactggaagtcttcctttagtgcatggaacacagcagtatgtggataagaaagtgtgttgcaaatgctgtttgccgtcttgtatataatggaaccaagctgatactccctctttgttttgagttggtttttttaaaaggtcgaacttcacaaattctggtaagtcaa

SEQ ID NO: 2873 - DNA, 449 bp, Euphorbia peplus
aatgtatgtaaaagcggtgccgccgacggatttgaataggaacacggagtggtttacgtatccaggggtttggactacgtatatgctcatggttttcatctcttggttgattgtcttatctctctttggttgctctcctggcatggcttggaccattgttcatctcgctcattttgttattacctaccacttctttcactggaagaagggaactccttttggcgatgaccagggtatctacaacgggttgacttggtgggagcaaattgaaaatggcaagcaactcactcgcaacagaaagtttttgaccgttgtacctgttgtgctgtatctaatagcctcacacacaacagactatcaaaatccaatgctcttcttcaacacattagcagtattcgtgctagtggtagctaagttcccccatatgcacaaagttcgcatattcggta

SEQ ID NO: 2874 - DNA, 1287 bp, Cephalotaxus harringtonia
ggtttagccaggtcacacggtcgaaacctggctaaaccaaaaccaaactccattggacaaagtctagcgtactggtatgtggcgcttgataataagactatttttccatcgtctcgctttgaagtaaagcaattctatgcagtaatattgagatcctggaggattgctaaagaatgaagaatctgtacgtggaggcagtgctaccggtggatttgaacaaaaacacatcgtggtttcaatacccgggggtgtggacaacatatattctcatccttttcttttcatggctcattgttctctcgctcttttcctgcaccgccggaatggcctggacaattgtgcacctcgcgcattcagcggtaacctatcactttttccattggaagaagggcactcctttttcagaagatcagggaatatacaacaagctaacatggtgggaacagatggataatggcaagcagctgacccgtaacaggaaatttttgactgcagttcctctagtattgtacttaattgcatctcacacgactgactacaaatatccttggcttttcttcaacacggttgctgtgattgtcctggttattgcgaagtttccaaatatgcacaaagttcgcattctagggatcaattcagactaccccatttgattgcatgcctgcgggagccatcatgtgtggaccaacaatgttatgatattaagattttcaagtgttgcatctgtatagttctcataagttgtgaatctcagaggtgtggattttcttctgtaccatacaatttggttttgagggcatttcttccgcattatgtataagttcttttgcatgtaaatgaaatttggcaatgccagccttctatgtgaaaatggttacatcaagattttaagagagtaattttagaaaaattgttattgtagaagtctccaagttttatatctgaaaatgtgtggcatcactagagaatatatgtggttgaatcaggtagatacgtgatgattagatggttatcatgtgtctacagtttcttagtttgaacccttggacatggacaaacgccagatggcgacttcagtttgtttgggataatatattcttgatagtaaagtcaaatattgtatgctagatgtgggtgagagacaggaatttgttacaggaattcacatggacataattgatgtacaactgtaactcttggtggaaaagtctttacttttgtttatttgctgagctttatatcccgactatttttcagtcaaataataaatgtaaatttatgtcgcac

SEQ ID NO: 2875 - DNA, 834 bp, Euonymus alatus
gctcagtctcacgcacgaaccgttccagatacctcaaacagcacgaaaccctctttaatctgttccttctcttgctttgcgattctgattatcttctgcaacaaacgaacaggaaagcagaggggttttaggcttagtttcgattggagcgcaattgctatccgtgtgacatagagcgagggagggaaacatgtatgtgaggacggtgccaacgacggatctgaatcggaacacggagtggttcacgtatcctgctgtctggaccacctacatcctcattgtcttcatgtcttggctcatcgttctatccgtcttgggctgctcgcctggcactgcatggaccatcgtccacctcgcacatttcctctttacgtacacttgcttccattggaagaaaggaacgccatttgctgatgaccaaggtatctacaatgggttgacttggtgggagcaaattgaaaacggcaagcaactcacacccaatagaaagtttttgacagttgtgcctcttgtcctgtatttgatagcctcacacacgacagattatcaaacccctatgctcttctttaacacactggcagtatttgtgctggtggttgccaagttcccgaacatgcacaaggtccggatattcggaataaatgccgattactgaaccgtgaaaaggatcttctgttcagtttacagtaatatctagttttgatcatttttgcctttgaatccactgggtcaatctctgtacatctctttaaactgagaaaggaatttcattttccctttacgttgtggatacatacacctgccttgttatgtaatgagaagtattagttccat

SEQ ID NO: 2876 - DNA, 1493 bp, Sorghum bicolor
cgcacgcacgcacggcaccccacctactcctcctccccttcccttagcttccagaaggcggttcggctcgggccggcggcgatggcgcggaagaagatccgggagtacgactccaagcgcctcctccgggagcacctcaagcgcctcgccggcatcgacctccagatcctctccgcgcaggtcacacagtcaacggatttcaccgagcttgcaaaccaggagccatggctctcatctatgaagttggttgtgaaacctgacatgctcttcgggaaacgtgggaagagtggacttgtggccctcaacctagatcttgcccaagttcgccaatttgtcaaggagcggttgggtgttgaggtcgagatgggtggctgcaaagctccgattacaaccttcatagttgagccatttgtgccgcatgaccaagagtattacctttcgattgtatcagaaaggcttggcagcaccattagtttctcagagtgtggaggtattgagatcgaggagaactgggacaaggttaagactatctttcttccgacagagaagcaaatgacacctgacgcatgtgctcctttgatcgccaccttgccattggaggtccgcacaaaaataggtggtttcattagaggtgtattttctgttttccaagacttggatttctcatttcttgagatgaacccattcaccttggtaaatggtgaaccgtatcctctggatatgagaggagaactagatgacacagctgctttcaagaactttaataagtggggtgacattgagttccctctaccttttggaagagttctcagtccctcagaaagctttatccacgaactggatgagaagacaagtgcttctctgaaattcacagtactgaacccaaaaggacgcatttggacaatggttgcaggtggtggtgctagcgtcatatacgcggatactgttggtgatttgggatatgcttcagagctaggaaattatgcagagtacagtggagctcctaaggaggaggaggttctgcagtatgctagagtacttctggattgcgctactgctgatcctgatggccgtaagagagcccttcttatcggaggaggtatcgctaacttcaccgatgttgctgcaacatttaatggcatcattcgggctttaagagagaaggaatccaaattgaaggctgcaaggatgaatatttatgtccggagaggtggtccaaactaccaaactggactcgctaaaatgcgcaccctaggcacggaacttggcgttccaattgaggtctatggaccagaggccaccatgactgggatctgcaaagaagccattgattgcatcatggccgcataaatcacaatgtagttgtgccatttgaagttgcatccgttttgtaccagacgttcaatgtaagcgattgttccggtaaaacagagaacgatcattgtcatgagtaaactcggcctttgtaacacaatttatgcaataatcaagat

SEQ ID NO: 2877 - DNA, 1559 bp, Setaria italica
caccgctagagctctccaccaacccacctgctccccccccccccccccccctcggctttcagaagcctcggcgagcggcggcgatggcgcggaagaagatccgggagtacgactccaagcgcctcctccgggagcacctcaagcgcctcgccggcatcgacctccagatcctctccgcgcaggtcacacaatcaacggacttcactgagcttgcaaaccaggagccatggctctcatctatgaagttggtcgtgaagcctgacatgctgtttggtaagcgtgggaagagcggacttgtggccctcaacctagaccttgcccaagttcgccaatttgttaaggagcggttgggagttgaggttgagatgggtggctgcaaagctccaattacaaccttcatagttgagccgtttgtgccccatgatcaagagtactacctttcaattgtatcagaaaggcttggctgcaccattagtttctctgagtgtggaggtattgagattgaggagaactgggacaaggttaagacaatctttcttcccacagagaagcaaatgacacctgatgcatgtgctccgttgattgccaccctgccactggaggtccgcacaaaaataggtgatttcattagaggtgtattttctgttttccaagacttggatttctcatttcttgagatgaacccatttaccttggtaaatggtgaaccatatcctctggatatgagaggagaactagatgacacagccgctttcaagaacttcaataagtggggtaacattgagttccctctacctttcggaagagttctcagtccctcagaaagctttatccatgaactggatgagaagacaagtgcttctctgaaattcacagtattgaacccaaaaggacgcatttggacaatggttgcaggtggtggtgctagtgtcatatatgctgatacggttggagatttgggttatgcttcagagctaggaaattatgcagagtacagtggagctcccaacgaggaggaggttctgcagtatgctagagtggttctggattgtgctactgctgatcctgacggtcgcaagagagcccttctcattggaggaggtattgctaacttcactgatgttgctgccacatttagtggcatcattcgggctttaagagagaaggaatccaaattgaaggccgcaaggatgaacatttacgtccggagaggcggtccaaactaccaaaccggactcgcgaaaatgcgcactcttggtgcggaacttggtgtcccaattgaggtgtacggaccagaggcgaccatgactgggatctgcaaggaagccattgaatgcatcatggccgcgtaaaccacgttgcgcaataatcaagatcttggcttgggacgtgaatgtgtaatgcagttgtggtgatccaccggattgcagtgttcctggccgtgctggcatcctataccgtctctgttctttcgagtgaaacagagaacgatcattgttgtgagtaaactctacctttgtaacacagttacgcaataatcaagatcttggcttgggacg

SEQ ID NO: 2878 - DNA, 1967 bp, Setaria italica
cacggcgcacacgagtcccgacgtcgccgttggccaccccgtccgaacgctcgctcaccgctagagctctccaccaacccacctgctccccccccccccccccccctcggctttcagaagcctcggcgagcggcggcgatggcgcggaagaagatccgggagtacgactccaagcgcctcctccgggagcacctcaagcgcctcgccggcatcgacctccagatcctctccgcgcaggtcacacaatcaacggacttcactgagcttgcaaaccaggagccatggctctcatctatgaagttggtcgtgaagcctgacatgctgtttggtaagcgtgggaagagcggacttgtggccctcaacctagaccttgcccaagttcgccaatttgttaaggagcggttgggagttgaggttgagatgggtggctgcaaagctccaattacaaccttcatagttgagccgtttgtgccccatgatcaagagtactacctttcaattgtatcagaaaggcttggctgcaccattagtttctctgagtgtggaggtattgagattgaggagaactgggacaaggttaagacaatctttcttcccacagagaagcaaatgacacctgatgcatgtgctccgttgattgccaccctgccactggaggtccgcacaaaaataggtgatttcattagaggtgtattttctgttttccaagacttggatttctcatttcttgagatgaacccatttaccttggtaaatggtgaaccatatcctctggatatgagaggagaactagatgacacagccgctttcaagaacttcaataagtggggtaacattgagttccctctacctttcggaagagttctcagtccctcagaaagctttatccatgaactggatgagaagacaagtgcttctctgaaattcacagtattgaacccaaaaggacgcatttggacaatggttgcaggtggtggtgctagtgtcatatatgctgatacggttggagatttgggttatgcttcagagctaggaaattatgcagagtacagtggagctcccaacgaggaggaggttctgcagtatgctagagtggttctggattgtgctactgctgatcctgacggtcgcaagagagcccttctcattggaggaggtattgctaacttcactgatgttgctgccacatttagtggcatcattcgggctttaagagagaaggaatccaaattgaaggccgcaaggatgaacatttacgtccggagaggcggtccaaactaccaaaccggactcgcgaaaatgcgcactcttggtgcggaacttggtgtcccaattgaggtgtacggaccagaggcgaccatgactgggatctgcaaggaagccattgaatgcatcatggccgcgtaaaccacggtatagtttctcccattgcagttgcacccgttttgcaccagacgttcaatgtaagcgattgttcgagtgaaacagagaacgatcattgttgtgagtaaactctacctttgtaacacagttgcgcaataatcaagatcttggcttgggacgtgaatgtgtaatgcagttgtggtgatccaccggattgcagtgttcctggccgtgctggcatcctataccgtctctgttctttcgagtgaaacagagaacgatcattgttgtgagtaaactctacctttgtaacacagttacgcaataatcaagatcttggcttgggacgtgaatgtgtaatgcagttgtggtgatccaccggattgcagtgttcctggccgtgctggcatcctataccgtctctgttcttgtgtcgtgtgtttcagtgtgttggagccttgtgctgtgtatttctcggttgagactctacggttgtagccaggcaaggtcctgagattttgggggccagggaccgaaattatatgggaccttttaataattaaaaatgttactccttccgtcct

SEQ ID NO: 2879 - DNA, 1568 bp, Pennisetum glaucum
gcgcctcgccgagcagatggggtgggtggccgcgcacggcgaacacgagttccgacacacaacaggtcgccgccgtttgccgccccgtccgcacgctcgctcgctcaccaccgccagagctcttccacccaacccatctgctcggcgatggcgcggaagaagatccgggagtacgactccaagcgcctcctccgggagcacctcaagcgcctcgccggcatcgacctccagatcctctccgcgcaggtcacacaatcaacggatttcactgagcttgcgaatcaggagccgtggctctcatctatgaagttggttgtgaagcctgacatgctgtttggtaaacgtgggaagagcggacttgtggccctcaacctagaccttgcccaagttcgtcagtttgttaaggagcggttgggagttgaggttgagatgggtggctgcaaagctccaattacaaccttcatagttgagccttttgtgccccatgaccaagagtactacctttcgattgtatcagaaaggcttggctgcaccattagtttctctgagtgtggtggtattgagattgaggagaactgggacaaggttaagacaatctttcttcccacagagaagcaaatgacacctgatgcatgtgcgccgttgattgccaccctgccactggaggtccgcacaaaaataggtgatttcattagaggagtattttctgttttccaagatttggatttctcatttcttgagatgaacccattcaccttggtaaatggtgaaccatatcctctagatatgagaggagaactagatgacacagccgctttcaagaactttaaaaagtggggcaacattgagttccctctaccttttggaagagttctcagtccatcagaaagctttatccatgaactggatgagaagacaagtgcttctctgaaatttacagtattgaacccaaaaggacgcatctggacaatggttgcaggtggtggtgctagtgtcatatatgctgatacagttggagatttgggatatgcttcagagctaggaaattatgcagagtacagtggagctcccaacgaggaggaggttctgcagtatgctagagtgcttctggattgtgctactgctgatcctgatggccgcaagagagcccttctcatcggaggaggtatcgctaacttcacagatgtcgccgccacatttagtggcatcattcgggctttaagagagaaggaatccaaattgaaggccgcaaggatgaacatctatgtccggagaggcggtccaaactaccagaccggacttgcgaaaatgcgcactcttggcgcggaacttggtgtcccaattgaggtgtacggaccagaggcgaccatgactggaatctgcaaggaagccattgaatgcatcacagccgcgtaaaaccacggtatagttgctcccgttgcggttgcacccattttgtaccagacgttcaatgtaagcgattgttcgagtggaacacagaacgatcattgttgtgagtaaactctgcctttgtaacaaagttatgcaataatgaagatcttggcttg

SEQ ID NO: 2880 - DNA, 1752 bp, Saccharum officinarum
catatgaaacttaagtacggtccggatccgcgagtcgacccacgcgtccgcaccaccggtcgcccgcacgctcgctgctgcagctacgcacgcacgcacggcacccacctacttctccccttagcttccagaaggctcggctccggccggcggcgatggcgcggaagaagatccgggagtacgactccaagcgcctcctccgggagcacctcaagcgcctcgccggcatcgacctccagatcctctcggcgcaggtcacacaatcaacggatttcactgagcttgcaaaccaggagccatggctctcatctatgaagttggttgtgaaacctgacatgctcttcgggaaacgtgggaagagtgggcttgtggccctcaacctagatcttgcccaagttcgccaatttgtcaaggagcggttgggtgttgaggtcgagatgggtggctgcaaagctccaattacaaccttcattgtcgagccatttgtgccacatgaccaagagtattacctttctattgtatcagaaaggcttggcagcaccattagtttctcagaatgtggaggtattgagattgaggagaattgggacaaggttaagactatctttcttcccacagagaagcaaatgacacctgatgcgtgtgctccattgatcgccaccctgccattggaggtccgcacaaaaataggtgctttcattagaggtgtattttctgttttccaagacttggatttctcatttcttgagatgaacccattcaccttggtaaatggtgaaccgtatcctctggatatgagaggagaactagatgacacagctgctttcaagaactttaataagtggggtaacattgacttccctctaccttttggaagagttctcagtcccgcagaaagctttatccatgagctggatgagaagacaagtgcttctctgaaattcacggtactgaacccaaaaggacgcatttggacaatggttgcaggtggtggtgctagtgtcatatacgcggatactgtcggagatttgggatatgcttcggagctaggaaattatgcagagtacagtggagctcccaaagaggaggaggttctgcagtatgctagagtggttctggattgcgctaccgctgatcctgatggccgtaagagggcccttcttatcggaggaggtattgctaacttcaccgatgttgcggcaacatttaatggcatcattcaggctctaagagagaaggaatccaaattgaaagctgcaagaatgaacatttatgtccggagaggtggtccaaactaccaaactggactcgctaaaatgcgcacgctaggtgcggaacttggcgttccaattgaggtctatggaccagaggcgaccatgactgggatctgcaaagaagccattgattgcatcatggccgcgtaaatcatagtgtggttgtgccatttgaagttgcatccgttttgtaccagacgttcaatgtaagcgattgttccagtaaaacagagaatgatcattgtcatgagtaaactcggcctttgtaacaagcaataatcaagatcttggtttggggttctctgccacccttctagggtgagccagtgaggtgtgattgtataatgcacttgtgatccccagattgcgtgttcatggtattttctaggatcatgtattgtctcttgcagtcttgctgttttgggttatttttctgcgtgtgctgtttatccttagttgagagttgtagtgtacaata

SEQ ID NO: 2881 - DNA, 1551 bp, Echinochloa colona
gacgcgcacggcgcacccgaatcccgagcgcacacaacaacacaggtcgtcgccttcgccgcacgcacgctcgccgctcgagagctctccacccacccacctgctcctgccctccgcttccagaaggttcggccggcggcggcgatggcgcggaagaagatccgggagtacgactccaagcgcctcctccgggagcacctcaagcgcctcgccggaatcgacctccagatcctctccgcgcaggttacacaatcaacagatttcactgagcttgcaaaccaggagccatggctctcatctatgaagttggtcgtaaaacctgacatgctgtttggtaaacgtgggaagagcggacttgtggccctcaacctagaccttgctcaagttcgccaatttgtcaaggagcggttgggagttgaggtcgagatgggtggctgcaaagctccaattacaaccttcatagttgagccgtttgtgccccatgatcaagagtactacctttcgattgtatctgaaaggcttggctgcaccattagtttctctgagtgtggaggtattgagattgaggagaactgggacaaggttaagacaatcttccttcccacagagaaacaaatgacacctgatgcatgtgctccgttgattgccaccctgccattggaggtccgcacaaaaataggcgatttcattagaggtgtattttctgttttccaagacttggatttctcatttcttgagatgaatccattcacattggtaaatggtgaaccgtatcctctggatatgagaggagaactagatgacacagctgctttcaagaacttcaataaatggggtaacattgagtttcctctacctttcggaagagtcctcaatccctcagaaagctttatccatgaactggatgagaagacaagtgcttctctgaaattcacagtattgaacccaaaaggacgcatttggacaatggttgcaggtggcggtgctagtgtcatatatgctgatacggttggagatttgggatatgcttcggagctaggaaattatgcagagtacagtggagctcccaatgaggaggaggttctgcagtacgctagagtggttctggatactgctaccgctgatcctgatgggcgcaagagagcccttctcatcggaggaggtattgctaacttcaccgatgtcgccgccacatttagtggcatcattcgggctttaagagagaaggaatccaaattgaaggccgcaaggatgaacatttacgtccggagaggcggtccaaactaccaaaccgggctcgcgaaaatgcgcactcttggtgcagagcttggtgttcccattgaggtgtatggaccagaggcgaccatgaccgggatctgcaaagaagccattgaatgcatcatggccgcataaaccacggtatagttgcgctgcttgcagttgcatccattttgtaccaaaagttcaatgtaagtgattgttcgagcgaaacagagaagcatcattgttgtgagtaaactccacctttgtaacgcaataatcaagatcgtg

SEQ ID NO: 2882 - DNA, 1903 bp, Panicum virgatum
accctgcttttcttttcccatgtcattctcccttttccttcccccttcccatccaatgatccaaacgccacctgatagtgccagaccaggtacccctgtgtaatccgtgagtatgtccggcgtcacccctcaccgcaccaacccaaccagatcccatccacccacaaccaaacgaaacgaaaccaaacccagcggggccccacctcccggcgaccgagagaaacccaccggcgggcgcctcccgtctcgtacccgccggccggcctcgctatataagccgcccgccgcggccgcggccgcgcacacgagccacgagcacgggtcgtcgccgttcgcccgcgtccgcacgcacgcacgcacgctcgccgccagagcagagctctcgggctctccgcccgccccgctcccagaaggtccgaccgcggcggcgggcgatggcgcggaagaagatccgggagtacgactccaagcgcctcctgcgggagcacctcaagcgcctcgccggcatcgacctccagatcctctccgcgcaggtcacacaatcaacggatttcactgagcttgcaaaccaggagccatggctctcatctatgaagttggttgtgaaaccagacatgctgtttggtaaacgtgggaagagtggacttgtggccctcaacctagaccttgcccaagttcgccaatttgttaaggagcggttgggagttgaggttgagatgggtggctgcaaagctccaattacaaccttcatagttgagccatttgtgccccatgatcaagagtactacctttcgattgtatcagacaggcttggctgcaccattagtttctccgagtgtggaggtattgagattgaggagaactgggacaaggttaagacaatctttcttcccacagagaagcaaatgacacctgatgcatgtgctcctttgattgccaccctgccattggaggtccgcacaaaaataggtgatttcattagaggtgtattttctgttttccaagacttggatttctcatttcttgagatgaacccattcaccttggtaaatggtgaaccgtatcctctggatatgagaggagaactagatgacacagccgctttcaagaacttcaataagtggggtaacattgagttccctctacctttcgggagagttctcagtccctctgaaagctttatccatgaactggatgagaagacaagtgcttctctgaaattcacagtattgaacccaaagggacgcatttggacgatggttgcaggtggtggtgccagtgtcatatatgctgatacggttggagatttgggatatgcttcagagctaggaaattatgcagagtacagtggagctcccaacgaggaggaagttctgcagtatgctagagtggttctggattgtgctactgctgatcctgacgggcgcaagagagcccttctcattggaggaggcatcgctaacttcaccgacgtcgctgccacatttagtggcatcattcgggctttaagagagaaggaatccaaattgaaggctgcaaggatgaacatttacgtccggagaggtggtccaaactaccaaaccggactcgcgaaaatgcgcactcttggtgcagaacttggtgttccaattgaggtgtacggaccagaggcgaccatgactgggatctgcaagcaagccattgaatgcatcatggctgcgtaggctaccgtatagttgcaccttctgcagttgcacccgttttgtactttgaatgcaagcgattgttcgagtgaaacagagaatgatcattgttgtgtaaactctacctttgtaccacaattgctcaataatcgagatcttggcttgggatgtgaatgtgtatggtcgtgctggcatcctatactgtctgtggttctgtcgtg

SEQ ID NO: 2883 - DNA, 1545 bp, Cynodon dactylon
ggggacggccagagtttcgacctgctctcgcagcgcaccggaacgccgcacgctcacctactctcgctcttccgctacaaggaagctccggccggcggccatggcgcggaagaagatccgggagtacgactccaagcgcctcctccgggagcacctcaagcgcctcgccggcatcgacctccagatcctctccgcgcaggtgaatcaatcaacagatttcactgagcttgcaaaccaggaaccatggctctcatccatgaagttggtcgtgaaacctgacatgctgtttggtaagcgagggaagagtggattggtggccctcaacctagaccttgcccaagttcgccaatttgtcaaggagcggttgggaaatgaggtcgagatgggaggttgcaaagctccaatcacaacctttattgttgagccgtttgtgccccatgatcaagagtactacctttcgattgtatcagaaaggctcggctgcaccatcagtttttcagagtgtggaggtattgagattgaggagaactgggacaaggttaagacgatctttcttcccacagaaaagcaaatgacacctgatgcatgtgctccgttgattgccaccctgccattggaggtccgcaacaaaatcggtgatttcattaggggagtattttctgttttccaagacttggatttctcatttctcgagatgaatccgttcaccttggtgaatggtgagccatatcctttggatatgagaggagaactagacgacacagccgctttcaagaacttcaaaaagtggggtaacattgagttccctctacccttcggaagagtgcttagtccttcagaaagctttatccatgaactggatgagaagacaagtgcttctctgaaattcacagtactgaacccaaaaggacgcatttggacaatggttgctggtggtggtgctagtgtgatttatgcggatacggttggagacttgggatatgcttcagagctaggaaattatgcggagtacagtggagcacccaatgaggaggaggttctgcaatacgctagagttgttcttgattgtgccaccgctgatcctgatggccggaagagagcgctcctcatcggaggaggtatagccaacttcactgatgttgccgctacatttagtggcatcattcgggctttaagagagaaggaatccaaattaaaggctgcaaggatgaacatctatgtgcggaggggtggtccgaactaccaaaccggtcttgctaaaatgcgcactctaggtgcagaactcggtgttccaattgaggtctacggaccagaggcgaccatgactgggatctgcaaacaagccattgattgtatcatggctgcgtaactcacggtgttattgtgctgtttgcggttgcatccattttgtaccagacctttctaatgtataagtggtcgtttgagagttttgagtcaacagtgaacaccagtgttgtgcgagtaaactacccttgtaattgcaagacaattacacaataatctagatcttggtttggagaaaaa

SEQ ID NO: 2884 - DNA, 2314 bp, Panicum virgatum
cccccacaaccaaacgcaaccaaaccaaaccagccggggccccacctcccagcgacagagagaaacccagccgccgcagccgcttcaccggcgggcgcgcctcccctcccgcctcgtacccgccggccgggcctcgctatataaaccccaccgcgccgcggccgcgcacaccggtcccgagcacgggtcatcgccgtctgcccgcgtccgcacgcacgcacgctcgctcacctccagagcagagcgctccggctccgcttgccccgctcccagaaggtccggccgcggcggcgggcgatggcgcggaagaagatccgggagtacgactccaagcgcctcctccgggagcacctcaagcgcctcgtcggcatcgacctccagatcctctccgcgcaggtcacacaatcaacggatttcactgagcttgcaaaccaggagccatggctctcatctatgaagttggtcgtgaagccagacatgctgtttggtaaacgtgggaagagtggacttgtggccctcaacctagaccttgcccaagttcgccaatttgttaaggagcggctgggagttgaggtcgagatgggtggctgcaaagctccaattacaaccttcatagttgagccatttgtgccccatgatcaagagtactacctttcgattgtatcagaaaggcttggctgcacaattagtttctccgagtgtggaggtattgagattgaggagaactgggacaaggttaagacaatctttcttcccacagagaagcaaatgatacctgatgcatgtgctcccttgattgccaccttgccattggaggtccgcacaaaaataggtgatttcattagaggtgtattttctgttttccaagacttggatttctcatttcttgagatgaacccattcaccttggtaaatggtgaaccatatcctctggatatgagaggagaactagatgacacagccgctttcaagaacttcaataagtggggtaacattgagttccctctacctttcggaagagttctcagtccctcagaaagctttatccatgaactggatgagaagacaagtgcttctctgaaattcacagtattgaacccaaaaggacgcatttggacgatggttgcaggtggtggtgccagtgtcatatatgctgatacggttggagatttgggatatgctttggagctaggaaattatgcagagtacagtggagctcccaatgaggaggaggttctgcagtatgctagagtggttctggattgtgttactgctgatcctgacgggcgcaagagagcccttctcattggaggaggcatcgctaacttcaccgacgtcgctgccacatttagtggcatcattcgggctttaagagagaaggaatccaaattgaaggccgcaagggtgaacatttacgtccggagaggtggtccaaactaccaaaccggactcgcgaaaatgcgcactcttggtgcagaacttggtgttccaattgaggtgtatggaccagaggcgaccatgactgggatctgcaagcaagccattgattgcatcatggctgcgtaggctgccatatagttgcaccttctgcagttgcatccgttttgtactttgaatgcaagcgattgttcaagtgaaaacagagaactatcattgttgtgagtaaactctgcctttgtaccacaattattcaataatcaagatcttggcttgggatgtgaatgtgtatggccgtgctggcatccatggccgtgctggcatcctatactgtgtggttttctgtagtgtgtttcccattttgtgtggagcctgtgctactgtatttctcagttgaaactgtaccagaaatgtgtatggttgcagctacatcagaaatcagatgcggcgctgtggtttccagaattccagagcaagatctgcgctcatcttcatggactgttccagctgtgccgttgcatcatcagcgttccgcttccgccgttccggcgttccgtgagcaaagcgcacacttcagtccaaccgttgtgacacaaggagcagaggcctcagcatgtggcatctgcttggaacagcaagccgttcatcgaccaaatctgaaccacctcgtggccatttgcgggctgcggcgtccctgccaattatgctgttgccgtttggctcgccgcgttctagccaagattatggtggaacagtgctatgcaggaggcctgacctttttcagaaaaaaaccttaattttttcttcataatttcgtggtactccacaagtatttttttggagatggaaaaggtttccgttaaactgaggccggtgt

SEQ ID NO: 2885 - DNA, 1770 bp, Oryza sativa
gcacgcgacccaagccgatccgcccgcacccgcacacacatcgctcggtcgaaggaggaggttctagaaacttctggaagcggcggaggtgtggggagagagagagagagagagagagagagagagaggcagagagccatggcgcggaagaagatccgggagtacgactccaagcgcctcctaagggagcacctcaagcgcctcgccgccatcgacctccacatcctctccgcccaggtcacggaatcaactgatttcacagagctcgtcaaccaagagccatggctctcgtctatgaagttggttgtgaaacccgacatgctgtttggcaaacgtgggaagagtggccttgtggccctcaacctagatcttgctcaagtccgccaattcgtcaaagagcggttgggagttgaggttgagatgggtggctgcaaggctcctattacaacattcatagttgagccatttgttccacatgatcaagagtactatctttctattgtatcagagaggcttggttccaccattagcttctcggagtgtggaggtattgagatcgaggagaactgggataaggtcaagacagtttttcttcccaccgagaaagcaatgacacctgatgcgtgtgctccattgattgccaccctaccgttagaggttcggacaaaaataggtgatttcatcagaggtgtatattctgttttccaagacttggatttctcattccttgagatgaatccgttcaccatggtgaatggggaaccatatcctctagacatgagaggagaattggacgacacagctgcctttaagaactttaagaagtggggaaacattcagttccctctgcctttcggaagagtcctcagcccctctgaaagctttatccatgaactggatgagaagacaagctcatcgctcaaattcacagtcctgaacccgaaagggcgcatttggacaatggttgcaggtggtggtgctagtgtcatatatgctgatactgttggagatttgggatatgcgtcagagcttggaaattatgcagaatacagcggcgctcccaacgaggaggaggttctgcagtatgctagagtggttttggattgtgccactgctgatcctgatggccgtaagagagctcttctcattggaggtggtatagcgaacttcactgatgtcgctgctacattcagtggcatcattcgagctttaagagagaaggaatccaaattgaaggctgcacggatgaacatttacgttcggagaggtggtccaaactaccaaactggccttgccaaaatgcgtacactaggtgcagaacttggtgttccaattgaggtatatggaccagaggcaacaatgactggaatctgcaagcaagccattgattgcatcatggctgaagcataattcagacaactatttgcgctgttcccagcttgagtccattttgtttcagaaattgtcagtgtgaggtgttgcctttctctctgagggaatgtgtgctgttgttggtgtaaaacaaaacaaagaaagatcgtattgttagaataaactacatctgtaagtttgtaacgtaattacgcaataatgttaatgtttgtttctagttctgaattctctgtgccttggttggtggccttatccaccaaactcaaagagggttcttgattttgtcatgtatgagagacagtgaaatggagggcttagtgacaggaactgcgttgttgtggcttgattattgatgtagtcatatggtcatatattcat

SEQ ID NO: 2886 - DNA, 1773 bp, Avena sativa
agcccaagctccggcgcgcctgtacgaaccaccactgccacagcttccacctactcttcccccatcctccgtctccagagtccagaagcttcggcgaggccatggcgcggaagaagatccgagagtacgactccaagcgcctcctcagggagcacctcaagcgcctcgccggcatcgacctccagatcctctccgcgcaggttacagaatcaacggatttcacggagcttgcaaaccaggagccatggctctcatctatgaagttggttgttaaaccagacatgctgttcggtaaacgtgggaagagcggccttgtggccctgaacctagatcttgctcaagtccgccaatttgtcaaggagcggttaggagttgaggttgagatgggcggctgtaaggctccaattacaacgttcatagtcgagccatttgtgccacatgatcaagagtattatctctcaattgtatcagacaggcttggttgcaccattagcttttcagagtgtggaggtattgagatcgaggagaactgggataaggttaagacgatctttcttcccacagagaagacaatgacacttgatgcgtgcgctccactgattgccacccttccattggaagtccgcacgaaaataggtgatttcattagaggatcgttttctgttttccaagacttggatttctcatttatggagatgaatccattcaccctggtaaatggggaaccataccctctggacatgagaggtgaactggatgacacagctgctttcaagaactttaagaagtggggtaaccttgagttccctctacctttcggaagagtcatgagcccctcagaaagttatatccatgaattggatgagaagacaagtgcatcactgaaattcaccgttctgaacccaaaaggtcgcatttggacaatggttgcaggtggtggtgcgagtgtcatatacgctgacacggttggtgatttgggatatgcttcagagctaggaaattatgcagagtacagtggggctcccaaagaggaggaggttttgcagtatgctagagtggttttggattgtgtcaccgctgatcctgatggccggaagagagcccttctcattggagggggtatagcaaacttcactgacgttgctgctacatttagtggcatcattcgggctttaagagagaaggaatccaaattgaaggctgcacgggtgaatatttatgttcggagaggtggtccaaactaccaaactggactcgccaaaatgcgtgctctaggtgcagagcttggtcttccaattgaggtctatggaccagaggccacaatgactggaatctgcaagcaagccattgattatgtcatggcggaagcataattcatcatcatagtatagttcaaatgtttgccgttgtgtccattctgtctcatataaattgagtgaaacaaacggagaaacataggttttgtggggggagaaattactggcataacacaataatacatgtatcttgctttgcagttttgattcctttgtgttgatgtacgatgcagtctccgataaacaccttcatacagtgttcctggatctgttgtgtgcccaacatcctggtggagcggcgtatcatgtctgtggagtatggactacgattctcttcgtgatgtagctaaacatctttgagccgtggggttccaaaaacgcgtgaatgcaaaaacgcagtatattgcaacctcatactttttgaaatctatacgaaatgacactcccttctcgagtt

SEQ ID NO: 2887 - DNA, 1778 bp, Avena sativa
tccggcgcgcctgtacgaaccaccactgccacagcttccacctactcttcccccatcctccgtctccagagtccagaagcttcggcgaggccatggcgcggaagaagatccgagagtacgactccaagcgcctcctcagggagcacctcaagcgcctcgccggcatcgacctccagatcctctctgcgcaggttacagaatcaacggatttcacggagcttgcaaaccaggagccatggctctcatctatgaagttggttgttaaaccagacatgctgttcggtaaacgtgggaagagcggccttgtggccctgaacctagatcttgctcaagtccgccaatttgtcaaggagcggttaggagttgaggttgagatgggtggctgtaaggctccaattacaacgttcatagtcgagccatttgtgccacatgatcaagagtattatctctcaattgtatcagacaggcttggttgcaccattagcttttcagagtgtggaggtattgagatcgaggagaactgggataaggttaagacgatctttcttcccacagagaagacaatgacacttgatgcgtgtgctccactgattgccacccttccattggaagtccgaacgaaaataggcgatttcattagagggtcattttctgttttccaagacttggatttctcttttatggagatgaatccattcaccctggtaaacggggaaccataccctctggacatgagaggtgaactggatgacacagctgctttcaagaactttaagaagtggggtaaccttgattttcctctaccttttggaagagtcatgagcccctcggaaagttatatccatgaattggatgagaagacaagtgcatcactgaaattcaccgttctgaacccaaaaggtcgcatttggacaatggttgcaggtggtggtgcgagtgtcatatacgctgacacggttggtgatttgggatatgcttcagagctaggaaattatgcagagtacagtggggctcccaaagaggaggaggttttgcagtatgctagagtggttttggattgtgtcaccgctgatcctgatggccggaagagagcccttctcattggagggggtatagcaaacttcactgacgttgctgctacatttagtggcatcattcgggctttaagagagaaggaatccaaattgaaggctgcacgggtgaatatttatgttcggagaggtggtccaaactaccaaactggactcgccaaaatgcgtgctctaggtgcagagcttggtcttccaattgaggtctatggaccagaggccacaatgactggaatctgcaagcaagccattgattatgtcatggcggaagcataattcatcatcatagtatagttcaaatgtttgccgttgtgtccattctgtctcatataaattgagtgaaacaaacggagaaacataggttttgtggggggagaaattactggcataacacaataatacatgtatcttgctttgcagttttgattcctttgtgttgatgtacgatgcagtctccgataaacaccttcatacagtgtgcccaacatcctggtggagcggcgtatcatgtctgtggagtatggactacgattctcttcgtgatgtagctaaacatctttgagccgtggggttccaaaaacgcgtgaatgcaaaaacgcagtatattgcaacctcatactttttgaaatctatacgaaatgacactcccttctcgagtttatagcataaaactactagtttactacccaa

SEQ ID NO: 2888 - DNA, 2057 bp, Hordeum vulgare
cacaaccaccgcccgccagcgacccagatcccatctacccagcaccaaactggagcagccagtgaaaccagtgctgcctatatataccccgtcctggtgcgacccgcgcctcaagctccggcgcgccagtactacaatccaccgttaccacagcgtccacctacctgtcctccgcctagagaagcgtcggcgaggccatggcgcggaagaagatccgggagtacgactccaagcgcctcctcaaggagcacctcaagcgcctcgcaggcatcgacctccagatcctctccgcgcaggtgacacaatcaacggatttcacggagctttcaaaccaggagccatggctctcgtcgatgaagttggttgttaaacctgacatgctgtttggcaagcgtgggaagagtggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcacaattagtttctcagagtgtggtggtattgagattgaggagaactgggacaaggttaagacaatctttcttccaacagagaagccaatgacacttgatgcatgtgctccattgattgccactcttcccttggaagtccgcacaaaaataggcgatttcattagagggtcattttctgttttccaagacttggatttctcatttatggagatgaacccattcaccctggtaaatggtgaaccataccctctcgacatgagaggtgaactggatgacacagctgcattcaagaactttaagaagtggggtaacattgagttccctctacctttcggaagagtcctgagcccatcagaaagttatatccatgaactggatgagaagacaagcgcatcactgaaattcactgttcttaacccgaaaggtcgcatttggactatggttgctggtggtggtgctagtgtcatatatgctgacacggttggagatttgggatatgcttcagagctaggaaattatgccgagtacagtggagctcccaaagaggaggaggttttgcattatgctagagtggttttggattgtgccactgctgatcctgatggccggaagagagctcttctcattggagggggtatcgcaaacttcactgatgtcgctgctacattcagtggcatcattcgggctttaagagagaaggaatccaaattaaaggctgcaagggtgaacatttatgttcggcgaggtggtccaaactaccaaactggactcgccaaaatgcgagccctaggatcagagcttggtcttccaattgaggtctatggaccagaggccacaatgactggaatctgcaagcaagccattgattacgtcatggctgaagcatgattcgtcattgtatagttccggtgtttacagttgtgtccattttgttccatatacatttagtataaagaactgttcgtgtgaagcaaacagagaaagatcggttttgtgggggaaaggaactactgttgtaacacaactacgcaataatatatatcttgctttgcggttctgattcctttgggccgaggcacaacgagatcaagataaagcgacccgacttctccaggtttgcagcgtttttgggtctgttgtctccgcaacatcctggtggagcggcgtgtgatgtgtttgcactgtgatttcaggctttcagggtgcaaactttgtacctacttgtgaaaaaatgcagctattccttggcaccaaagaagatgtcttaatcatgtaaaaaaaaaagatatcttaaaagccttgattctacgtgttttcagcgtgagatgcggtgcaaagtacatgctccctttgtcccgaaatatctgtcccaatgacaattttgtaaaaggagttctcagccatttatgtattgaacccgcagtcttgtctacctctccactcagtcgtaaccgcacttgcactcgctgccttgga

SEQ ID NO: 2889 - DNA, 1750 bp, Avena sativa
ccggcgcgcctgtacgaaccaccactgccacagcttccacctactcttcccccatcctccgtctccagagtccagaagcttcggcgaggccatggcgcggaagaagatccgagagtacgactccaagcgcctcctcagggagcacctcaagcgcctcgccggcatcgacctccagatcctctccgcgcaggttacagaatcaacggatttcacggagcttgcaaaccaggagccatggctctcatctatgaagttggttgttaaaccagacatgctgttcggtaaacgtgggaagagcggccttgtggccctgaacctagatcttgctcaagtccgccaatttgtcaaggagcggttaggagttgaggttgagatgggtggctgtaaggctccaattacaacgttcatagtcgagccatttgtgccacatgatcaagagtattatctctcaattgtatcagacaggcttggttgcaccattagcttttcagagtgtggaggtattgagatcgaggagaactgggataaggttaagacgatctttcttcccacagagaagacaatgacacttgatgcgtgtgctccactgattgccacccttccattggaagtccgaacgaaaataggcgatttcattagagggtcattttctgttttccaagacttggatttctcttttatggagatgaatccattcaccctggtaaacggggaaccataccctctggacatgagaggtgaactggatgacacagctgctttcaagaactttaagaagtggggtaaccttgattttcctctaccttttggaagagtcatgagcccctcagaaagttatatccatgaattggatgagaagacaagtgcatcactgaaattcaccgttctgaacccaaaaggtcgcatttggacaatggttgcaggtggtggtgcgagtgtcatatacgctgacacggttggtgatttgggatatgcttcagagctaggaaattatgcagagtacagtggggctcccaaagaggaggaggttttgcagtatgctagagtggttttggattgtgtcaccgctgatcctgatggccggaagagagcccttctcattggagggggtatagcaaacttcactgacgttgctgctacatttagtggcatcattcgggctttaagagagaaggaatccaaattgaaggctgcacgggtgaatatttatgttcggagaggtggtccaaactaccaaactggactcgccaaaatgcgtgctctaggtgcagagcttggtcttccaattgaggtctatggaccagaggccacaatgactggaatctgcaagcaagccattgattatgtcatggcggaagcataattcatcatcatagtatagttcaaatgtttgccgttgtgtccattctgtctcgtataaattgagtgaaacaaacggagaaacataggttttgtggggggagaaattactggcataacacaataatacatgtatcttgctttgcggttttgattcctttgtgttgatgtacgatgcagtctccgataaacaccttcataccgtgttcctggatctgttgtgtgcccaacatcctggtggagcggcgtatcatgtctgtggagtatggactacgattcttcaccgtgatgtagctaaacatctttgagccgtggggttccaaaaacgcgtgaatgcaaaaacgcagtatattgcaacctcatactttttgaaatctatacgaaatgacac

SEQ ID NO: 2890 - DNA, 1541 bp, Pseudoroegneria spicata
gcgccccaagctccggcgcgccagtgctacaaaccaccgctaccacagcgtccacctacccctcctccgcctcgagaagcgtcggcgaggccatggcgcggaagaagatccgggagtacgactccaagcgcctcctcaaggagcacctcaagcgcctcgcaggcatcgacctccagatcctctccgcgcaggtcacacaatcaacggatttcacggagctttcaaaccaggagccatggctctcgtccatgaagttggttgttaaacctgacatgctgtttggcaagcgtgggaagagcggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcaccattagtttctcagagtgtgggggtattgagattgaggagaactgggacaaggttaagacaatctttcttccaacagagaagccaatgacacttgatgcatgtgctccattgattgccactcttcccttggaagtccgcacgaaaataggcgatttcattagagggtcattttctgttttccaagacttggatttctcatttatggagatgaacccattcaccctggtaaacggtgaaccataccctctggacatgagaggtgaactggatgacacagctgctttcaagaactttaagaagtggggtaacattgagttccctctaccttttggaagagtactgagcccatcagaaagttatatacatgaactggatgagaagacaagcgcatcactgaaattcacagttcttaacccgaaaggtcgcatttggacaatggttgcaggtggtggtgctagtgtcatatatgctgacacggttggagatttgggatatgcttcagagctaggaaattatgcagaatacagtggagctcccaaagaggaggaggttttgcattatgctagagtggttttggattgtgccactgctgatcctgatggccggaagagagctcttctcattggagggggtatcgcaaacttcactgatgtcgctgctacattcagtggcatcattcgggctttaagagagaaggaatccaaattaaaggctgcaagggtgaacatttatgttcggagaggtggtccaaactaccaaactggactcgccaaaatgcgtgctctaggatcagagcttggtcttccaattgaggtatatggaccagaggccacaatgactggaatctgcaagcaagccattgattacgtcatggccgaagcatgattcgtcattgtatagctccgccatttgcagttgtgttcattttgttccatgtatacatttagtacgaagaactgttcgtgtgaagcaaacggagaaagatcggttttgtcggggaagaaactactattgtaacgcaactacgcaataatatatatcttgctttccggttctgattca

SEQ ID NO: 2891 - DNA, 1540 bp, Avena sativa
ccggcgcgcctgtacgaaccaccactgccacagcttccacctactcttcccccatcctccgtctccagagtccagaagcttcggcgaggccatggcgcggaagaagatccgagagtacgactccaagcgcctcctcagggagcacctcaagcgcctcgccggcatcgacctccagatcctctctgcgcaggttacagaatcaacggatttcacggagcttgcaaaccaggagccatggctctcatctatgaagttggttgttaaaccagacatgctgttcggtaaacgtgggaagagcggccttgtggccctgaacctagatcttgctcaagtccgccaatttgtcaaggagcggttaggagttgaggttgagatgggtggctgtaaggctccaattacaacgttcatagtcgagccatttgtgccacatgatcaagagtattatctctcaattgtatcagacaggcttggttgcaccattagcttttcagagtgtggaggtattgagatcgaggagaactgggataaggttaagacgatctttcttcccacagagaagacaatgacacttgatgtgtgtgctccactgattgccacccttccattggaagtccgaacaaaaataggcgatttcattagagggtcattttctgttttccaagacttggatttctcttttatggagatgaatccattcaccctggtaaacggggaaccataccctctggacatgagaggtgaactggatgacacagctgctttcaagaactttaagaagtggggtaaccttgattttcctctaccttttggaagagtcatgagcccctcggaaagttatatccatgaattggatgagaagacaagtgcatcactgaaattcaccgttctgaacccaaaaggtcgcatttggacaatggttgcaggtggtggtgcgagtgtcatatacgctgacacggttggtgatttgggatatgcttcagagctaggaaattatgcagagtacagtggggctcccaaagaggaggaggttttgcagtatgctagagtggttttggattgtgtcaccgctgatcctgatggccggaagagagcccttctcattggagggggtatagcaaacttcactgacgttgctgctacatttagtggcatcattcgggctttaagagagaaggaatccaaattgaaggctgcacgggtgaatatttatgttcggagaggtggtccaaactaccaaactggactcgccaaaatgcgtgctctaggtgcagagcttggtcttccaattgaggtctatggaccagaggccacaatgactggaatctgcaagcaagccattgattatgtcatggcggaagcataatcatcatcatagtatagttccgatgtttgctgttgtgtccattccgtttcatataaattgagtgaaacaaacagagaaacatcggttttgtggggggagaaattactggcataacacaataatacatgtatcttgctttgcggtttgattcctttgtgttgatgtacgatgcagtca

SEQ ID NO: 2892 - DNA, 1518 bp, Brachypodium distachyon
gtgcccatcgcaacgctaccgcagcttccacctacttctctcccctcttccagttccgctgcttcggtgaggccatggcgcggaagaagatccgggagtacgactccaagcgcctgctcaaggagcacctcaagcgcctcgccggcatcgacctccagatcctctccgcgcaggtcacacaatcaacggatttcacagagcttgtgaaccaggagccatggctctcatctatgaagttggttgttaaaccagacatgctgtttggtaaacgtgggaagagcggccttgtggccctcaacctagatcttgctcaagtccgccaatttgtcaaggagaggttgggagttgaggttgagatgggcggctgtaaggctccaattacaacattcatagtcgagccatttgtgccacacgatcaagagtattatctctcggtcgtatcagacaggcttggttgcaccattagtttctcagagtgtggaggtattgatattgaggagaactgggacaaggttaagactatcgctcttaccacagagaagcctatgacacttgatgcatgcgctccattgattgccacccttccgctggaggtccgcacaaaaataggtgatttcattagaggggtattttctgttttccaagacttggatttctcatttctggagatgaatccattcaccctggtaaatggggaaccatatcctctggacatgagaggtgaactggatgacacagctgctttcaagaactttaagaagtggggtaacattgagttccctctacctttcggaagagtcatgagcccatcagaaagttatatccatgaactggatgagaagacaagcgcctcactgaaattcacagttttgaacccgaaaggtcgcatttggaccatggttgcaggtggtggtgctagtgtcatatatgctgacacggtcggagatttgggatatgcttcggagctaggaaattatgcagagtacagtggagctcccaacgaggaggaggttttgcagtatgccagagtggttttggattgtgccactgctgatcctgatggccgtaagagggctctcctcattggagggggtatagcaaacttcactgatgttgcttcgacatttagtggcatcattcgggctttaagagagaaggaatccaaattaaaggctgcaaggatgaacatttatgttcggagaggtggtcctaactaccaaaccggactcgctaaaatgcgtgctctaggttcagagcttggtcttccaatcgaggtctatggaccagaggccacaatgactggaatctgcaagcaagccattgattgcgtcatgtccgaagcataattcgtcatagtattattctgctgttggcagttgtgtccatgttgtttcacatacatccattgtgaagtactgttagggaaacaaacaaatggaaaaatattggttttgtgtttgggaaaaaaaaactactgtttgtaaggcaaatttcgcaataatcgatgtctctctttgc

SEQ ID NO: 2893 - DNA, 1531 bp, Brachypodium distachyon
ccatcacccatcagtgcccatcgcaacgctaccgcagcttccacctacttctctcccctcttccagttccgctgcttcggtgaggccatggcgcggaagaagatccgggagtacgactccaagcgcctgctcaaggagcacctcaagcgcctcgccggcatcgacctccagatcctctccgcgcaggtcacacaatcaacggatttcacagagcttgtgaaccaggagccatggctctcatctatgaagttggttgttaaaccagacatgctgtttggtaaacgtgggaagagcggccttgtggccctcaacctagatcttgctcaagtccgccaatttgtcaaggagaggttgggagttgaggttgagatgggcggctgtaaggctccaattacaacattcatagtcgagccatttgtgccacacgatcaagagtattatctctcggtcgtatcagacaggcttggttgcaccattagtttctcagagtgtggaggtattgatattgaggagaactgggacaaggttaagactatcgctcttaccacagagaagcctatgacacttgatgcatgcgctccattgattgccacccttccgctggaggtccgcacaaaaataggtgatttcattagaggggtattttctgttttccaagacttggatttctcatttctggagatgaatccattcaccctggtaaatggggaaccatatcctctggacatgagaggtgaactggatgacacagctgctttcaagaactttaagaagtggggtaacattgagttccctctacctttcggaagagtcatgagcccatcagaaagttatatccatgaactggatgagaagacaagcgcctcactgaaattcacagttttgaacccgaaaggtcgcatttggaccatggttgcaggtggtggtgctagtgtcatatatgctgacacggtcggagatttgggatatgcttcggagctaggaaattatgcagagtacagtggagctcccaacgaggaggaggttttgcagtatgccagagtggttttggattgtgccactgctgatcctgatggccgtaagagggctctcctcattggagggggtatagcaaacttcactgatgttgcttcgacatttagtggcatcattcgggctttaagagagaaggaatccaaattaaaggctgcaaggatgaacatttatgttcggagaggtggtcctaactaccaaaccggactcgctaaaatgcgtgctctaggttcagagcttggtcttccaatcgaggtctatggaccagaggccacaatgactggaatctgcaagcaagccattgattgcgtcatgtccgaagcataattcgtcatagtattattctgctgttggcagttgtgtccatgttgtttcacatacatccattgtgaagtactgttagggaaacaaacaaatggaaaaatattggttttgtgtttgggaaaaaaaaactactgtttgtaaggcaaatttcgcaataatcgatgtctctctttgc

SEQ ID NO: 2894 - DNA, 1422 bp, Avena sativa
gcgccagcacgaaccaccactgccacagcttccacctactcttccaccatcctccgtctccagagtccagaagcttcggcgaggccatggcgcggaagaagatccgagagtacgactccaagcgcctcctccgggagcacctcaagcgcctcgccggcatagacctccagatcctctccgcgcaggttacagaatcaacagatttcacggagcttgcaaaccaggagccatggctctcatctatgaagttggttgttaaacctgacatgctgttcggtaaacgtgggaagagcggccttgtggccctgaacctagatcttgctcaagtacgccaatttgtcaaggagcggttaggagttgaggttgagatgggcggctgtaaggctccaattacaacgttcatagtcgagccatttgtgccacatgatcaagagtattatctctcaattgtatcagacaggcttggttgcaccattagcttttcagagtgtggaggtattgagatcgaggagaactgggataaggttaagacgatctttcttcccacagagaagacaatgacacttgatgcgtgcgctccactgattgccacccttccattggaagtccgcacgaaaataggtgatttcattagaggatcgttttctgttttccaagacttggatttctcatttatggagatgaatccattcaccctggtaaatggggaaccataccctctggacatgagaggtgaactggatgacacagctgctttcaagaactttaagaagtggggtaaccttgagttccctctacctttcggaagagtcatgagcccctcagaaagttatatccatgagctggatgagaagacaagtgcatcactgaaattcaccgttctgaacccaaaaggtcgcatttggacaatggttgcaggtggtggtgcgagtgtcatatacgctgacacggttggtgatttgggatatgcttcagagctaggaaattatgcagagtacagtggggctcccaaagaggaggaggttttgcagtatgctagagtgcttttggattgtgtcaccgctgatcctgatggccggaagagagcccttctcattggagggggtatagcaaacttcactgacgttgctgctacatttagtggcatcattcgggctttaagagagaaggaatccaaattgaaggctgcacgggtgaacatttttgttcggagaggcggtccaaactaccaaactggactcgctaaaatgcgtgctctaggttcagagcttggtcttccaattgaggtctatggaccagaggccacaatgactggaatctgcaagcaagccattgattatgtcatggcggaagcataatcatcatcatagtatagttccgatgtttgctgttgtgtccactccgtttcatataaattgagtg

SEQ ID NO: 2895 - DNA, 1790 bp, Secale cereale
acccgccagcgatccagatcccatctactcagcaccaacctggagcagccagtgaaaaccaaagctacctatatataccccgtcctgggtgcgacccaagctccggcgcgccagtgctacaaaccaccgctaccacagcgtccacctacccgccttccgcctcgagaagcgtcggcgaggccatggcgcggaagaagatccgggagtacgactccaagcgcctcctcaaggagcacctcaagcgcctcgccggcatcgacctccagatcctctcggcgcaggtcacacaatcaacggatttcacggagctttcaaaccaggagccatggctctcgtcgacgaagttggttgttaaacctgacatgctgtttggcaagcgtgggaagagcggccttgtagccctcaacctagaccttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcaccattagtttctcagagtgtgggggtattgagattgaggagaactgggacaaggttaagacaatctttcttccaacagagaagccaatgacacttgatgcatgtgcaccattgattgccactcttcccttggaagtccgcacgaaaataggcgatttcattagagggtcgttttctgttttccaagacttggatttctcatttatggagatgaacccattcaccctggtaaatggtgaaccataccctctggacatgagaggtgaactggatgacaccgctgctttcaagaactttaagaagtggggtgacattgagttccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatctgggatatgcttcagagctagggaattatgcagagtacagtggagctcccaaggaggaggaggttttgcattatgctagagtggttttggattgtgccactgctgatcctgatggccggaagagagctcttctcattggagggggtatagcaaacttcaccgacgtcgctgctacatttagtggcatcattcgggctttaagagagaaggaatccaaattaaaggctgcaagggtgaacatttatgttcggagaggtggtccaaactaccaaactggactcgccaaaatgcgtgctctaggatcagagcttggtcttccaattgaggtctatggaccagaggccacaatgactggaatctgcaagcaagccattgattgcgtcatggccgaagcatgattcgtcattgtatagttctggtgtttacagttgtgtccattttgttccatatacatttagtatgaacaactattcgtgtgaagcaaacagagaaaaattggttttgtggggggtgaagaagctacagttgtgatgcaactacgaaataatatatatcctgctttgcggttctgattcctttgggccgaggcacaatgagatcaagataaatcgacccgacttctccagatttacagcgtttttggttatgttgtgtccgcaactgtggcttcaggctttcagggtgcgtgactttgtacccaccatttgtgaacaaaatgcagttgtgccttagca

SEQ ID NO: 2896 - DNA, 1764 bp, Secale cereale
cgccagcgatccagatcccatctactcagcaccaacctggagcagccagtgaaaaccaaagctacctatatataccccgtcctgggtgcgacccaagctccggcgcgccagtgctacaaaccaccgctaccacagcgtccacctacccgccttccgcctcgagaagcgtcggcgaggccatggcgcggaagaagatccgggagtacgactccaagcgcctcctcaaggagcacctcaagcgcctcgccggcatcgacctccagatcctctcggcgcaggtcacacaatcaacggatttcacggagctttcaaaccaggagccatggctctcgtcgacgaagttggttgttaaacctgacatgctgtttggcaagcgtgggaagagcggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcaccattagtttctcagagtgtgggggtattgagattgaggagaactgggacaaggttaagacaatctttcttccaacagagaagccaatgacacttgatgcatgtgcaccattgattgccactcttcccttggaagtccgcacgaaaataggcgatttcattagagggtcgttttctgttttccaagacttggatttctcatttatggagatgaacccattcaccctggtaaatggtgaaccataccctctggacatgagaggtgaactggatgacaccgctgctttcaagaactttaagaagtggggtgacattgagttccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatctgggatatgcttcagagctagggaattatgcagagtacagtggagctcccaaagaggaggaggttttgcattatgctagagtggttttggattgtgccactgctgatcctgatggccggaagagagctcttctcattggagggggtatagcaaacttcaccgacgtcgctgctacatttagtggcatcatccgggctttaagagagaaggaatccaaattaaaggctgcaagggtgaacatttatgttcgcagaggtggtccaaactaccaaactggactcgccaaaatgcgtgctctaggatcagagcttggtcttccaattgaggtctatggaccagaggccacaatgactggaatctgcaagcaagccattgattgcgtcatggccgaagcatgattcgtcattgtatagttccggtgtttacagttgtgtccattttgttccatatacatttagtatgaacaactattcgtgtgaagcaaacagagaaagatcggttttgtggggggtgaagaagctacagtttaattgcaactacgcaataatatatatcttgctttgcggatctgattcctttgggccgaggcacaatgagatcaagataaatcgacccgacttctccagatttacagcgtttttggttatgttgtgtccgcaactgtggcttcaggctttcagggtgcgtgactttgtacccaccatttgtgaa

SEQ ID NO: 2897 - DNA, 2041 bp, Triticum aestivum
tcctctcctgtgtcgcgtggcccgtctacgagacgacgcgcagcgtagtgtacacgacgcagagtgcggcccaagctccggcgcgccagtgctacaaaccaccgctaccacagcgtccacctacccgtcctccgcctcgagaagcgtcggcgaggccatggcgcggaagaagatccgggagtacgactccaagcgcctcctcaaggagcacctcaagcgcctcgcaggcatcgacctccagatcctctccgcgcaggtcacacaatcaacggatttcacggagctttcaaaccaggagccatggctctcgtcgatgaagttggttgttaaacctgacatgctgtttggcaagcgtgggaagagtggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattatgtcagacaggcttggttgcaccattagtttctcagagtgtggtggtattgagattgaggagaactgggacaaggttaagacaatctttcttccaacagagaagccaatgacacttgatgcatgcgctccattgattgccactcttcccttggaagtccgcacgaaaataggcgatttcattagagggtcattttctgttttccaagacttggatttctcatttatggagatgaacccattcaccctggtaaatggtgaaccataccctctcgacatgagaggtgaactggatgacacagctgctttcaagaactttaagaagtggggtgacattgagttccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatttgggatatgcttcagagctagggaattatgcagagtacagtggagctcccaaagaggaggaggttttgcattatgctagagtggttttggattgtgccactgctgatcctgatggccggaagagagctcttctcattggagggggtatcgcaaacttcactgatgtcgctgctacattcagtggcatcattcgggctttaagagagaaggaatccaaattaaaggctgcaagggtgaacatttatgttcggagaggtggtccaaactaccaaactggactcgccaaaatgcgtgctctaggatcagagcttggtcttccaattgaggtctatggaccagaggccacaatgactggaatctgcaagcaagccattgattgcgtcatggctgaagcatgattcgtcattgtatagttccggtgtttacagttgtgtccattttgttccatatacatttagtatgaacaactattcgtgtgaagcaaacggagaaagatcggttttgtgggggaaagaaactacagttgtaatgcaactacgcaataatatatatcttgctttgcggttctgattcctttgggccaaggcacaatgagatcaagataagtcgacccggcttctccagatttacagcgtttttggttctgttgtgtccgcaacttcctggtggagcggcttgtgatgtctctccggactgtggcttcaggctttcagggtgtgtgactttgtacccaccatttgtggaaaaatgcagctctaccttagcaggaaagaagatgtcttaaaatgtttgattgtacgcgagattgtaaatatccatattttttctatgaatttggtcaaacttaaaagacaacttaagatgcactctgctacattaactgtgacggtttggaatcctctgcagtagcgcaccttgcaatactacactgtatagttttgcagaggatcttgaacccactgtaaaatatgttgtgggttggtttgacactcttatccacaaactagtat

SEQ ID NO: 2898 - DNA, 1620 bp, Secale cereale
aaaccaccgctaccacagcgtccacctacccgccctccgcctcgagaagcgtcggcgaggccatggcgcgaaagaagatccgggagtacgactccaagcgcctcctcaaggagcacctcaagcgcctcgccggcatcgacctccagatcctctcggtgcaggtcacacaatcaacggatttcacggagctttcaaaccaggagccatggctctcgtcgacgaagttggttgttaaacctgacatgctgtttggcaagcgtgggaagagcggccttgtagccctcaacctagatcttgctcaagtccgccaatttgtcaaggagcggttaggagttgaggtcgagatgggtggatgtaaggctccaattacaacattcatagtcgagccatttgtgccacacgatcaagagtattatctctcaattgtgtcagacaggcttggttgcaccattagtttctcagagtgtgggggtattgagattgaggagaactgggacaaggttaagacaatctttcttccaacagagaagccaatgacacttgatgcatgtgcaccattgattgccactcttcccttggaagtccgcacgaaaataggcgatttcattagagggtcgttttctgttttccaagacttggatttctcatttatggagatgaacccattcaccctggtaaatggtgaaccataccctctggacatgagaggtgaactggatgacaccgctgctttcaagaactttaagaagtggggtgacattgagttccctctacctttcggaagagtcctgagcccatcagaaagttatatccatgaactggatgagaagacaagcgcatcactgaaattcacagttcttaacccaaaaggtcgcatttggacaatggttgcaggtggtggtgctagtgtcatatatgccgacacggttggagatctgggatatgcttcagagctagggaattatgcagagtacagtggagctcccaaagaggaggaggttttgcattatgctagagtggttttggattgtgccactgctgatcctgatggccggaagagagctcttctcattggagggggtatagcaaacttcaccgacgtcgctgctacatttagtggcatcatccgggctttaagagagaaggaatccaaattaaaggctgcaagggtgaacatttatgttcgcagaggtggtccaaactaccaaactggactcgccaaaatgcgtgctctaggatcagagcttggtcttccaattgaggtctatggaccagaggccacaatgactggaatctgcaagcaagccattgattgcgtcatggccgaagcatgattcgtcattgtatagttccggtgtttacagttgtgtccattttgttccatatacatttagtatgaacaactattcgtgtgaagcaaacagggaaagatcggttttgtggggggtgaagaagctacagtttaattgcaactacgcaataatatatatcttgctttgcggatctgattcctttgggccgaggcacaatgagatcaagataaatcgacccgacttctccagatttacagtcgtttttggttatgttgtgtccgcaactgtggcttcaggctttcagggt

SEQ ID NO: 2899 - DNA, 1504 bp, Leymus cinereus x Leymus triticoides
caccgcccacagcgtccacctacccctcctccgcctcgcgaagcttcggcgaggccatggcgcggaagaagatccgggagtacgactccaagcgcctcctcaaggagcacctcaagcgcctcgcaggcatcgacctccagatcctctccgcgcaggtcacacaatcaacggatttcacggagctttcaaaccacgagccatggctctcgtccatgaagttggttgttaaacctgacatgctgtttggcaagcgtgggaagagcggccttgtagccctcaacctagatcttgctcaagtccgccaatttgtcaaggagcggttcggagttgaggtcgagatgggtggatgtaaggctccaattacaacattcatagtcgagccatttgtgccacacgatcaagagtattatctctcagttgtatcagacaggcttggttgcaccattagtttctcagagtgtgggggtattgagattgaggagaactgggacaaggttaagacaatctttcttccaacagagaagtcaatgacacttgatgcatgtgctccattgattgccactcttcccttggaagttcgcacgaaaataggcgatttcattagagggtcattttcggttttccaagacttggatttctcatttatggagatgaacccattcaccctggtaaatggtgaaccataccctctggacatgagaggtgaactggatgacacagctgctttcaagaactttaagaagtggcgtaacattgacttccctctacctttcggaagagtcctgagcccatcagaaagttatatccacgaactggatgagaagacaagcgcatcactgaaattcacagttcttaacccgaaaggtcgcatttggacaatggttgcaggtggtggtgctagtgtcatatatgctgacacggttggagatttgggatatgcttcagagctaggaaattatgcagagtacagtggagctcccaacgaggaggaggttttgcattatgctagagtggttttggattgtgccactgctgatcctgatggccggaagagagctcttctcattggaggaggtatagcaaacttcactgatgtcgctgctacattcagtggcatcattcgggctttaagagagaaggaatctaaattgaaggctgcaagagtgaacatttatgttcggagaggcggtccaaactaccaaactggacttgccaaaatgcgcgctctaggatcagagcttggtcttccaattgaggtctatggaccagaggccacaatgactggaatctgcaagcaagccattgattgcgtcatggccgaagcatgattcgtcattgtatagctccgccgtttgcagttgtgtccattttgtcccatatacatttagtacgaagaactgttcgtgtgaagcaaacggagaaagaactgttttgtgggggaagaaactactgttgtaacgcaactacgcaataatatatatattgctttgagggtatgtgacta

SEQ ID NO: 2900 - DNA, 1783 bp, Lolium multiflorum
gctgaaaccaccgcgcgctgccgcagcttccacctaaccacccacctcggccatggcgcggaagaagatccgggagtacgactccaagcgcctcctccgggagcacctcaagcgcctcgccgccatcgacctccacatcctctccgcccaggttacagaatcaacggatttcacggagcttgcgaaccaggagccatggctctcatctatgaagctggttgtcaaacctgacatgctgttcggtaagcgtgggaagagcggccttgtggccctcaacctggatcttgctcaagtccgccaatttgtcaaggagcggttaggagttgaggttgagatgggcggctgtaaggctccgattacaacgttcatagtcgagccatttgtgccgcacgagcaagagtattatctctcgattgtatcagacaggcttggttgcaccattagcttctcagagtgtggaggtatcgagattgaggaaaactgggataaggttaagacgatcactcttcccacagagaagacaatgacacttgatgcatgcgctccactcattgccacccttccattggaagtccgcacgaaaataggagatttcattagagggtcattttcggttttccaagacttggatttctcatttatggagatgaatccattcactctggtaaacggggaaccataccctctggacatgagaggtgaactggatgacaccgctgctttcaagaactttaagaagtggggtaaccttgagttccctctacctttcggaagagtcatgagcccctcagaaagttatatccatgaactggatgagaagacgagcgcatcactgaaattcactgttctgaacccgaaaggacgcatttggacaatggttgcaggtggtggtgcgagtgtcatatatgctgacacggttggagacttggggtatgctgcagagctaggaaattatgcagagtacagtggagctcccaaagaggaagaagttttgcagtatgctagagtggttttggattgtgtcaccgctgatcctgatggccggaagagagctcttctcattggagggggtatagcaaacttcactgatgttgctgctacatttagtggcatcattcgggctttaagagagaaggaatccaagttgaaggcagcaagggtgaacatttatgttcggagaggtggtccgaactaccaaactggactcgccaaaatgcgtgccctaggttcagagcttggtcttccgattgaggtctatggaccagaggccacgatgaccggaatctgcaagcaagccattgattacgtcatggctgaagcataattcatgattgtatagttccgatgttcgctgttgtgtccattctgttccatataaatatgaagaactgttcgagtgaaacaaacggagaagcataggttttgtggggggaaggaactactgtcgcaacacaataatatatgtatcttgctttgcagttttgattcgtgtgtactgaggtacaatgcattctgcggtaaccttctaaagtgtttctgattctgttgtgtggccgacatgctgttgaagcgtcgtgtcatgacatgcatacaaaccatttgggcaaattgcagctttacatgtatttgtcatctctccgtgatgtagctacttatctcacggacgtctttgatacgtactgttcaaaataaaaacgagtgtactagaaaacacagtgtagtgcaatttcatggtattttgaattctatgtgactgaaatgatatctgaccgaaccaaagtga

SEQ ID NO: 2901 - DNA, 1405 bp, Festuca arundinacea
gccatggcgcggaagaagatccgggagtacgactccaagcgcctcctccgggagcacctcaagcgcctcgccgccatcgacctccacatcctctccgcgcaggttacagaatcaacggatttcacggagcttgcaaaccaggagccatggctctcatctatgaagctggttgttaaacctgacatgctgttcggtaaacgtgggaagagcggccttgtggccctcaacctagaccttgctcaagtccgccaatttgtcaaggagcggttgggagttgaggttgagatgggcggctgtaaggctccgattacaacgttcatagtcgagccatttgtgccgcacgagcaagagtattatctctctattgtatcagacaggcttggttgcaccattagcttctcagagtgtggaggcatcgagattgaggaaaactgggataaggttaagacgatcactcttcccacagagaagacaatgacacttgatgcatgcgctccactgattgccacccttccattggaagtccgcatgaaaataggagatttcattagagggtcattttctgttttccaagacttggatttctcatttatggagatgaatccattcactctggtaaacggggaaccataccctctggacatgagaggtgaactggatgacacggctgctttcaagaactttaagaagtggggtaaccttgagttccctctacctttcggaagagtcatgagcccctcagaaagttatatccatgaactggatgagaagacgagcgcgtcactgaaattcactgttctgaacccaaaaggacgcatttggacaatggttgcaggtggtggtgcgagtgtcatatacgctgacacggttggagacttgggatatgctgcagagctaggaaattatgcagagtacagtggagctcccaaagaggaagaagttttgcagtatgctagagtggttttggattgtgtcaccgctgatcctgatggccggaagagagctcttctcattggagggggtatagcaaacttcactgatgttgctgctacatttagtggcatcattcgggctttaagagagaaggaatccaagttgaaggcagcaagggtgaacatttatgttcggagaggtggtccgaactaccaaactggactcgccaaaatgcgtgccctaggttcagagcttggtcttccgattgaggtctatggaccagaggccacaatgaccggaatctgcaagcaagccattgattatgtcatggccgaagcatagtatagtccggatgttcgctgttctgtccattctgtttcatataaatatggaaaactcttcgagggaaacaaacggagaaacataggttttgtggggggaaatgaactactgctgtaacacaataatatat

SEQ ID NO: 2902 - DNA, 1787 bp, Oryza sativa
ctgagtggtctccagaccagctggtcataaacatggtctcattcacaaggttgcttacttagatccaatctagaacagagcgagtcatcttctttatattcattccattctccctaggcaacgtgcacacaccaccaccaccttcatcttggtggcttcgttcactccgcctacctacctacctttgcagttggtttgctgaaccctcctcaagaacccacgcgcctctcgcggcagcagctaaccaagccatggcgcgcaagaagatccgggagtacgactccaagcgcctcctcaaggagcacctcaagcgcctcgccggtatcgacctccagatcctctccgcccaggttacacaatcgacggacttcacagagctggtaaaccagcagccatggctgtcaaccatgaagttggtcgtgaagcccgacatgctgttcgggaagcgtggcaagagcggacttgtggccctcaacctagatattgctcaagtcaaggagtttgtgaaggagaggctgggagttgaggtcgagatgggtggctgcaaggctccaatcaccaccttcattgtggagccatttgtaccccatgatcaagaatactacctttctattgtctcggagaggctgggcagcaccattagcttctcggaatgtggaggaatagaaattgaggagaactgggacaaggttaagacaatttttcttcccactgagaagccaatgacacctgatgcatgtgctcccttgattgctacccttccattggaggcacgtggaaaaattggtgatttcattaaaggagtctttgctgttttccaagacttagatttctcatttctcgagatgaacccatttaccatcgtgaatggagagccgtatcctctggacatgagaggagaattagatgacacagcagctttcaaaaacttcaagaagtggggaaatatcgaattcccactaccattcggtagagttctcagttctacagaaggctttatccatgacttggatgagaagacaagtgcatctctgaagttcaccgttttgaacccaaaggggcgcatctggacaatggttgctggaggtggtgccagtgtcatatatgctgatacagtcggagatttgggatatgcttcagaattaggaaactatgcagagtatagcggtgctcccaatgaggaggaggttctgcagtatgctagagtagtacttgattgtgcgactgctgatcctgatggccgcaagagagctcttctcattggagggggtatagctaacttcaccgacgtcggggccacatttagcggcatcattcgggccttaagagagaaggaatccaagttgaaggctgcaaggatgcacatctatgtccgacgtggtggtccaaattaccaaactgggctggctaaaatgcgcaagcttggcgcagaactcggtgtcccgattgaggtgtatgggccagaagcgacgatgactggaatctgcaagcaagcaattgaatgcgttatggccgcagcataaatgaagatgcaagttctgggatctgcaggcaagatgctgaatgcgtgatgggtgcgacatggatgagagtgtggtgtagttgcagtagttctctgcagatggctgatttgtttcttgatacatgttatacttggacgagatctggataggttattgatgtactgaaactactactgcgatgcaataaaagtgagagtagcgtttcctgatttgttctcttcttgattgtgatattgttgcaatgcaatcgcgctgtatttcatc

SEQ ID NO: 2903 - DNA, 1416 bp, Festuca arundinacea
gccatggcgcggaagaagatccgggagtacgactccaagcgcctcctccgggagcacctcaagcgactcgccggcatcgacctccagatcctctccgcgcaggttacagaagcaacagatttcacggagcttgcaaaccaggagccatggctctcatctacgaagttggttgttaaaccagacatgctgttcggtaaacgtgggaagagcggccttgtggccctcaacctagatcttgctcaagtccgccaatttgtcaaggagcggttaggagttgaggtcgagatgggcggctgtaaggctccaattacaacgttcatagtcgagccatttgtgccgcacgagcaagagtattatctctcaattgtatcagacaggcttggctgcaccattagcttctcagagtgtggaggtattgagattgaggaaaactgggataaggttaagacgatctctcttcccacagagaagacaatgacacttgatgcatgcgctccactgattgccacccttccattggaagtccgcacgaaaataggagatttcattagaggggcattttctgttttccaagacttggatttctcattcatggagatgaatccattcaccctggtaaatggggaaccataccctctggacatgagaggtgaactggatgacacagctgctttcaagaactttaagaagtggggtaaccttgagttccctctacctttcggaagagtcatgagcccctcagaaagttatatccatgaactggatgaaaagacaagtgcatccctgaaattcactgttctgaacccgaaaggtcgcatttggacaatggttgcaggtggtggtgcaagtgtcatatatgctgacacggttggagatttgggatatgctgcagagctaggaaattatgcagagtacagtggagctcccaaagaggaggaagttttgcagtatgctagagtggttttggattgtgtcaccgctgaccctgatggccggaagagagctcttctcattggagggggtatagcaaatttcactgatgttgctgctacatttagtggcatcattcgggctttaagagagaaggaatccaaattaaaggcggcaagggtgaacatttatgttcggagaggtgggccgaaccaccaaactgggctcgccaaaatgcgtgctctaggttcagaacttggtcttccgattgaggtccatggaccagaggccacgatgaccggaatctgcaagcaagccatcgattacgtcatggccgaagcgtaattcatcatagtatagttccaatgtttgctgtgtgtccattctgttctatacaatatgaagagcttgttcgagtgaaacaaatggagacttaggttttgtgggggaaggaacacactgtcgtaacccaataatatatgtatc

SEQ ID NO: 2904 - DNA, 1526 bp, Festuca arundinacea
gccatggcgcggaagaagatccgggagtacgactccaagcgcctcctccgggagcacctcaagcgcctcgccgccatcgacctccacatcctctccgcgcaggttacagaatcaacagatttcacggagcttgcaaaccaggagccatggctctcgtctatgaagctggttgtcaaacctgacatgctgttcggtaaacgcgggaagagcggcagggggccctcaacctagaccttgctcaagtccgccaatttgtcaaggaacggctaggagttgaggtcgagatgggcggctgtaaggctccaattacaacgttcatagtcgagccatttgtgccgcacgagcaagagtattatctctcaattgtatcagacaggcttggttgcaccattagcttctcagagtgtggaggcatcgagattgaggaaaactgggataaggttaagacgatcactcttcccacagagaagacaatgacacttgatgcatgcgctccactgattgccacccttccattggaagaccgcacgaaaataggagatttcattagagggtcattttctgttttccaagacttggatttctcatttatggagatgaatccattcactctggtaaacggggaaccataccctctggacatgagaggtgaactggatgacacagctgctttcaagaactttaagaagtggggtaaccttgagttccctctacctttcggaagagtcatgagcccctcagaaagttatatccatgaactggatgagaagacgagtgcatcactgaaattcactgttctgaacctgaaaggccgcatttggacaatggttgcaggtggtggtgcgagtgtcatatacgctgacacggttggagatttgggatatgctgcagagctaggaaattatgcagagtacagtggagctcccaaagaggaagaagttttgcagtatgctagagtggttttggattgtgtcaccgctgatcctgatggccggaagagagctcttctcattggaggtggtatagcaaacttcaccgatgttgctgctacatttagtggcatcattcgggctttaagagagaaggaatccaaattaaaggctgcaagggtgaacatctatgttcggagaggtggcccaaactaccaaactggactcgccaaaatgcgcgctctaggttcagagcttggtcttgcaattgaggtctatggaccagaggccacaatgaccggaatctgcaaacaagccattgattacgtcatggccgaagcatagtatagttcggatgttcgctgttctgtccattctgtttcatataaatatgaagaactgtccgagggaaacaaatggagaaacataggttttgtggggggaaatgaactactgttgtaacacaataatatatatgtatcttggtttgcagtttttatgcctttgtctgagtcacaatgcaatctccaataaacatatccacattcactaaaaaaaaaaaagaaaaaaacaaaagtactctgcgttgataccact

SEQ ID NO: 2905 - DNA, 1755 bp, Elaeis guineensis
acggcgatcgcagctaaccacccacctctcctcctctctctctctctccctcctttaaatctccctcggctccgatctacctctcttcgaagccaccgctccttggaagctcgaatctaggggagctctccaatcgatttctgaagcgttccaaaaagggaggaggagatggcgaggaagaagatccgggagtacgattcgaagcggcttctcagggagcatctcaagcggctcgccgccatcgacctccagatctgctcagcccaggtcacggaatctacggacttcgctgagttagtgaacaaagagccatggctttcatccatgaaactggttgtgaagcctgacatgctgttcgggaagcgagggaagagtggtttggtggctctgaaattagatatggctcaggtggctcagtttgtgaaagaacgcctgggagtggaggttgagatgggtggttgcaaggccccgataaccacatttatagttgagccatttgttccccatgaccaagagtactatctctcaattgtctccgagaggcttggttgcaccatcagcttctcagagtgtggtggaattgaaattgaagagaactgggacaaggttaagactatctttctccctaccgagaagcctatgacatctgaggcatgtgctccactgattgcaacacttcccctggaggtacgaggaaaaataggggacttcataaaaggtgtttttgctgttttccaagacttggatttcacttttcttgagatgaacccatttactttggtaaatggggagccttatccattggatatgcgaggagagttggatgatactgctgcattcaaaaacttcaagaagtgggggaacatagaatttccacttccttttggcagagttttgagccctacagaaagctttattcatgaacttgatgaaaagactagtgcctccttgaagttcactgttttaaaccccaaaggacgcatatggaccatggtagctggtggtggtgccagtgttatatatgctgatactgttggtgacttgggttatgcatcagagctcggaaactatgcagagtacagtggtgctcctaatgcggatgaggtcctgcagtatgccagagtggttcttgattgtgcaactgcggatcctgatggcagaaagagggcccttctcattggagggggtatagctaacttcactgatgttgctgctacttttagtggcatcatccgtgccctaaaagaaaaggaatccaagctaaaggctgcaaggatgcacatttttgtccgaagaggtggtccaaattatcaaacaggtctagccaaaatgcgggctctgggtgacgagttaggcattccccttgaggtgtatggaccagaagcaacaatgaccggaatttgcaagcaagctattgattgcatcatgtctgctgcataatttggatttcatgtactctacttttgtttttctccatctattttgttgagcaagaatcagaatttagtgatttatccatagtgaaggacaaaatgagaacatttagagaacatgaatgagtccaatactgcaataacctaatttggttgccttggcaaacgtctgaagtgtgaattgtgctgagacaatgtaattttgttggagtagagaatttctattccatcttggatttccagtgataccgggctggacgtgtggaaactatgcatgacatttcgatgctactaggttatgctcctggtagacatattgaat

SEQ ID NO: 2906 - DNA, 1674 bp, Olea europaea
aaaggaaagaaaacaaaacagccatcatctccttgttcaagtcgcccatttccctctacccaacccacccactatataccagttgctgtggttggtgaattccagtcgtatctgagaaccgaagctcatatcaaatcagatctatgtttactctagcaagtaaaagctaaagcataaataaatccgcccggaattgtttatttacttgaattatcttgcaattttcactaaaaatggcaagaaagaagatcagggagtacgattccaagaggcttctcaaggagcatttgaaacgattggcaaacatcgaccttcagattcgctctgctcaagtgacgcaaacaacggattttgccgagttaacaaacaaagaaccatggctatcgtccacaaagctggttgtcaaaccagatatgttgttcggaaagcgggggaagagtggcttggtagctttgaatttagatcttgcacaagttgctgaatttgtgaaagaacggcttggtgttgaggttgagatgggtggttgcaaagcgcctataacaacattcattgtagaaccatttgtcccccacaatcaagaatattacctttccatagtttctgaaaggttgggaagtaccattagcttttcagaatgtggaggcattgaaattgaagagaactgggacaaggttaagaccatattccttccaactgaaaaacaaatgaccattgaggcatgtgctcctttgattgctacacttccccttgaggtacgggggaagataggcgattttataatgggtgttgtttctgtatttcaagatctggatttcagtttccttgagatgaatccatttacactggtgaatggggagccatacgcattggacatgaggggagagttggatgacactgctgccttcaaaaactttaagaagtggggtgccatagagtttcctctgccttttggaagagtcttgagtccgacagaaaattttattcactctttggatgaaaaaactagtgcatctttgaaatttactgtcttgaacccgaaaggacgaatttggactatggtggctggaggaggtgcaagtgtaatatatgcggataccgttggagatttgggctatgcgtccgagcttggtaattatgccgagtacagtggagctccaaatgaagaagaagttttgcaatatgccagagtagttattgactgtgccacagcagaccctgatggccgcaagagagctcttcttattggaggaggtattgctaactttacagacgttgccactactttcaatgggattatccgggcacttaaggaaaaggaatcaaagttaaaagcagctagaatgcacctttatgttcgtagaggtggtcccaactatcagactggtttggctaaaatgcgtaccttgggagaagaattaggagttcccattgaggtttatgggcctgaggctacaatgactggtatttgcaagcaagcaatcgattgcatcatgtccacgtagtaatcttcctttgtactctttattaatgcgtcaaggattttttgttgtccaaggctgttcgaaagaacgaactgaattggttgtgtgtgtcctcccttctccccgtgaactaccagacacttttcccttcaatatggaaacagtttttgcaataaaatctgaataatttttc

SEQ ID NO: 2907 - DNA, 1713 bp, Orobanche aegyptiaca
tcttcttatcatcatctaaatcgccaaaccacctaactctcttcaccgtccattctttcatctcattaaaaaccaaccgtaatcacacagtcactctctattactcaatcagtagtctttgagggattccccagagcaaggaaaattgtttcttcgcattgaataaaatggcgagaaagaaaatcagggagtacgattccaagaggctgctcaaagagcatctcaaaagattgtccggtatcgaccttcagatctgctcggcccaggtaacacaatcgacagactttactgagttaacaaacaaagagccatggctttcatcaacaaagttggttgtgaaacctgacatgttgtttgggaaacgagggaagagtggtttggtagctttaaatttagatctcgcccaagtagctggattcgtcaaagaacgccttggtgttgaggttgagatgggtggttgcaaagcaccaataactacattcattgttgaaccttttgtcccccatgaccaagaatattacctgtccatcgtatctgaaaggttaggatgtaccattagcttctcagaatgtggaggtatcgaaattgaagaaaactgggacaaggttaaaactatcttccttcccactgaaaagccaatgaatttggaggcatgtgctcctttgattgctacacttcccttagaggttagggggaagattggtgattttatactgggtgtttttgctgtatttcaagatttggactttagtttccttgagatgaacccattcactctggtgaatggcgagccatatccgctggacatgagaggagagttggatgacactgctgctttcaagaacttcaaaaaatggggtgatattgagtttcctctgcctttcggaagagtcttgagcccaaccgaaagtttcatacactcgttggatgaaaaaaccagtgcatcattgaaatttacagttttgaacccgaaagggcgtatttggacaatggtggctggaggtggcgctagtgtaatatatgcagatacagttggggatttgggctatgcatccgagcttggtaactacgctgagtacagtggagctccaaacgaagaggaggttttgcaatatgccagagtagttatcgattgtgccacatctgatcctgatggccgcaaaagagctcttcttattggaggaggcattgctaactttacagatgttgctgctacttttaatggaattatccgggctctcaaggagaaggaagccaagttgaaagcagctaggatgcacctttatgttcgtagaggtggtcccaactatcagactggtttggcgagaatgcgcgctttgggagaagaattgggagttcctatcgatgtttatggacctgaggccacaatgactggcatttgcaagcaggcaattgattgcatcatgtctgcagcatagtcttgctatgtattttgttcttgccattaaccgcaaaattgatgattattttgtaattgaacataccatagtctggattgatgtttgtaatgtgaaactgaaagcaagtaacatctggagaatactttgttatattgcagccttagctttgagttcgttaggtgtttgtactgaaatgatgaattttcatccgttgctgttgcatttatcacacttgtctttgtgtatttaatgttgcacattggtcagttaactcctgtgcgtgtgttttttt

SEQ ID NO: 2908 - DNA, 1606 bp, Saccharum officinarum
cgggggctgactgacttacgtgcacccggcacgcccagcgccactcaccaacccgcccactttccagtccaacacctccttccctccgtccgtcgccatggcgcgcaagaagatccgggagtacgactccaagcgcctcctcaaggagcacctcaagcgcctcgccggcatcgacctcaccatcctctccgcccagatcacacagtcaacagactttgcagagcttctgagccagcagccatggctgtcaaccatgaagctagtggtgaagcccgatatgctgttcgggaagcgtgggaagagcggcctcgtggctctcaacttggattttgatcaagtcaaggagtttgtcaaggagcggctgggagttgaggttgagatgggtggctgcaaggctccaatcacgaccttcatagttgagccgtttgtgccccatgatcaagagtactacctttcgattgtttcagagaggttgggcagcaccatcagcttctcagagtgtggagggattgagatcgaggagaactgggacaaggttaagacgatttttcttcccactgagaagccaatgacacctgattcatgtgctccattgattgcaacccttcctttggaggcacgcggaaaaattggtgacttcattaaaggagtgtttgctgtcttccaagacttggatttctcgtttcttgagatgaatccattcaccatggtcaatggggagccatatcctctggacatgagaggagaactagatgacacagcagctttcaagaacttcaagaagtggggaggtatagaattccctctaccttttggaagagtactcagccctacagaaagtttcatccatgaactagatgagaagacaagtgcctctctgaagttcacagttttgaacccgaaaggtcgtatctggacaatggttgctggtggtggtgctagtgtcatatatgctgatacagttggagacttggggtacgcgtcagagcttggaaactatgcagagtatagtggtgctcctaatgaggaggaggttctgaattatgctagagttgtacttgattgtgcaaccgccgatcctgatggccgcaagagagcccttctcattggaggtggcatagctaacttcactgatgttgctgccacattcaatggcatcatccgggccttaagagagaaggaatccaagttgaaggcatcaaggatgcacatttatgttcgccgaggtggcccaaattaccaatccggactggccaaaatgcgcaagcttggtgcagaactcggtgttccaattgaggtgtatgggccagaagcgactatgactggaatctgcaaacaagcaattcaatgcatcatggctgcagcataatcggagcctagttctgggtagtttgggatctgcaaacactcaattgaatgtttcatggactcagcataaatgagagagagtagtagttgcagtagttcaccacacatgattgttctgtcttttttgtttcagatttgttgtagcgtgttgtttgaactaaaccttcatagattattacggcaaagaaattactgctgtgttaaaataaatcataagtttagtttcgtgcgttttgga

SEQ ID NO: 2909 - DNA, 1901 bp, Aristolochia fimbriata
aagcagtggtaacaacgcatccgtactttttttttttttttaaaaagtcgtactggctgctaatcctaccgaactcgcctccccagtatttctcactcgaaccactcctcaacggtgttggttgggccaatcttctgcaataaaagccgtctccgcatctggaatttctgtctatcttctcgtgtctgaagctttctttccgacacagcttgatcgagatctggtgggacgaaaatggcgaggaagaagatcagagagtacgactccaagaggctattgaaggagcatttgaaaaggcttgctgggatcaatctagagatctgttcagctcaggtgacggaatcaacagacttcactgaattagcaaaccaagaaccatggctttctgccaatagattggtggtcaagccagacatgttgtttggtaagcgtggaaagagtggcttggttgctctgaatctcgatctagcacaggttgcccaattcgtgaaagaaaggctgggtgttgaggtcgagatgggaggatgcaaagcacctattaccacattcatcatcgagccgttcgtccctcatgaccaagaatattacctttcaattgtctcggataggcttggttccaccataagcttttcagagtgtggtggcattgagatagaagagaactgggacaaggttaagaccatctctctgccaactgagaagcctatgacttctgaggcatgcgcccccctgattgctacactccccttagaggtgagaggaaaaattggcgacttcataaaaggagtttttgctgtatttcaagaccttgatttctctttcttagagatgaatccttttacattggtgaatggggaaccatatcccttggacatgcgaggcgagttggatgatactgctgcttttaagaacttcaagaaatggggaaatatcatgtttccattgccttttggaagagttttgagcccttcagagaatttcattcactccttggatgagaagacaagtgcctctttgaaattcactgttctgaaccctaaaggtcgcatctggactatggtcgcaggaggcggtgctagtgttatttatgctgacactgttggggacttggggtatgcctcggagcttgggaattatgcagagtacagtggagctccaaatgaggaggaagttttgcagtatgctagagttgttattgattgcgctactgcaaatcctgatggtcgtaagagagctctcctgattggaggaggaatagctaacttcactgatgttgctgcaacttttaatggcattattcgagccttaagggagaaggagtccaagctaaaggcagcaagaatgcacatttacgttcgtcgaggtggtccaaactatcagactggtctgactaaaatgcgggctctcggggaggaactcggggttcccttggaggtttacggaccagaggccaccatgactggcatttgcaagcaagccatagattgcatcatgtctgcagactagttctattctgctgcattcttttttgttttagccctcaatccttcaatcccaaatcaaaagttctggaacattgacgtagaatggtgccatctatcgatgatgaagactgagttcttgtagtaaccatagcttggtattgtcatctgtgtgtgcctttgttattgttgttgttgttgttgttgttgttgttattagcaaatattaagcaggccatgctggtttttgtaagctccttagtttgaactgcaaatcccaaaacactattaacaaagccccaaagctattaataaacgagttctgcggttcacgcatcccttaccaaaaaaaaaaaaaaaaaaaaaacaaaaaaaaaaaaaaaccaaaaaaaaaacaaacaaaacaaacagagacacaca

SEQ ID NO: 2910 - DNA, 1506 bp, Manihot esculenta
gatcttgaattgtatttcaaatggctcggaagaagattagagagtatgattccaagagacttctcaaggagcatttgaagcgccttgctaatatcgatctccagatctgctctgctcaggtgactgagtctacagacttcacagagttaacaaatcaagaaccatggctttcttcttcaaaattagtggtgaagcccgatatgttatttgggaaacgtgggaagagtggcttggtagctttgaatttagatctagctcaagtggcagaatttgtgaaaggacgccttggcgttgaggttgaaatgggtggctgcaaggcaccaataactacattcattgttgaaccattcgttccacatgaccaagaattttacctctcaatagtttctgaaagacttggctccaccattagcttttcagaatgcgggggcattgaaattgaagagaactgggataaggttaagaccattttccttcctactgagaaacctatgaccttggaggcatgtgctccgttgattgctacacttcctttggagattagaagtaaaattggtggctttataacgggcatctttgctgtctttcaagatctggacttcacttttctagagatgaacccatttaccctggtaaatggagagccatatccattggatatgagaggagagctggatgacactgctgcctttaagaatttcaagaagtggggtaacatagagtttcctcttccttttggaagagttctcagccctactgaaagcttcattcattcactagatgaaaagactagtgcgtctttgaaattcactgttttgaacccaaaaggtcgcatatggacgatggttgctggaggtggtgcaagtgttatatatgccgatactgttggtgatttaggttatgcatcagagcttggcaactatgcagagtatagtggagctcctaatgaggaggaagtcttgcaatatgcaagagttgtaattgattgttctactgctgatcctgatggtcgtaaaagagcccttcttattggaggtggcattgctaacttcacagatgttgcggctactttcaacggtatcattcgagcccttcgagaaaaggaatccaagttaaaagcagcaagaatgcacatctacgttcgaagaggtggtccaaactaccagactggattggcaaagatgcgctctctgggacaagagttgggagtacctcttgaggtgtatgggcctgaggccacaatgacaggcatttgcaagcaggccattgattgcataatgtctacggcatagttctgcaacccatcctttttatggatgagcatggagaaaaacaatttggagcaacgtgtgttttaaaagataattttgcgtacaaggcatgaacccaattttataaattttccttttttaggtgaaaaacttgattgaatggtttccagtccttgtagctgtggcatttactttacttgtggcatgaattggacccatacgtgtatgtgatgtg

SEQ ID NO: 2911 - DNA, 2112 bp, Cocos nucifera
catgaagcttttatgcggtcgttttcttcggttactactagggcgaaaggcggtccaatggctcgctcggttgggagaagggtaggtgggacgtttgctactttctgaacggcgatcgcagctacccacccacctctcctctctctcgtccttaaatctctgtcgactcgcatctaccactcttcgaagccaccgctccttggaagctcgaatctacgggagctctccaatcgatctctgaagcgttccaaaaagagaggaggagatggcgaggaagaagatccgggagtacgattcgaagcggcttctcagggagcatctcaagcggctcgccgccatcgacctccagatctgctcagcccaggtcacggaatctacggatttcactgagttggtgaacaaagagccatggctttcatccatgaaactggttgtgaagcctgacatgctgttcgggaagagggggaagagtggtttggtggctctgaaattagatatggctcaggcggctcagtttgtgaaggaacgccttggagtggaggttgagatgggtggttgcaaggccccgataaccacgtttatagttgagccatttgttccccatgaccaagaatactatctctcaattgtctccgagaggcttggttgcaccatcagcttctcagagtgtggtggaattgaaattgaagagaactgggacaaggttaagaccatctttctccctaccgacaagcctatgatgtccgaggcatgtgccccactgattgcaacacttcccctagaggtgcgaggaaaaataggggacttcataaaaggtgtttttgctgttttccaagacttggatttcacttttctcgagatgaacccatttactttggtaaatggggagccttatccattggatatgcgaggagagttggatgatactgctgcattcaaaaacttcaagatgtgggggaacatagaatttccacttccttttgggagagttttgagccctacagaaagctttattcatgaacttgatgaaaagactagtgcctccttgaagttcactgttttaaatcccagaggacgcatatggaccatggtagctggtggtggtgctagtgttatatatgcggatactgttggtgacttgggttatgcatcagagctcggaaactatgcagagtacagtggtgctcctaacgcggatgaggtcctgcagtatgccagagtggttctggattgtgcaaccgctgatcctgatggccgaaagagggcccttctcattggagggggtatagctaacttcactgatgttgctgctacttttagtggcatcatccgtgccctaagagaaaaggaatccaagctgaaggctgcaaggatgcacatttttgtccgaagaggtggtccaaattatcaaacaggtctagccaaaatgcgggctctgggtgatgagttaggcattccccttgaggtgtatggaccagaagcaacaatgaccggaatttgcaagcaagctattgattgcatcatgtctgctgcataatttggatttcatttactctacttttgtttttctccatctattttgttgagtaagaatcagaatttagtgatttatccatagtgaagaacaaaacgagaacatctatagtgcatgaatgagtccaatactgcaataacctaatttggttgccttaccaaacgtctggggtgtgacttgtgctgagacaatgtaatttttgttggagtagagaatttctattccatcttggatttccaatgatattgggcagtagccaatggtgtggaaactatgcatggcattttgatgctgctagctattgaatgaacttcttatgcatgcgagcatcatacatggcagtagccaatgatattgttagcttttaatgcatgctgttgcatgccatgttatcattttttcgttctacctcttttgagttggaattgtcgagaaatgtagttcatttcatattattagcatcacctcctgctttatgctttggtcggcatggtgaatatcgcatggtagcgggacagaggtggtgtgttcagctttatgcttgggtcgacatggtgcgtatttcatagtagtgggac

SEQ ID NO: 2912 - DNA, 1944 bp, Ocimum basilicum
tggcccaacaaccttacctctttgctttcactcctctttcctaccaaaccatcatcacaccactcacactatcgtcgcccatttcaaacccaattctactccaaaccggatttacaaaaccttatcagatctttcttattctcgatatacccgtccaccacttcttttagttcctcaatcaagtgggagatggcgagaaagaagatcagagagtatgactccaagagactactcaaagagcatttgaagagattatctggtattgacctccagatacgctctgctcaggtaaccgaatcgacagactttgctgagttaactaacaaagaaccatggctatcatcgacaaggttggttgtgaaacctgacatgttatttgggaaacgtgggaagagtggtctggtagccttaaatttggatcttgctcaagtagcagcatttgtcaaagagcgcctcggtgttgaggttgagatgggtggttgcaaagcacccataactaccttcattgttgaaccttttgtacctcatgaccaagaatattacctttctatagtatctgagaggttaggaaacaccattagcttctcggaatgtggaggtatcgaaattgaagagaactgggacaaggtcaaaactgtatttcttccaactgagaaatcaatgaacttagaggcatgtgctccgttgattgctacactgccactagaggttcgggggaagattggtgaatttattaatggtgtcttttctgtatttcaagatctggattttagttttctcgagatgaacccctttacgctggtgaatggagagccttatccattagacatgagaggcgagttggatgacacagccgcttttaaaaacttcaaaaagtggggtgatatagagtttcctctaccttttggaagagttctcagtccaacagagagtttcattcactcgctggatgaaaaaactagtgcatctttgaaatttacggtcttgaatccaaaaggacggatttggacaatggttgctggaggtggtgcaagtgtaatatatgctgatactgttggagatctgggttatgcctctgagcttggtaattatgccgagtatagtggagctccaaatgaggaagaagtcttgcaatatgccagagttgttcttgattgtgcgacagctgatcctgatggccgaaagagagctcttcttattggaggcggtattgctaacttcacagatgttgctgctacttttaatggaattatcagagctctcaaggagaaggaatctaaattgaaagcggcgaggatgcacctctttgttcgtagaggtggtcccaactatcaaactggtttggctagaatgagggctttgggtgaagcacttggggtccccatcgaggtttatgggcccgaggctacaatgactgggatttgcaagcaagccattgactgcatcatgtcgtagcccgactacttgttttcagttgttttgcattgaagatggcctcatgtgatagctggattcatttgtgttctctctccttctgcattgagaaaaagtattgttgagagttattgttgctgtttgcctctgaatttcttgtgaaaccatcaattttctgcaatgctgaatatatccatcttatctttaaaactgctgctttttgtttttacttgtttgtgattgatgctgtgttcatagaactatttatctgaataccgttgcatttttcatgaattgcattttctcgtagctaaaatgcaattttgtaggtctgagctgagcctagcttgactgcttgagtacacacttgtcgaagtttttgttaaaaacgttacacccaatcctctatcacacaataatgttatactatatgaatttttgacatgcgtattttgattaagaacgtgattatacattattcgacttagaaaatcatatttgaacattcct

SEQ ID NO: 2913 - DNA, 1554 bp, Zea mays
ccccggcacgcccagcgccagtcaccaaccttccactccctccctccgtcgccatggcgcgcaagaagatccgggagtacgactccaagcgcctcctcagggagcacctcaagcgcctcgccggcatcgacctcaccatcctctccgcccagatcacgcaatcaacggacttcgcggagcttgtgagccagcagccatggctgtcaaccatgaagctagtggtgaagcctgatatgctgttcgggaagcgtgggaagagcggcctcgtggctctcaacttggatttcgatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggagggattgagattgaggagaactgggacaaggttaagactattttccttcctactgagaagccaatgacgtctgattcatgtgctcctttgattgcaacccttccattggaggcacgcggaaaaattggtgacttcattaaaggagtgtttgccgtcttcctagacttggatttctcatttcttgagatgaatccgttcaccatggtcaatggggagccatatcctctggacatgagaggagaactagatgacacagcagctttcaagaacttcaagaagtggggaggtatagaatttcctctaccttttggaagagtactcagccctacagaaagtttcatccatgaactagatgagaagacaagtgcctctctgaagttcacggttttgaacccgaaaggtcgcatctggaccatggtcgctggtggtggtgctagtgtcatttatgctgatacagttggagacttgggatatgcatcagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgtccgccgaggtggtccaaattaccaatctggactggctaaaatgcgtaagcttggtgcagaactcggcgttccaattgaggtgtatgggccagaagcgactatgactggaatctgcaaacaagcaattgaatgcatcatggctgcagcgtaatcagagcgtagctctgggtagtttgggatctgcaaacacgcaattgaatgtgtcatggactcagcataaatgagagatggatagtagttgcattatatagttcacacatggtgtttctgttttttgtttcagatatgttgtagcgtgttgtttgaacgaaaccttcacagatcattactgcaaagaaattgctgtgtgttaaaataaattcaaagtctagttttgtgcc

SEQ ID NO: 2914 - DNA, 1768 bp, Mimulus guttatus
aaccaactttattcttgcacattgtacaaatcgctgcgcctacctaactcttcaatcttcatacacacctccattcttccatctcaatcaatccaatccaatccaatccaatccaatccaatccaaccccactcactcactcacacacactactgattgttgcttttattgcaagtaaacgcagaagctcaataaaccagatctctcttccgatcgaaagaaatggcgaggaagaagatcagagagtacgattccaaaaggctgctcaaagaacacctcaaacgattgtccggaattgatctccagatctgctccgcacaggtggatcaatcaactgactttactgagttaacaaacaaagaaccatggttgtcatccacgaagttggttgtaaaacccgacatgttgttcgggaaaagagggaagagtggtttggttgctttgaatttagatcttgcccaagtagccgcgtttgtgaaagaacgcctcggtgttgaggttgagatgggtggttgtaaagcaccgataactacattcattgtcgagccttttgtcccccacgatgaagaatattacctttccattgtgtctgaaaggttaggatgtaccattagcttctctgaatgtggaggcatcgaaatcgaggagaactgggacaaggttaaaactatctttcttcccactgaaaagccgatgaacttggaagcatgtgctcctttgattgctacacttcccttagaggttcgagggaagattggagatttcataatggctgttttttctgtatttcaagatctcgattttagttttcttgagatgaatccatttactctagtgaatggtgagccatacccactggacatgagaggagaattggacgatactgctgctttcaaaaactttaaaaaatggggtgacatagagtttcctcttcctttcggaagagttttgagtgcaacagaaggtttcattcacacgttggacgaaaaaactagtgcatcgttgaaatttaccgttctgaaccaaaaaggacgtatttggacaatggtggctggtggtggtgctagtgtaatatacgcagatacagttggagatttgggctatgcatctgagcttggtaattatgccgagtacagtggagcgcctaatgaagaggaggttttgcagtacgcccgagtagttattgattgtgcaacagctgaccctgatggccgcaagagagctcttcttattggaggaggaattgcaaactttacggatgttgctgctaccttcaatggaattatccgtgctctcaaggagaaggaatcgaagttgaaagcagctagaatgcacctctatgttcgtagaggcggtccaaattatcagactggtttggcaagaatgcgggctttgggagaagaattgggagttccgatcgaggtttacggaccagaggctacaatgactggaatttgtaaggaggcgatcgactgcatcatgtctgaagcctagtgtaacaatgtgttttcgtttttcttattactccattattcttgagttgtagtatttgttgttgaattgccccttcatactcgaactgtaatattggtttcttttttccgatctcctgtttttgtgagacccaaaacaatttttctgcaataagagcaatgtttgagagaaatacgagtgtacgagcaaaaacgatctcatagatgtttactcaggtgactaaaaaggttaacaagctaaggttttcatttctatgtatcttagttcaggtcaa

SEQ ID NO: 2915 - DNA, 1564 bp, Sorghum bicolor
ccaacgtgcacccggacccggcggcacgcccagcgccagtcaccaaccagcccaccttccagtccaacgccaccttctccctccgtcgctcgccatggcgcgcaagaagatccgggagtacgactccaagcgcctcctcagggagcacctcaagcgcctcgccggcatcgacctcaccatcctctccgcccagatcacacagtcaacggactttgcagagcttgtgagccagcagccatggctgtcaaccatgaagctagtggtgaagcctgatatgctgttcgggaagcgtgggaagagcggcctcgtcgctctcaacttggacttcgatcaagtcaaggagtttgtcaaggagcggcttggagttgagattgagatgggcggttgcaaggctccaatcacgaccttcatcgtcgagccgtttgtgccccatgatcaagagtactacctttcaattgtttcagagaggctgggcagcaccatcagcttctcagagtgtggtgggattgagatcgaggagaactgggacaaggttaagacgatttttctgcctactgagaagccaatgacacctgattcatgtgctccgttgattgcaacgcttccattggaggcacgtgggaaaattggtgacttcattaaaggagtgtttgctgtcttccaagacttggatttctcatttcttgagatgaatccattcaccatggtcaacggggagccatatcctctggacatgaggggagaactagatgacacagcagctttcaagaacttcaagaagtggggagatatagagttccctctaccttttggaagagtactcagctctacagaaagtttcatccatgaacttgatgagaagacaagtgcctctctgaagttcacagttttgaacccaaaaggtcgtatctggacaatggttgcgggtggtggtgctagtgtcatatatgctgatacagttggagacttgggatacgcgtcagagcttggaaactatgcagagtatagtggtgctcctaatgaggaggaggttctgaattatgccagagttgtacttgattgtgcaactgctgatcctgatggccgcaagagagcccttctcattggaggtggcatagctaacttcactgatgttgctgccacattcaatggcatcatccgggccttaagagagaaggaatccaagttgaaggcatcaaggatgcacatttatgttcgccgaggtggtccaaattaccaatctggactggccaaaatgcgcaagcttggtgcggaactcggtgttccaatcgaggtgtatggaccagaagagactatgactggaatctgcaaacaagcaattgaatgcatcatggctgcagcgtaagcggagtgtagttctgggtagtttggcatctgcaaacacgcaattgaatgtgtcatggactcggcataaatgagagacggacagtagttgcagtagtgtaccacacatggttctctttttttgtttcagatatgttgtagcgtgttgtttgaacgaaaactttatacatcattactgcaaagaaattattgttgtgct

SEQ ID NO: 2916 - DNA, 1594 bp, Saccharum officinarum
gcaccagctgagactaacgtgcacccggcacgcccagcgccagtcaccaacccgcccaccttccactcccccaccaccagtccatggcgcgcaagaagatccgggagtacgactccaagcgcctcctcagggagcacctcaagcgcctcgccggcatcgacctcaccatcctctccgcccagatcacgcaatcaacggacttcgcagagcttgtgagccagcagccatggctgtcaaccatgaagctagtggtgaagcccgatatgctgttcgggaagcgtgggaagagcggcctcgtggctctcaacttggattttgatcaagtcaaggagtttgtcaaggagcggctaggagttgaggttgagatgggtggctgcaaggctccaatcacgaccttcatcgttgagccgtttgtgccccacgatcaagagtactacctttcaattgtttcagagaggttgggcagcaccatcagcttctcagagtgtggagggattgagatcgaggagaactgggacaaggttaggatgatttttcttcctactgagaagccaatgacttctgattcatgtgctccattgattgcgactcttccactggaggcacgtggaaaaattggtgattttattaaaggagtgtttgctgtcttccaagacttggatttctcgtttcttgagatgaatccgttcaccatggtcaatggggagccatatcccctggacatgagaggagaactagatgacacagcagctttcaagaacttcaagaagtggggaggtatagaattccctctaccttttggaagagtactcagccctacagagagtttcatccatgaactcgatgagaagacaagtgcctctctgaagttcacagttttgaacccaaaaggtcgtatctggacaatggttgctggtggcggtgctagtgtcatatatgctgatacagttggagacttgggatacgcgtcagagcttggaaactatgcagagtatagtggtgctcctaatgaggaggaggtcctgaattatgctagagttgtacttgattgtgcaactgctgatcctgatggccgcaagagagcccttctcattggaggtggcatagctaacttcactgatgttgctgccacattcaatggcatcatccgggccttaagagagaaggaatccaagttgaaggcttcacggatgcacatttatgttcgccgaggtggtccaaattaccaatccggactggccaaaatgcgcaagcttggtgcagaactcggtgttccaattgaggtgtatgggccagaagcgacgatgactggcatctgcaaacaagcaattgaatgcatcatggctgcagcgtaaccagggcgtagttctgggtagtttgggatctgcaaacacgcaattgaatgcgtcatggactcagcataaatgagagatggagagtagtagttgcagtagttcaccacacatggttgtttctctttttgtttcagatatgttgtagcgtgttgtttgaacgaaacctttatagatcattactgcaaataaattactgttgtggtaaaataaatccaaagtctagttacgtgcgtattgga

SEQ ID NO: 2917 - DNA, 1467 bp, Allium cepa
cattacggcctagttacgggggagccaataaagactggagagcgcatttgaatcgatttctactgctcaccgaaccaaccactcaccaaaatctagctaatcttccctctcattattattatttagagtaaatccgcatccaacagccgttcctcttttcaaattccttcttttcattcctaatggcgaggaagaagatcagagagtacgattccaagaggcttttgaaagagcatctcaagaggttggcgggaatcgagcttcagatccaatctgctcaggttacagaatcaaccgatttcactgaattagtaaacaaagaaccatggttatcatccaccaagttggttgtaaagcctgatatgttatttggcaaacgtggaaaaagcggtttggttgctttgaaccttgatttggctcaggtctctgaatttgtcaaggagcgccttggagtagaggttgagatgagtggatgtaaagctccaatcactacattcattgttgaaccttttgtaccacatgatgaagagtattacctcaatattgtttctgagagactgggttgcactatcagcttctcagaatgtggtgggattgatattgaagagaactgggacaaggttaaaacaatatttctgccaagtgagaagcctatgacatctgatgcatgtgcaccattgattgcaactctgcctctcgaggtaaaagaaaaacttggtaacttcatacaagccgtcttttcagtattccaagatgtggacatgagtttccttgagatgaatccattcacattagtgaacggagagccatatccattggatatgagaggagaactggatgacactgctgctttcaagaatttcaaaaagtggggtaacattgagtttccgcttccatttggaagggtattaagcccgacagagagctttattcatggactggatgagaagacaagtgcctctctcaagttcactgtcttaaatccaaaagggagaatatggacaatggtggctggtggcggagccagtgtcatatatgctgacacagtgggagatttggggtatgcaaatgaacttggaaattatgcggagtacagtggggcaccaaatgaagatgaggtcctgcagtatgctagagtagttcttgattgtgcaacttctgatcctgatgggcgtaagagagcccttttaattggaggggggatagctaattttactgacgttgcagccacctttagtggaattattcgagctcttagggaaaaggaatcaaagatcaaagcctcaaggatgcacatttatgttcgacgaggtggaccgaattatcaaactggtttggcaaaaatgcgcgctttgggtgatgaactaggcgttcctctagaggtttacggccctgaggcaaccatgactggaatttgcaaggaagccatcaactgcattatggcagaagcatgatttgtcttgcatt

SEQ ID NO: 2918 - DNA, 1690 bp, Panax ginseng
agctaccagcaaccagctcagtgctcatcagtcatcacaaagtttcttgctaaagtcgcccaactaccactcctcgtcatcctattttcccctaaatttctctctctgtcagttggggtttggtttttgcctttttgggtgagctcaatcgtcccttcaaagcaatcatcctcttcttcccaatccaccctcctcctgtatttgtataaactagtattacatccaactttaatcgatcaattttggtgaattagataaagaaatggctcgaaagaagatcagagagtacgattcgaagaggctcctcaaggaacacttgaagagactcgctgccattgatcttcagatctactctgctcaggtgactgaatccacagactttaccgagttaacaaacaaagaaccatggctctcatctgcaaagttagttgtaaaacctgatatgttgttcgggaagcgtggaaagagtggcttggtagcgttgaatttagatttagctcaagttgctcaatttgtgaaagggcgccttggtgtggaggttgagatgggaggttgcaaggcaccaataaccacattcatcattgagccgttcattccgcatgaccaagaatattacctttccatagtctctgaacggctaggctgtaccattagcttttcagaatgtgggggcattgaaattgaagagaactgggacaaggtcaagacagtatttctcccaactgaaaagcctatgacgctggaggcttgtgctccattgattgctacacttcctttggaggttcgaccgaagattggtgatttcattatgggagttttttctgtatttaaagatctagatttcagtttccttgagatgaatccctttactttggtgaatggggagccataccctttagatatgcggggagagttggatgacacagctgcctttaagaactttaagaagtggggcaagatagaatttcctctgccttttggaagagttatgagcccaacagaaagcttcatccactcgttagatgacaaaactagtgcatctttaaaattcaccgtcttaaacccaaaaggtcgcatctggacaatggtggctggaggtggtgcaagcgtgatatatgcagacaccgttggagatttaggttatgcatctgagcttggaaattatgcagagtatagtggagctcctaatgaggaagaggtgttgcaatatgccagagttgtgattgattgtgccactgcggatcccgacggtcgtaagagagctctcctcattggaggaggtattgccaatttcactgatgttgctgccactttcaatgggattattcgagccctcagggaaaaggaatcaaagcttaaagcttcaaggatgcatatctatgttcgacgaggtggtcccaattatcagactggtttggcaaagatgcgtacccttggagaggaattgggagttccccttgaggtctatggacccgaagctacgatgactggcatttgcaagcaagcaattgaatgcgtcatggctgccgcatagtctttataccattcataatcttttcctccaagaaaatgagaaatggtctgtgtttgtttttggaaaacatgttttttctttttatttttatattgaaagtgacaatgtgatgatgttgtagaacctagcgtgggcttttctatgctagtttgaatg

SEQ ID NO: 2919 - DNA, 1490 bp, Platanus occidentalis
tgagcttccgatcttctgagattatcgcattaggaattagagtgatcgcgtgaagaaatggcgaggaagaagatcagagagtatgattcgaagaggcttctcaaggagcacttgaagagacttgcggggatccagctcgagatctgttctgttcaggtaacggagtcgacagacttcaccgagttaaaaaatagagaaccatggctttcaaccacgaaattggttgtgaagcccgatatgttatttggaaagcgtggaaagagtggtctggtagctctgaatttagatctggcccaagtagccaaatttgtgaaagaacgccttggtgtggaggttgagatgggcggatgcaaggcaccaataaccacattcattgttgaaccgtttgttccccaccaccaagaatattatctctctattgtctctgaaaggcttggcagcaccattagcttctcagagtgtggaggtattgaaattgaagagaactgggacaaggttaagactatatttcttccatctgagaagccaatgacatcagaggcgtgtgctccactaatagctacacttcccttggaggtgcgagggaaaattggggacttcataaagggtgtattttctgtatttcaggatctggacttcagtttcctagagatgaatccctttacattggtgaatggagagccatacccattggatatgaggggagaattggatgacactgcagccttcaagaactttaagaagtggggcagcatagagttcccactgccttttggtagagttttgagtcctacagaaagctttattcattcattggatgaaaagacaagtgcatccttgaagttcactgttttgaaccctaaaggacgcatttggaccatggtagctggaggtggtgcaagtgttatatatgctgacactgttggagatttgggttacgcatcagagctcgggaactatgcggagtatagtggagctccaaatgaggaagaggtgttgcagtatgccagagttgttattgattgtgccacagtggatcctgatggtcgtaagagagcccttcttattggaggtggtatagctaacttcacagatgttgctgctactttcaatgggattattcgggccctaagggagaaggaatccaagctgaaggcatcaagaatgcacatctatgttcgaagaggtggtccgaactatcagactggtttagcaaaaatgcgtaccataggagaggaactgggggttccccttgaggtttatggtcctgaggccacaatgacgggaatttgcaagcaagcaattgagtgcatcatgtctgcagcataaaatctcttccacatcattttcttctctttccaggattctagagattcttcagtgttgtgtcgaggatgtaatttagtttaaggcttattctcttaaagggacaagctagactgaattgctgttgaatatgaaacatttatttcttaattctgataccattt

SEQ ID NO: 2920 - DNA, 1787 bp, Solanum lycopersicum
aaatagttggattatgaaaatcaggcagcatcattattcttcccaatacagtatcttcccttgttaaaaacgcccaactacctactcccctgtccccacccccacctcagctcattcatctcactcaccagttgttgcctgtttggtgaaaacccacaattcttctaccttaagataattccataaatttcatagttctagatcttcgttttttgtaatcaattgcatacccaccaactgtttgtataattgtttaagagagagagagttgtcgttcgtttggattgtaagaaaaacagagtaatatggcgaggaagaagatcagagagtatgattcaaagaggcttctaagggagcatttgaaacgccttgctggcatcgatcttcagatctgctctgctcaagtgacagaatctacagattttactgagttaacaaacaaagaaccatggctttcatcgacaaagctggttgtaaaaccagacatgctgtttggaaagcgtggaaagagtggcttggtagctttgaatctggatctagcaggagttgctgagtttgtaaaaacacgacttggtgtggaggttgaaatgggtggctgcaaggcacctataacaacatttattgttgaaccatttgttccccatgaccaagaatattacctttccatagtctctgaaaggttggggtgcacaattagcttttcagaatgtggaggcattgagattgaagagaactgggacaaggtcaagacaatattccttccaacggagaaacctatgaccctagaggcgtgtgctccactgattgctactctgcccttggaggtacggggaaagattggcaatttccttatgggtgtttttgatgtgtttcaagatctcgattttagtttcatagagatgaacccatttacgctcgtaaatggtgagccttacccattggacatgaggggagagttggatgacacagcagccttcaaaaattttaagaagtggggaagcatcgagtttcctctgccttttggaagagttttgagccctaccgaaagcttcattcactctttggatgagaaaactagtgcctctttaaaatttacagttttgaacccaaaaggtcgtatctggacaatggtggctggaggtggtgcaagcgttatatatgctgatacagtaggggatttaggctatgcctctgagcttggtaactatgccgagtatagtggagctccaaatgaagaggaggttctgcaatatgctcgagtagttctagattgtgctactgcaaatcctgatgggcgtaagagagctctgattgttggaggtggtattgccaacttcactgatgtagctgctactttcaatgggattattcgggctctcagggagaaggaagccaagctaaaagcggctagaatgcatatctatgtacgaagaggtggtccaaattatcagactggtctagcaaaaatgcgcgccctaggagaggaacttggagttccccttgaggtttatggaccagaggctacaatgacgggaatttgtaaaggggcaattgattgcattatgtctgaagcataagtgccaaatgagaaagaagacttgtgttacattcttgcaattaagaagaaactttgttggatatttaatttgccttctgatattgttttgttacaattgggaccttcaagaataatttgagatccttttgttttacctggaaactaactgtacgagaacagatgcgtgtgttccatccagcaaaacacattcctgaaattagcaaaaaaa

SEQ ID NO: 2921 - DNA, 1604 bp, Triphysaria pusilla
atcgtctaaatcgccaaaccacctaactactcttcaccctccattctttcatctcaatccaaatcattcttttacactcactatctactctgagcaggtgtggaattttactttcttcggattaaaaaaatggcgagaaagaagatcagagagtacgattccaaaaggctcctcaaagagcatctcaaaagattgactggtatcgatcttcagatctgctctgcccaggtaactgaatctacagactttagtgatttaacaaacaaagaagcttggttgtcatctacaaagctggttgtaaaacccgacatgttgttcgggaaacgagggaagagtggtttagtagctttgaacttagatctggcccaagttgctggatttgtcaaagaacgtcttggcgttgaggttgagatgggaggttgcaaagcaccgataacgacattcattgttgagccttttgttcctcatgatcaagaatattacctgtccatagtgtctgagaggttaggttgtaccattagcttctcggaatgtggaggtatcgaaattgaagagaactgggacaaggttaaaactatcttccttccaactgaaaagccaatgaatttggacgcatgtgctcctttgattgctacacttcctttagaggttaggagtaagatcggcgatttcataatgggtgttttttctgtatttcaagatttggattttagtttcattgagatgaatccgtttactttggtgaatggcgagccatatccgctagacatgagaggagagttggatgacactgctgctttcaagaacttcaagaaatggggcagtattgagtttcctcagccttttggaagagtcatgagcccaactgaaagtttcatacactcgttggatgaaaaaactagtgcgtcgttgaaatttaccgttttgaacccaaaaggacgcatttggacaatggtggccggaggtggtgctagcgtaatatacgcagatacagttggagatttggggtatgcatccgagcttggaaactatgctgagtacagtggagctccaaacgaggaggaggttttgcaatatgccagaatagttattgattgtgccacatctgatcctgatggccggaagagagctcttcttattggaggaggtattgctaactttacagacgttgctgccactttcaatgggattatccgggctctcagagagaaggaatcaaagttgaaagcggctaggatgaacctttatgtacgtagaggtgggcccaactatcagactggtttggcaagaatgcgcactttgggagaagaattgggacttcccatcgaggtttatggacctgaggccacaatgactggcatatgcaagcaggcaattgactgcattatatctgcagcataaatctggatatgtgttttcatttgccatttagacggtttattgattatttcgtaatcggattattgctcggattgttgtttgtgatgccttttttgcttttttcgttttcggattgcagtcgagcattgaatttgtaggttttgtggtgaataaccgatgcctgtcgttcagtagcatgagatagcattcaatgcatgcttaac

SEQ ID NO: 2922 - DNA, 1787 bp, Citrullus lanatus
gttactgtgaacatttctctttaaacttatctttcttaattgagtcacctacccacctaaccagtgttgaaactctccgtctacagccttcttcatagctctctctccatcttcctatttaatcttcccatctactttcccctctcttccacatttgttgaatttcttttgtcaatcggaagaagaagaggaagtgggtaatggccaggaagaagatcagagagtatgactctaagaggcttctcaaggagcatctcaaacgcctcgctaatatcgacctccagatctgctctgctcaggtaaatcaatcaactgacttcgctgagctgacaaataatgaaccgtggctgtcatccactaagttagtagtgaaaccagacatgttatttgggaaacgtggaaagagcggcttggtagctttgaatttggatctagctcaagttgctgagtttgtgaagacacgccttggagtgcaggttgagatgggtggttgcaaggctccaattacgacattcattgtggagccatttgttccccatgatcaagagtactacctctctattgtttctgaaaggcttggctgcacgataagtttttcagagtgtgggggtatcgaaattgaagagaactgggataaagtcaagacaattttccttccaactgaaaaaccttttacacttgaggcatgtgctccgttaatagctacacttcctctggagattcgaggaaagattggtgacttcataatgggtgtattcagtgtatttcaagatctggacttcagtttcctggagatgaatccatttaccctggtgaatggggagccgtatccactggatatgaggggggaattggatgacactgctgccttcaaaaattttaagaaatggggaaacattgaatttcctttgccctttggtcgagtgctaaaccctacagaaagctttgttcactctttagatgaaaagacaagtgcatccttgaaattcactgttttgaacccaaaagggcgcatttggacgatggtggcaggagggggtgctagcgttatatatgccgatactgttggggatttgggttatgcatctgagcttggtaattatgcagaatacagtggggctccaaatgaggaggaggtgttgcaatatgcccgagttgttattgattgtgctacttccgaccctgatgggcggaagcgagcccttctaattggagggggaatagctaatttcacagatgttgctgccactttcaatggaattattcgagctctaagagagaaagaatcgaaattgaaggctgcaagaatgcatatctatgttcggagaggtggtccaaattatcagaccggtcttgcaaaaatgcgggctctaggagaagagcttggagttccactcgaggtttttggcccagaggccacaatgactggtatctgcaaacaagcaatcgagtgcataatgtctgctgcatagtcccccattttatttgcagctgataacttagttgaaagatgcaataaatatcctttatagcttggtatctgctgcggtggggaagggaaagggagagggaaaggtaaagggagtttgtggtatctgtttctgtagcattgctcatttttgtagtctttggaatttggaaaacaatcccttcatactgctttgccatatgaagatgatggcagagttggattctatgtgcactccttttgactcagtttagcatgttgtgtgcgccatttgcaatagccttcaatgtattgttcttatatcaaaagtaacattctc

SEQ ID NO: 2923 - DNA, 1724 bp, Amorphophallus konjac
cccttcatccctatatacacaccaagcaggagccaccattgcagcgctccaccctctccagtgctctctgctcgtcgtctcccccagcgagatctcccccgcagcggatccgccgatctggtgaggagctggcatggcgaggaagaagatccgggagtacgactcgaagcgcctcctcaaggagcacctcaagaggctcgccggcatcgacatccagatatgctccgcccaggtcacggaatcgacggatttcacggagctgacgaacaacgagccgtggctctcctccacgagactggtcgtcaagcccgacatgctgttcgggaagagggggaagagtggtttggtggccctgaacctggatctggctcaggtctcgcagtttgtgaaggaacgcctcggcgtggaggttgagatgggtggatgtaaggccccgatcaccacgttcatcgttgagccgtttgtcccacacaaccaggagttttatctttccattgtctccgagaggctaggtagcaccataagcttttcagaatgcggtgggatcgaaattgaggagaactgggataaggttaagacagtattctccaactgacaagccgatgacttcagaggcctgtgctccgttgatcgcaacacttcctctggagataagagataaaattggagactttattcaaggtgtctttgctgtattccaagacctggacttctctttcatcgagatgaatccatttacattggtcaatggggaaccatatccattggacatgcgtggggaattggatgatacagctgctttcaagaacttcaaaaagtgggggaacattgaatttccacttccttttggcagagtgctgagccctacagaaagttttattcatggactagatgagaagacaagtgcttccttgaagttcactgttctaaactccaaagggcgtatctggactatggttgctggtggtggtgctagtgtgatctacgctgatacggtaggagatctgggttatgcttctgagctcggcaattatgcggagtacagtggtgctcctaatgaaaatgaggtcttacagtatgccagggttgtaattgattgtgctactgcagatcctgatggtcgcaagagagcacttctaattggtggcggcatagcaaatttcaccgatgtcgctgctacttttaacggcattattagggctctaagagagaaggaatcaaagctaaaggctgcgaggatgcatatctatgttcgaagaggtggtccaaactaccagaccggtttggcaaaaatgagagctctaggagaggagctaggtgttcctcttgaggtttatggacccgaggccaccatgactggaatttgcaagcaagcaattgactgcatcatggctgcggcatagaagctatcctttttgttcttgtttttttttctctctctctttttttggggaaaactacccatataccccttaaatctttcaatattatcgctatatccctacttttatcgtatttaccataatattcatgaaatccttaagaaaatagccattgtgccgttccacatggacatagggataatcttctgtttcaaggagttttaaggataagggcacaatggctccttttttaaggatttcagaggtatgacggtaaataagataaaggtagcggtataggggtaatttcacaagacttcaagggtataggggtaactttct

SEQ ID NO: 2924 - DNA, 1588 bp, Triphysaria pusilla
ctactcttcatcctccattctttcatctcaatccaaatcattcttttacactcactatatactctgagcaggtgtgaaattttactttcttcggattaaaaaaatggcgagaaagaagatcagagagtacgattccaaaaggctcctcaaagagcatctcaaaagattgactggtatcgatcttcagatctgctctgctcaggtaactgaatctacagactttagtgatttaacaaacaaagaagcttggttgtcatctacaaagctggttgtgaaacccgacatgttgttcgggaaacgagggaagagtggcttggtagctttaaacttagatcttgcccaggttgctggatttgtcaaagaagtcttggcgttgaggttgagatgggaggttgcaaagcaccgataacgacgttcattgttgagccttttgttcctcatgatcaagaatattacctgtccatagtgtctgagaggttaggttgtaccattagcttctcggaatgtggaggtatcgaaattgaagagaactgggacaaggttaaaactgtcttccttccaactgaaaagccaatgaatttggacgcatgtgctcctttgattgctacacttcctttagaggttaggagtaagatcggcgatttcataatgggtgttttttctgtatttcaagatttggattttagtttcattgagatgaatccgtttactttggtgaatggcgagccatatccgctagacatgagaggagaattggatgacactgctgctttcaagaacttcaagaaatggggcggtattgagtttcctcagccttttggaagagtcatgagcccaactgaaagtttcatacactcgttggatgaaaaaactagtgcgtcgttgaaatttaccgttttgaacccaaaaggacgcatttggacaatggtggccggaggtggtgctagcgtaatatacgcagatacagttggagatttggggtatgcatccgagcttggaaactatgctgagtacagtggagctccaaacgaagaggaggttttgcaatacgcccgaatagttattgattgtgccacatctgatcctgatggccgtaagagagctcttcttattggaggaggtattgctaactttacagatgttgctgccactttcaatgggattatccgggctctcagggagaaggaatcgaagttgaaagcggcaaggatgaacctttatgttcgtagaggtgggcccaactatcagactggtttggcaagaatgcgcactttgggagaagaattgggacttcccatcgaggtttatggacctgaagctacaatgactggcatttgcaagcaggcaatcgactgcatcatatctgcggcgtaaatctggatacgtgttttcctttgccatttaggcgcggtttattgattatttttgtaatcggattattgctcggattgttgtttgtgatgccttttttgcttttttcgttttcggattgcagtcgagcattgaatttgttaggttttgtggtgaataaccgatgcctgtcgttcagtagcatgagataacattcaatgcatgcttaacaacatca

SEQ ID NO: 2925 - DNA, 1646 bp, Musa acuminata
cgtgtccgttggagccacgggcggaagaaccgaagaagggaggcgatggccaggaagaagatccgggagtacgattccaagcgtctcctcaaggagcacctcaagcgtctcgccggcatcgatctccagatccgatccgtccaggtgacggaatcgacggacttcaatgagttggtgaacaaggaaccatggctttcgtccatgaagttggtcgtgaagcccgacatgctgttcggcaagcgtggaaagagcggtttggtggctctcaacctagatctggctcaggcggctcagtttgtcaaggaacgtctgggagtggaggttgagatgggagggtgcaaggctccgatcaccacgttcataatcgagccatttgttccccacgatcaagaatactacctctctattgtgtccgagaggctgggttgcaccgtcagcttctcagagtgtggaggcattgaaatagaggagaactgggacaaggtcaagacggtatatcttcctacagagaagcctatgacaggcgaggcatgtgctcctttgatcgcaacgcttccattggaggtacgagggaagataggggactttattaagggagtttttactgtgttccaagatttggatttcagttttatagagatgaacccatttactttggtaaatggtgaaccatacccactggatatgcgaggagaattggatgatacagctgctttcaagaacttcaaaaagtggggaggcattgacttcccacttccttttggaagagtcctgagccctacagaaaaatttgttcatgaactcgatgagaagaccagtgcctccttgaagttcactgttctaaatccaaaaggacgcatatggacaatggtagctggtggtggtgctagtgtcatttatgctgatacggtcggagatctgggctatgcatctgaacttggaaactatgcggagtacagtggtgctccaaatgaggaagaggttcttcaatatgccagagtcgttcttgattgtgcaaccgccgatccagatggccgtaagagagctcttctcattggaggaggtatagcaaactttactgacgttgctgctacattcaatggcatcatcagggcactgaaagagaaggaatcaaagctgaaggcagcaaggatgcacatctatgttagaagagggggaccaaattatcagactggtctggcaaaaatgaggaaagtgggcgaggagctcggagttcctctggaggtatatggaccggaggccacgatgacaggaatttgcaaagaagctattgactgtgtcatgtctgctgcataactaccattgcatcgatcatttcttttactacccttcattttgtcttgctaatcaaaaccatgcttcaggaacaatgtgtagcttcagtgagaaatttgacatgtgaacattagaatacatgattgttgagcttgaaagttaatttgatcatggaaataaattaaggttcctttttgaagtgtctgatgtgaaagcttgtgtgattcatgaaggtgcctatctgcataggaaaaaagataaggtgcgtggtacctgctgctgctgcttctaacagtcgtcgccaaacgctcctatcgagaagaaccgagtcttaccgatcagtattctag
